United States Patent 11,667,974 (DIAGNOSTIC, PROGNOSTIC AND THERAPEUTIC USES OF LONG NONCODING RNAS FOR PATHOLOGIES AND TOXICITIES INDUCING HEART DISORDERS) - sequence listing, part 3

SEQ ID NO: 2607 - DNA, 11111 bp, Homo sapiens
gtgaggtcttactgagcactgcgtgccagtggaaagaagcattttgaaaggtaaactggtgggggcgatggggttcagatattctctgagaccgggaacgtcactgctctccccgggaagctgctttaggcacagtgctcctgcctgactcgggaagactgctctcctggcctcctggaagtcatatgggaaacagataggcagcaaggaacaacagagatttagggttcactgtgagccagttccccaacacccaggacagcttcccagggaagacggagtctcgtctgcctgtgctccacttgtacagcagatacccagtttttcagctccattaactgaaagactcttttcctgaatgttgtccttgcatcattgcacaaaatcagcttaccataaagaggatttactgaaatcctgaaacttaggagtcagcaagtttttcatttgtgtttgtcaaatgtcaagaaaagctgaggagttacaagaaactcagtgatccctgacagctctctgcaattgcagcaaaatctgagcaagactgacagaaaccactcggggacaaacatctgacttccacagcagttaaaatcattgaatacagaaccaaaatgtcttcatgtgaaaaactccatcaagacccaagaaaacttctgactcattagtagtttagggtacatcatgtggatgcttttgaaaccccattctttgaagtcttccccacttaacatatatctaaaaaccatacatacattcattagatataatcttagttaccagttttaaaggaaataaaagcatatagaacacaatagttacatctccaaaataaagaagcttgtaagatgtgtaaaagttaagaattcattttcactaacaattattctcaaacttaaatgaggatactgaggacatgaaaattacagagctagtatcatgatgctataaaatactgatatatttaatatcccaacagggactgattagacttatatatttaaaacatatttaagttgcttagaaattttaagtcaataaaattcacatacaataatatacattataaaatatgaatttaaagctttggaatttactgatcagacatttccaatagctctttgaaatgttcccatacatatattttgttgtttgcttgatggcaaagtttaaaaatgttgagtaaaaatattagaacttgtgaaaccctgtttgtatacacccaaacacacttacatatctatctatatctatctatagaaatatatgtatgcatttgtatacacacacacacacacacacacacacacacatatggcaaaatacattgctagaacaaaggaagtggagtcacatagattcttagtatccattcagattcaaaaattctaacaaactaaatatgggattaaggaatggtaaaattttaaatctcatattagcactacgtactgttttaacaagcaatcaactaaacaaaggcattttcttctctttaagagcaattcagtgggcaggtcacgatctctctgtctgtgtgtgtgtgtgtgtgtgtgtgtgtgtgtgtgtgtgtatgtatttgtgtgtatgtgtttctctgtctgtcttagttcatttgagctgctataacacaatgccatagactgggtgggttattaacaatagaaatctatttctcagttctggaggctgggaagtccatgatcaaggcctcagattatgtgtctggtgaggtcttgtttcctgatcctaggtgatgattacttgctgggctttcacatggtggatgtacaaaaaggctcccttgggcctctcttagaaaggcattaatctcattcatcaggctctagcttctggacctaatcaccttggagaggccccatgtcctaacaccatcaccttggattaggattgcaacgtatgaatttcagtgggacacaaacatttaagaccataccagcctccttcttcccttttctacccccaacaccatgcccatccttccaaatttgttagtagttttcactcacagtttattttatttttttcttcatccattttccttagactgaatacatctttatgggtctctcctttatgctaataaatgttggaaatattgaatggaggtattgtacatctcatccgtcttttctgatgagagagaaggaatcaccaagcagagcagacatgttggggcttaataactttcatagtccttatggtgtaaagcctccgtttgaaaatcgacattctattaggctgaatcatgcttgccatttgtcacagttcagtgcactaaacttaggactgaaaatatgcattttggatacttggggtaagagaaagtttttctcacagaaatctgtttatttggagctgaatgcaaggaactgataattttcttctcagaggttctcattacatagtgtcataagagactgtcagaaaaatgccgataagaaaacatactatctgacttctcaggaaatacattaaaataaattcccagcaacaaaaacttgcattaatccatttgataaggagtggtagaattatcgttcatttctactaagtggccttttccttgtgtttgatctgaaatataggaccttaaatgctattgggggagaaaggtaagtttgtgattttctacttttacttttaaaccaatttattttatttaatgatcccttgatatattcaactatagcaattttaataacttacctaaaattctgattaagtggagtaaattcataactttaaaactgcctcattttgattataaccaggaaatatttttttcatttttattcttctttatgttgtaaaggatgtatcaaaaatgataattcataaatatttttaaagtttttaaacaatttttgagttattatatctgtagaaaagcagtacaaattcctgacatgcatatgccacatagacatgcttagaaattactattacctccatttcacacatgttgtttttaagcatacttaaagtaagtagaaacttactggattttaatagatgactgatattagatattgtctgtgatttcccatacactttgctagattattatatgtcatatttaatcactaaagcagcctccacgagggttgtttcatatcattataaagtgagtaattggaaagctaaaaaggccacagagttagcaaatggtagacatggcattttaaactacatgtgtctgacttcaagatacaggattagatttttcagattttatgtcctatatgcagaatctattcatttctttttctttccttttcttttttttttttttttagacatggggtcttgcttattgctcagcctggagtgcagtggcacaatcatcactcactgcaggatcaacccctgggctcaagcgatcctcccacctcagtctctcaagtagcttggaccacatgcgcataccatcatgctcagttaatattttataatttttgtagagatggggcctcacatgttgcccaggctggttttgaactcctgggctcaagtgacccttctcccttggcctcccaaagtgctgggattacagacatgagccaccatgccttgctcttcatttcttaaacagaatattttgattgagtgaagccttatgtacactaataaagtatacttttaagcttctacactgtacttgttagttaggctttgctaacttaaatatgaactatttcatatgaatctgaaacataaaaactgaaaaatgccacactttggcaaactgtgaagccttcatgagaataactatgccctgttgcatagagaccagcttagtcaattctatcagacccctctctttataattttaaaatatttcattgaaagataagaattatatatatttaagaagtatgatgtgataagtggatatacatatatattatataatgattagcacaatcaaattgattgacacatccgtcatcccctatgctgtactgcatgagcttatttgagggttattggcagaggaagaagctgattaatcattttttaatcttttattaaacatggtcacaataccttggtaaaactttcagtaaaatagaagaaaggaatttatcaccctgcctaacttcttgagcacattcattttaagacttttgattgacttttaaactattagttggaccaccataccaaaagggagtgaactaatcaaatgaacaatgctggcttccatttattgattatcttatttatgattttttttctgtgaggcccttcccttcacccttgagaccttgagtcccagagataaatatgacataatccctgctaagaagagtgtagcgacagaaagacttgttcatgtcacttgccttcacaggataagttttctgtaaaatgtcacttcccttatcgaatacagggcactatgcttgttcattgaaaaaggaactaagttttaattgtggtaggtttctgagaagagaagatgtctgtatcaagaacaagtacaagaaaactggacaaaatatgcatgtgtgtaggatctgcagcggatggggacatgaaccaagggcatgaatttaagacaataagcagcatttgaaaaataagaaagggttgtaggatttttcttctcagtcactttgcaagccagggaccctcgatcgatgacgccccgcccgggccttgctctgccacgctgcatgccccagctcgcctgtgtgatagcttgtacccacgttcagtggttcctgagcttttgcaccctgcccaagaagaatgaggatatgctggacattgaaggggtggccttgtttgatgttgctgttttatgaaattacactatccatgtacaacataaggaaaatgtgacccagctgagagcgccaggccagattctggcaacaccgatgtctggatgtcagtgccaaaccagctccctgatttcacaggtaaattgatcaggaatagttctgaaaagtgtactgcagttgaagaaagcactatctagagagacgaagacaatcattcaggtctgaacatttctattgtatgtcattctcactttctcgctttcattttcctcttctgcccataacatcaacttttagccattcatcttctttctttcttgagtaaaaaattatgagaatttatcccttattaacagtgactgtctttcttttttaatttttagtctgtatgagtacatagtacgtgtatatatttatgcggtgaatgagatattgtgatacaggtatacaatgtgtaagaatcacctctgtgtaaatgggttatccatcacctcaaacatttataatttctttgtgttacacacattccaattatattcttttagttatttttaaatgcacaataatatttgactgtagtcaccctgttgtgctatcaaatactaaatcttattcattctatctaactataattttgtacacatttgccatctgcatttcccccacacacaccgctatctttcccagtctctggtaaaccatcattttactctctatattcatgagttcagttgttttaatttttagttcacagaaatgagtgagaacatatgaagtttgtctttctgtgcctggcatatttcatttaacacaatgccctccagttcaatccatggtgttgcaagtcacaggatctcattctttttttatggctgaatagtacttcattgggtaccacattttctttatttgttcatctgttgaaggacacctaagttgcttctaaattttggctatggtgaatagtgctgcaataaacatgggagtgcagatacctccttgatatactaattttcttacttttggttttatacctaacagtgggattacaggatcctacggtagtttgattttccattttcagaggagcctctatactgttctccctagtggctgtactaatttacattcttatcaaaagtgtacgagggtcctcttttcttcacatcctcaccagcatttattattgcctgtcctttggataaaagctattttaactggagtaagacaatatgtcattatagttttgatttgcatttctctgatgatcagtgatgttgagcacgttttcctacatctgtttgccatttctttgtcttttgagaaatgtctctttaggtattttgcccattttttaaattggattattagattttattctatagagttgtttgagctccttatataatctgggcataaagaccttatcagatggagagtctgcaaatattttctctcattctttgattgtctttttacttcgttgtttcctttgctgtgtagctttttaacttgatgtgattccatttgccaatttttgttttggttgcctgtgcttgtgggatattacttaataaatcattacccagactaatgtcttagagaatttcccttatgttttcttttagtagtttcataacttgaggtcttagatttaagtcactagtctatttttatttgatttttgtacatagcaaggatagggatctagttttcttcttccacatatggatagcttttcgtccccaatgtatgctcttgtcaacttcattgaaaatgagttccttgtagaagtatggatttgtttctgggttctctattctgttccattgctctatgtgtctagtgcctggaatgtggcttcaggactctacttggtggtttattttcctatggctgaactggtgtccaaattgcaagacaaagttctctttactatcttctctcctttactcaagaaaaaaaagtctctgctgaagctgcaagctatgttgcctgaagttggggaaaggttgatgcaggcactcccttagccaccgcagctggaattttactggatcatgtgcaccccaagctcactggcctgagcccagcacagcaacaggtcttgcccagcaatttcagtctttgtggcctatgctgcctttcaagtttatttgggactgcagggcactttagcctgcagtggtgggactagccagaatttactttctgactgctgggatagctgagtcccctctggctagagcttgtctaaatgctccctccatgggcgccatttgaattctgccccatatttgtttttcactgtgccggcaacattaggttccaatgcaacgcctcacaatcactgcactgtcaccccccaaagcacacagattctctctttcagccatgaggccactgcagagggaagggagagtggtgatggaggcaattcaggactgtcttttctaccctcttcagtgcctcttcgcttatatgatgtgaaaaccaggtagttatcgtttacctgatttttcgttcttatgaaggtgatttcttgtgtgaatagttgtttaatcggtgtttctgttgggggtgagtggtgggaggggctgatcactgaaggtttctatttagccatcttgctctaactcctccttgactgtttttcttgaaagtgatgctttttttgaaaatcgcatgtggtcattccataacactaaaacagcccaagtgcattatgggtttttttcttagtcttgatcaagcatattttgctacattagcatgagattggtggctgcccttatttataggtgttccctgttttctctgtatttctccatcatggcattctaatctctgaatggaagatttccatctagctggactggacatgagcttttggatgtgtctgtgcaatgcattggctttcattcatgagactaggtactattgtctattgtgtttgggtgtgaatgtgtatgtaggaggtagaatgggaaagtagttgctccaaaaacctggaagtagtataacattatttcattgaccatttgttaatatgtagtaatttccagttgctgtagtgctactgtggttgagatagaaatatatgaggcataatccttagttcaggacactacggttatatatctgcaatttgaaaaaccaagtttaccaggctttatttttgcagaagacttttaatttttcgtgactcaatcaagctttagacattatatttaaaattaatagattttaaatgaaagggcaaaaattaggcagtggaaaatgaaactctcctgagcacttccatgtttttctaaaataagaacagatttttagataaactgtcctttcctgaggccaattcaggattttttttttttttttggcacccaacattacttagtattgcacatcaatggcagtttctctgaaacttttctcaatttcttactgaaatactgctacactttggtgattttaaaactccaatatgtacttcatgtcaaattatatcaatgcaatgaagttagacacattcatcaaaagttttaagaatatcaacacagtaaagataagtcatgaatttaaatttgtgattaaatattatcagaggagccaaatggtatttccagttaataatcctcaggcagaattttcaatagacaagttgtctctactaagaggctgcatgatgaatgaaatgaacagaatatagaacttgagtctgtttgagttcaaggtcttacaattaccaagtatatgaattggcaaaggaatcattaaactctcaaagttacctctagtgttactttaaagttcatgataaaaatgaataaatatttgtgaattactttcagaagtgctaaatattttattgctattttaattgcctcagtataattttcatcgattttaaaatgatgagtcctacgtataaaggtgggcttaaataggagggaggtctgactggtttagttggaataaaattatcattgcttataaaattaacatgtaatataaattgtcattgaatgaaatggtgaataacagtgaatgtgttcttaaagcagtaaaagaagtgattaatttaattgttctctactattcccaaaaagaagtatatcagaaatgattgcaggaagcattaatttttaccttaattagatatattgaggatgcaaaaatttctgagagaagatcttatgttttctcaccacaaaaatgaaaattatgcaaggtaatgcatatattgattagcttgatatagtcagtccacaacggatatgcgtttcaaaacattatggtgtagattatatatataattatattttatccgtacaattatatataattttatatgtcaattaaaaaataaactcaatggtaagaaaacattttttattttacattttcactttctaaattctaaagaaaatttctttggctagtcttacaaaacaacagaagagttaagatttaaaaaccttaaaaattaatgagactcattttattccttaagggtatcgtgtgttttgtgttactgatgacaaggatagggtgcagaaaattcaccttgtatataatttcatttgaaaagcatttctgttgggggctggccataaagagaccagttgtcaccaaaagattatttagttggagaatacaatgatatacaatagatgaatatcgatctttaggtaaagaggataatccaaagccacaaaaaaggaaattaaaagaaattagaaggataaagggcaggttagtggaacagaatttgagcattaaaaacagtggtctattttataactgtgtactacaccatcacttatatgtgaatgaccctataagttagtctagttctctctggagtgttccatatctgtatggaattacttgctaggcatctacaacatgaagccaagggaacttcattcattttcagaactgacatcattatctcactcccataacctactctgcatcctgcattaactagctttgtaaatttcaccagttatttattcaataaatagttattgatcactaaattatgctaggcactctggtaaacttacaaatagtaggttattaagataagtgaatttgcaagttcacttaagagcttaacaggttacatacaccatgctgtacttgggaagtgagaagacagaaagtcattttatttgctttattttcatcatctgcagaattcaattaggctacaggttctttaatatttgttaattaaattaaaaaacacttataatttgataggtacctatctccttctttgtttaccattatttccttcaggtcaccattgactctcacctaggtgactacaacaatctccacactgatcaccctgtttttattattaaaacctccaaatagctctgccttcttattgttaaaataatctttctgtcataaaaatactgttatgccacaacactgcctaaaatcattaaatagctctccattaacaagattaggtcttaaattcttttgttggacaaaaatgatcttgcctatcaaattagtactaatgctcaatctatactttacagaaatatcaagttacttgttcaaaaacacagttgtatttatttctcccatatcttgaattttccatatgtttttgcctcttctcagaattctatcttcaggtcttcatatctgggcaaaatgtcttcaactttcaagtctcagattgaaagtctttggattttgaagccttcctatattctgccagaaaaattattatactgtttcctctactttctctatctcatttactggctcttacgcatttttttttaaaaagattgtttattcttctgtctactaagtagcctgtatcatgattcactcatttattttcttcactttctatacttttccatttgtctgaaatgtatttggagtgatcaactttctcatgtcttgagataaaaaattatacaggcctttgtgtatctccagttcatagcacagtgcttgatatatgtaaggtgcaaataaaacacttttgaaataaaatagaaaaggacagaaagaatgaaaaaatgtaagataaaaccctcagatctagagagtcagtaatactttaaatattaataactcaaaatataacacctactgagggtttattacatatttttggtcactagcaactgatatcatatgactagtaattattagagtgaaaatctgaatatgagcaacctgagctgagaatgatatatgtaatagaaatgaatatacttgttgaatatgtgtgtgtgtgtgtgtgtgtgt

SEQ ID NO: 2608 - DNA, 6805 bp, Homo sapiens
atttgggatcaaataaggcctcactgaaaggtaatgagactgattggttatcttgcatgccctgtaagtagaatctagaaataaatagaaaattttgaaaaaacatctgagatagcaacagaatcatccgagtagtcttcagcttgcagggtaactgtttgaaggggaaaacgtaaggaaagtctgttgtgtacatttacaaagaaatggctttacttttttagacataacatgggcatgtgaatctgcttccttaaagaaaatttagcaacttcaaagatgttaacagggaaaaagactctatgatgtcacagtttaaaatatctggcaaggcctgagaaaacaaataagttttcacgtgtgttttcttgccagattgatctccgtgatgacccaaaaaccttggcccgtttgctgtatatgaaagagaaacctctcacttacgagcatggtgtgaagctcgcaaaagcggtatcctgcatgagaacctctcacaacacctgatcgagatactgaactcttcctacttctatgcacaatcggagcacagtgctacttggaatgttcagctctgactcagaaaggtctcaaagcggtttttgatgaagcaatcctcaccattttccaccccaagaaaaagaagaaacgctgttctgagggtcacagctgctgttcaattatctgaggttgtctgggacctgcctccaccccatccagggatgagaatggcagccaatctctgtggccaagctccagccaaaaaggagggcacgaccagaaaggaactccctttgcacggaggcttgccccatcaccctctgagccctcccaacacagcacactagtcagcccactgccacgacctccctgccagccagaagcatccgtactgcacgctgtctgagaatgctgggcctggattgcagacagtgccgctgctgatcgcatcaaaaacaaagtcaaaggccatctcacattttacaaatccccagctcatgaacgtgaagctgataggaaatcaccccagggaacccgaaaaagaaacttgattcctctattgctggccttacttgatgtcttttataaaacttgggactacaatactaacctttttttctgaatctgctgttctacccatgtgtctcacattcatttgtattatttcaagaaatgtactaatttccagttcactcaggccttactaatccataccaaattagcctaaagacaaggcattttatattcatttctattttcagcatgtttctaccaaagctattagaaccaacacgtacctctgaatgcccgattataagaagacatgagaagactttaaaagttttggaaatttacagagccatgatttttgaacctaattgaaagaaaaccatctgaattgttgcaggtccacatttttgccaaagatacactctatagatgcttagtagtggcctgatttttttccatgtattgccacgacaaactaaaaatgaactgtgtttaagaatgtagtatttctgtttttcatccaagttgattgggggaagaatatggcaggatccatcttttacagtattttgtattcagtaaagtggacattcctgctcctcccttcccccattgcatgccctcttcctcccttgatttcactttctctcatgcccggatccttttattctccccagttataacccagttataaaagaaagatctgagcataaagatacgtgtttaaaaataactaaaagtaaaggaaagtgccttaatttttctatttgcttcaactgaaagtgcttctcagctcgccccatgtaagttctcattccatgtaaatgacattttccagttacaactggtactgagattttgcctctctctttccttactcatcctcccaaatgtctttgtgggagccatatcagtggataccaagctctgtatccatttgtcccctgccctccacaatgtgtgacatagaacagggactttggccctgggaaagcaaaagctcccagtaaggaatcctgtgcccaatgatgtaaaacaattccaaacatccaggaatttttgtatcatagagcgaattacttcctatcttttcattagaggctatgaggacttctaattagtcttagttgcttataagtgccctggaatcacccaggtaggcacttaatttttttttcagttgcatgagcaaagtgcttcttagtagtgtgaaattacaacaactttaagactttccagattcaagctcccactgttggaaaaagccagcctttctaatctcttctgctactggaataagcacttaagaattgcgtgatagccaggcaccgtggctcatgcctgtaatcccaacacttagggaggctgaggtgggtgggccgcttgagctcaggagttcaagaccagcctgggtaatatagtgagatcctgtgtctctataaaaaaattaaaaattagtcagttgtagtgacacatacctgtagtcccagctactcaggaggctgaggtggaaggatcacttgagcccagaaggtaaggctgcagtgagctgtgactgtgccactacactccagcctgagtgacagagaaagaacctgtcaaaaaaaaaaaaaaaacaacctacatttcaagtactatttcccttctctcccatctaattgctaaagattttctttcatacgcacacactccagtgactggaaaaacgggagttttcagtcaaagcttgacatttagagaaaacaaggactttctgcctttataaatggaaatcaactgtgtatgaactataactctgcagaggttatgaattcatcctttacaaacaataatgaacttttagtcctgtaataaatgaaatgttattaggcagctttgttgcatgattgcatagttatatcttgctaacgggccactcatttctcactgatgtggatgaaaaaatgagagcagtatgtttccaggtgtgtgcactcaacaggcaaatagctcccgaggtcaccacttccctaatgggccacaggaagtaagttgatcttgatggggagatcacgtcacccagaaccagcaactggatagagactgttgttagtgtctgggtagagcacaggctcccaggggtcttaagagctaattactgaataaaacaatctagaacaaagcaacctaaataagttgatgtcattctgccaaattaatcagttattccttgtttcacggcaagatccagtttgtttcactaaaaagtgttttctgctataagattaaactgtcttctgaaaccaaagataagaagagacatagaggcccggcgcagtggctcacgcctgtaatcccagcactttgggaggccaaggctggcagatcaccaggtcaggagatcaagaccatcctggctaacacagtgaaaccccatctctactaaaaatacagaaaaaatagctgggcgtggtggcgggcacctgtactcccagctactcgggaggctgaggcaggagaatggcgtgaacccaggaggcggagctttcagtgagccgagaccgcaccactgcactcccgcctgggcgaaacagcgagactctatctccaaaaaaaagaagagacatagaaatttgaagaaggatcctttaatggtctacaccgtcttccaaagtcaagaagtggcagctgatatccatttgaaagtagaatcctagcttttcagagctagacaaggcctcagaaactatagttgaattcctcattgtaccaatgagaaactcaggcctagatgggtaaaaagaggtgtgttgtagcagtgctgggacagatctcggtttttctgcttcctatacaatcctcttcaacccaatactacaatgtatttattatcacatattaagctggagatttgtagccatgttattagagttgcaactgtttatcctatagattccagccacattttaaacacataacttcatgtagttaggccactaaaaataaagtaatccatcaaactagtaatacactagagaatttgacctacatactaagatgcctgaaatccacagtatatggcaatttaacccccatctaatagtggctcaatcaagtagctaaacatatttatttcactcagatggttggttgtttggtagaaggaatggactccttgggctattttgggaacaaaaaaggactaggacacaaatcaaagccacatccacagtaagaaatccgggctgatctctgccaagaaaagttacaaagaataattacttgatcacgtggggaaatttcgacataaaagaagtaatggataaaaagaaagaaaaatgaacaattgctgaagacaataattatagcaaccctaaaccagaaagcactaagccaggaagtcaaaaactaagtcatacacatatgacaaggtgcgggggttggtcctgagacttcagtgagaatatgtccgatcaggatatgcaaagaaccatttggaagatttctagttcataagggaagtaccaaatgaagtggatgggaccatacgcaatttgcataggacccccaaggaggaaatagtatgacatggtagtaaaaaagcaatcacgactacactcacaattttaggagaaaataaaactaaatccagaatttgaagccaacaacaacaaaaaaagtcattatttagggtatacgttcctgtgggcagtaccttgcaaagtagaacatcttcaagaagaaatatttgacttgaggtaaggctttcaagattgccatattacattcataaaggcaaactcatccttgagaccaaagtgacagaagattagaaattaaggctttgttttaaagaaatgttgacatcatactggaaattattatccagctacttacacattcgtttttaaatccatccctatgtttagctgccaaaatgcaaactgcgcattctctctcaacggagagcgccacaggtcaccagctattattctcccaggagtcattgagtaggctgcccaagtacacataaggaaactcaacgaactattttcatttcaaggaccattagaaacagaaaggaaaagagaaggtcagggaaacttagtttctaacaaaggaagtgaggcactttgaaaaagaaaatatttagagaacggagaggaagctaaacccaaacaaccaaaacgcacagctgacaattattccgggaagttggtaacttctgcctggtctctagaagcacaggaagaaaggactgttagcgtgaagaacactccagggttctgggtatctaggcagagtcagtcaacagggctaaccatgtgataatcctgggtaattccacctcacagttcactaaaaaacaagcggaaccctgggcaaagccctttggggctttaatagcaatggaggacatcaccctgtcactttctctgcttctacacagcaggcaatcaaggaaaacttgccaagaaatatgagtgaataaatgattttgaaagtttcattgagcaggaacatgaaaaggatgatttggggatagctggaaggatagttacttgcatgaataatatttattcaccgtcagtgtgatatttctcaatagaaagattgtatttaaaatgtacaactacaataacagaaaaaaaaatacgagataaagcaacagttcacagtgccacaacggtcaacaaagaccagaaaggaaattaaagcacaagttctactcagcagcacttcagccatcagaagctccgccgtgctattttgaagatctctttctgttaggggacgaatgagtcaaagcgggattggctgctctgtgaaatggtgagattcaagttcaacaatagttcttggctttgaaattccactaccggaaattagagtaaaatctgcaccattagtcttggtcacaatctatgtttttgtccttagaggatattatgtcaaaaaactagggttgcttcagtgtgtgcgtgtgttttaaatatgttctactttgatcatttcattttgttctatgagttctgcagtgactcagaagttccatgatactataactggagtaattttgctgtatttttagccatgtcctccaagcctcccagtatatgctgtgatctttgccaaacagaatctgatcagtgttacaggggaaatgatgtgtgaggctctacaaggagagggtctccagggcccacacctgagtcatgccttgaagcaacctcagcacacttagcctcccagtgattctgtgcaagtctgtctcaatcttttgagcttatgttagttctttgggggaaaaaaaatagaaacaacttctgaatagggcagtatgtttggggcagctttgtgaatacatatctaaaattacctccatttgccattttttaaatcaattttttttcaagcaatcagattcttttctcctagaggagctgtgggcaagaaaactaatgaattctacatccttctcatcacctggtttaaattgttttctgctctgagtaaacagtaattactgtttaagtacatctcagcagaattttatcccaattgcaacagttcatgttcctcctaatgtaatctctgcagaggaaatgatcgtcaagggaagcaggctgacctgctcacgggatggcgttcttacaatctgcatcttatgtaatggtgattctgtgtgcctgtgtcataattattggaatattattttatgcttttttttttttgagacggagtctcgctctgtcgcccaggctggagtgcagtggcacgatctcagctcactgcaagctcccctcccaggttcacg

SEQ ID NO: 2609 - DNA, 497 bp, Homo sapiens
attaagagcacagccaactgttccactaaaatgccgaatgaggtaagacagtctcagcagcataaagaaagctgtctagaaatacagaggagggagagattgttctggctgactgtagggctagagaacagaaatagaatcagaaaagaggacgagatctgtggcatgtgagggtgagggcatttacatcagtccaaatggatgaagaggagattccagtctagcacagcatggccagtcagagtagaagggaggccccagcatgtggggaagctgcaattaactttttaccaaaacctacccctggtgaggcagaacagagagaaataataccaaaagccacccaactgaaaaggtcttcttgacttcctggactatgatgaacggtcgtcttgagaagaccccctacaccaaatgcgcgtatcggaacctactcactcagaacagcatggtccattatctccaaatgacagactagactgacatcacagacacac

SEQ ID NO: 2610 - DNA, 3873 bp, Homo sapiens
catagatcgtaaactgtcctttcataatggcgatccatttgttctcaaatgcgctgacattttgtcatatggaacattttcattttggctacaaaataagtggaaattttagtttgcagcaataagcttccatctcccattattaaaaagattattttatagttgcatgcatctttattattttatatatatatagtataggatcaaaattcataaatgatgtgatgaatagtactgttgcctggcttaggtagctatggtactgatgtgataaatgatacagcaaaaataaaaagcaaattcaggattcagttcactttccacatttcttcactaacttaaaaaagttagaacacatggctttcaaataatttttcaatctattgatagtgcaacgatgttatatattattattgatgactaccactacaaacagaaacaaaataccttgattggtagttaagcaaaagaagagtattaaatctcattatattgtaaaagtaatgaataaaattttggagatgctggaaaagaatagatttacctatgttgcactttatttttaaaggtcatatttttaaaagtccattctatgccttcaaatttgaagtcgtcagctaatatgctattatttacaaaagatgtgcaaaacacttttgacaatagaaaggtttaatatagttgttgctcatcagggtctattggtttcaatatctgatattctggataaatcgaatatttctaaaagctctttttcattgtattgtttgcatttctgaagcagctcattatgatatacatcacaggtttttattgtttataattagaaaacaaaactccactaacataattactttattttgcttccaaagtattatttttaaatctcagaaccctattttcctaaaaatattggcacaagtaattagaagtgaagatataaacttaatccctgcaatcggacccattaaccaccacaaatattgtcttatttaagctgatcttggtaaaccggttgcctgttatacccacttgctgtttctttaggctaacctatgtggcaacaagtatatttgggaaacgagttttcatcaaaaacaagaaactgtttatcttggaaataccattctccctaaagttgtaggcatcaagaagaaaacacaactgaattgtttaacgtcattgtgtgggatatggtgaggaaactacttccatttgtctttgaggtcagattgacaagtagcatttcactttcaattagtgaaaaaaggaagtaagacaaagcttccaaaagtcaactaatggccaaatattgagaatgattggagcattacttagcaatatgatgtaaaaaaatatgatgataattataaccgatatttgagtgcctacatgcaccaggcacttcatattaagtgttttatttgattttccatactgatttcttaaatctatgaggtaagtacattactatagtttccacaggaagaaattatggttcaaaatttggatagctatttcaatatccattccttttggatattggacatctttattttttaagcataactttataattatgctcacagtacataagcccacatcaattaatatctattaagtaccacaaacactaagttagtacttaatatgtgctaagaaatgtgctgaatcaattctttaaaatctttaatcagagaagttttgttattgctagatgaagaaaatgcaatcaccacctgttaggaggcttggtttttccagagagttgctaaagtctcagaaagtctgtaattttaccttgacatttactttattaaccagaatacgggtgcttatttggtcaaatattttgtaaataaaaagtgaaatgaataaagattgcctgttttaatataaaatataatacatactttgttcaaaagatatgtaaccggaaaatcactaaaagtaaattgcaaatttggacaaaacagagcatgtactttgttttctagacaccatgttacctgctccctctaataaaaataacacaaaaaataggtggcagaatacaaaacataattttaaaaaagaatcaactaatgaaaaaactctgctttgttaggaaaatttacttctgatacaatttaagcataaaattcaatggcactaaaaattcaagttaagtgtaaagtgtaaacacaaatttgatgctggataaacatcgtgtcaaatcaacttaaaactaggaagggaattattaacatgattttaaatagtcatctaaatggttatttgccaattatattttattcagttttaaatgccttaatgccagatgtgaattaaggaagacttttttttgtgatgttatttgcttgattatttgtttttgacctggtcaagactctcagacctcccaataaactgttagttaaaggttaatttctattgtgccaatagggaaaaatagaaagagaagggatgtaacttctgagtcatgagttactaagctgcagaatgtgatttcagagaaataaaaaattgaagggactccaggaggttcaacctcgtctctaatatatatatgtttgccatgggttgctaatttgcaatagctgtcataatgagaatagccaaagttggataaatgtgacaaaagattaacaaagtgtttcacacccttaaattataccacatcaagaatgaggaaaaagcattgccaaaggaaactactgcaatgctacttgcattcttgcaataaatccagcatagcatccaaattaagagagttaccatctgacttctaactttttccccttaagaacaatttgaatctctggcatccacctcgtcggtactttaaaacctgtatttcccacccaaagtccaattagtctccggttgatgagtactctgatattgctttctcttgtccatatttcttggtttgggattattctagatcaataggagggtaaactatcagtaccaagtttgttctagatgaaacacatcaggataaccttccatccaaatactgtgttgatgtcacagggggaaacagttgagctaattgcgcaccataatctgaagttacattgcaagtgtcaggtgttagactgcagtgaattggttataccacagggaacgttattgcaagagatttggaggacactaaaatagattaatgttacacatctccctcaaaaataagaacacatttaactctttatttaaaaaaaacattatggcaaaataaaatgaaaccatttaatggcatattttctgaagggattactttttacattagtgtagggtgaaaatcacttaatgtacttgatctctagtgtccctttcaccttttcctcccttgagaactctttttcccccttctcccctgcacttctttaatttacaatatcgctgtatgtgcagttcttaagaaatgaagcaagagactgtaacaggggagagaagaaatctaacagctaaacaggtgtacatggaaaataaataaaaaattgaaaaattgggcctcttgggtgttataaaaggaacatttgctgaataactactttggtagcccttgtgccctgtgaattatcattctgatttacccaatcacactgtctagcaaactcaaattgcttaacactctaattattctgtatgcgacatgaaaggagagcaatttcttactggccaattattatagaaaatacgtggttctatttttatttgtttttaatgttgaatgataaaaaagcaatatattagataagatggcaaattaaaaagactttttgtgtaaatactgtattatatttgtttatattgctttggtttccctctataatggaggacatattcaggcttaaagaatacctg

SEQ ID NO: 2611 - DNA, 4825 bp, Homo sapiens
aaactaaatcttttgttcaccagctgctcagcttttcagtctgggtctgagctgaaacctgctgcaagtctgacggtaccaaattacatatatatctgtcaaaatgatgtaggacctaaagtctctctgtaagttgatccttttgaccccatgattaggagcttcacaatgtggtaccacacctggaaacctccagaacaagatctcaaggaaacacaggaaattcctgaaacagcaaaaccccctatgtgaagacgtctgttattcctttgtgtatcaggagcatcactgttaattaactgttgatacacttaaaacagcttggttggcaatgtcctttttgaataaagaagagccaggtgtgtttttcaggatgaactagacaatgctgtcacaagtttacctctacatcttattgccttggaaaaatttcctgcatatcgtggcacaagatggttggctctccaggcagcagttggcgttgtgaatcagtcatctcagcatgtgtctccaagatcccacagcagggggaaaaagaggtggagggtcacatgcctggtgttacatactttgaggcagaggtggtaggtgccatttctgctcacagctcatggaccagaacaaagccatgcatacctgagagaggaccagaaaatattctgaagcagatggctatttggtgagcagtaaatgtttctgttacaacaggtcttgacaaacttcaaatgtactcctactaggcctacttcacaccactaaactctgtacttcctgttgcttgatggcatcttatgctgatgttttctatcatagtgtccggcacaaaacaagagctcaatacatatacttaatagcgcatttagatctaagagtttcactttatcaaaagattttagtacctacgtagctattgggccacatcaggaaaatgtaactgcttctacaactgcaaagaaaatttaactaattgtatgctcatcccagcttcaggtttttgttttgttttgtttgctagcttctttttatttcataatttttgctttgttttctgcccttgagcagaggttcatttctagttttcactggaattagaacaacagttgtgtccatatgcaataacagtgtttcaaattctttggggatttgcccacagtgtctgcagtcatattgtgacaccagttgtgatgccagtctctgtaaatcagacttattcccagtgagacattatatatttttgcagccaatacgatctattttatagcgatttatagcattgtctctgaaaaggatactttgatttgtgtcttgtttttgtcagttttcaacactttgattgtggcccaggttaattaatattttgtgtctaggtttcctcatctctaaaataaagatgtttatttctatagcttcatgttgacaattaaattatataatttatgttactcaactagcaagtaaattgatgtacagtgtatttataaatgatagatactatctttatgttaatttttattattgtcatcattatcatcaattttcaggtccgtgttctgactaaaaggaagccacactctgtcgaaaacaagctttgtaagaaaattttgaagtatttacttatatctaaccattcattccaccttttctcccaaataacactctaatatcttgagacatcttgtctagggccagatttcataaatgcttgtgaggcaggagaataagttccagaggcagttcacactgcctaaagccaattcacactgacttcctataactaaatctaaaggaaaatctcaactttcctcgcccaagtaacaaaagaatcagaggttatactccctttgcaacctgccccttttctgcctggcagatgaaaaatgaaaagtacctatgactggtcccctcccacgaccagccagactggtcacggatcactacttcatttacatagggcgtaaaccgagtaaccaatgggaaacctctagagggtatttaaaccccagaaaattctgtaaccggtggtctccagcaggttgctcaatcttgctgccactctgtgggatgtacttttgtttcaataaatctgtgctcttccttcgtggttttgtttgtgctttttgtccaactctttgttcaaaatgccaggaacatggacaccctccacaggtaacacttgttgatcaaataaataatatgctaatgataaatgtaactttagttatcaacatttttaattaaatgattatacatttaggttgtacatatttcacttggcttttccacttccttcaaagtaatagtaaaacaaagaatataaaacccggaatttgagatgcctgacaaaaatgcttcatatggccaaaagaactattaaattctaaagaaaaagccatatgtcatttcttacctaaagcactttggaaacacattgtagcacacagctacgtaaggacagtgagaaccagagctatcaggatggacacaccctccccttacagccctgagtggcacctacaaagaaacaaatggatcttgagacacaacctaaaaaccaagcactaatttctccaatatatgtaatacagccggtgaaatggcccctcaaatgccatacctgtgttttcttggtctattaattcatttgataggtacattcttggggtaaatatttgagcaactttattttccttaatttttgtcttcagctatttagttattaattccttccagttttctaagttttgtttaatatataaatatagaaactataaatgtagaaatacttctaatgcagaaaatttaatctaatacccttgtatttatcaagagtcaaaaaaaaagggacatctctgtaaggcctgaacagcaaaatgttacttagtggaatctagaaaaatcaaatccccatagaattcagtgctagaaaaacagagcctaacaaaaagggaacaaaggacatgaattactgcattatcaaagtagaactatttatgatcaagaaatattaaactactggaaacttacttgtaataaaaatgaaagttaaaaaagatagcattttccacctatcaaattgataaccattaaaaaacaaataggttatgatgaaaaggattttgaataaatgttttacactagagtgtaattaggacagattatctagtggaaattttaggagtaagtaaaatgtttaatccaataattgcagatgaattaatatagtgaaaggaaataattagatatatcaaatgacgtacatacaattgtatctctgaagtgatacttattatattgaaatatgtcaaacaataaaaatggattaaataaattatggtaaatcatgataagtacagcctattaaaaatcattaaataatagagaatatgaaaaatcaatcatgatataatgctgagaaagaaagcaggttacaaccatctgattcaaacacactcacaccatacatgttttgttgtatttattatatatatatttgatttcaaagacacactcaaaatgacaacaatttgagcttattaatactatctctagttggtgagattagtggatatttgtattgtttctaacagtttcaaaatagttttataattgtttatagtgaatgtgtacactttattatcaggaaaatgactttgttatttctaaatattcctatatattagaaaaaaatctgtagtggctgaagtcaacttttcacatgttaaataagtccattacgtatagacaccatcatcacgtaattattcattggccagcagctgtgttaaaggcattgattctctttaatgaatctttgcctttgaaactattgtttctctttctaaataacatccattactctaaaattgtattgttgtgctacctccagtttggcactaatctgaaccaactcaaatgtgaaggattcaatggtctgcctctgcagtaaggtgaagcatatggcgtgcattacacttaaggtcaagagtttatactggctggttggtagtatctgggggtataaaccagggtgttatcttggacaaatatagttatttaatagtttgaattatggtaaattgaaaccaattcttctcccatgtgtaaaagttgagactggggcagggacatttttgggttttttgctatgatagggtctaatctttagtgggagtcagaatggcagcaagtgttctcaaatgaagggatgacaaggaaaagttcagagtatcacatgacaccttctattacctatgaggcacgggctgctgcagtgctaaagcacaagtttacagagtttcagggtcttgagatttttacaccaaatttcaaacaagactcatagtgttacttttgctcctgagttgataccattttgcaaaatacaaatatttaactaacaatccaaaaataagcacattcaaatttctaatacataaccaaagaaatagtttttcattaaaaaacacagtttaacatccgtttgtagtaaatatcctcttcctctccctatccctatccttatcttccaccctcttattcacttacctcttctctctctctctttctctggcaaatgacttagatactgttattgatgtctctaatatgaaaatactcttggcataatgagagcttaaactgtacttaaagtccactgaaatgtaaagttaaaaacaaatcttagactcagatggaagcgactttagagatcaactgattcaatcctctttatttaaaaagaagaattcaggggctatttgtagcatatgaatgatctataaagtcacaagttaaattagaaattagtagtaatttgttaagaggc

SEQ ID NO: 2612 - DNA, 55608 bp, Homo sapiens
atatatacatatgtgtgtgtgtgtgtgtgtgtgtgtgtgtatatatatgtattttttttttttgagatggagtctcactctgttgcccaggctggagtgccttggtgtgatctcagctcactgcaacctccacttcccaggttcaagagattctgcagcttcagcctcctgagtagctgggactacaggcgcatgccactgcatccagctagtttttgaatttttagtagagatggggtttcaccacgttggacaggttggactagaactcctgacctcaggtgatccacccgccttggcctcccaaagcactgggattacaggcatgagccacggcgcctgaccagaacagataattttcaaaacaagacatacaagtgaccaaaaaacatgaaagaaatgctaaccaggttgttaaccaggatgcaaagaaaactgaatgcttatacactgttgttgggaatgtatatcataacaacctttatggaaaacagtatgaagctttctcaaagaactaaaaatagaactgccattagattcagcagtctcaccactgggtatatacccaaaggaaaatctatatataccatggaatactattcagccatagaaaaggatgaaatcatgtcttttgtagcaacatggatgggactgaaggctattatcctcagtgaaataactcagaaagtcaaatacagcaagttctcacttattgttgggagctaaacaatggatacacatggacatacagtgtggcataatagaccctaaagactataaaaggtgggagggtcaaagttgggagagtgttgaaaaactacttactggttacaatgttcactattcagacaatgggtacactaaaagcctagacttgccctatacacaatatatacatgtaggaaacttgtaactgtaccccctaaatatatacaaattaattaattacaaaaaatattatgttgtagtgttaactggtatatcttgtcttgggaaaatatggcagctcctatgaaacatctcggaaaatttgtaactgatgttacaaaacacccagaagaaataagtggtctggtgagaaaacttactcatctttgcctacatatgtatacatgagtaatttgattacacatttgtgcgggataatataactgaaaagaaaatgtaaaatttaacttaaattgtatttgtaagttgtaatttcattaattctgcattattgaagtacatgtaggaaaggtgcagaaatgcatcaggcagttaatacaaatacgttttttttttttttttttttttttttgagatggagtctcgctctgtcacccaggctggagtgcagtggcgtgatcttggttcactgcaagctccgcctcccaggttcacaccatcctcctgcctcagcctcccgagtagctgggactacaggcgcctgccacctcgcctggctactttttgtatatttagtagagacggggttcaccgtgttagccaggatggtctcaatctctatacctcgtgatccgcccacctcggcctcccaaagtgctgggattacaggcatgagccactgcgcccagccaatacaaatatgttttgctcaattttgtaatgtttatgctaccatcagttttttgaaatatgtaacttttactttttttcttagagtcctccaaattatgtttcaggctccttaaaaactttttatctatccctgataaatattcctcaataataattttaaaaatccatttggttaaatgaacatgaactctaagtcttttaaccagaaataagctattaggttgatgcaaaatatttgcattttttgccattgaaagtagtggcaacaaagaaataaaattgtatttttggaatagttttctcttaagctcttgataataaacctgtaagtattaactgccttacaaatggcaaaagaggccacttgaaggaaaggaaattccttaacaggactttccttagcaggaaagttagttgcctgggtcatcatttggataagaaaaaaatccattaaaaaatggcagtattattagtatcatatgcataattacatatataaaacttgccatatattgtgtgaaatatagttctttagtataggaaaaatatattgatatctataaaggtaaaattattttaactctttcacatacatgttatttgataaaatttgctttcgtgttttttctttgtcaggtttcattgatactcaaaattcatttcctttgacatagctcaggagatttgttagtaaaaatctcacccaaattcataagaattttccaataaaatatttcagaaatgaaacattttgaaagaattggtcaattatcactttctgctagatagagcatgatagtttggtgtatattttaatatatcagtgatatagtttggatattactccccacccaaatctcgtgttgaactgtaatccccagtgttagatgtgaggcctggtgggaggtgtttgggtgacaggggcaaatcccttatgtcttggtgctgtcctctagatagcgagtgagttctcttgaggtctggttgttgtaaagtgtggcacctccactcccaactctctctcttgctcctgctttcgtcatattaagtgcccactcctgctccaccacctgccatgatgataaggttcctgaggcctccccagaagcaaatgccattgccaagcttcctgtacagcctgcagaactgtgagctaattaaacctctttacttataaattacccagtgttgggtatttctttatagcaatgcaagaaaggcctaatacagaaaattggtactaggagtgaggcatggctattaagatatctgaaaatgtgaaagcaaattaggaactgggtaacaagcagcagtccaaagagtttgaatggctcagaagacaggaagatgaaggaaagtttggaacctcttagagactggttaagtggttgttaccaaaatgctgattgtgatatgaactttgaagttcaggctgctgaggtctcagatagaaatcagaaatgtattgggatcaaagattatgcatattatttcttagtaaacagcttggctgcattgtgtttatgccctagagatctgtggaagtttgaagttgagaatgatgacctagagtatctggtggaagaaatttctaagcagcaaagtgttcaagatgtggcctggatgcttctaacaacctatgctcagatgtaggcacaaaggaatgacttacatttggaacttacatttaaacaggaagcagagcctaaaagttcagaaaatttgcaggctgatcatgtggcaaataaataaaaaccttttacaagagagaaactcaagcaggctgttgagcaaccatttgctagagatatctgcataactgaaaaggagccaaatgctaatagccaagacaatgggaaaaaggtttcagtgacatttcagagaacttcctggcagcccttcttaccacaggccctgaagcctaggaggactgaatggttttgtaggccaggcccagtaccttgctagcctgcacagccttgagacacggctccccaaattctggtcactctggccccagcctcagctcaaaggggcactggtaaaacttgggccatcacttcagaggacacgagctataatcattggcagattccacatggtgttaagcatgtgggtgcacagagtgcaagagttaagaaggcttggtagcctctgcctagacttcagaggatgtatagaaaaggctggtgttcaggcagaaggctgctgcaggagtggagccctcacagagaacttctagtagagcagtggggaggggaaatgtgggtttggaagcccacagagtccccagtggggtattgcctaatgaagctgtgagaagggggccaccatcatccagaaccaagaatggtagatccattggcagcttgcactctatgcctggaaaagctgcaggcactcagctgtagcacttgagaggagccatggggctacatcctgcaaattcacaggggaagagctgcccaaagccttgggagcccaccccttgcattaacgtgccatggatgtgaggcatggagtcaaaagagattatttcagagctttaagatttaatgactgtcctgctagttttcggacctgtgtgagctctagtccctttctttgcctgacttctttctcttgtaatgggaatgtttacccaatgctggcaccctcattgtatcttggaagtaaatgacttgttttgattttacaggctcacaggtggaaggaactcattttcagatgggactttggacttgggacttttgattgagttgttgcagaaatgagttaagattttggggaattgctgagaaggcatgattgtattttgccatgtgaaaagaataggtaatttgggggaagacaagggtagaatgatatagtttaggtatttgtccacactgaaatttcatgttgaattgtaatccccaatgttggaagtgtggcctggtgggaggtgtttaggtcatgggggttgatccctcatgtcttggtgctgtcctctcaataatgaatgagttctctcaagatttggttgttgtaaagtgtggtacctccacccccaactctttctcttgctcctacattcaccatgtcaagtacctgttcccactttgccttccaccatgattgtgaagttcctgaggcctctcggaaagcagatgccagcactatgcttcctgtacagcctgcaaaactgtgagccaattaaacctcttttcttataaagtacccagtctcaggtatttctttatagcaatgcaagaacagcctaatacaatcagtaaatatgtcagattctacaatgaggctactataatgtgaagatatttttcttaatcatttacatttacaaatagactaaaattcttgttttatgttattgtcttagttcattttgtgctgctataacggaatactacagactggtaattaataaacaacagaagtttatttggctcatgtctctggagattgggaagtctaagactgaggggcctcatctagtgaaggtcttgctatgtcataacataacatggtggaagtcatcacatggtgaaagcatgtgtaaaagaggaagacaggagaactcatactcttatcaggatcccactcccacaatatctagccctctcccaggataacagcactgattatcttagaagggtctcaactctcaggactgttgcattggggattacatttcaaacacgtggatcttgggagacacatttaaaccacaacagtgatgttttgaataataaatatacatctacaaatgtgtttcttccacctggcaatgccttcttctgatagttttattctgcaaatttcaattattcaaataaaatttcctcattggccctctttaacactttttcctctgaaatcttatattacttgttgctttacaaatactctttaaaaattattccacactggtatctaaattcttccttttttcccagtcttatcttcccaattggcttttaatttccatcaggaaaggatccatgtgttttgacttcttggtactgctcacagtaatacgtaaataattaagatttaatataattgggtttaatttaatttcatgtagattccaattgatttttccaattagatgtgtgagatttttattcattaaaatacgcaattatactagcatccatttttacttgtccaaagaatgagctaagatttaagttatattttgcgatcttgagatacatttcatatgctcttcgttgaatcacttttctattcatcttcaaattccagctataaaatatgatatgcaattgtcttagctcagattgatcacaaatccttgttctacaagataccatgtattcatatattcataaaaatatcaacagaaataatatattaataaatatttaagtatgtaatttcagaaagagatggtaatgtatcaggacagattttagttaggagacacaatatgcttatccgagcacaaagttggtttttatcaattgatgttagtttttgattatatactatatgtaagttctctatttataattataattttctcattaataataataataaatcatacctatattgtaccttgaaattatcaaagcccctttcatttccacctcattttctctctttctctttttctctttctttttccctgttcttttagtctctgtctctccttcagaaaaaatatcagttacttagcaggacatatattattgtttccatgttacaggttggaaatgaaatttcaaaggaataagttattttttatggtcttatagctaataattattaataattgatatatgtaggattgggatcccaaggtttaactcctaatcatgtgacttcagacaaaaaaacgtagaaataacagtttttctggattgttacatggggtcttaggcaatttgagtcattataacaaagtaccataaactgggtagttttaaacaacagagatttattttgcagagttctagaggctacaagtctgacatcagggtgccagcatggttaggtcccagtgagggtcctcttttgagtagattgctgccattttattgtctcatcacagggtgaaaaacaatgtgagctagctctttggcctatttttataagggctctaatcccattcatgagggttccaccctcataatgtaactacttcccaaaagccctatctccaaataccaggatactggggattcgattttaacatatgaattttgggggaaaatgaacattcactttataacacatagagagtgaggtagtctggataaatgatctagcgtgttcactcataaatgttattttcatgctccttttctaagccttttctattataacagcaatgcagtttgtaactttaagaattattccatgtagaatgtaaattgatatagccattatagaaagcagtgtgaagggttgggcatggttgctcatacctctaatcccagcactttgggaggcctaggtgggaggattgcttgagcccaggtgtttgagaccagcttgagaaacacagaagggcctggtcactacaaataataaaggaaaattagccaggcatggagatacatgcctgtggtcccagctagtcaggaggctgaggtgataaaggctgcagtgagttgtgatcgtcaccactgcactctagcttgggcgacagagtgagaccctgtctcaaaaaaaaaatcaccaaaaccaaccaaccaaacaaaaaaacacacaacaacaaaaacagtgtaaagtttcctcaaaaaataaaaaatacaactaccatatgatccagaaattccactactatttacccaaaggaaatgaaatcagtactttgaagagatatctacattcctatgtttattgcagcagcattcacaacacacaagatatggaatcaacccaagtgtccaccagtgaatgaatggataaagaaaacatatataggcaatggagtacaattcagctgtaaaaaataatgaaaccctgtcattttcagcaacatgaaggaaactagaggacatgttaagtgaaataagccaggcacagaaagacaaatagcacataatctcactcattgcggaatctaaaaaaaatatacatcaatagaaatagagagtaatatagtgatttccagaggttggggagggttgggaaagagggaatggggacagattgatcaatgggtacaaaattacagttacgtgggaagaatacattttggtgttctatagcacagtagggtgaatatagtaaacaatgttatggtgtatatttcaactacaagagaggattctaaatgtctcatcacaaagaaatgataaatgtttgaggtgatgaatatgctaaataccatgctttgatcattatacaatgtatacatgtgttgaaacatcacaccgtactccataatatgtataattactatgtgtgaattataaacaaaatatcattccatgtaatgtgaggaaattgtttctctttgaaaaaaatgtagctatcaacaatactggtaaaagcagatgaagaagcaaaatatcaaaaacccataatcctgcaagagccttaacaagattaaatatttgattatttctaggacacaggaccttttaaaacatttcctgttgttctttggatggtccactgtgggtagtttgaaacagtctacgagacttctctctgtatcaaaggaagcaatgagatcagagtaaaaatatcagagaaagattttttaaaatgaattaaggaaggtaaatccaagcagagtttttataacattcacaaaagcatgtagctttgtgttaaatcgtgtttttaaaaaatattctcttcttgcttcgtatctttgagtcagaaagctggatgtgtgtctaaacaaactaggcaatgctaataccaagaatcccggaaaatgtgctaaattcactattctatgtaagtttgctcagatggtggagaaagtgcattaaccagtactgcaaactgaatcttttgtgtgtgtgtgtgtgtgtgtgtgtgtgtgtgagagagagagagagagagagagagagagagacagagagagagaaacagacagagaaagagagagagagaagatatttgaaaaaaatacaagaaataaagaaagaaatattcaaggaaatagatagcatgaatgaaaagcaatctaaacttcaggtagcaatgaacacacttacagaatgcaaaaggctctggaaagtctcagcaatagaattgaacaagtagaagaaagaatctgagctcaaagacaaggtctttgaattaacccaattcaaccaagacaaagaaaaaagaataagaaaatacaaacacagcctccaagaagtctggaattatgttaaatgaccaaacataacaataatcagtgttcctgagaaaaaagatgaatctaaaagtttggaaaacatatttgggggaatcattgaggaaaatttccccatcttttctagaggcctaaacatcctaacacaagaagcacaaagaatacctgggaaattcatcacaaaaagatcatcacctaggcacattgtcatcaagttatctaaagttaagatgaaggaaagagtctaagagctgtgagacaaaagcaccaggtaactgtaaggaaaacctatcagtttaacagcagatttctcagcagaaaccctacaagttagaagcgataggaaccctatcttcagcctcctcaaacacgacaattatcagccaagaattttgtatccagttaaactaagcttcatatatgaaggaaagatatggtgtttttcagaaaaacaaatgctgagagaattggcactaccaagccaccactacaagaactgttaaaaggagctccaaatcttgaaacaaatcctggaaacacatcaaaacagaacctctttacagcataaatctcgcatgacctataaaacaaaaatacaatttaaaaaacataaacaaaaatttaaaaaccaaggtatacagacaacaaatagcacgatgaatggaatggcacctcacatctcagtactaacgttgcctataagtggcctaaatggtccacttaaaaggtacagaactgcagaatggataagaattcaccagccatctactgccttcaaaagactcacctaacacataaggacccatgcaaatttaaggtaaaggggcgaggaggggaagacatttcatgtaaacagacaccaaaagtaagcaggagtagctattcttatatcagacaaaacaaactttaaagcaacaatagttaaaaaagacaaagagggacattatataatggtaaaaggccttgtacaacaggaaaatatcacaatcctaaacatatgtgcacctaacactggagcttccaaatttataaaacaattactaatagacctaagaaatgagatagacagcaacacaataataatgggggacttcaatactcccctgatagcactaggcagttcatcaagataaaaagtcaacaaagaaacaatggatttaaactgtaccttggaacaaacggacttaatgtatatgaaacattccatccaacaaccacagaacatatattctgttaaacagcacatggaactttctctaggatagaccatatgataggccacaaaacaaacctcaataaatttaaaaaaattgaaattataccaagcactctctcagaccacagtggaataaaactgaaaatcaactcaaaaaggaaccttcaaaaccatgcaaacacatggaaattaaataacctgctcccaaatgataattgggtcaaaagtgaaatcaagatgaaaattaaatattattctaactgaatgacaatagtgacacaacctatcaaaacctctcagacacaggagaggtggtgcgaagaggaaagttcacagccctaaatgcctacatcaaaaagtctggaagaacacagacaatctaaggtcacaactcaaacaactagagaaacaagaacaaaccaaacccaaaaccagcagtagaaaagtattaaccaagattaaagcaaaactaaataaaattgaaaccaaaaaaagtacaaaagataaatgaaacaaaaatctgtttctttgaaaagataaataaaatggatagtccattagcaagattaaccaagaaaagaataaataaaatccaatcgagctcaataagaaatgaaacgagaccactgaaattacaactgacaccactgaaatacaaaataccattcaaggctactacgaacacctttatgtgcataaactagaaaacctagaagagatggataaattcctggaaagttacaaccctcctagcttaaatgaggaagaattagataccctgaacatactaataacaagcagcaagatagaaatggtaattgaaaatattaccaacaaaaaaaatccagggccagtttgattcgcagcagaattctaccagatattcaaagaagaattggtaccaattctactgacactattccacaagatagagaaaaaggcaactctccataagttattctgtgaagccagtatcaccctagtacaaaaatcagaaaaggacataatcaaaaaagaaaactatggactgatatctctgatgaacatagatgctaaaatccttaacaaaatactatctaatcaaatccaacaacatatcaaaatgataatctaacatgatcaagtgcgttttataccagggatgcagggatggtttaacatatgcaagttagtaaatgtgatacaccacataaacagaattaaaaacaaaaatcacttgatcatctcaatagatgcagaaaaagcattttacaaaatccagcatctctttatgatgaaagctctcagcaaaattggcatacaagtgacatatctcagaataataaaagccctctatgacaaacccacagccaacataatactgaatggggaaaagattgaagcattccctctgagaattggaacaagacaaggatgcccactctcaccactcctcttcaacatattactagaagtcctagctagagcgcagacaagagaaagaaataaagggcatccaaactggcaaagaggaagtcaaactgtcgctatttgctgatgatatgattgtttacctagaaaaccctaaggactcctccagaaaacccctagaactgataaaaaaaattcagcaaagtttctggatacaagattaatgcacacaaatcagcagctcatcaatacaccaacagtgaccaagctgagaatcaaatcaagaactcaagaaatctccacactgttcaaatcaagaaatcaagagccccttttacaatagctgcaaaaaatacaacaacaacaacaacaacaacaaacttaggaatacacctaacaaaggaagtaaaagtcctctacaaggaaaactacaaaacactgctgaaataaaccatagatgatacaaacaaatggaaacgcattccatgctcatagataagtaaaatcaatattgtgaaaatgaccctactgccaaaagcaatctagaaatccaacacaattcccatccaaatacaaccatcatttttcatggaattagaaaaaaatctaaaattcacaaggaaccaaaaaagagctctcatagccaaagcatggctaagcaaaaagaacaaatctggaggcatcacattacctgatttcaaactatactgtaaggccatgatcaccgaaacagcatggtactggtataaaactaggcacatagaccaatggaacagaatggagaacctagaaataaagccaaatacttacagccaactgatcttcaacagagcaaacaaaaacataaaatggggaaaggatacccttttcaacaaatggtgctgggataattggctagccacatgtaggagaatgaaactcgatcctcatctctcaccttatacaaaaatcaactcaggatgggttaaggacttaaatctaagacctgaaactataaaaattatagaagataacattggaaaaatccttctagacgttgacttaggcaaggatttcatgaccaagaatcccaaagcaaatgcagtaaaaacaaagataaattgctgggacttaattaaactaaagagcttttgcacagcaaaagaaacagtcagcagtgcaaacagacaacccacagagtgagaaaaaattttcacaatctgtacatctgacagacgactaatatccagaatctacagtgaactcaaacaaatccataagaataaaaaaacaaacaatctcatcaagaagtgggctaaggacatgaatggaaaattctcaaaagaagatatacaaatggccagaaaacatattaaaaaatgctcaacatcactagtgatcagggaaatgcgaatcaaaacaacaatgcgataccacctcactcctgcaagaatggccataatcaaaaaatagtagatgttggcatggatgtggtgatgtgggaacacttgtacactgctggtaggaatgtaaactatacaaccactatggaaaacaatgtggagattccttaaagaactaaaagtagaaccaccatttgatccagcaatccccctactgggtatctacccagaggaaaagaagtcattatatgaaaaagatacttgcatatggatgtttatagcagcacaattcgcaattgcaaaacctgacaccagcccaaatgcccatcgatcaaccagtggataaagaaactgtgagacatataaatacacacacacacacacacacacacacacacacacacacaatggaatactactcagccataaaaaggactgaattaatggcattcacagcaacctgcaagagattggagactattattctaagtgaagtaactcaggaacagaaaaccaaacactgtatgttctcactgatatgtgggagctaagctaagaggatgcaaatgcacaagaaggacacaatggactttggggactcagggggaaaggtggaagggggtgagggataaaagactacaaacatggtgtagtgtatactgcccgggtgatggatgcaccaaagtctcacaaatcaccactaaagaacttactcatgtaaccaaacactacctgtcccccaacaacctatagaaaaagaatttttttagttaaattaaattaaacagaaaaaatttaaaaaataaaaacagaagccacaggccaagtgcagtggttcacgcctgtaatcccagtactttgggaggccaaggcaggtgtatcacttgaggtcagaagttcaaaaccagcctggccaacatgacgaaactcccatctccaccaaaaatacaaaaattagctgggcgtggttgtgcatacctgtaatcccagctacttgggaggctgaggtacgagaattgcttgaacctggtgggggcagaggttacagtaagccgagttcacgtcactgcactccagcctgggtgacagagtgagagtctgtctcaatgaataaataaataaataagccacagagagacacacaggaagaaaggccatgtgaagatatagaaagattgaaattctgcatctatgagcaaagaaacattaaaattactggcagacaccaaaagtacataagagatgtagaataaattctccctcagagcctccacaaggaagcaacacttccaacaccttgattttggacttctgcactccagaaatgttagataatacatatctcctagtttacatcacttaatttgtgctaatttattatggcagccttgggaaactaatacagactcatgatgcctccatggcagccatccaaatgtttgctctgttggcttgcatgtgtgagttcttaagagaatcctagagagtttctctactgcatttcccaggtctggaaggtcacccttaaacttaactttcccttcctcttcattcctgtaacttggagtatatccaaagctcatgcggatgtcatcctcttgtcttgaggtaaattttaatatatggtgtgcagttctggcaagaaagtttagtcctttggtggcatcccactgatctttgagaaactcagaaattctcaaagtgccagatgtaaaaaacaggttgctctattcccttcacttctgtagctgtctccagttttcttgctctgctctaggagatctactgtctaacagacaactaactaggaggatggtatgccaggctttcttcttgtcagaaatccatttctaaaagtgtcatatgttttccaattttttgagaagcagctcccctgtccctttggggatgggagttaataatttttctctaagagcttatagtttctacaagaacaacaacctgatatctttatctccttaattccatactgactcaccttctttcctggattgggaaggaaagtggcattgtagctggtggtagagttaatgctggttctccaatcccataaattcaggagtaagtgtgggggaatgcaatgcttgccttaactgttaaccagctttctttaaaacgttaggtagttaatgcctcattgtcctcaaatttgggccagggttactgattcttgggcactggattacatttcccttaaccactagctatacatgcttaacacaaaatccctccactagcatcagatgagtttgtgggtttggaactttagagtgaaaaagcacttagcaagatttgatttcactatatatttgacattcaactcaactgttcaacttacctttttgtgaggtgagggaatttgactaaaatcagcaattgcttacccaaacgatttcaggagctagaaggaaaagtaaatgcaggaagtaattattttgaatggggactgtgaccagtttgagagtggtaataccaacctgagtcgttgaattttaggccttcttgaagcgagtttctaagctctgagagatgttttaatgtccattccacatttaaatgtccatatatccactctttatgggcaggtagataacatatgagggcatttttcccttgtcataatgtttgggagtgggtgctactagccattttagtaagtagggatcagaaatgtgatatatgcaattgtcctttgtctcccatgattttcaaatgatacataaggtattaacgcagaaactgttcatattaacttgagcataatccaaattctgctttatatagagcttagatagacagacagaagagtaaagtattttgcatattttccagaaatacaattgctatttatattgagtaactattgcactttattttgtttattgttttccatcattatctagattcagccaccctttcagaaaatcatttcagcgatagcaagttgctgatagaatttgagtccataacacttcacacttaagtcaggcagcatttgtagtttttaactcatgtgattatacagatagaggtcagcatctgactatttcatacaatcttctcatgtagtcatgcctgaatatacataatgaacttcagatttcttcttaatgaactgctttcttgttatttatacttaaatttcagataaggcattatatagactttttcaaaaagctatttgtgggaagatctttatatccatggtcttcatttcaggtggtaaagcatttattacaaagtactttttataaaaatggaaaattgttttgatagcactgctctatatccactgtcagaggtctacaaaatctcagaggtcatcaatattctaatgtatatatatacacacatatatcagtcttcacctatcccttggccatattctttaacatgttatggttctcaggctataatattctcttagtcaccaggggcctaaagtaatctggttttacttgtagcatagtaaaaacttcaacctgagactgactgccagaggacctattcatttgatggtttcctgagtaggtacagttttcaagtctagatttaatatgaaagaagtatagccccctaaatattgtgtatggttatttgtagatatattcaaaattattgttttgccatgattaaaatatttatgagactgaggagattttaaaatttaaactaataaattggatcaactcactgttaactggtaaagcattttcatcattataaagagaatgcatcatctaattttcaaatgttttatctttctaattgaatttctaattagcacatgctagtaaaatgaaaatattaatgagatcctcataggtgcttaatatagtgatatcaagtactatcatacatatgtgtgtatatatacatatatatgcatgtgcataagttctgaagaaaatttttattatgcaagataattaagtgtcatttgacataaaaattttgcaaagaggtaaaaagtggcataaaattaaagaaagttaattatctgatctttctcctttcggcaatttactttcttttgtccacagatcaatcatcctaatgctcatttctttaattccctttaattacaactgagaagtaagcaagtgagatagtaatttctactgaaatttccatgcttaatctgcaaatgtagtgagcactgatatagtcaaggaacagtgtggctgttgtgagaaatagaaaatggaggacaggaattatactcagtttcccccattattcagcaataatagaaaaagttaatttacattttcttctttaaaatgtacattttaaaatttcaatacatttattgaattgagcaacaaaagtaatgtgtagggtaggcatttctgtaactttttctccctattttgtattttcatttttctgtattttttctgtaaagttttgtatatatataaactaaactaaactaaacttggaggttgaaataaaacccagattgacactgtatatagacagcagtacaatccagaaggaatctctttatatggtcagtgagaaacatttctatttttaacactactaaggggctccactaatgaagtttgtctggcagaggatgtgacctcagtattttataacacagaaatttctcctcaaggtagaaagctggctcgaagaaacctgtgactgtcatgtccctgaggggtgctttagagttcatagcttcaggatatctgtgaagttctgaaattgcaggcaataatttaagcattagtccccatgtttgtgtgtgtgtgcatgtgtgtgcacacctgcatgatactttggggggaagtggcccatttggtatgatccagttctaaaatatgattatccatgaccccctcaaagcttaagatcccctgaaatttcagctttctgcttttttgcaggcaaagatctaatttctcctctcttttaagtgaattatcctgccctttaacaaatagtggcgatacgttattttggtctttacaatccaggaacactattggttttgacaggctttgctcaaataaagactagtttcacttcatttccaaggcattcaactctacccaagtgacatttgtgaaagccatatatttcatttgtgcattccaatgatttaatttagtaagctcaataagcttatctctagtcaaagataacatggcatttatgactgtagagtgcgtgattgaatgggattcttcctgcttcagtttcaacttagactccattttgttgttatcagacaccaaagatcccgtgagaaaaattgacatatggagattttaaaagacactggttgaaactcttaattccggaactctttcacgtacttaggaaatacgcaagagagtcatggtctcaagagaaggttttaagaaaggggttattaaaactattgctttggagagtgcacttcacatgcaggctgttccatcctcttttgggggagaggcattaggcaggggtttactttccagtcccaatattgaagagggtgggcttctaggcatccaattgaagatctttgaaatagtcaaaaaaccttgaggataagtgcctgatcccaacaaaggaagctaaagcagttagtgttctgaggtcttttcttcccaggaggtccaggagaagagagagggtctgactaacagtgctggtggctgagccgggagatgctgctatgttgagattggttcactttctcctagcttgtcaggacaccggatgtgtgtcctgattgtttctggtgaattggatgtgggctatgtggtacaggatcctcttgggcctgtccatttgggatctcaggagggataagggctgcaagtgtattgcgggatgcccttggacaagggaagggtcagaagaatccacatatagacactgatacgcccaagacaagggaatttcagacaagaggaggagcagggaactattcccaggctcctataatcaaaatcatgagacagagagagtagattttaatcatctgccaagtttatgaagaataccagcttcactgatctactctgtccagatagcacaaagccacccaaagtaaatgtggcacagagccaaacagcagcttgcaagtgcaggaagaaagggaactgcagagagtagatagtagaggcaccagataccaccttagcccattttcctcaagcatctaattggggaaaaaagagatttaaggctacatcaagattggaatattttgagtatctatcttgtaatggacattctaattactggactgaaaggcatttgcaaactaaagtgatcatattgtgatatattccctaagaatgtgcaaaaaaaaaaaaaaaaaaaaaaaaccttgggacctacctgagcttctattcagggatggggaagatggcctgtatgtcttttcctaacctaccatcccctaagtgggagagaaaaaaaaaaaggttgtactttattcatatctgaagaccagtctgattatcatatgagttacactgcttaacagaatccaagcagtaaatactatgattgataattgtggtgattaatactgaatgtcaacttgattggattagaggatgcaaagtattatgcctgggtgtgtctggagggtgttgccaatggagattaacatttgagtcagttgactgggaaaggtaaacccatacttaatcttggtgagcacaatctaatcagctgccagcatggccagaataaaaagcaggcagaataacatgaagactagactggcttagcctctccgcctacctctttctccagtgctggatgttccatgccctcaaacattggactccaagctcttcagctttgggacttcaactggcttccttgctcctcggcttacagatggcctattgtgggaccctgtgatcgtgtgagttaatatgccttaataaactcacctttatacatacatcaatcctattagttctgtccctctagagaactgtgactaatacagattttggtaccaggagtggttctagaggaaaagaatattaaaaatggagttcttttgttggttttcaggtttctggagttggcttcttaaagtgattagccataaaaatgctaaggactctaattctaatagtatggagaacagacagtccttggtgtgaacaatttagagagttattatgcaaaataaatgcatttgatactcttgattcaccgctcatgaaaggcaaggagtttagtgactcaatacctaatacctttgaccatatgtggagaaccaaggaacataatgaagttggttggttgctcctaagttcactggacagagtgatgaaaaaaaacgaactcagggattctaactaactcctggcttcagaagcagatactgagcctcaaatctgctaagattgccctgagtgagtcttatctcctgcagagaaagagctgaaattgtggaaaatcagacacaggctattaccatgtgagtggttgacctgcaacaaaaggtgcacgcacagcctcgccaggtgtctactattaaagtgagagcattgattggaaaacaatgggaccttgcaacttggaatggggatatgtgagaggactttgatgaagctggggacattgagcttgtaaactctgatgaaccttttctgccagaaggaacagcttccccatccccagtagtggtaacatcccctccccaacccatgctgctattagcctttccatctttgtctgaggagatgaaccctgctctgcctgaggcaagagtgatggcctcccctgaggcagttgctaggcaagataatgttgattctcctcaggagcccccctccccccaacacccctgcttgcttctagacttataactaaagttttggcaggcccctagaggtgaagttcagagtgtgacccacaaggaggtgcactacactcgaaaagaactccttgagttttccaatctatataaatagaaatctggagaacagatatgggaatgaatattaaggatatgagaaatggtagaaggaacatacagttggatcgggctgaatttattgatttgggcccattaagtagggactctgcaattaatgttgcagctcagggagttaataaaggttctaatggttaatttgcttcattagctgaaatatggattaaaagatggctcactgtgagagaactggaaatgcctgatttcctcccttggtttaatgtagagaaagggattcaaaggcttagggagattgggatgctggagtggattagtcactttaggcctactcatcccagctgggaaagtccagaagatgtaccttttaccaatgctttggaaaacagatttgtgaaggcagcacctgcgtctttgaagagttctgtatctgttgcttttctccggataccatatctaacagtgggaaccatagtcactcaacaacaaaatttaaatgcaatggggataattggaacccaaggtggcaggagccaagtggtggcactcatccatcaaaggcacagtgggcatagctaccatcatggacaacagaggcaaagcagcaatcgggatagattgatttgtgtagagctctggcattggctagttaatcacagtgatcctagaagtgaaattgataggaaacttactgcattcctacttaatttaaataagcagaaaacttccaggccgaatggacaaaagactaatttgaattataaaaacagagcatcatggcccctcaattaattttcagactagagccagtttacagaaccctttgcatgaaggggaggccaggtccccttgaggaaggaccccactacactaccaacaatttatgctgttaatctttctcccatccttccccaaagggacctttggcctttcaccagggtaactgtgcatgggggaaaggaaatattcagacatttcagggattattggacactggctctgagcagacattgattccaggggacccaaaacatcactgtggtcctccagttaaggtagggggttacggaggtcaggtgattaatggagttctagctcaggttgaacttacagtgggcccagtgggttctgggactcatcctgtggttatttcccctgtgccagaatgcaaacttgacatagacatacttagcagctggcagaacccccacattagctccctgacttgtagggtgagggctattatggtgggaaaggccaaatggaagccattagagctgcctctacctagaaaaatagtaaatcaaaaacaatatcgcatccttggagggattgtggagattagtgacaccatcaaggacttgaaagacacaggggtggtgaaccccaccacatccccattcaactctcctatttttcctgtgctgaagacatggatcttggagaatgacagtgtattattgtaagcttaaccaagtggtgactccagttgcagctgctgtaccagatgtggtttcattgcttaagcaaattaacacatttcttggtacctgatatgcagccctttatttgtcaaatgcctttttctccattcctgtctgtaaggctcaccagaagcagtttgccttcagctggcaaggccagcaatatagctttgctgtcctgcctcaggggtatatcaactctttggctttgtgtcatagtcttgttcagagagaccttgatctatttgcccttccacaagatatcacactggtccattacattgaggactaaactctgatttttttttaacttgcccaaattcctatctaagctatctggtgagtcatgccctacaaatcatacattctcatcagatgggttttatttaaccctatatatcgtaactttccaacctgactctggcataacattactagacaaagaagaaaatcaaaatattttacccccaaaacacatttctttgatatattttgaagtagccctggaaagctgttctttgttgggggaaatttgcatatgtaaagaatctctattaacatagctagatttttttcttccagactctctcaatcctaaagaaattaactaaaatctgaataggaaacatttgtcatctgttgtctcgaagggcagccagtataaggcttcaaaataaccttagtctccacaatcttttatcttaacctgaacattccctttctatcaatcccaggtctttagacacaaacaaccaattgtccagcagaaaatatttaaattcacctatagcctggaagcccccactttgatttgtcttgcctttctggaccaaaccaatgtatttcttaaatgtgtttgattgatgtctcatgcctctgttaaatgtatgaaaccaagctgtgccccgaccaccttggtaacatgttctcaggacctcctgagtgctgtatcatgagccatggccactcgtatttggctcagaataaatctcttcaaatattttacagagttcaactcttttcattgacaacattatgacattatgctgattggatccagtgagtcataagtagcaaacacactgggctcatgctcatagaattcatcttaccatgttccccatcatcctgaagaagctggattgatagaactgtggaatggccttttgaagtcacaatgataatgccagctaggtaacaatactttgcagagctggggcaaagttctccagaatgtcgtgtatgctctgaagcagtgtccaacacatggtgctgtttctcccatagccaggattcacaggtccagaaatcaaggggtggaagtggaagtggcaccactcaccatcacccctagtgacccactagcaaaatttttgcttcctgttcctgtgacattatgttctgctggcctagaggtcttagttccagagggaggaatgctgccacctggagacacaataacgatttcattaaactgggagttaagattgccacctggacactttgggctcctcctaccttaaagtcaacaggctaagagggggtaactgtgttgactggggtgattgacctggactatcaagatgaaatcagtatactactccacaatggaggtaagtaagagtatgcatagaatacaggagatccattagggcgtctcttagaatcaccatgccctgtgattaaggtcaatgggaagctacaacagcccagtccaagcaggactacaaaatggcccagatctgtcaaaaatgaagatttcggtcactccatcaggaaaaaaaccccatgacctactgaggtgcttgctgaaggcagagggaatacagaatgggtagtagaagaagatagtcactaataccagctacgaacacatgaccagttgcagaaatgaggactgtaattgtcatgagtatttccttattcttttgttaaaaacatgtttgtgcatgtatacacttgtactagaaaatttcttcattttatttccttttttcctttatcatgtgacataagatttattgacttcatatcagcgtttaagtgttgttaattttgtgtaatagcatttgggttgtggattggtgcatttctggttgtattttgttaggtgtaattatgaccttattattgtctttatttgaagattacatatgatttcaggaaatgtgtatgaattcaagttgacaaggggtgaacttgtgatggttaatactgagtgtcaacttgattggactgaaggatgcatagtattgttcctgggtgtgtctgtaagggtattgacaaaggagattaacatttgagtcagtggactgggaaaggcagactcacccttaatctgggtgggcacaatctaatcatcggccaacacagctagaataaaagcagacagaagatcatgaaaagactacactggcctagcctcccagcctacatctttctctggtgctggatgcttcttgccctcaaacatcggactccaagttcttcagctttgggacttggactggcttccttgctcttcagcttggagatggcttactgtgggaccttgtgatcgtgggaattaatactctttaataaactcccctttatatatacatcaattctattaattgttctgttaatagttctgtccctctagagaaccctaatacaataattcttttttttgtttgtttctttttttaattttttattttattatactttaagttttagggtacatgtgcacaacatgcaggtttgttacacatgtatacatgtgccatgttggtgtgctgcacccattaacccgtcatttaacattaggtatccctaatgctatccctcccccctccccccacccacaacaggccccggtgtgtgatgttccccttcctgtgtccatgtgttctcattgttaaattcccacctatgagtgagaacatgtggtgttttgttttttgtccttgcaatagtttgctgagaatgatggtttccagcttcatctgtgtccctacaaaggacgtgaactcatcattttttatggctgcatagtattccatggtgcatatgtgccacattttcttaatccagtctatcattgttggacttttggcttggttccaagtctttgctattgtgaatagtgccgcaataaacatatgtgtgcatgtgcctttatagcagcatgatttatatatacccagtggtgggatggctgggtcaaatggtatttctagttctagatccctgaggaatcaccacactgacttccacagtggttgaactagtttacagtcctaccaacagtgtaaaagtgttcctatttctccacatcctgttgtttcctgactttttaatgattgccattctaactggtgtgaaatggtatctcactgtggttttgatttgcatttctctgatggccagtgatgatgagcattttttcatgtgtctgttggctgcataaatgtcttcttttgagaagtgtctgttcatatccttcgcccacttgttgatggggttgtttgtttttttcttgtaaatttattgcagtttattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccctgcccatgcctatgtcctgaatggtattgcctaggttttcttctagggtttttatggttttacgtctaacatttaagtcttgaatccatctcgaattaatctttttttaaatgaaatattccttttttttctcagtgccatagataatagatgggtggactgtaacagtacctagttttcagctgaagcattttaatctccatcatttccactattaaaagaactaaatcatgcctgcttaatacgtcgtgtgtgttcgatactatttaggttatataatagtatagctcatttgaaacttagtgattctcagaaaaatctgagtattgcttatgttactaagagtttgtcatctggggtcaatacttatcatgccatattgctgtgtcccctatctcccattggagatgagaaaactctgacttttagtgtcagactgtctggaaatcacaatgtgaaattatcttctaaactaattcagctaaatcacatttaatatcagattttagtgactttctcatgactgtttatcaactcccaaatgactctttaattaattgtttctcctttactggctcattttctgtcagatccctttccttagagtgttgttttatccctgtgtggcagaaagactgtctgagattgtgctgttattaaatgtagtctggcataatttaagcacattaccttgatgatggtgatgtcactcaggtacttggcctacaaggagctagtacaatttcacttatttcattttaatggatccccttggttttgagcctataaactaaaataccattgcagtaccctccctccagcaatctcaaacttaattattccactccaggaagctgtctgatggccctgcagagacctgtttttgcactaaaacgcaatcccttattgtgtgacaaaattacttttgtttcatgttcttttctttatttatttacaaacagcatggaaaagcacttctcagcacaacttaataggtgattaccacaaatttgattttgagatttagattgaatagttgttaaagttttctttgtattctttcctttgtaatcatgatgacttcttaaatactattccaagtactgggcattgtgggtaatgtggcataaattgccaagatagctgactcaaatcttttcccctacttagttttgatattatttattaagtttcatagcttggatgacacctcttataagcccatctctaccaatatcttttttgctgctttgagcaaatttagttttctaagctaaaatttctaagtggttttgcagaaagcagaaaagacagagacacattgcagaaaaaggtgtggaaagattagagattcatagatgttgccatttgcagtacaaagttatctatgacaatggtcagtaatatatttcataaatgatcaaaagttttcacttacaatttcaacattttcacaattgtataataaccaagaaatacttagttttgttcatagtcaaaaagaaggttgaattgagagccagaaactctgtagtattttgcaagggacatatttgtctctagtcatcactttggtctatggggactaataggaaacgaacttcgtgcttctgtcacattttttgaagacaaagggacagcccatggatgtgctgtattttctattaataacatgttctttctcttcctagtttcctaggctttgaaaaaaatggtgaagagagagagaaaagagtaagagggactggcatacttacactttatgtgtgcatgcagtttttaattttgtgcttttcaaccctctctcatcagtgcaagaaattaaatgcatgagaattaatatgctcaagtcaataggtgaagcaataagctataacggaagagaaagggcttccatcatgcacaagctttatagacatttaattccctatgtggacaggaggtttacttatctgcacaagagcttcacacaaaacaagaattagattctcttcattttgagtttgcaatcctacttcatacaacaactgtggaattgagaaagaaaaataaatgcagagatagacaatatttggaaaaggagtcagaatgaaactgaattacacttgtttattttgagtttgggagaatgtggagaaaaacagattgaattaacacacacagaaaccacaaacacttttttcaaaaactcattttagtttatcttccctgaacaaactgagcaatatttagtgaagctctgtcttagtccctgtgaccacttttaaattacaggatggtcagaggaggattggtgagcacctggaagattgacaagtcacttccggcagagcaggcagatgctgaacatgatgtttctaaatgttctagcatcaaatgtgatcaacatgccttcccctgtctccttcgtggtatttttataaagacacagtgtttgaaggacattaatctaaatgacgggtcacaggaaatgaatgtgataacaacaggaagtgtattatggagatatggttcaatacaagcaagaccgagtttcattctgtctcccaggctggagtgcagtggtgcaatcttggctcactgcaatctctgcctcctagattcaagagattctcctgtctcagcctcccaactagctaggactacaggtgcgtgccaccatgcccagctaagtttttgtattttttttagtagagatagggtttcaccatgttggccagggtagtgtagaactccagacctcaagtgatccaccgacctcagcctcccgcagtcctgggattacaggtgcgagtcatggtgcctgtgtatttcctttttaactttaacagattttatttgaatagataacatgtttacatatttctgtgatggcctggtttgcctgtctggtttacaaataccaataaaagaggatacaaacaaatggaagaacattccatgctcatagataggaagaatcaatattgtgaaaatggccatactgcccaaggtaatttacagattcaatgccatccccatcaagctaccaatgactttcttcacagaattggaaaaaactactttaaagttcatatggaaccaaaaaaaagcccgcattcccaagtcaatcctaagccaaaagaacaaagctggggcatcacgctacctgacttcaaatatattacaaggctacagtaaccaaaacagcatggtactggtaccaaaacagagatatagatcaatggaacagaacagagccctcagaagtaatgtcacacatctacaaccatctgatcttttacaaacctgacaaaaacaagaaatagggaaaggattccctatttaacaaatcgtgctgggaaaactggctagccatatgtagaaagctgaaactggatcccttccttacaccttatacaaaaattaattcaagatggattaaacacttaaatgttagacataaaaccataaaaaccctagaagaaaacctaggtaataccattcaggacataggcatgggcaaggacttcatgtctaaaacaccaaaagcaatggcaacaaaagccaaaattgacaaatggcatctaattaaactaaagagcttctgcacagcaaaagaaactaccaccagagtgaacagtcaacctacagaatgggagaaaatttttcaatctactcatctgacaaagggctaatatccagaatctacaaaaactcaaacacatttacaagaaaaaaacaaacaaccccatcaacaagtgggcgaaggatatgaacagacacttctcaaaagaagacatttatgcagccaacagacacatgaaaaaatgctcatcatcactggccatcagagaaatgcaaatcaaaatgacaatgagataccatctcacaccagttagaatggcgattattacactgttgctgggactgtaaactagttcaaccattctggaagtcagtgtggtgattccttagggatctagaactagaaataccatttgacccagccatccattactgggtatatacccaaaggattataagtaatactgctataaagacacatgcacaagtatgtttattgtggcactattcacaatagcaaagacttggaaccaacctgaatgtccatcaatgatagattggattaagaatatgtgaaaaaaaaaaaaaagaatatgtggcacatatacaccatggaatactatgcagccataaaaaaggatgagttcatgtcctttgcagggacatagatgaagctggaaatcatcattctcagcaaactatcgcaaggacaaaaaaaccaaacaccgcatgttctcactcataggtgggaattgaacaatgagaacacatggacacaggaaggggaacatcacacaccggggcctgtggtggggtggggggagcggggagggatagcattaggagatatacctaatgtaaatgatgagttaatgggtgcagcacaccaacatggcacgcgtatacatatgtaacaaacctgcacattgtgcacatgtaccctagaacttaaagtataataaaaaaaaattaaaaaaacaaaacaaacaaacaaaaaaacaacaaatacccagggatgtgcatttagaagctgccaagacattaagcacccaagaggttctttttggtctgtgtctgtgcttctcaggtggagctgatggctgtactttcttgaattcagcagttgcatttccagcatgtgaggaatgtttcttactgctttcagggatgggcttaatctgagagtaacaaaactcttatttcttccccctggggcctttaacacttcaacatgtgggactgggaatcatcttttttaggaagtgagagaaattgcaagtatatctaaacatttttgagtaatacaatctgcgaaaacagttttattattcaacacttctgaaattgaatgtgaacatgaaataaacaaaacaaaaccaaagcaccataggactgaatggtttgcacaggagatggaaggattaactagaagcctgaatatctttgttggctttatatacttaataggcagccaataggaaataaattgtaagcaaaagcatgtattcctatatgccaggaaaattaccctgtaaatactgaattatatgtggctaatcaatattcataatttatcagatttcttaaacttatatttgtaagaaacatctacagaatagttgtttggcttcattaacttttgattcttatgtagatatatatttacatgttttgatggtgttgaaaggcaattcaattgtaaataataatttcaaaatatttctgcagagaaaatgttaaccctaaagttcggaatgattgtagaaaagtaaaacatcttgaaagctctttctaaggaagtaaaaattaagaccaatttattagtaaaataatttattaagtccagatcctaattttatgtaacttgaagcctttaacatatattttaatagttctgtcaaatacctattaatctttaaaatatcttaaaaatctttttaaaattctggatttctcctctataatttagattaaataatgataaagggcagacaaaagatgataagtcctttaaggaaaatatatttacttcacataggttttatattttttgtaatactcccagaatcataaaatatagatttttatataatttaacagtgtttggcaaaacatttggcatatgatagttgtatccttctggattttgggttgcaagccataaacacaacatctggctaagttataagaaaaataatttattggaagtgtatgcggctgtcactcacagatttgatgggaagactggagagaatcaggctcagaaaatggaaaggaaacaagaaagcctcagcatcaacattctcagctctggtcacattgtagagttgtctagtgtgatctccatggccaaacaccactgctgctgcaagctgccaatgggaataaatatatcttttttaggaagtgagcctttgtctttagatcccaagctcaacattcagcatcctaggtagcagcatttaatctgctgaatctaggtcaagtgcctgcatccttacttccaggagtatggagagacagggtctgatccccttcagcttgccaacttgcactccaaccaagacttaaacaatggaggaatttccaccaccaaatagaaagaggttttggacaaagggaaactaagcaaaaacagatgtcatctaaatgtggcatcccatattatacagacagttgattcttgttatttgcagtagttatagtctataaagtcactgaaaacactgaattagagagtgctaagcaattacctttagagaaaatacaggtatagtttcctgtgaacctctggtcacaatattttcatcaaccaatcgatacataaccttgctttgtgtgtgtttctctttaaagacgccttatttaatatatattgttgattcaacaacattgaactcttggccaacagcgttataactcatgcctgagcaaagcttatctaacacgtcttttctccgtaagtcacatcatagctttgttgcacttagaaatgctagatagcacttgggcactctgttgggggccattttaaacagcaaaattaccaacaaacagcacaaaaatgcaaacaatgtaacactagacagacctcaaaaagcacactggtttacagtgtgagagctgaaacaagaaggcagagcatgaacttgttcaacatctgctgggaatgtgagcatcgggtagccccaattttctgcttctctgcagatgagcatgtctgcgaatggcagcagaagtgacatgaatattgatttggggctacaaataaatttgccccaaatttatgtttctgtattcacaaatataaaatctgtgagcaatgaggataagctgtatatatgtgtgtgtgtgttaacaaatatacatacctaacaaatactactgtttttcaaactgtaaaacatatacatgcatgtaaaagctgggattatgtaagtcagtgatatagcatatacaaaaattctgtactgtattggcactgaaaccactcaatcctgaaaattcttaacatatttccattattagataaatgtgataatgttaggaggttatatatatttgctttttatttgattgtccatgttaaatgttaatactttgaaaacctttttgcatctatgaatttgactatagtttgtgagtttagttttacttggatacatcaaaatctttcagccattattcaaatattccttaagaaaaactagtatgcatgtcctgtaatatattttcagtttctaaacacattcaaaggtaattatctaactaattaatcattctccatctttgtccaaatatataaatgtttattcaaagattaaaataaatgttttatttttttcacacatctgatgagttgaatagacctcatcagtcaaatgacttcccaggacacttggtaaattaaaaattttgaaacacaaataagcctaactcccatcagcatttccacctatggtttctttctagcagaactagcagaaagttggtatagctttgtgtcttcaataccttaatgtttctaatctttcttaggtatctcttggctcactgacttttgacatttggtttctgtcaatagagatgatgatataaaatacatcttatgaggaaatgaggaggaagagctatcagatccaaaaactatgtcccagatggaaaaccttgccagttcaacagttatttgttggcattgttggtacctctggcaaaggtggatcagaaggatagtcttaggacaggtttgaggcaaatgtttggatcaaagatacaggagacttttacatcaacataaggttgattaagggaggcagaaccaaaaaaattacaagtatgaacggtctgccagacaactcagttctagactccgaagacctgattgaaatatatcagaaggtaacattcaatatctaagaaatcagagaatgattatgattgatcctagaaattgcaggctgcttggcctctgctccatttatagtacttgctagagtgggtaggctcaggtcttgagatatcattttaagcaagaaggaggtcaaaagtttacaggataaggtcagctatgctagaattagcttttagaaataataggtctacaataaaattagatacaaatgtatgagtttcctagggaaggtgaattgagttcttgtaaaataatagagagaaatggcagatattctaagacctaatatattttatatattcatttatctgaagtaaaagcaatttctcatgtctaaagtaaaaagaaataccataatttattgattctaagatgcactttttacaatttttaacatctctgaaacctggagacattttaccatcaatgacatcctacaattaaaatggaatgattctttatctttaaacataaaataatggggcaccttacaaatggcgatgaccaaaatatgataaaatatggtaacgcagacatcccttgataagcgcaaactggttccaggactccgcatatacccaaatccacacataatcatttgtagttggccctgtgaaacctgcaggtatgaaaagttggtcctctctatatgcaggtttgtatcctgtgaatactaggtttggctgaaaaatatccatgtataagtggagttgcacagttcaaatttgtgttgttcaaggatcaactgtatatcctaaattaaaaacaaaattccttagtgttaaaaaaatataattgggaagccattagcctgagacagttctagtgctttgggttcctatttaagcgaagagaagttcaactcaaggcaaaaagtaaaaggaaactgaagtttaactgagtagaaactgtcaaactagcctctaattagggaattttgatttgaaccaataaaaaatattttctttgccttgtttctgtcggaagcaccttataaaagttccccctgggtatagcccaaccacttatggtctgacgctgctggggtcatgaatcgctgtttactcaaataaactatttaaacgttaaatgtgcctaagtttaccatttaacgttagtaaaaacaggattgatatctgtacaaaatatgtattttttaaattgtactttaagttctgggataattgtgcagaacgtgcaggtttgttacataggtatacacatgccgtggtggtttgctgcacccatcaacctgtcttctacattaggtatttctcctcatgttatccctcccctaaccccccaactccccaatagtccctggtgtgtgatgttcccctccctgtgtctatgtgttctcattgttcaactcccacttatgagtgagaacatgcagtgtttggttttctgttcttgtgttagtttgctgagaatgacggtttccagcttcatccatgtccctgcaaaggacatgaactcatcctttttttatggctgcacagtattacatggtgtatatgtgccacattttctttatccagtctatcattgatgggcatttgggttagttccaagtctttgctactgtgaacagtgctgcaataaacatatgtgtgcatgtgtctttatagtagaatgatttataatgctttgggtatatacccagtaatgggattgctgggtcaaatggtatttctggttctaaatccttgaggaatcaccacactgtctccctaaaatatgcatttttaatataacattttattatttcaacttagggatcaacggtacccctttggatgtcttcctgttgggtcaacttcctgttattttatacgaaattctttctgtgtgtgtatatgtgcatttttctccctaaagagtctgtagttttcatccaattctgagttagtaattcaaaaagtggaaaacatctcaaataatcataggtggttaatttttaatagtccaaataatgattacataataggtgataaataatattttctaattattacattaaagtaatttgtataggtgacgttttttctgttttgattcctcattacagggcaattttccatagcttaacagatatgaggccacctagatttatagcggaatccttcatctatagcaagaaaaagtagaaaggaacctctactatttgagttctcaaatacgttgctgtattacatttaatgtctagaaaatagagtcagtttttatatcgactttaaaaattaagtataaaacaaactatacttttgaataacttctaatttcaaaaaataagatgttctttttgtaaaatacatgcaatggtaagaaaaaaatgtcagacagtatctaactacagagatattttacctccctgattagctgtattcctaggtattttattttatcttttcttttttgtggctgttgtgaatgggattgcattctttatttggctctcaggttggacattgtatatagaagtgctacagatttttatacattgactgtatcctgaaactttgctgaagttgtttatcaggtctaggagattttgggcaaagactatggggttttctaggtacaaaacaatatggtcttcaaactggggtagtttgacttcctctcttcctatttgaatgccttttatttctttatcttacctgattgctctggcgaggacttccagtattacattgaataggagtggtgagagtgagcatccttgtcttgttcaggttctcagtggaaatgcttccagcttttgcccattcagtacaatgttgattataattttgtcacagaattacaaaagactgctcaaagaaatcagaaacaacacaaacaaatgaaaacatactatgcgcatggattgcaagaatcaatactgttaaaatggctatgctgccccaaagcatctacaggttaattgcagttcttattgaactactaatgccatttttcacagaaagagtaaaaacgattctaaaattcacatgaagccaaaaaaggtcccaaataaccaaatgaatcctaagtaaaaagaacaaagctagaggcatcaccttaccccacttcaaactatacaaggttacagtaaccaaaacagcatggtactgatacaaaaacagacacatagaccaatgcaacagaatagagagcccagaaataaagccataaacctacaactgtctaatctttgataaagttgacaaaaacaaggaatggggagaggactccctattcaataaatggtgctatccaataaatggttgaatagcggccaggcacagtggttcatgcctgtaatcccagcactttgggaggccaaggcgggtggatcacaaagtcaggagattgagaccctcttggctaacacggtgaaaccccctctctacaaaaaatacaaaaaattaacttggcgtggcagcatgcacttgtagtcccagctgctggggaggctgaggcaggagaatggtgagaacctgggaggcagagcttgcggtgagatgagattgcaccactgcactggagtgggagacagcctgggagacagagtgagactctctctcaaaaaaaaaaaaaaaaaaaaaaggttgaatggcatttcaaccattattaaggctagccatgtgcagaagattgaaactgtacttcttcctttcaccatatacaaaaatcaactcacgatggattaaagacttaaatgtaaaatctaaaactgtaaaaaccctagaagaaaatctgggaaataccattttggacataggctctggcaaagagttcatgatgaagatgccaaaagcaattgcaacaaaacaaaaaaaattacaagtgggaactaaattaactaactttaattgaactaaagagcttctgaatgacaaaagaacctatcaacagaataaacagatgacttacacaatgggagaaaatatttgcaaactatgcatctgacaaagggctaatattcagcatctataaggaacttaaacaaatttacaagcaaaaaccaaacaaccccaataaaagtgagcaaaggacatgaacagacacttttcaaaagaagacgtacacgaggccaacaagcatatgaaagaatgttcaacatcactaatcatcagagaaatacaaatcaaagccacaagacatactatctcaaaccagtcagaatggaagttattaaaaagtcaaaaaataacagatgctggtgaggttgcagagaaaagggaacacttatacactgttgatgggaatgtaaattaattcaaccactgtgagaaacattttggtgatttctcaaagagctctgaatataatcaccattcaaactagcaatccattattggttatatacccaaaggaatataaattgttctaccgtaaagacacattcacacatattcactgcagtactattcacaatagcaaagacatggaatcaaactaaatggtaataaatggtagactggattaaaaaaatacatatataccatggaatactacacagtgataaaaaagaacaagatcatgttctttacagcaacatatggagctggaggccgtcatcttaagcaaacttacacgagagcagaaaacaaaacacctcatgttatcacttgtacatggaagctaaatattgagtacaagtggacacaaagagggaacgatagataccagggcctacttgaaggttgaaggtgggaggaaggtgaggataaaaaaactacctattagttactacatttatcacctgggtgacaaaatatttgtgtgtccgacccctgtgacacacaatttacctgtctaacaaacctgtacatgtatacttgaacctaaaataaaagtaaaaaaaaaaatctaactacattcggatcttcattttggaagaaaaattggaattgatcagataaatgaattgtttaagaatgaactctcatcagtaggtctttgatagtgaagggcaaagctctggccactgtggagaggtgaccaaaaaaagtaggtattctttatttaaaacaataacagaaaatttgggttttcatttatctattgaatactcaggaggtaagatgttgggttgccttaaagattcaaaggaagaaggaaaatgggtaagagtgtccctaaaaggggagcaataatgtgataaaccgggaaacacaaaaagggaactaagaaattctttttgtcagagatagctagaaatttagtaacaatagtggctgtcatttagcttttaatctttatttttttgttctgcagcaattatcctctagtataccatggatttggtaaaagattcacacaataatattatgttcatcatataaaagtacagacatttgagaacacagtttttgcagccaagcttacgtaggttcgaatcctgactctaacacatgactatcagcctctcagtgtttcatttacctaagctccagaatgggagtaaaatgtactgaatccacagatctggtcaagattaagtcagttaatgtgtataaaggtcttagaccactgctaggcatatagtaaaaactaaaaaaaaagttttggaataaaatgacccatagaaaactagagcagcctgtggaagcattgggatttaactgcataatcaaaaaatgaaccagtagcagggatttagagtaaaatatcttggcaagtataagtgtcccttctgcatgcccttattgtttgtcatctcaggaagtctcagaaatatgaataaacctgttccagtttcatgggatggaggcttgaattgatttcattaggatattactaaagggtcacttgggaaggctgcatgactttggaatactttggctacatatgccaaatagaaagtgaaatttcccagtcacctaactcctcagaaataccctgtgttaacaatctgatatacagaatatactctttcactttatagtcttaatacaattattttacttttgaatgaagaaaaatgtgtctccaataatcattttaatttccctgaattgatcagcatgaaaaaaaatcttcagttttcattgctgtcaaggaaagatactgcatagaaaattgggagacatgagattgaatcttgtggctttaacttgttttagactgtgtaaattgctttattcctgaaggactctgtttcatcatattttaaatggaagtatttagctaactcatcccgaatgtgtcttccatatttaaaaatatataattttaatggctccatagcaaattgggagaatgaattataataaaagtacttctattgcctaaagcaagtttttttctttattttttggacaatagttattcaatagcccacacttaattttgtccaggtttcaccaaacaagtcacaattctaaacacttcccagtagctgggagagcgattcttcacaatttttccatatgtaggatagtttcatatctcaattatattgatttgcaagcctcttcactcttctaattgtgaaatatttattgagagccccagctgtacttcatgtaggttctcatgacaatctcagtaggcagaaggccatttgatggcagtcaacttacttgcccaacctatttttaaagagtatgtagtcagaaatacacctaccatataattcagcaatttcactttggatatataaccctcaaaaggatatcagtatattgaagagttatctgcactgttatattggccgcagctctatttacaatagccaagatatggaagcaacttaagtgtccatcagcaggtgaatgaataaagaaaatatagtacttagacacaatggagtacagccatcaaaaagaatgagattcaggcatttgcaacaacatggatggaactggagatcattatgttaagtgaaataagccaggcacagaaagacaaacattgcatgttttcacttatttgtgggatcgaaaaatcaaaacattaaacccatggagatagagaatagaaagatgattaccagacaggggaagaatagtgggggttcttgggggaagtagggatgattaacaggtaacaaaaaatagttagaatgaatgaataaggcctagcatttgacagcacaatgaagtgactatagtcaatgataatttaattgtacacttaaaaaataacgaaaggagtataatttgactgtttataacaataaattttaagggaatggataccctattttccatgatgtgattattaagcattgcatatctgtatccaaacatctcatgtaccccatacatatatatatatatcaattatgtacccacaaaaattaaaaataaaaacaaatagagaattgagtcagaatgaccaatctatagcagttggtgttataattggtggtagcagtggaaaaggaagcagacagatctataacacaatctgagggaagaaatgaaagagaaagggatgatcagctatgtcctcatgatctgacatttgatatctagctatcacaccagataaggcattaatttctggaacttttctttatccaacttcctgaagttttgtcactattattctttaccacctagtctgcagttgtaatattacttgatagaagtggattttctttagaaccagtagcacataaagacattattcatttagcaattgagatttaagttgtcagatttgcttctggcacaaagactaataaactgggggccattgtggggaatactgtggggaactagaattgggaaaactcaggataactgaatacacattggcagttggaaaggttggtaaaaggagagtgtataaaaggaagagggagctaatagataaatcctctgaaaatttccttgaattgtatattttccggaaagctggccctcaatcaaagttcctaagaaacggaattaattgaaaatgtagatgctctagcttgagatgctttgaatttatttattcagctcaaggcatttgctcttcatatatgttattttaggattatgatgccagatgtttcttgtgcgggatactggcaatgaaattctttacatatttaccttttgatttctatcttggaggcttgactgaatgccacatgactggaattaaaataaatacacaatccaacttttaagttaagctttgataacttttctcacatagatatatacttaacaaaacttaatatcattaatagtaggcagttttctcaatttttgttgattctatcttgtctgcaatcataccctgtgaaataaaattaaaaatatataattacagtcctctcggtaggctgttgactattttgagttaaaaagcactctgtgctggcagcagaaacacagaggcagcagtctaatttcctctatttcactaggtgcctgcttaattgcaaccttccatttaccagctctctggcggcatgccatttttgcttgtatattttttcattcagtttatcattcatttgtatttcatcgagtaacatataatagagactgcgctgtttgctctgtagcttgtgcacacattcagttgagccatttctatattttgtagagttgattttaactcagagaagaaatacatttgtataaaaatttagacttcaaaaggttttgttaaggtgtctcagaattatgagaaataacagaagagtgtaagaatcattttagctgtcagattgaagagtaagatgatagactgaaaggaatatgaatcgatgttagtggaagagttttgctgtcatataatgtattgtgttaattatttttaatggaagaaaagattcttggtaccagttttcaaaaccgttatcttgtatatgtatgtagataatgtaattcttcaaaccatccaattatttaatgaagtcaataaatcaaaaaatgaaaaatattcactaaatatacaattatatgttattgtttatatacatttaattgtatacatgtaaaatatacggagtttcttttcagctgaagcagttttgttatttttgtggtgctaaaattgtatataatacattaggtttaatagaattagagatatttggtctggtttacagtaaatttattcaacttagattgtaatctacatgaagccagagagtttatctaacttatttagcaacatattctgagactaccacaaagtaaattcttaatgttattgaggtacataaatatcaatatttaagtggtttttttcctaaagagacatgcagttaagatttacaacattgtactgtctttgtgaaggttctggtcaactgttatgaaaagacaaactcaggaagatagtagagaagctgagatgaagataattcaatctagaactttagaatacaaatgttagcttttgtcaggctaaaaaaagattcaatatgaatgttggcttttaattttatatttagagggaaaaaagatgaccgggagttatgggacgaatcaaatgggaaggtgaacaaaggattacttcagagtgatgaaaatgttttacatcttgattgtggtggtggttacatttctgtatccatttgccaaactcagagctatatgcttaaaatgggtgttatttactgtttgtaagtaatattctacttcatatatctataatacgttactaatatgtttgcaaataaaattttacttgttattactgtttgtaagtaatattctacttcatatatctataatatgttactaatatgtttgcaaataaaattttacttgttattactgtttgtaagtaattgatttaaaaaatgttctccaggaggaaaaataaataaaaaactgaaaataaaggcaatagttgacatggcattttttaataggctctagccagaaaaacattctaaaacataactagaagcctgatctggaaacaattcgccaacttggaacatgttgactagaaaatcgatgactgtcattttcattttatttttcaccttttctgactactagccactgaataaggaatgagagaaaatattagagcccagaaagaatcacgaaatctccttgaactcttagattacgattagacagtaaattaaaatgaggatccctcatttctgaacaagcatatttttataatgacatcaaaattgttttttaaaaatagtttttgtctctaattttcctgtcattgatcatgtttattcactcagcaacattcctgcctcatttgctgggactagcttaacatttggctatgctttgagggtctgtcatgaaaccttatctgacttcaaattatgtgatcctttaagtttctccacaagaatgcaagctcagtcatgtagtcgcagtggttagcaatgaaaccattatgtaatgtactataaataagtaactcagggataaattaatctctccattggattttcagaacttccttcaagaaagtagctcagagcagacagttacgggttttcgtgtgtgtgtgtgtgtatgtgtgtttaccactatcttctacagaaaagtttataatatgttcttatttaacttttagtttccaatatcttatgttcaaatgccaattctatttgcattgataatctatgagtctgttgtaatgatcatttttcatagttattggctgtccactatgttttcaacactctttaacatgttttgggggaattttctcccttatttataaatcctctcttctcagagaaaatgccagaaattttatttcccaggctcccttgcaattaggccatgaacatgcgacctaggctctaccaaatggaagcatccattcaggagtatgatttgcaagaatagatatcatgtactgttacctcatgtatctaggcataaacttgggcacatacagtagaaacaggatcttgctttgtcacccagactgggttgcagtgatgcaatcgtagttccctgcagcctggaatttctggtctcaagagagcctctcaccttagccttttgagtagctgggattacaggtatgtgacaccatgcctggcaaatgtttttatttttatttttttagagaaagggatttactatattgctcaggctagtcttgaattcctggcctccaatgattatccttccttggcttcctgaagtgctgggattacaggcttgagccactgcacccagcctcccaatgactaattaacagagaagaggaaagagagtttgatttggtttatagatcacccttcatgttatataaagaacatgaacctctgtattgtgacagtagtactcagagatgttcctaaaagaacatgggaaagaataattattttaatgtgaagaatgttgagcaactttccccattgttcttttgtcttggaaggtggaaatatctgaagtactgttccacaatcattcatggatattgatgaatagtttttttttttttttgagatggagtctcactctgttgcccaggctggagtacagtggcccaatctcggctcactgcaagctccgcctcctgggttcaagctattctcctgcctcagcctcccaagtagctgggactacaggcacccaccaccacacccagccaattttttgtatgtttagtagagatggggtttcaccatgttagccaggatggtctcgatctcctgacctcgtgatccacccaccttggcttcccaatgtgctggtattataggcgtgagccaccgcgcccggctggggaagaggtatttagatagataacaaaatgtacctacagtgtgtaattattttttcccatgtgacttatcaactgaagattgtcactgggaaggagatgagcaatattctgatagaaaagggtgatccagctaatgaatgtcagtaaccatgccgatattgagtggagtcattcttgcttttacttgtttttgattgtttttgtttttgagacattctcagtctgttgctcaggctggaattcagtggtgtgatcacaactcactgcaccgttgacctccttgggattaaacagtccttctgcctcagcctcctgagtagctgggaccacaactgcatgccaccatgtccaacaaatttttgtattttctgtagagacagagttttgccatgttgcccagtgctgatctggaactcctgagctcaagtgatccatccgccttggctgcccaaaattctgggattacaggcatgagccaccgtgcccaggctcattcttgtttttgtgagattatgcactggatcagcatgtccttcccttagcactatctgaccaattattggctgtatttgatggccagttcaccagtggcagaagtcttagaaggcaaaactcttaacctctgatattaatagtatacctgggggtgaggtatgaactaaccaagaagggttaaacaaattacttggtggtaggctgatgatactaaacctattctaccatgaattagactgtgatttgacctcactggaattaattacaattttggatttggaaatttggatttcctccccctcttttccagagacaatatctatggacttattaaaatgccttgtctacaattgtggtgtcccatataccaatgcttttgaccatggaaatgatttttacagaaacggaagtcatgtatagatatatactgtttggatttagagatatagctaggcactcagtcacccaaaagctgctggtcttgataaaagtgtgtaagattattgaacacatattatggcaccacccttgtgaagctggaataccatcttgcagaataaggcagaagcttcttccaaaaataagaaaacaaagagattgaaagccagaatttcacgtgtcacttttacgtcttatgatcccttaacaaaaactatgtttcatattctatgacctttggcttcgttggcttggaagacgtagtgccggagtgaagaatgcttccaacatgacacccaactatatttttgtagaactaggagctgagactattacataaccatttcaagctttttgtgccactgtatgaataggtcaaaaatggaagttatagttttgctggggtgattgaccctaattatcacagacaacaagggctgacacatgtagtacagaaatgaatatttaaaatacaggggatactctggccttcatagtgctattatagctagtagtaaaatgaatggaagatccatggatgcgtacacagcaggcaagaccaccaatccttttgtatttaaggaataaaatttcatttactgtgccaggtaaggattctgaacagctgaagaactagatgaggaacagttgaggaaaaagaattctagaatacatgatagagaaagaaaattataacttgaaataatgagcagttccagaaatgaggaatatagtatctactcacattccctgtagtctcttatacatattcacatatttcaaaatgtttttcctctctcccttccccctattattttatatttatatgttcttctttcacaatgtagtccataagttaaagaatataaagatgacattatgatggacttagaccagtgatgtctaccacctagatatcttagtttagaattggatggagaaacttatgaggctttggatttgccatccttttagaggtagggcacttgtattttcatttctatgaagaatagttccattatgttaagctgtggcattttcttattgttcaaagtttaaatatattttttaaaaaacctggtgttgttgggaggtcacaaagcagatagtagcagatggtaggatatttggcaccttttgtggccatcagcgtgttgtgaactatgttgggaattatcaatgttgtgaatcccttctctctaagacagaggttccttttcccagcttctcttataactgaaatatagatatttaatataagctctacctatcaggcacattgctcaagaattctgcttggaagacagtgacatgaagaaggaggcattcataggctctttcaggcaattttggcagagccggtcgagagatttcagttttgggagtataaccccagaatctttaatggctgtgtccaggatgtgcctctagtcttttcttaggaactatccctggctctgtagcctctaagaatgatcccagagaatctgtgggccacccaataattaataaattccttttccttttctacctaacctgctggaatgctttttccccatatgtgtctatttatttacagtatgctccctgaacataaatgaactcaaagaacaaataatctgaaagaacacctgacctacatgcatacatacttgtgggtatgtgcatgtttgtctatgagcatgtgtgtgtatgacatgggattaattcagttttaatatttccttgtttttagagcttctactctgtaagttttcacattttcattttatacttatttggtgaaatattttccaagcgtccaaaaatagaaaaaaatagattttgaggttctcagtgtcacccaaagaaaacttttgaaatagtctcacagtatttttctcttttcaaaagaaaatttcaaggtatttctactcaaaatttcattatcaagaaaatatcctcaattttactaacttatataaaggagtatatatatatatatatatatatatgacttccagaacattatttcttactgtttaaaataagccaggcacggtagctcatacctgtaatcccagcaatttgtgaggctgaggtgggaggatcgcaggaggccaggagtccaagactagcctggacagtatagtaagactcatggtctataaaaactaaagtaaaataaaataattgttaatagtttgaggctggaatttttattctttgttcagtgatctggaaagtccaagcacttattaatttttctgttatttcttttcttttttttgaggcagagttttgttctggtgcccaggctggagtgcaatggcacaatctcggctcaacacaatctccgcctcctgggttcaagcaattctcttgcctcagccgcccgagtagctgggattacgggcacccgccaccacgcccagctaattttttgtatttttagtagagatgggggttcctccatgttggtcaggctgacctcgaacacctgacctcaggtgttccgcctgcctcggcctctcaaagtgttgggattacaggcgtcagccaccacatctggccaattttgtttgtttgtttgtttctatagtacatatacattttatggaagtaaatttgtattttaaaaaatactcttgtaaacatttgttatgatttgttttcattgtcaatgtctgttttcattgctgatcaagcccaaattacttagtgaatgaattgtacacattttcagtgaagttaggaatgtctaaaacagtttttaactatttaagccagtagatcatgacaaagccaatcttgtcacttggtcagcttactcaaattaataaactggccattttccagtgcagtgcttgtctctgaaaggccagggcctcattcagggtatttttccttagcttctatctggcccttatacctgaattaggaatctgagaggaataacatttggagaggtttataagctcaagttactattgtatttctcttgctgtttagggtagaatctagtcacaattaaaagaaaaaaggagaagcttcccaaaatgtccgcccttcacgcctcttgctgttcagatatttcctctgggctttccgccctgatttcctctggtttttagtgcttttatttttcattcaagcattagaagagggagtacttaaaacaaatagaccaaaggaattatgtcctatgtggtatagatccaagagctccgttctgatgtcttcaggggacacagaacaaaacaactgggcctctaagggcttttgggaggtgtaaggaatctggaaataatccagctatcctcaccagagtttgtgtgcagtcctggagtcgtcagggattacgcatgaaagaaagaaattctctcctctgctcactggccgcgcagcaggcaaagcactaaatctcctggtcccttctacttgtggattttaattgatggggctggtacacagagtaaagccatttgggcacaaatgacaggggttggcatttaaacaaaaatggcaattttaattttatcttcatccaaattagaaaggcaaaaaaaaaaaatcaaaaaagaaaaacctcgttttttcaaacgaaaagtgagtttttaaaacctttggtttgcaggaattaaaaaaaataattaaaacaaaacttgtcgatgtcattttaaagtggttggttaataagctttggctcatgatttcaatttgaaatttccctagactaccctgtttatgatagaagctgaattttacagtggcattttatgtgcctgggctacatttttaagcccagtcctgttgtttagggccagaaatggacacaatttaattctgtttattatagaaatcaagtgcttttggaaagagattgtgagcagctgcttagtattgtctttgtgttaatatagaggttcatttctcatgccttttgaggaaaaagcagttcatgagatttctagaggctcttttctacagaaatataggttggctgccaggatttagcagcaaaagagatttgctgttaattggtggggctggatgtctctgacaggtgtcaaattaagacatgtactccagtagaatttctagggttgtgcaaagaagacatcagtaatcaaaatagaaaaataaaacttttttttgttatacaatttcccagcgagtttttaatctcatgtagctgaattcaatatgaagaaagtttttggaatgaggatgacaaggattatttccactttccttagaagactgtgttcatcgatggttaacaaaattaattttttatttaaaaaacaatctagttaagataattgagcaaattttaaggtgagatgatggttttaataattgcatttacaatggtaagtaactgaaattcacagtctcttgaagcaggcccttgcatatagcatttgattctttctacaatgatataaagaacctattaaatttggtggaaaatagcaatggcatttagttcttaagctatttttttatgtttggtaacgatatgaataaaaaccaaggatgagacattcttatactctcataatggctggctctgtttctccatccactatcttaaatcttagggtccctttttcttagtgctaagaaagtgacagccaactgcatctcagaactgcagcaatgctgagtcaataaataaaaatatccaggtaatttccttatccttaagtgaagcttatgaacataagttatactgaactactttgaaagttggaataccattgaggaattattaaatggaatagaatttgtactacacccacattttgggcaaaatactcatttaaaatatgccttaaggaatatgccttgaggaaatatacccagtggatttctaaaagcattctgtggtcttataggtagactgtgatttctgcattaagactacatggggtgaggttatttctgtctgtgttccatgaatactttgctttacatgattttagaaaaactagtttgaatttcttcatttattgatttatccttctgttaaaaaaaagcactaattttaaaatttattgcagaaaaaaacacttttggactgagctatataaaatgactcagaagtaaaacatataagtgtcagatagaatttgccaccagtctgcctaaaagactgaagtatttgagtatggattatatttcatccggttggtagcactttgtgaatctgcatttcaggatggcctgttttcagtttccaactcaaataagagtattattgaattagttggcaatcaaaatatacagtctcgcaccctggaaacttgatttgtgaagaaatctctttgaaataaaagaggttaggtacgtatactcttttatggaaatgaaaatgcataatatgaaatttcagttcttgagactttttggataccaaattagcactcaaactcaagacctcagaaggatgttggtgcagcagggtgagaaaacttggacctctgataactgcagtgctgctatctccactctggactgccagagtgaattacagtttttgtttaaatactgtaggcctgtttgtctgttttgtcatataaagttgaatataacactaactgatagcatttaattaagtaaattgagctcagtcaactgtatgcatttctctctcgctctttccccctttctttttctctcttgtctccctccccactcctttccttttggattggtaagtaatacagacacatatgcataataaggccataggcattaatataccaaaatgtacttcaaacaaaaggaaataaagcttgattttaagttccaggctctgtgttcacacttactttctctactccacagatattttaacaatacttatcatttatatgcataatcccccagtcctttttttttcaatcaagactacaatgatggtgaatgaaataacatgagaaaacaaaacttgacatagagtggacatcaaaaaatgctatttgctctttctctttcctttaaggaatgagacaatggtatagttcacatatgaatttggagtacttttcaggttttgaaaattgtgttattcttttacatgttttaaaataaagtagctgatagtaacacctacttgtggtatggaatactatttggaaaagggatggcaagtaaatttatatcctacagctgcaaattcattgtcctcaaatggagataaaactcaaattagctgatgtcttttcaaatatagtacaatttgtatcctcaagaattttattttattttgtttattattatttttttgagatggaatctcactctgttacccaggctggagtgcagtggctcactgcaacctctgcctcctgggttcaagcgattctcctgcctcagcctcctgagtagctgggattacaggcgtgtgccaccatgcccagctaatttttttgtatttttagtagagacagggtttcaccatgttggtcaggctggtcttaaactcctgaccttgtgatccacccgcctcagcctcacaaagtgctgggattacaggtgtgagccaccacgcctggcctttttttttttttttttttttaatggacaagaggtttttaatgttgcccatgttggccttgaacacgtagccttgcctccttatgcgccaggacaacgggcctcagccaccagggctcctatcctggagaattttatagtctttgattacgtaaacctttatcagccaataggaagactggtatttcatatacatggtctccagtattctacatatggaataacaattcttgtcttactgtatatgaggaaattggtggctttctttacatggctgtattatctgctttcacaccttagagagaaagccatcagctgaaccatttacttttcactttcttgaactgccgcgtgggagtacatttaaaacaatttgaactttatacatgatgagcatgatccaattttagtcttgtcctacatttccaaaaaatgtggcttattttcataaattacttttacatatgtttctgaccctctgttatggttatataaaaaggcaaaatgcatggaaatagtaccagacagtcatcctgttttaatacaattttcagtataattgtatgtgctataaagtttcaaataacatttgaatcaacaggcaaattttgggggtgcttaagttgaactgaacttctgaacatcaaagtttgcttttcagtggttaaagattgttttagggaaagtgaataccctctgtcaggtcgagagttatttataattttttttttacagtctagcctgctacatttgacctctatgtaccttttccacttagcttgctagtgagaaatggaaacattgatttcagaaaatgacaggtattttttcctaaggtggtggatgcatattttgaattgtgtcctgttatatccaaattgagaaacgataaattactagatgtgaaaaaatgtttataattcatattaaattaagcttatggccagatgacgtcaactctcactataaaagatgatgttttccatttaataacaacttttatatagattttataatgctctcccacttaaaaaatgcacatgtgatcccaacaactccgtgaaatttcttattaatgtcattttactggaaatgaaggagtcttagatgtttaaggacaagctgaacatctggttagtttttgaaccgagattgttatagtgggtggttagtcagacagtaacagggcaggagaggcccacacactccaccaggaaagtcaggcaaccatcaggtgatggtcaggcagttgtcacattgcctctctaaaataataataggttgcagccagcaccagggaaaggcagtctccctatagataggacacccctgaaactagtgatcagcagcttcctgataagatctcaggagctgggtcaatgagctcaagcatgcacactaagaggcaaaatggcagtttaactagtatatgatcttccaggggcatttgactggtaagggaagaatgcctcagatgagcatgcatgcaactccagtaaacacactgcgcatgctcacctatcaactgctagcaggccactgcgcatgcgggtagctcaccctaagggaagaatcaagagaaatgggacacaacacaccagaagtatgccaacatatataacctcaagtcaaagtccaaacctcacacttgacctccaagatgtccgcttggccctcttccaaatgcactttcttttcattcctgctttaaagctttttaataagctttacaggcctgctctaaaacttgcctcagtctcttcttctgccttatgcccctcagtcaaattctttcttctgaggaggcaagaattgaggtcgctgcagacctgtactgatttgccaccggtaactcgggtaacttccacggctaacaagatcttctgattttggtctgttattcattgtgtgccacaactacttctaatctcatatgagaagtctttttcaagagacagaggaaaatgaaatgaataatatagaaacagcaaaatttaatctgtgatgtatcaggtggcaagtttaagctaagccacatgtaaatgaaagttatgggggaagagaaaagcccctcagagaggaagtgtttccaaagagacaaagggtgtggttccagttccctatcttccagctccatcctgtaacccacctgaactgtcaggttcccctctatagttttttggaaagcgattaaaaaaaaaaagaaaacataaaaaatgatgaaatgatgttctcaagtgataaatagacaagtcattttattttattttattttattttattttattttattttattttattttattttattttatttcttttgagagagagtcttgctctgtaacccaggctggagtgtgg

SEQ ID NO: 2613 - DNA, 58011 bp, Homo sapiens
atgtaatatgtaaaataaattataattatattattaatattcatattataacaataatatatgtgatattatatattatatctattatatatttcctataatacatatattatattacatataatacatattatatatattatataatacgtattatatataatatataatatatataggagtttgttaaatattaacttacacaacttacacaatcacaagttcccacaatagtcggtctgcaagcttgaggagcaaggagaaccagtccaagtctcaaagctgaagaacttggagtccaatgttcgagggcaggaagcacccaacacgggagaaagatgtaggctgggaggctagaccagtctcgcctcttcatgtttttctgcctgctttatatttgctggcagctgattagatggtgcccacccgattaagggtggatctgctttccccaccccactgataacatctttggtaacactgtcacagacacacccaggatcaatattgcatccttcagtccaatcaagttgacgctcagtattaaccatcacaaatggtttatagacttttatgtttcctgtttctttttgaaggacttatactaaacacatatttgtaggaaattgttttatttagtttactaatcatgttggcacaatattaatatattattgtcacttttctgattttaaagatattttctggggaagtggataaattggtcttttcccatttgttgagaactataggtacgtttatattcaaatacttgacccagagaaaacatttggatttcactagtgtgtttctataaacaaaccaaaagtgactctaatgacagacatagacatagtttgggagaggcatgctttaaactcaagatgtgttaaaggccgtctattctatttatgaataaaactgctttgctttcatgtactaccaaggtttgttgttgttaaaaatcaattaaaaattgaaaagcatttgcaaaataagtttaaagtgtatagccaagcaataagctggctagttttgttctttcacttattgaatggtatttattaaatgcatagtatgtgccaggcatgatattagacataccacattaccaagcactgccattctcctgcctaggatgcacaatgcccttgtaaatttctagaaatcttaagaaaaacagtggagggccaagatcagcagtaggatgaaaacactgtgtcaaacagttgatagaaactaaaacattggacttcctctctgcctctcttcaacctaagtctttttgacaggagtatatttaggtatgtttctctcctagtgctattgtttatgtcagattgatgtcacctagtgagggggatcatttgtttcataccatttaaattgctgatggaatccgagtagcatatatatttctttaactgtgttattttatttaatcactgtcatttccaatagattctgagagagattcggttacacagttttgtccactcccatatggcaaaacatttttttgttttttgagaattgatagtctacaataatattgccaaaatatgagtcaatagccagttagatgagaaccattatacaattctcaattttaacctgttgtaatttgcttttctagggggacaatatttggtgttcttattgtcctttgctggaatatagatattaatctttcattctctattatcaaccttaaatagaattgtctaaacatgctccaaaggcagttcctatttcagtgcccatttaaatttgcctttaatactctgtttatcagatttccaaagaggacttcaggcatattaaaattgagtagctttcaatctaatgtgtatcccaacacaactgagtaatctcagatgctttcatcagtaaggagataatctcatcagcgatttgtttgcatgtgggtgcttttgaagttgttagaaatctccaagggagtttattcacaaagagtgactctcacaaatatttgttgagtgcccactacatgttatacaatattctagctaccaaaaatgcactactgaaataggtagttattgccctttagacttacattatattggtagaccttattaggcaatttcactgcagaggaataagagttatagtagatcaaatacaggtgctcagagagcacaaggaggtgcacagaacccagagctggaaattaagggaagacttcttgaaattacctctctgctgagatacaagcaacaacactttgctaggtaaacagctgtcaaggttgtagtttgggggttgggaataccaacagcaggaaaagcaagcaaacaacaaacatatggaatgaactggggttatatggagaagggcaggcttaaataatttaacattcattagctgaattgagtgtatactggatgaattgaagcagttttagggcatgggtctttccctctatgttttgggtcatttccttcatatatactgtaatacattcgatgcatgcatagaatttcaagctcatcacacttcctacttaggaccaaatattaaataaataaaaatggcaaaaggaggtatttggaagacagcgatggttattagtgtcttatctagtgagatgattaccaaatttagtagaagaaaacctccttttagtctctcttggctccaagttacagaaaccatatgaactggcttcatctaaaatggaattttttagaacaaggatactggtgtaccacatggaacccaagaacagggatgtgatgagcctgcatctcatgaaaaattggaacagggactctcttgctctcttacatctttacttcaatttgtttatttactttatccttttctcttgctcagaatcatctttcacattctacagaagtcacagaagccaacacacaactccagagttaaacatattaaacccctgtcatcagagagaactttcaaaaaatcttgagatgggacccattggctcagactgagtcagatgtctacccttggaccaatcaactgtggtctctgtgaatgtaggctactattattgccctatttgagttttcttcccactcatgagccaatcaactctagacagaaaagggaatgatctgaagcttggaagttctcacaggaaccctataaatgaagaagaggacaggacatgttttaagacaaagaaaaacgctatgcaaccaaaatacatctactacaataacagtgattattaaaaagtcatttaatttctctaagcctcaattttctcttctctaaaagtgtatgaattgtctattgctatggatatgtatcaaataagatactttaaaagttttaaatgacaaacttctatacagttctaaaaggttgctctgattattacactggtgtcaccaaagtggtttctagattctatttctgcagagctttcatttgtaaaattggaatgattttctctactttttatggttatggactaattaaagagaaatatctaccatttatttattgatggtttaatatatattatggtaggaggtttgcacatatttccttttttaattttcaccacagtcctataaactagatagtcttaccaagcatactgtaatgtaaacaggttaagatgattaagttcctaacatgaattagtgtcagagagaggatttaaatcaggtctgagtgattccgtgattccaaaggcaaggtggggattttaaagagccatacaataacactcttatgtgttataattttattgttcatttttataattcaattataattggtttatttctgagctagtttccttaaaatttttaatattttgccattacatttttaatgacctagtgattatattaaaaatcctatcttttatgaagatataatgatgccatactgtggatttgccaagtgatgctctactacttgttgggagaaattaaaattttaattctgaatgagaagcttgatatttgtaaacaattgcaagaagagagggataaataatcacaacttgttcagaaacagtatgtcagcatccagggaggtttctggaagaattattaacagcaggttatcatctttggtcttaacagtggaaagtacaattaaggagtagttgttagaatttctgggttctgatccacctggacagaatacacattttcttttgtaatttatattagaaataagatacctggcccatctgagcatgtatgattagtttggtggaattgtgttctaatcagaaacattagagtattctgaccatttttgtaagaaaaagagtctcaattgcatggcaaaaaccccccaaaaaatggtattctacttttatgttcttaatttaatgacatgttagatactccagattccattcaaagagatgagtgggctagcttttgtgatatttctcattactgagatatcatataaccctttcaggtatttctgaaaacacatgagacagaatcctctcttcatgaagtaatatgtggaagtcctcttcattatatcaatgctgttagtgtttacctcttgactttcagaaagtttctgtgcaatgcctttcttttttggcttcactttaggtctctcttccattaatcttgcacatatacttaatgattctctttcaaagagtgtttcctttaaggattaagctcctttgggaattaatccaaacttgtaggtttacatagcagtctaaaatcatgaatttttgtatctgggacaacaactccatccacaacacattatctcatcatttactcagagagtattcagatttctttggacctgactccttgaaagtgagctgtccttcttatgtatccaaaaagtctcaggtgtattatagctttgctatttgaaaataatatcaaagacagcatcttacgatgttcaaaggcaatgttacattatttgtttttcagatgataggactgaaattttgaaggctgaaatggcttgctatggaatacaatgtcatgtggcagattgggaaggaacactcagggcttctggctcctagtccagagtaatttttgtgctctctttacatgtcaccttcatctgcactgtatcatttggttcataaaataatatggcattcaggcagaaacagatttggtcctccactagtttacagataagaatattgagccctagagggatttttgtccaaggctatatgacgagaaatgttttgcccccaagtttaaggtatttccagtacaatttgctggctttccaacttaaaaacgttctctatggcccattaataaattctacaatctctttttattttaaacgcccttcatattttttagatttcttatatttataatattttaaaatacatgttttattgaattaataaagcaataatttccatagtggtccaccctgaactctccagggaacctgcctgctgctcttgtagtataagaacagcagcaaacagcttttttgttggaagtctacatgagttctgttgctaataaaatgaacatttcttttttaattttaatttgagttggggatacatgtgcaggtttgttacaagggtacatttcatgatgttgaagtttggacttttatagtcccatcacccagatagtcagcatagtacctaatgggaagtttttcattcctttgaccatctttaggccccctagtatctattgttcccatcaatatgtttgtgggaactgaactgaagggaacaaactgaaggtttatctctcacttataagtgacattataagtgatatttggttttctgttcctgcattaatttgcttaggataatggcctccagctgcatccatgttgctgcaaaggacatgatttcattcttttttatggctgtgtagtgttcgtggtatatatgtaccacattttctttatccagtccactgttgatgggcacctaggttgattccatttctttgttattgtgaatagtgctacaataaacatatgcatgcgtgtgtgtgtgttgttttttttttggtagaatgatttattttcctttggttatatgcccagtcatgggattgctgggtagaatggaaggtctatttttaattctttgagaaatctccaaactgatttctatagtgaagtaatttacatttcctccaacagagtataagcattcccttttctctgcagcctcaccagtatctgttgttttttgactttttaataatggtcattctgactggtgtgagatggtatctcattgtagttttgattggcatttctctgatgattagtgttgttgagcctatttttcatatgtttgttggcctttttatgtcttcttttgagaagtatctgttcatgtacttggtctactttttaatggggttactttttttcttgttgatttaagttccttgtagattctggatattagttctttgttggatgcatagcttgtgaatattttcttctattccttaggctgtctgtttactctgttggtagtttcctttgctgtgcagaagctctttagtttaattaggtcccaattttcaatttttattttcattgcaattggcttttgaggacttagtcatacattctttccctaggccagtgtctagaggggtatttcctgggttttgttttaggatttttatggtttgcggtcttacatttaagtctttaatccacctttagtcattttgtatatggtgataggtaggggttcagtttccttcttctacaaacagccagttttcacagcactgtttattgaatagaaagtcctttcctaattacttatttttgttgagtttgttgaagatcagttggttgtaggtgtgtggctttactcctgtgttctctattttattccattggtctgtgtctatttttgtaccagtatcatgctgtttcagtcactgtagccttgtagtatagttcgacatcaggtattatgcctctagctttattctttttgcatagaattactttggctatttgagctcttttttggttccatatgaattttagaatagttttttctgtgaaaaatgatgatgatttgatacaaatggcattgaatatgtagattgttttgggtaatatggacaatttggacaatgttgattcttccaatccataagcatgagtgttttttctatttgtgtcatctatgatttctttcagcagtgttttgtagttctccttgtagagctctcctaccaccctggttacatgtattttatttttttgtgtatggctattgtaaaaattgtgttcttgatttggctcttagcttgaaaatcactggtgtatagaaatgctaccaacttttgtatgttgattttgtatgctaacactttactgaagttatttatcagatccaggggctttttggtggagtctttagagttttctagatatagagtggtattgtcagcaaagagagaaaatttgacctcctcttttaactatttggatgccttttatttctttcccttacctgattgctctggctagggcttctagtactaggttgaatagcagtagtcacagtacacatctatgaaagctaacatttcttaaatgatgtacatgagacaactttttaaaatgtggaaattattttcatctaagccaaaacaaaaagtttttgtaatttttttccttgaaaactaattgatgttaatttaagaaaatcattttctgcatcttttcaaaacatttgttaatttgctaatgtacattaggaagcagttcaataattattaccaggaaactatgggtatattccaattttcccaataataaatttaaagataatagataaattaatagtacagtattttgcccctaatatttttcctaaaagttgtagactctgaggaaatcacatctctgttcactaaggttctatatgcattttctattgctgcccttatcaattacaacaaacttagtggtttaaacaacacacatatattattttatatctcgatagggagtaaattggacctgatatggtttggctctgtgtccccaaccaaaatctcatcttgaattgtaataattctcatgtgccaagggcgggaccaggtggagataaccgaatcattggtggaggttcccacatcctggtttcaatatagtaagttctcatgagatctgatggttttattaaggggcttcccccttcgtttggctctcattctttctcctgccaccatgtgaagaaggacatgtttgcttcccatgccaccatgattgtaagcttcctgaggtctccccagctatgtgaaactgtgaatcaattaaacctcttttctttataaattacccagccttgggtatgtctttattagcagcatgagaaccgacaaatacaaattcattcccttgaagttgttagactgaggcaccattctttgctggctctcagctggtggtcattctcagcttctagaggtggcctgtatttcttaacttgtgggcccttttgtcttcaaatccaacaatgtaagttgtcatccttctcctgccttctctctcctgcttttttatgtgtcatcacatctctctgaccattgctgggagaggttttctatgtttaagagctgatgtgattagattaggcctattatgataatccagcataatctccccatctcaaaattcataaccttgatcacatctgcagagcctcttttgccacaaaaaggaacattcatatattctgggaattaggatataaacattttggggtccattagtctaccataggtcctttgtaagattctgtgactcttcaattcaagtttgtgtctgcagaataactccttttgatttcagagaaataaaaaatattgggaatattgtggcttctgtgatgaaaagtcttttaattttattacaattttaaaaactttatggaaaaatgaaatctgcctcaatttatgctaagtatatatcaaacacaagcctgattttttgttaattcaatcagttattcaatgcaattaaaacaattatactcttggttgtttagtgtcaaagtgactgaaggtccattttcaaggcgtgaagcaatgccatgcaaacatagcgttgaggcaaaaaaaaaaaaaaattaaattccagattgtcccccttcttccttcttcttttcgtcctaaggaagagaggatggtattatgggataaaatggtgggatttcaaataagatacagattatttaatttggatatgtttcaaagtctcatataaggaaccaattgctcttgaaataggaaggagactttccttctggtagctcgtaagaaaggtgagctgttgcagaggaatgagagcaatggtactgtaattattgctccacacaggaccctcccgttctttttattcatttgtttatttactcaaccatattcattctgagtttatctaaaccaggaattataacaaagccagtcattctacctatagccttctttccagcttgtctttggccactctctcagaggaaaacattatgctgaattttttgtttatcttttctttgacaaaaaaatatttataggccaggtgcagtggctcacgcctgtaatctcagcattttgggaggctgaagcgggcagatcacttgagcccaggaatagaagtttacagtgagctgtgattgcatcactgctctccagcctgggcaacagagcaagcaagaccctgcctctaaaatgttttttttaaatataaattctagaactgaaaaattcaataattgaaattaattagtcaacagatgcatttattagccaattggaaaaacaaaagataggattagtgaaccggaatataggcccacagaaaatatgcagactaaagcatgggccattaactgccaggcattttcaacttgtcttacgtggtacctgaccaataaccctgaggcaaagaccagaatggggagtgccagggttgtagactgggctccaagtctgctaaatgaatttttctttatgtatgtctaattttaaaaagcaagatacaacttttttcctgacctatatttattatcaacacttttgacatcaaatttgtgggggttttctctataccaatatattctccaactctatggacaccaactttgtgtcctatgattgaattcaattctgacgctaactctcctatgttagcactgagcccacagattaaagggctcaatcctaccaagcttcacctacttcagatggcaaatgccagtcccaggttgccatctttgcttttggccaaccagttataaattggagttttctatgtcccccttctcaagttccataatttgctagcatggcttttagaactcaggaaagcactttactattactagtttattatgaaggatgtcatacaggataccaatgaatagccagattaaaagatacatagagtcaggtatggacgaggtgtgtggaacttctgtgccctctcagggtgttcccaggacctcaatgtgttcattaacctggaagctctctgaaccccattgtttagggaggtttcattacataggcatgattaattaaatcattgccctttggtgattaactcaatctctggccccactctcttccctgcaggccaggagttgaaagctctaatacttcaatcatgccttagtcttcctgttgcctagttccaatcccaaagctaactagggaccctcagtcaccagtcatctaattagcatacaagagacactcatttctttatgcagattccatgtgttttaggagctgtgtgccagggactggaaacaaagaccagatactttttataaatgtaatatgttacatttccttttaatttgatgttgtcctttaatttatgattctagtacatttatatttattgtgattatttgtatatttggagctatttctaccatttaaaacttatgttttctcctcttccttttctgtgattgagttttcatttgtttttatcctccttttctcacatcttatttgcttagaatttatacatgtaacttctcttctttagtccttagctttataattgtattgtaaacatttactccaatagagccttaaagctaaacaccatcttgatccctctcctatatgataaatgtatattaaaacattttaggttttatctttccttccctaccaatgtagtggcaagtattttggatgggatcttgtgattaaaccctgtcagtttttatctgaaaatatttttattttgtccttattctgctgcaataattaatccaagttgacagttattttctctcatcatttggaagttcttattccataatcttcaggctgtaattttagttaagaattctgctggctgggctcacacctgtataccagcattttgggaggctgaggcgggcagatcacttgaggttaggagttcgagaccagcctggcccacatggcaaaaacctgtctctactaaaaatacaaaattagccaggtgtggtggcatgtgcctgtagtccctgctacttgggaggctgaggcaagaggatcacttgaacccaggaggtggtggttgcactgagccaagatcacgccactgcactgcagcctgggcaacagagtgagactccatctcaattgaaacaaaaataattctgctgtcattttaattgatcttcttcttttaaaaatatgagctgtgctttttctctagttgcttttatgaacaagagttctttggaaaggattttggaggaaagaggctttattccagtgaatagtttgcaaactggagaaacatagcagtgtaagacaaagatacattccaaaaacaaagagagggtttgggttttatagcaaatgttcctgtctagtttctcaaccaggttcacttatgcaaaagaagaattgaactttgcttagttatgattggtcaatacagttaagccctaattggttgatatagctcagcccttggactaggacaaatgagctctgattggttggtttccaaccctcaaaccagaaatctgtcagatgcttctttcaaatgccaggtgttggaggatttctggaagcagtttatcctgacactaacaacaataactggtctgccttgattctagaaagggaggtcctatgataacttttacaacaactttctgagaacgcaaactgtgtgattgctccctcacccagccatggccacctgttttaactttgagcacctcagccacaaggaatgtattttgtctgtaagtaggggctcactttaacacgtttaagattttttttgtataattttattatgatctgtcaaatatggatgtatttttggatctgtggtttcttattttgcatctctactgggaattttacagctattattgcctttcttttgttctcttcattttctttctttttatatatttttttgatcttcaacaaaatccaaagccttctcattttgtcctctatatcctctatatcttttattttcttttatttatttttttgagaccaagtcctgctctgtcacccaggctggagtgcagtggtgcaatctcggctcattgcaacctctgcctcctggctcaagagattcttgtgcctcagcctcccaggtagctgggattataggcatgtaccaccaggcctggctaatttttatgtttttagtagagatggggtttcaccatgttggccaggctggtctcgaactcctagcctcaagtgatccatctgtcttggtctcccaaagtgctgggattataggcgtgagccactgcacttggcctctatatcttttaatgtttacttgttttgtctcattatgctacattggggataaattattttgctatgtcttcctctaatctattattcttttttttttttgagacagagtttcgctcttattacctaggttggagtgcaatggtgccgtcttggcccactgcaacctccacttcccaggttcctgcctcagcctccagcagctgggattacaggtgcctgccaccacacctggctaatttttgtatttttagtagagatggggtttcaccatattggccaggctagtctcgaactcctgacctcaggtggtctgcctgctttggcttcccaaagtgctggggttaaagccatgggccaccacgcccagcctattctattattattactatttgtttgagtcggagtctgctttgtcacctcactagagtgcagtggctcaatctcggctaactgcaatatctacctcataggttcaagcgattctcctgcctcagcttcctgagtagctggaattacaggcatttgccaccatgcctggctaatttttgtatttttagtagagacagggtttcaccacgttggccaggttggtctggaacttctgacctcagggatcctcctgccttggtctcccaaagtcaaagtgctgggattacataatctattattcttttttttggcagggggagacggagtctcactctgtcgcccaggctggagtgcaggcacgatcttggcttcactgcaagctccgcctcctgggttcatgccattctactgcctcagcctccccagtagctgggactacacgggcctgctaccacgcctagctaatttttttttttttttttttgtatttttagtagagatggagtttcactgtgttagccaggatggtcttgatctcctgacctcgtgatctgcccacctcagcctcccaaagtgctgggattataggcgtatgatctattattctttaaaaaaattcttgctatttacctaatatacttattggcctttattgagcctttaatttcaacagttataatattttatttctgtaattactatcttttcagctcaatgtgcttatttctcatgttttttactctatgcttctctttgtaacttcacttttcttttacaaatttcatgcatagctattttcttttttttttctttttttttttttttttttgagacggagtcttgctctgttgcccaggctggagcacagcagggcgatctgggctcactgcaagctccgcctcccaggtttatgccattctcctgcctcagcctccggagtagctgggactacaggtgcctgccacccacacccggcgaagttttttgtatttttagtagagacggggtttcaccttgttagccaggatggtctcgatttcctgaccttgtgatccacctgcctcagcctcccggagttctgggattacaggcgtgagccaccgcaccaggcccttatagctattttctattatgtcagtttcaaggtctgcaattccttcactttaaatctttgtttttttttttttgtctgatgattctcatacatagcagcttgattttctgtgtatttgagaatccttgtttttaaggtcatgcttgcttttaatctgtaggagacttagcctacctgaggaaagtttccttcaaggagggcttgcttctgcctttgcctgtgggtgatttatcccaggcacttcagttgctattctttcagttatggctcaggagagggctctgagacttcaatttccgtcctggtgctatctctacagcattgttccctgggggcaccgctttccaggggcacctgttgatttagtccagctcgatgccctctggctgcccactgctctgactaactgctgctttagctcagacttcccttctctatgggctgggtcccgggatgtttttcctgaagccttcagggtttcctgctttgtatccagtctgacccagactccctgtcctggaagtcctggaattagcaatattttgttggcttgtctgttttctttttggtggtggtggtgttgactccaggaaatgtttcctaccttttgtgacaccagtggttgtctccaaggaggtgcagtattttgtctggttatgaataaaatgattgctcataccttttaaatactagtgaccctggaagtaaaaacaaggtgatgacgtcttggcactgtgatatacaagtggcagtcccagaaagtagctatgtttgtatatggagagtaaaagaaccatatttaagatgttatattttgagaggcaaatgttggcattagtatctttcttgtatttgtgaccgtctaacaagaagcagcagccagagatttgtcaacattggaaaggtaaaaagtattggtagggcacagtggctcatgactgtaataccagcactttgagagactgagttgggaggatccctcaagcccaggagtttgagaccagcctgggcaacttaaggagatatcatctctataaaaaaaattaaaaattagcagggcatggtggtgtgcacctgtagtcccatctaccagggaggctgaggcaggaggatcacttcagcccaggagttcaaggctgcagtgagctatgatcatgccgctacattccagcttagctgacagagctagaccctctgtcttaaaaaaaaaaatacagtcaaatttgtgtttgctttatggaaagaaagaaaagataattccaatgctgttaagaatattctaattattaaagtattaattagctttaaatataaactattttcccttcctactagaaagcaaaaaaactgggtaatatattggccgggcgtggtggctcatgcctgtaatcccagcactttggaaggccgagacgggtgaatcacttgatgtcaggagttcgagagcagtctagccaatgtggtgaaaccctgcctctactaaaaatacaaaaattagccaggcatggtggcgcacacctgtagtcccagctactctggaggctgaggtgggagaattgcttcaacccgggagccgagatcgcgccattgcactccagcctgggtgacagagcgagactctgtctcaaaaaacaaaacaaagcaaaaaactgggtaatatatgaatgatataaatgataatctgaatatatttagatgtataattttagaggagttgatgttacattgtccaacatatgtagataatgtgtgaaaggcttctgagaattatataattttcataattcaaaatgatcatcttcatttagcccctgcaggaaactcaattaaataagggaaaatgtcttgtttaaatatggagaatttatgagtcacacagccaattcagcacaaggtttttatttccagactggtgctcttttttattgtaacctgctgcccacagggatgggtgaagaggacctttagggacaagctaaatggaagagcataagtctttttttttttttttttaatctaaaactgtagttcacttcatttaggcctctaacaaaaagtactaattagtgaagaaatgttagcaataacaaatctttcttgaattatcactgattgaaatgtcatgatgtctgttgattaaaacagtgtgtgcaaaaaaaggaaaacttacagcttcatttcttcctaatgaagtagaaattggaattcatctacaaatacgtttaattttcatggcccttgtttccatcatatgctattgaatagtcgaagaaaaaatatagggaattagatttttgtcaggaacaataattataacaggcactttatagtattcacactgtgcccagcagggctctaagtgatttatgaatttaatccatgtaatccttataacaagtccacgagttgcgattataatctctattttaaagaagaagaaacagaagcaagagatagatctacttgctctgggtcaaacaaacaattaaaatatgaacagtatgtcccaatattagtttccaaaatgaagtgttttagtaatccttatatatttaggaatgaatggcagagcaaaaatgactttagaaatctaaatggactgtttttttttcctatcagtgcattatatggcttctgaaaccatttttctcattttaaatatgaaatctcaaagagctactcaagtcaattcattattttgctgattttttcatttttctagactgcacttgttaatactcttcaatgaggcccagttttactacaacaaacattgacatatatattaggttggtgcaaaagtaattgcagtttttgccataaaagaaatgacaagaaccgtaattacttttgtaccaacctaatagaaagataagcaaagtcaaggaaactttatagaaagcaagggactctgtagagaagtgccaatggtgagatcattgtgaaatctctatattaatacaagtggggtgtttccctaaggagttatactcttatttaggaacacagtatcctgtactagtttcacatgattgtcaccttaagtgaagtgacagatgagtgatggcagttataaaacgaagactggtttcagaaaatctaaataaaaactaaacaattgtatacgacaatagaaaatgatgttgatggcaagaaatgtagagactgttggactgaataaaaatatggtcttgcttattcaaagctcttatggagataaatcagaatgtttttctaacatttggcctgaataaattgtagtacacaaaccacagagtatctaaaacaacaactaatgtttcaatcttaatttttgtatttggttcagaaatgccacttggaatgttatacataaagaatctgacattgtgtaaatggctgcataagcttaatgtaaaggaaaattgtggaagaatttatcagcttggactgaatatttcctcaattcacaaaatgaactgcaactccaatagaatgcagagtgaaaaatttcctgtctttttcctattgggtttgtaggacgattgataaacacattgctgttgtgtttgtagggatattgataaagacattgctaaggatggtatgtcacattttttcttttatgttgacccacagaagaaatgtctgacatatttccatgacatgaaaagttatgcttcttttgaatgattgccttttaaaattatttggacattatatgtctgatgagcaattttgtttctctttttgctttggacactaggaatctcaaagctgaatttgaaaagcattttatttaaccgtgtaatatcctgtggaattcaattttgtgtactaaatttatctaataggccagcctttattatcctttgtattcattcttggatttgtttttgagcctgttgcattatctatatttctgtaagaaaattcaaatcattttgaaaggacatagggtataattacctgaacaaatgttgtatttttccttatcaaaatttataagtgcaataaacagtaacaaggaatgaattatcaactatgccaaagtgacagataaaaaatcacataccattattttctgaatacggactccaaagtatgaagatcagaaatgaaaaaatcttagtgttgttattccagtaatggaaagggagaaaaaaactgataattcatgttatcatgaattgtgaattcatgataaaataacacatgctattatgcatgtgttattagaaggaattaggtcatcagagtcagaatttaaaatttttaaatggttacatatatttaggaaaaactttgacagttacctttgagatgtatgagctttgtaatctaccttgcttaatgtaaaccctacattaaattgccctacttgtttttccatgttagccaatgagaatatttaaggaatcaaatcaaatttgttgtacattcactttggctaattcaatggtcagatttttggaaccaaatcacaatagcataaataacggtggtagaattttgattaaagaccaggcagtttgcttatcccattcttttaagacctgtcctatattgtttatatttgatggggtgtaggaagttaatatgtaataacaaatgacccccaaacttagaggctttaaaccataaaagcttatttctcatttacatctacatgttcaccatgggctggttgaggctttgccatctgttgacttcgtaactggacccgggctgatggagattctgtcagggatattgcaaggctcataacagaggggacatagaatcatggtgactcatgagctgaattgtaaacttctgctgagaagtatatctcactttttgttcacttttcattgtccgaagcaagtcacatggctaaacctgttatcagcagagtggggatgtataatcctcccactgagagcaatgaatattttgaataaataatatattacgttgctgcaagcaaagggttttacctcttgtgtttttggttttgcctgattgggcctggtacaatgtttaatacctagactgtttgactctctagcatatacaattacagattgtctagttttgactctggtacaaatagatggcatttctctccccccatatcttctaggatgcctattttttgagaggataaaattaaaaataaaaacctctcagggtagcctgtttttttgcactcttttctaaactgctttataaaggacagacatatttatcctttataaagacatatgtgtatatacacacacatatacacatacatacacatgtgtgtatatatatgtgtgtgtatgtatacatatacacacacatacatatacacacacaaaatatacatgtatatatacacatttattaggttggtgcgaaagtaattgtcacttttgccattgaaagtaatggcaaaaaccgcaattacttttgcaccaatctaacaagcatgtgtgtgtgtgtgtatgtgtatgtacatatatatatatgtacatatatgaccttggaagagatctgaggtatggtagaggtttacctcttagaattgtttcgaggattaaatgagatgatttttaagcagcctttagcagtgtttgtgtggcacatggtaagtgctcaataaatattatcttattagtattatttcaagcgtaatatattttgatatctttagagctcaattgatacttgaacagtcatgaaaagaaatgatttactttaaaaaacacttgaaaaactatcctattagatgaatttatattttattataacaatgcatgtagacacacgtacatacacacaactagaaaggatatatgtgagagacatatgtatttatttagtcacaaaaagagcaaaataaatgtgccaaatcatttgaagatcatttgcaagaaatctgcaccctctaatccaccattatctttcaaaatttcatggttactttcttggcgtacatggacaaatgtttccactccttccataggacactaattctaactttggcctcccattaactgcaaaacatctcatgcaacattattctgcaggtttagctgactttattggttaacatcaagaaaatcacttaaatgttaataatttgaaatggaattgaactctcttgaactaaattttttattaaagcacacatggttttcacattgaaggaacaaaatattccataaaatatgttttaaatttaatgaactcaagactgttagcaatcatttgaatcacaatgaaatcaacatgtgtggcaaagatttgtctactctggtaagcagcaatgcatttgtgcaccaatttttactttaaattttatagaactataacaaaagagaatttcagctcagttcttgaaatcatggacaaaactttgcagaaaaataaatgagtcatatcattcaataccatacatacagctgagttgacttttatccaaactcattatatattatcattttagtattgtcccctgcattttctttgccttctcctctaagaaatattttccttatggtagaaatccaattattttttcccctgtaattgaaattttctgttttcatgaggccaaagccgagcaaataagatagaaatggagagtagtgagcaagaaatatttgcagaacagaattatatgggagctccttccttgtatgtagggggcacaggtatgaatgcatgtgctagaacaggttttcctcactgaaacaagtcttatcacagaatcactatgtgaattaatattttggaaaatgaaataattccttcccactgatttataactatagagatatttaattcttttctgatcaacctttaacattgtgaccacattttccaactttgaaattatcaatcttgaatgtgtccataagaattgggaagtacagtatagaaccttaagatccatcagtgcttttgtaaagtgaaataaactaatttaatggtagtgataactctcagttgctctcttttttaagttgatcttttaatgttttgtcatatgctatttttcttggcagtgaatgtataatgaaaaacctgtccataatatgaatgattaccctataatttatctcctttgggggtgtagacgaattgcaagttaaatatcaggaaatgcaggatggatgaacacttctctgggattgagaatcagctgagtctaaggaattttgccagaatagtatagctcatgatgttggtgggacacatggctccataaaagtcccacccatcttgtgtaaaggaggactttcaccttttcatgccctggttcccatggtgactggtatattattagtttttggcataatagtggcattgtggcatatcatgttaaattatagctagggactcagctgcaaatgtttttgcttcctgatttatgggagatagcatgattgagagaaaagaatttgtaagcagtaattagaggagcagaggtaaagaagtgcactgagatatatattttttttcagagaaatgcagttaatggagcatgtcaatgaaaaggattttccatttttaggctggctggtacgtcccctgtttaataaaataagactgaagtgtgccttttactttctatacagtctgacaaaggtaatttagaatggagcttttcgatgtctgtaggctgctgctgccaggatttatatcttcatgaacgaaacacaattgcagatgccttctcaagctgattgataggcaataaaaaactgaaacaagagctcaatctccaagaaacaagaaaaagttgtgtgtgttaaatggggcagagagatatctgctatcctcttgtgatatttgtgtctattttaatgcctatgtagatttgtgctgtggcacatgaaaccaggtatatattaccaatgtaacatgcttcatttgatttgcaacattttcagtgaactgcatatctcatagtgctcagagccaacctaaaatttctgactgattagaattgtctgcatttgtaaatcactgaggctggacctggaaagaaaagggatttggctcctctggggcccctggtatacattgtgcttaatagaagaattttgattcagatccttgtttgatgctgaaattattcttttttctccccatataaaatctcctgaaaattgaaggcaaattctataaggggcacaatatagatcattgtttattatgcaacacattccttcttccctcccttcttccattcttaaaaatagtttttgcatctttgcttatctttacttaccctacaaggatattgctatctgctgtgaagatagacaaaactgaataattttgatgcaatgcatctggacaataatagataatgtttgttatagaggattaggtctgtgtaagacatctggagagatagagtcagtaactctgttaggactggggatgagtcaaggaagacttcacctaagagcacaagcagaaagaaaatttcaggcatggagaatagatggtaactcaaatacatgaaagagtaatgtatttccagctgattagctctggtcaaggctccaaggaaggctgaataacaaagggtaatgacatcaaccttcccatactactaagctggtttaccaagttgccttgatattgtgaacattgatggacctttaggacaaaagatacggtcaggagcaaagactcaacattaaatgtcctcttgatgaaagtctcaggtgctggaatgactgtaatatgaggataggcaagatgcacattgataaagaagttccaaatatttggtgcagagagtaagaagctccccagttttggagaaagcattaccaacgaaaggatggttattagtaaaaggttattctgagacttctgtcttggattactgatgatgttgatgcaggtatagaacaagttaagtctgaagtactgatgagccaagataactgtcttatagctagaaatatgtatttcattctagggcagaagctgaaattgcagatatagatttgagaatgtccatcacagagctggtagttaaagccatggagtagtggatgagaatacccaaaattgctgtacatgaaactctacaaagccacaaaatttacttcgcggtcaagaaggaagctgagagagagttataatgattggcatttgtctgtggtcagctgagcaataatttccccctttccccttcctaactgtgcccaggtttttgtttgggtatccatacatcttcccattatgttgccgagattccttaggaatctgtctcaaacacagctctagggatgagccatggtttatacagccattcagactaaccttatatcactgccataatgattaattcaaataacccaagcctaagtaacatggcattttcaggatgggaggggcaaaagatctaattaaatttaattggacatgatgggaaatttgctggatggaggtttctggggaaagtatatcttctgaaagacagtctgttcattctgaaaggtgtgacatgttaatatgaagcttggaactgttacaacataggataaaactgacaccagagatgcagaatagaaggaaagaaaccaggtccttggacaagctgcctaatccaatcagctctgacctctgccttatctggaaatttcatttacattaacttatatgttgttattatttagaccaattttatttgagttttcctttgtttgaaatggaaagcaccctgatagctgcaaatgaacaacatgaggaatgtagttaataatattgtattgcatattgaaaatttgctacaacagtaaattttaggtgctcttacgacatacactcacacacccaaagtgacaatggaagtttctgctgtgtatgtatataaaacaccatgctgtataccttaaatatatacaattaaaaagggacatgttgaaataagacattaagaaaagtgtcaaatgccacagaaaccttaggcatgagtttggcaattgcagttctttctctgtctttgctagattagccctgtttggggagagggatggaagcagatttcagtaggtagaagagtgaacgggggaaaataaaatgaagacagcaagtttcagtagggcaagcatttttgtctttttaaaatgtatgactgaccccccagcccctggaagagtacatgagaagcagtaagcacttaccatgtactggacagtggataaatgtgcagacattaattgcacatttcccatttaagaagtgtcagaagagaatagaaatagtgtgtcaacatactgaaagaagaggataagtaaaaaataatttaaaattagaaaaaattttagtttgggatggtccttactatgtaattagaagacattcaggaaaacgtaaaagataatagaaaaagttaagaaatgtgaagaataggcctataaaatttttgagaaggtaaaagatgcaaagagaaaatctggaaagtttctaaagaggcaaaaaaatattaataagctacttacaatggaagaaaaatgagattagaattctggaagcaaagagattgtggactaactggctgcagatcagtaggaggagagggctacaagctgggaatgtggatataattcatctgctaaaggaaaagaaagatatttatggatttgtgagaattcagagaatatgtcatgtatatgccccaaatgggaaagattaaaaaaaaaaataaagctttcatcagaaggaaactccagcatgtggtggcacatgcctctggtcccagttacttgggaggctgaggtgggaggatcacttgagcctgggaagttcaggatgcagtgagtctgtcttgactgtgctgtacaatgcagcctgggtaacagagcaagaccttgtctcaaacaaaaaaaaaaaaaaaaaaaaagaaacttccacataggtgactataagtcgaaaaacaaatagcaagcaagcaataaaccttaaaatgtgtacaatgtacctaaaatatataaccaaggggatacaaaatgtttataaataaatagtagtgataagataacaaggaatgcatgttttaagtgctaaatacaaattgttgaaacagaagggacattcagagaggaaaaactgcagttactaaatgttcatcaaaacttaggaaggctcattctacagggttcatcactaaaagggagaatagagaaagaaaagtctctcagtggccttcttagggaagaaaaaaacaccaccaccaccaccaccaccgtggggaaatagcacatctcagtcaggaaaatagttgttattttggtttcatataaaaagagatagatgtaagaagttggaaaagagaaagtaaacactcgtagaatggaaaactacagaatttcatattaagtccaaggaaaagaaggaataaatagtaaaacatcaaaagcaagcaaaaaaatagtgtaagcaatattaaagaagcaacaacaaagtaaaacagtagtaagcagtaagatgtaaggaataaaacaaagtaactaaaagttatgttaaatacgacttggccaaattctcttattgaaaaattgacactgagagacttaaaaaaaaaaaaaaaaccacccagatatagtcagtaatgaaacactgaaagttatgaagaaagtttaaaaagagaagccagacaaaggcaaagaaagagacagaatggcaatattattaggtggggtagaatttaagattaaatgcatcaaatatgtatatgtgaacaaagaatgagttagatctgtcaactctcttgagaaaaaagagatttctatgtgcgaaatgatagatgtagagaaaatattgtgaaaataatttttgtaaaacaatcttccatccctaagtacgtgtaaatgtgcacgtgtatatgtaattctatgagcaaaaggaaaacgtggaagactgcagactggtgtttagtattggccacctagaagggactggggcagcttgtacaggatcaggtgcaggtgaggctggaggaagaaaaataaggtttcaataacagctgacttgtggcaaatgcattggtaaactgcccatcagctccttcctaaagacttaggatacaggccctggattcaggagacattggagaatgacatcaaagctcaggacgagtcccatagaaaaggttctagaactgactcacagctgcctgcttagccacactacttaggagaataaattcctttttattttgttgtatataagtatacaaataaaactgcaaatagcattaaaaaaattaaagtgtaaaaacagatgcttgagtccaataacaattggttgggttcccttgaggcctagaaaattttcaaaatgttctggatgcatacgtgttaaggagtgttattaagtcaattttccagaatcctggtatcatagggctaatgtaagacccaagggtcaagtgtagagagaacagcagtatgcactgaacacttgggatctgtgcttcactgacatttcccacctgcagataagttttgaacggatacacatacagattttcctgttgtttccccagccccaggtaattgctttgaacatcctgcgaaggtctggagtcacttgtatttgggtgatcgtaagtaagaaacaatatagcatataacatcttggtaatttagaattttctctatttcaaggtccagtaattatgaccatgactgacatgaatatcgaaggacagacaagctttctaaccaggacataggaaattacctgatatgaaaaagcagattaactttgtgatatatttaggtcaatttagaggtgagatggattttttttctttctacagctagagaaggcagccagccagaaagccccctgcttaacagagaatccacaaaagggatgagttcatttacagagggctggattgattataagggtgatgctggctctaccagcagaagcagtggcagggtattgaagactggaggagactccagacccttcaatgtagctgatgacagcaatgtgtttctcaaactgagaaaatcctgaagagcttgatggacgataagcagccactaatggatgggggaaatgtgatcactaatggagaggagactggcttaggacatgggcctgggagaagccccagaggctttgtttcatggtcagtttgaacagattagactactggatgctcacagtgctgctggctgctgcttccaagaaagattgacatgtttgtcttgacatctcgcttcaggaatggatggatacacagggaagcataaatttgggactaaagtgttctaacatttctcatgctgtatgttcattcgtctcttcgggcaattcagcacatgcgtttatcccattaatggctggagaaaaagttctgattaccttccaatttacatgattcatattagtgggttggagcagtaatggtgatgaattcttctctgcttaggttgtgcatgtgtttagggcccttgaaatctgagaatagccacactgtaagtagctgagcctctttctctagcacctgctcagatagaatttgtttgtaatttaaacaaactaataaacaacatattccaagctggagaattctgaagatgatgattatggcaaattctacttccaattttagctgtttgtggtgctttgccttgattttatggatttaaatttgctttaggttaaacaataccttaataatacacacacatgcactcatatgcatacacaataacacaatgtcagcaagcctagctagtttgatcttcagaacattttgttctagtgttttatgtggctgccataagaatgttatgggcaatgtggggaaatgtcagcatcctattgggagagcagcactggggtaattttttatgtcaagtttatttccctcctgcaagctgacatggagaaagaattggacaggttcttgatctaaggctctttgtctcctgtcttggttatgcttaggccaagtacttttggaggaatggttgagctgagccttctgcagaattttgattctaaggtcccaaagattttttttttccatagacagagtctcactctgtcgcccaggctggagtgcagtggtgcaatctcggctcactgcaacctccacctcccaggttcaagtgtttcttctgcctcagcctccaaagtagctgagactacaggtacatgccaccatgcctggctaatttttgtatttttagtacagatggggtttctccatgttggccaggctggtcttgaactcttgacctcaaatgatccacctgcctcagtctcacaaagtgctgggattataggcatgagccagtgcacctggccagatcccaaagattaaattgtataaatggcaacagcagcaagagccagagacactgaaaagtagtgtagagtagggattgagaatggctttggattttggagtttcattattaaaatctcagctttgacctttggtagttgcacaattttaggcaagctttaattttttccataaacacttaggatagtttctgccctatgatgaatactcaatctgtagtgcaatgatattgatgattgtatggacaacagacttactttctttttaaatcagaacctggcaatcatttcctgcctcctttacagagttacagattctgaatatctaagattagggccaaggtgtctgcgttttagaaagttccatagatggttgtgtaaggagtggatagaaaattatgtttctggtgttgggagattctctgacctcactcagcttggtctctgaacatctatctcagataacattaggccttactccatgtagctaaactcctagtcccgactcagcccttacatgtttctatacaatccctgcctcactgccacaacgatttctctgacctgcctcagaacactacacttcagggaatagagagagtgctgctaggaagatagtatttgaaatgaaatgctagttagactgaggcagggcagatctgtgtagatattaagctgatgaggtgttaaactaggagtggtagaatcatataatgcatgatgaatcttgcataggcaaagttgaaaaacaaactgttctgattcatctgtacttgttgctgaaatagttttatcttaactccctatttttctgtgtgtgttaggtctgcaagagggtactgaactaaaatcctcagattggaatttgctgtgctaactatatgcattgtttggagaacagtgaacattcaaaattgtattcacatatgggcagtcccaggttcacagaggtagcaggatggagactgagcgcaggtgagtagaccatggtcattcatggagcatccaagtgtggtaggactaaacccttacagccagggaacactgtgagagagtgaagacaatctcagagacttgggagcatggtcaaggaattacactcctgggagagatttctagaagtggaacatggaatcagaagtacaatgatgtgaatctgggtaaatttctatgatgtagtctcaggaggacaggcaaaagtgccctagaattaaatgaatgggcatcaaaaagtaatgaacaggctgcaaatcagaagaaagcctggggatgccactttttctttggaagaaaaaatgtttttgttattttaagttccgggatacataggtagaatgtgcaggtttgttacataggtatacatgtgccgtggtggtttgctgcacctatcaacccatcatctaggttttaagccccagatgcattaggtatttgttctaatgctctccctccccttgccccccaccccacggcaggaactgttgtgtgatgttcccctccctgtatccatgtgttctccttgttcagctcccacttatgaatgagaacatggggtgtttggttttctgttcctgtgttagtttgctgagaacgatgggatgtcgctttttcatgttggggataacctaatgctacaatcccttcaagatagggcttaagtacttcctgtttcaaggaattgtcagtcaaggagattagcatatataattgtggggaatcttgggaaaaacagagcccaaagcaaagaggagagagctctcaccatcagagcatttccatctttgaatttttctaaatgcagtttgcaaagtatcatcacaggcgagtaccaacaccagctagcatttattgatcacttactctgtgccaggaattagactaaatattttacatgtgtcatctctttattctttccagcagccttattggtagatttcttttatcatctctctttggccattcaggagatgaagtttcagagaagttactgtgtctaggtgacagaggtgtaagtagaggcaatcgaattcagacccagatgtgttaactattctttatctcctgatcttaggtattatttatcgatctgtgctaaatcacaacagtccttcctgaagtaattttccaaatttctttccattgtaccgttaacttaccaagaaggaaaatgaagagatataatacactatatatctctatctcgctgtcatctatcttgctatcttcctttgccactctctctctaatttgtatctatacagtgttaaaagagcatcagttattaaattacataaatactgagtttatattaaattatataaatcctattctgtcttaaacatttagtaagatattctccttggactcaagaaatgcatggtccagttggaacgataagactaatgccataataacatactgaaggccataggtatcacatgctatataatcaggcaaaaaactaaggtctaaaagtggggaaggcctctttgatattgagaataatattataggcaagggagcagttcagctagttcatagtattttgttaaaaatcagctgatctggctgggcgtggtggctcacgactgtaatcccagctctttgagaggccaaggcgggtggtttacaaggtcaagagttcgagaccagcctggccaatacgatgaaaccccgtctctactaaaaatacaaaaattagccaggcgtggtggtgtgtgtgtgtgtgtgtatatatagatgaattagcattaatgacattgaattattttgaaaggtattttcagaagcagacctgtgtgaaactgattgttctattaaccatatgaatgtttctaatgctaaattaggaatggctttgtttcatctgaacaactaacatgtttttacatttgggccctgtgaatctttaatgtgttcaggtttccttctcatgcttcctgtaagaagatttaaagtcaatttttttccctaaacttcagcaaaattaaaaactttatatatatatatatatatatatattctgggagctaatctctcttactgatctcctcttacttgtcttcttatcatgatttgtccttactccaacatgtcttttcaaaggtaaatttataccactacttagcatatcatttcaaaatgttttcttgtcctttttggaacaagacaggttatgaataaacaattgtatgaggacttgatcaatctaaaataacagctatcattgtattgagtgcatattcactcattttgcgcactcaccatgagtgcgtgtcacccattttatggaaattatgtaatattcacaaagatcctttgatgtaggaaacattatctccatttacagatgatgcagccagtttaaaaactagcaatggatgggaacaggcctcaaacccacatctctctgactctaaagccttctcacaactgagagtttatgtaactagatgacctagatgcacttcgcctcagcctcagaccccttcccagttgagctctcttgacagtcactggtgatcaaccctacttgactgggagaagattttaagttccatctctggatcccatgctcgaactaaaacatttctttttgtggtattaggaggttactttcccaactattttctgttttgttcatcccttccccatcgctcccaagtaaatgaaataaaaattggctgggcacagtggctcacgcctgtaatcccaaccatttgagaagccaaggtgagggtcacctgaggtcaggagttcgagaccagcctggccaacatggcaaaaccccatttctactaaaaatacaaaaattagccaggcatgatgacatgtacctgtaatcccagctactcaagaggctgaggcacgagaattgcttgaacccaggaggtggaggttgagctaggattgcacccctgcacttcagcccaggtgacagagcaagactccatctcaaaaaaaaaaaaaaaaaagatagcattagcagaatgcggactaaaatttatattttaagaaggaatacacagctttgtgaacttaggatacttggacaagtatctttgagagctcagtttgattctataaaactttccttcacatttatgagtctggactttgggactgtgatgagtatttcacttgatattcagtcctcctgccaaagtgaaactatggccctcttcctgtttttaaatcaaatctgtacaaatcactcaaccatgcaaaatctctacctgcattaataaactgatgacctaaaatcagacagaagggaggggtgatgtatactttatttgatctgttggctggctgatgaaggcagacaattttatgagattcagattcatattttgctttgaatctacttttctttaagtccacagaatgtttttcactctcaaattttccacataagtagctttgggagttgtctcttcaatccattctacgacaggtcaacagagatggaagcctttgatatacataggctttctaagctgtacgtagtctgtaatatttatctgttgacatagttcagggagaactcaatttatttagaatcaagacatgagtacttgattgtggctgttacttcatttgcttcatgtagatagtattgtactttagacccaggaatataagtgtagatttgaagctagtatacaaataggttatatttttatagcaaatcctatctcctttttttgatgtctgtagggactgaatacttttagaaggtatatattgcagaatgctaaggagtatcttagaattgaatagaacagtagaaaatgagtcttgggaaataaagtaatatagttaaaataattcatccaaagtaaagcaattgttctatgctcagatcttcaaaattataaacgaaattgtcttcttagaaaatggttagaaaacttcaaagaatttttggtgtagatttaggaaaggcatttgtgcgagtgttagtttctctacatcttttctggccccaatcatttgtttaaatttatagtttctgaagtactttgttttgaggtaaaaacaaaattttgtctgatatagtcaaataattgaagcaaaattggattctgtagttaaataattcaaatactttccttaaattctcttatcacctaaactaacattggaaaacaaacaaaaaacctctaactacatattgtggatggtatagagttcctgggatacagcagatatacggtgtcgaatattttaggacattcatcaattcattaattcaacaattatttactgactacctgctatacaccaggcagtgttctaggtactggagattcagcagtgaaaaaaaaaatggacaaaaaaatttctgttctcttggagcttatattctgttttagtctgttctcacactgctaataaagacatatccgagactggataatttataaagaaaaagagctttaatggactcacagttccatgtggctgggcaggcctcacaatgatggcaggcaaaggaggagcaaaagctcaaattacatggcagcaggcaggagagagagcatgtgcaggggaatgccccattataaaaccattagatcttgtgatagttattcactatcatgagaacagcaggggaaaaccctccaccatgattcaatcacctcccaccaggttcctcccatgacatgtggggattattggagctacaattcaagatgagatttgggtggggacacatccaaaccatagcatattctaattagggaggaagacaatatatgctataaaactcatagcttgttagtggtaagcactaaagagaacaagaagaaagcattggaggaagacaaagtttagagcctgtggccagagaaggctttgttgagaaggcagcatttgaggagagatgctgggagggaaggagtactatggtgacagtacctctgtattgcagtttctgtgcctttctgtccttggcttcctgtgaaatggaaggcaaggaggccagcatggctggagtagagcaagggagaggaagatcaagatgagttacacagtaacagttgcagacaggaggtagatactgtagaactttgcaagtcatagcaagggctttggctgttactctaactcagggcttcccaattggaacactattgacatattactacagggttgtcctggggattccatgatgttttgtagcatctctggcctctgtgcattagattacagtagcacttccccagtgtgaaaatttaaaaatgtctctagacattgctaaatatctcctgggggacaaaaccactcccagtcgggaaccactgctcaaagtgatacgagaggccactgaaaggttttgaagggaagattgcagatctgatttaaaatgtaataggatcactctggctgcaattttgagtacaaattggagagagagaaatcatacaatatttctgtagttcaatggatcctgatttttaaaatctggatattgccaatgagaatttttttgcatattcaaggatctcttctccttgtatgatatctcatgtgctcaatagttaaaggaaattcatagcaatcacagcaaatccaaatatgccatctctcctcccactacaaatcagaaacttaaaattttcttaactcattataaaaaagaaatctctctgtaggttaccaagttatcagtaaatgacactagaagactttggatttaatataaaaactttaaaacatttctattgcaaaaatccatagatatagttaaatgagacagttgacaaacattattttgtatatatttgtaacatagaattttttttgtatttttattttgtattttttgtttatattttgtatatacaatttttatatatttctatgtgtttgtaagtatatacaagggattaatatcaacatataaatttcctcagagttaagaaaaaaagcttcaataggaagaaaggacaaattatataaatagaaagtacatgaaataaaaaatatagataaatggaataggaaataatttggaaaacatgcttaataccactaagaatcaaataaatttaagttaaacaataagatacatttttcatctatgagactagcaaggataaagagtatcttatttgatatttacaagaaacagatactcaatttacattgctaggtaaagagtaaacttttaaaaattgcaagccatgaatattttacttctaggaatttttcatatggaaataattagacaagtgcccaaagttataggtatatgttttgtgtttgccactgaagagtggtatcaacccctcacccaaaatagttttgaatgtgcagactgataaagccacacacacacaaagatggtatggaaaggcttttaatttacataacaggactttctgggagagcatggcagaaacccaagccaatctgcaaaggctccagtgatgcgagaggtgagaggtgatggttctgattgtggttagggattggagctggggtgagtgttcctgtgcagggccagccacttgtgtggtttgaatttcctgctggcaccaaaagactttcttatgggcctgcccagatgtggggcaaaaggggcaagagaaggggtgggccttaaacgctgtcagtgaacaaacaccaaaactggagtcagactctttattacaattcattcctgatacctgatcaatgatggaaatgtgccatgtctcatttaatgaaatttgaacttaaataggctattctggcatcctgtgaggcctgcaccctgagcctggtaaggaatgtaaaagttccattcaaggctttggcgaatggcccagtgttttgtattttgagaaataaaatgaatgccttggtcaccatcaaaaatgactagaactgaagggtataaggaatgtcttggtgaggccttgtgtcatgcctcagggcacagagagataggtgtgactttggtgtgtattttaggtatctgtgggacaaagaattcccagagttctttctaacgggataacctcagagaaggaactgttgctgttagcattaattggatcagttagccagaccattgtcaatagcccgagagtctgtaaaaatgtgcagaaagagcttcctattgtccaagtcatcttctagtgctaaggcgattgcctgaagtttggtcagttgttgtaacccttggatctcgtctttgatcagggatatcccagttgggggatagacagcaaaagctctccagggagcttcaacacatgtgatatctctaaaggttatgaacaccctttctgatcactcagttgactcctgtgggcctcctaagtggtcactgggtccaaagagggatgaccttcctctggtgtcatcgtacatgacaacggaatgaggacaggggaagctgcttcctctcataggtggaatatgccagagggtccaggtttgggtctatctggaagcacaatttccattttcattaggaggtcattggccatgccaagacttcagggttctgtccctacaacctgagacataacaatcagctaagtttggagagtcataggctcagggcttgtggaagccttcatctccagaagggccttgtatgaggccagaaattgctgctccactgcaatgtggcattgggctgggaagggcagtttcttgcgtcagaaacacatgggcaactatggccactatggttggtccagtggctctaggaggcctgagaggaggttggtaaagcctctacaggaaggggtctctggcatactaatgggagttcctgttgcatagcaatctggatggattctagagactactgcccccacctgccccctctttttttgtagaggacccagttcaaaatggggcaatttgtcagtgatgacgaatggcccaactttaatttactgatgatgctgggattgagacatgattcaacctgagacagatggataggtcctggccaaggcatacaacccagattcactataaagcaggcctcaatttcatactcctgtccctaaatgctaattattggaacatatgacttaggtaggttaagtctataacagacgctcagagtaggactctacaagtggatcagaacatgggaatgctcaaaatacaagcttgacagcagacagccacacagctcaaagcttgcatgagtcagcagacaacaggtcaaagggcatgtttgtaacaacaaatgatccagctggcaagccaaaggcaaaagaagaaagacccaggaagtaggagtcatcatgtagaacttcctgcttgtagcgccaattatacctctcaaaattggttcagatgctgagactgatgatgccacacatgcagtaatgggataggaaaagtttttatactcaagcaataggatcatttaaaatggtttgcaaaacagaaggaaaaattggctttgatttttattgcatttaggggttggagcttgggtgagggttcctgcaggatttgtgtggcttgaagttcttctctgtgctaggagtagcagcaccaggctttcttataggcttgcccagatgtggggcaactgggggaaaataagggatgggatttgaaaggggtcagtggtataatatcagaaaggaagtcagattttttattataatatattcatcataattctacttatactgacaaagaattagaaccaacttaaatacccaaggagaggatgtggtcaataattttgtagctccatgcaatgaaatattgtgagactggaaatattgataggtgaggaaattaagttatgtaaagtaggtgcaatatgacttcattttttgtgaatatgcacatatacatctaaacacacatacacatatatgcacataaaattagaagcgaatgcacaaaaatgttaatgattacttctggtaggattataatgaatttcattctgattttgtttatttgcattttcctttaacatatatttgatttgtttttttttccaaaaaaaaaacaaacaaacaaaccaaggctttttattgaaagtttgtttttgaaacttttggtttttaggccatttctagcaatggggccacacatagtgtgtaggtgagaggtggaggctttgctgcatgtggcttttgtccttctgctgtgtgttttatcattttgcctggtctggtttaaagatgatccagatggccaaaattctatgctgagtaaatagctttgctgcatggtctgtttaactctgatttaccatggttcagaacatcttgaattacttttgtatttattttgtaattttataagcctgcaaatttcagaagtagaaagatattcagagttactatggtaaattactttcccctccaatttttcagtgccttgcctagaaaatgataagatctttataataaaagttttgaattctgacaactgaatagggtgagaatttggcccatcataaagatttctttattagtaaagcaaattctgtttagaggacacaaacacttcatagtgtgaatgaaggacatattgccagtgaggcaattaaaaactaatttgcatgtttgaaaacagcatttctttctcttaaaagtgaaacgacactgcttgaaaaaagtcactaggtgtttgttttttaaatttttaatatttttaaaattatagtcactaagaaaagtattcatttaaaagttgatttaggaagcaatctaaaatttggaagtctattatgtgacatttactttcattatcagaatattaattacagagataacaaataatgcccagtgggtaatgctatagaactttatttttttttttttcaatatggagtctcgctgtgtctcccaggctggagtgcagtggcgtgatctcggctcactacaacctccacctccctaggttcaagcaattcttctacctcaacctcctgagtagctgggattacaggtgcccgctaccacacccaggtaatttttgtatttttaatagagacagggtttcaccatgttgtccaggctggcctcgaactcatgatctcaggtgatccacccatctcggcctcccaaagtcctgggattacaggcatgagccacaatgcctgcctgccatagaactttctgaagatgaaaaaaacttttggcaataagtgcatttatttcattctagttattttaaaattgataatttggataacgtatagttcccatttaaacatactaagccatgtatcagaaaacttattttcttattgccaaatataaagaatgtatagaatatggtttccaaagaagttagtgacataagactaaaaaagaaaaaaacttgtcttacttgtcttacttccttacttgtctattatattccacacagagtaagaatttttacccgtattcttcatccatttcttgtttcctaaaattactctaacaactctttttaagcattcattatgtgccagtcttaaattaggggtcaagatctcttccttgatggaatttacacctgtctttgtaattttagccttattgaaacttttccaaagaagtatttgtagttgactgatgagcagggtctgttttcaactccattttctcagcatccctcctagctaaggtgtgggcacactggctccagactttgaatgggaagagagtgtcctgatgaagcagagaccatagaaaaacaaaataaaactgagctggtgactgatggaagcagtagggattgaaagagacatccattttccagaggtggccatagtatctgagaggcaagctgaggcatctgccagtaggggctccggtggagttccttagcttaagcctggttctctggtcttccctgcaatcctgtcagctactcagtatcttttaaatcaagtcttttcttttttctttttttctgaacaaaaccatagtcagcatctgctgcttgcatctaagaacctaagtcatttaatattattaatctgatatcatcaaggagggaataaaatcagagtttaatgaagacctatttgtctataaagtccatgctctttctaatatgttgtgctacagagatggcttcttttccaagcaaagctgcctctgggtccagttttataagaaaatcactcttggctcattaaaacctgtatacccttctgcagtggcacctctaatgagagcagggacaggctttctcatcctaactcaattcaggggtgtctgtgatgctgaaaccatcttcagttcattcaacttagtgagaaaaagagtgcaaaaaaatggctgtaaaaataaagcttagcattgtggaagtggctcattgacttactgtgtatcttagttttcaggtcattgttttgtcatcaagtataaaataaaagtattttttgttttgttttgtttttgtttttgtttttgtttttgagacagagtctcactctgttgcccaggctgtagtgcagtggctcgatcctggctcactgcaatctctgcctcctgagttcaagcgattctcctgcctcagcctctcgagtagctggaattacaggtgtgtgccaccacacccagctccttttgtgtatttagtagagacagggtttcaccatgttagccaggctgatctcaaactccccacctctggtgatccacctgccttggctctcaaagggctggggttacaggggtgagctaccacacccagccaaaataacaattttaaagtaaaacctggtcatcttctgttagtgatggccaggctgtgtgaggtgttatagagctggagctggggccccggtcacaatgtcttattccactcacccctgctgttttgtggaacgtgctgtcaagatttatgtttgttttgaagttaattagtctgatgtaaaccttatgtgcttctgattaattagtttgacactagctaactctgatatgcatgtatgatctgggacaacataggttgggggtggaggagggctggtggctcccaggaggcagtggatgggaggtcttcccctaagaggacactccatcctctccattctccattttattctaacaaaacctgcatacattttacactgacttggagaaaaaaaaaagttcacagctcacactgtgttttcatgactcaccatttttcatgtttggactagttttctgacagtttcttttttctttttttttttttttaaaaaaaaaaaaaaaacaaacctctgggtgtattttgtgaaattttgatggtagttgtaagtctcctttttgtgtaccagagcccttcatgaggaaatacttgctttttcagattgtcttacctcttctccttcccagattgatgacgaagtcttagggcagtttgccatgtgtcggtggctggtggagggggtgttaggagggagggcttcagatctgcaggagagtcccagagttgttttctggctccctattggactctacagcctggttactcttgtccacaaggtcactgctacccctgcctgctgcagcctgtggctggagagcatataaaaagctcacttgtacaaaagtatttgtaaggagactagggtcagctgcttctcctctcctcttcctgcccaaactttttcttctataccttcccccatcttcctcttccagtcctgcttctcggaaagaaccagttaaggcccatcctccctccacagggcacctaagaactgtggataccttctacatagtgtgcaggctgctggcagaagttctagaaggataaactcagacctgacttctccttcactgcaccatgtccatgtgtttactgtgtggtggccactccatgcaagactcttcccacaggacaaaatgtggaactggcaaaaagccctcccacttttagcttctcttcaacctatgtaatatgcttcctaccccaacttcagattttggcttaaagtaaagaggaggtcttgaccactccccactaatctttttcttcccacagtcttctggggttggaagaaatttctaggatagcatctgtcctgtcttgactttctctggatcataatagctgtcaagttgaaacaaaagaaactggctcattttaagaggagtttcaaaaattttatgtcctatgagtgtgtttgtgtatgtgcctgcgcatgcatgcatttagttctattgaaattggataggtacatattcgctgcaccttgtagttgtaacttaatgtatagctttccttttggaaagtatgcataatgtattagtctgtttttaccctgctgaggaagacatacctgagactgggcaatttacaaaagaaggaggtttaatggacttacagttccacatggctggggaggccacacaatcatggtggaaggcaaggaggagcaagtcacgtcttacatggatggcagcaggcaaagagagcttgtgcaggggaactcccctttataaaataatcaaatctcatgagacttattcactatcacgagaacaggggcagggaaagacctgcccccatgattcaactacctccctctgggtccctcctacagtacatgggaattcaagatgagatttgggtggggacacagccaaaccatatcacacaggtaaatactttaaataattattttttaaaaggagataggtgttcataaggaaagccatcaccggtttctcccctctctatcccatcctattccccagaagaaaccattattacctttttatacaaattctctttacattttcctgctaattatatctacatcactaaatgatacagcacccttgtgaggagggaaactgtcagcctgcagggatcttctcccccaacctggaggtgaattcagaggtggattcagtgcttagggggtgggacaacagctacatcagctgcattgtctctgtacagacttagaagcatcaattcctcactgagagctcattacttactaaatgtatgggtaagatcaaatctacagcatttaaattaagcatgcccaattatttacagatgtcttaaaatgtgaaaaccacaacatttataatgaagattacctatatgtaataggtatgtgtaactgatgcactgaatgtatgactcataagatggataaaagctctgtctcctgacgtccctttcaacttcattcggtggaggaagactttcctcagctcctcaatagagttactgaaataatagactgtcccagagtcaatatatgtcacaaaatagtcataattcaagagttaggagcatctagtccaagctgtgaatgaacacttctgtctttattgaaagacatgacttctcaccttctcccagctaaggtctggggtgtactcactacctgcaccctttctaattctatcccccagtggatgttctatacccctccaggggtgaggcttggggaaagaagagaggtcagaaggcatacaagtgtctctgggctgaatggctttattctctctgggcttggcatggtttatgcccactctctctcttgtggtgtcttccataggctcttttgaaaatctcaaatagaggacctctcacttggctgttcttgacccaggagattgcctgtccattctaactagtcatttgaacttccttctgtggccttcaggaactcatgttcatctctagccccttgctgaaagatctctttgacctttctagaacaccagaggtgacccctcactagctccttctcactcatggcacatgggaaacactcacacattctttgcttcaacaaactctggggatggccccaaccccagtgacaaggcaactgtcctggctctgcaaccaaaagcactaagtcacctgggcttataccttctagtttttgctctccataaaatagtgtctagccctctgcctcatattctgcttttatctctatcagcaccctaattcactatgccctaagcttcaagggcttcagagtaagctctcagtggagtctgattggaatccctcttcgccagcttgtgaggtatggggctaggttccacaatattccctttgagggagtagatcttccagccttctggggcatgctctgaaagtcctctttgcagaagtagctctttaaaatcatattctctttccaatttgacctctttttttatccttgttctgtccatgctgtccaaagcatcttggactaagttttgactttttttttaagtgctgcatttccatttgacattttacctttgtaaatttctatttttttacctttgtgacttattaaaatattttcttttcaaaaatttaaaagtgacatacaaaattatatgtgtatgtacaacaaaagcttaactataacaccttgttacatactttgctatccaggccactgatcctttcttacatagtaagtcagctatagttcattagcttacagtttttagatacaagtcttaatccatcccttctccttttgtattctttactttctgcaatatttaagactttttgcgttctgactaaaagaaaccacctgaaattggcatatgcaactgttcatgaatgagaactcgcatggaattgaaaggcaggaatgcagcttgaccttagaatggatttgatccaggaactagaaggtgggtaggaagcctagagaatatcctctctcaaattcacacacacacatacacacacacaccctcctttctcctcctctctgcggggctgaagtcttctttcttgacaggctggctttctttgttatcaatattggtggtaagagggaaatgatcactgatgacattcaggttcatatatgacaatgcacactgcaaagccagacttctcttatttctaggaaatggatcctgattggcccatatctgatcaggtgtttgtttcttgctgtagtaaacaggagtggcagcaaaatgttacaaccacagttgcctttgggaacccagcacagaagatgggggatagtaaacaacacatgcactgaaacatctcctataatgcctatgctgatttttcttgttgaattggctgccatctaagtgtcactgcagttattagatacctttttagtattcatttttattgctgttgtagcaaattaccacccagttggtggcttagatcaacataaatttattaccttacagttttttaggtcagaattctgaaatgaggctcactgggctaaaatgaaggtatcacatggctgtattcctttgggaggctctgagtaagaatctgtttctttgccatttccaacttctagaggctgcctgtatttcttagttcatggctcctttgcatcttcaaagccagaaatagctggaagagtccttctcaggctgtattacttacagtcagtgtcttgcctctctctcttataaggaatcccatgattacattgggctcacctgcatcacacaggataatctgccaatctcaagaaccttaatcacatttgaaaagtccccttagccatgtaatgtaacagattcacagcttcaggaaactaggatgtagatatccatggggagggagcattattctgcctaccacagctttcatttgtctacttttttgacctgacttctatttctatgttgtatttgaccccatgttttaacgtttctttttccttcctcttttcatggctacttacctttagctagtcacctgcacctaaagacagaaatgacattctagtgctttatctagtctactctgccccctcactttattgaggctacaggagtttactaaatatgtattagattgactaaagggaaagattacatagccaatagatcttgagaacacataatcttgcaagttgccaaaggagcagataacctaatcagtcatgagtaagagaaagataagctaatcagatgcaagtaggaaaagaaaaagccaatgtcagcagaaattcttaattgccaaaagaagatgacattgaatacatagtggtgatgcaaagtggtaaatgaaaaatgaaagtccaatatgatgtgtttttttccccaaagctactaaggatcttttgcaaaggatctaggaagaatatcattaataattttagctatgaataaaatcagaaaggtaaaataataatatatatttatatgttaattaaaataatggctatcatttattggtaacttagtatgtgagagacattgtgttaagtgccttatgtgtataataatgaaaatactcctgacagttgaggtactaccatttgcagtttatgactgcgagactaagaactagttagatcatgtgtgttgcacaaggtcatacaacctactggtcttgcctctacaacctacttgtcgtatgactttgtgcaacttacatagagaagcctgattataaacccctgtggttcaattttactctatagcctccctattatatacttcaatatcacgcaccccctctctattctcactacaaccatcagaggaaggcatcaaaccatggggaggataagagacttgctcaaggccacccatattttggtggaactagaatgtagaggctaggtcctctactcccaatccacagatgataggtcttaggcagacacaagagaagggaaaataaaggaagaatgaagaggtaaaaaaggaaatgaagtaggaaagtgagacaaagctgagaagaggcacaaaaggaactaaaagttgaataaaactttataaagatattcatggtatgtagtggaacatactgctgtgttttcttgctacctacctaaagtacctgcattatattcaagtggccaagttatccctgttctatgtcattaacatccactttactgtttatggagacagttgctggtcccaagggcctaccagcctagatatacatgtagcacgtatctctcccagctcattaaatcaaggatacagaaaatatatacttatgattggaggacctcttagaagtctgcctaattcatatcccctggcacgcacgcctggcaaaatccctgagtactgtggatatgatagaatagaaaaaccatgattaagttatgctacatggaaccattgactttaagaaagggagttatccaggtagacctcatctaatcacatgagccttttagagctgttgctggggatcagagataggaagtcatagatttgagacacaggaaaatggcttgaagttggcagaagccaagtggcaaggaacttgagtattcttgaactgagagagtcccctgtatgaaggtcagcaaagaaaagggacctcgattctacaaccaaaaggaatgaaattcttccaacaataagcataaatttagaagtgggttttttcctagagccttcagacaaaagctctgcctgtgcgatgctttgatttcaggcctgtgatatcctaaccagaaaacccaggcatgccatgctagacttacaacctgtggaactatggcttaataagtggatcttgttttaagtcattaaatttgtggttgttacacagcagaagaaaacgaacccactagttttatttttctttatgccaagttggtttttaattcaactcccaacccacatggtggcaaacactaagttcagtttttctactttcccagggttgcttctgggttaccacctgtacaaatcccccacggacattgaaggaggctgcactaggtttctctctatttgagttggcatctgttgagtcacctttttctttttttctttttttttcaagatggagtcttgctctgtcacccaggctggagtgcagtggtgcgatctcggctcactgcaacctctgcctcccgggttcaagcaattctcctgtctcagcttcctgaatagctgggcctacagacgcatgccacgacgcccagctaatttttgtatttttagtagagatgaggttttaccatattggtcaggctggtcttgaactcctgacctcaggtgatccacccgcctcggcctcacaaagtgctgggattataggtgtgagccactacgcctggccgagtcacctttttccacagattggtccaggatagtccacatagatcataactaaggtatctcttgcttctaacaagaagtcttcttcagactttgtgtttacttagctaccttactgttccatttaagcttgccaatcacctttgctcctggatctcaccagtgctgtggaaaactctacctgagaccttccctggctaaccatgcaacgtggtttttatcttttctaggattgttaagcaagggataggataaataccagaaaagacacaatctggcataatctctaaatgccagactatcaaaatatacatcacctcccagaattttggcatcccatataagagacataattggactagacataacccagtcaagtgagtgacaggcaaggaccaaaaaacctggcacccacccccacatgccctgccatgggctacagactttgaggtgaatctttccagctccagaaagcaagtagcagcatgttgtggttacaaggcaaatgatcctttctttctcctcttgtattatagctacagagaagctccttcaaatagcctctcagattcatgccagccaatagctcagggtgcaaacaagtcacaatactgcaactaatgtcttctgatatgaaagctatgtttccagagccactggggccaggacgtggactcaagagagacagaaatatgctcactggatactgtggctcagtaaggaaccgtgccagacctctcatatgtaactgttctctccatgtcattagtataagaaaagaggaaactttggatgccaccaaggctagattgttcaggtgattctgctccatcccttccaagctcccccatgtaagtggaaggaggcaagggtgtatgtccgtctcctggaggaaatccactaagttcctagttatggctgacgatgtgtgcctctccttgggatgtcaaaccacatctttcctgctacccctgaaggtatacatttctgtgagcctgcacataggttgtaatatctgccctttctacttgcacatccagtggcacctagtgaaggacaagtcccactagtcctgatggtacaacctttacaaagtgtccaaggtgttatattacccctaaatgggagaaatatctccctttggacatggaggacgacttggctgagttgggatgccaacaggggagtgattaggggtctttgtctctggactactgcagccctggaacagcaaatctgccctgagggggaaacaccagtacagcatgatgaagccccacccggttgcctgacctgaatatacctggaatagttgtctaaatgtctaaatggggatgagatgattcttccaggctggtagatgacttgcattaagaagttaatggagacaaaggatcctcaaaacgagtccatgtttttttttatcaaaacagtaagaaataaagatgaagtgggggattgagtgctggaccacaaactgccttatgagattatctcacaccaaataatgtgactaaagctcctatgaaaagagatggacacagaggaaatgatggcttctcaaacttttagatgcaaggtagcttgttcatatatggaaacccaaaggaagctaaagaaagtacaaggaacagactaataggatataatgaagactaatctgtgagctagagcaatttgttagtagaaggagaaccttcagaagattgagacaaagggagatccctttaaagactagaattgtttgttctcatccttgatgttagccatgcatgaccctcaaatcccggaatctttgaaagtacatccaagagatgaagctaaagactttgtcaaaccaatctcatttacattggtggtactgaagtggagcacatggaggaaactcttgctgctttcagcaccatcttgtaaaactgatcctggtccctgagtgggagccctttcacattaaaaaactagtgttgaggtcttgtccttctatctcccagggagaatcaccataagtgttgaactcttcaaattcctacttttactagattaaaaaccccaggtaacttttacccatgggtcagagaagctacaaaataaattcttttttttttcttgatttgagattagtgtttgccattgctcataagcccagatcataattacttgatatttttcaccttttgaatggaacatgatagcccttcctttgtcagactgcataattggcaaaggaaatttatactgtagaagaccctcagtaggacctgatgtgttgatgctgaatgcaccagtaggaacttcctatgctaccaagacctgctatggtcattcaaagtaagtatttgccgatatacataacctggctcttggttggcttgtgtctttgataataaaactgttggcatctatttacctcttttcagatttggtggagagattttcctcattaaaggaaaactttgactcttcaatttcacattcctatttgataataagtactttctgagttgaagtcccataaggtaagacaaaattgaggatgctgtcttgtgaaataaaaatggtacatccagtcaaggaataagaccattcctcccagactcagttaactccacctgtagttagctgcccatctattggaaaaatatctacattagctgtttttcctaaagttctagctcaaaaagagttttgtctttaagacttgacaagtaaaactggttccctgatgaagcagtttacctctgaagtggtcatagtcaatgagctgcagctatcaagcataataattggaaattctggtagctctcagtattgcctgccctttctcagtgggctgaaatctaaggtgtgttctaatgagctattgctaatgacctcatttgcatggtcaaacaggaggtcatttaagaccagatttttaagggtatactcataaggggtatctcctatggaaaaaaaaaactggtgttaactagaccttggttgaaggcaattagatggacatgaatgtgaatgttcttttctattggtgcctaatagtcatgctgactacaagggtacttctaacctcatctttgctttaaggctactttcttctgcttctgaagtcatgctttgcagtgaaatgcttattcctgaattcctgtagagctcgttgctccagaaaaagaacaaagtgtctggcttatccccaagggtgaagaaagacctttgatttgttgggtgcatacatcatgaccccaggaagggcggagagttataggacaagtagctttttatcttttgcagtttgtatatgggtaggtagacccaaaatttttattaaaactatcccagctaagagtgaaaacttgtcagaaaagttgataacaatattgtacatccccttgatgggaagacctaaatgtaataagctgctgtaactaagaagagcctgtgtgtcttccagatattccctctcataagctagcaataggattcctctaaaggccgctcatgtgggccattaagaggtaattggtattagtattagagaatagaatgtttctgttgccggcaagactagataggatggcaatttcagctactgtccaggcttggaagtgcctgctcctgctctctgacctctccccattcctggtgtctgctccagggtggagcaaagctgtgaccaagcctgggtggtgttgcaacctggccaagtatgcgtgtgcttagggtgatgctgacataccagccccctgctgcctcggtcccctctgaacttcgggtgccaacgagcacaggagagaggccaaggagggactgagggcagcctggtgcaggcactcctcagaatgaacagcctgggtaccatggatggcatgttgatggtggcaggaggcaggcaggcttctgggtggaaagggacaggtccccagtgagaccccaccttcaagccagggacagcctgaaacctggtggctgagctgccagttccaggtggagtctgtggcccagagtgagaacttatgttgcttttttcaggcccactcatggccacccatagacaaatcagcatgcacttcttcccatcagagcccataaaaaccctggactcagccagacttggacagatatcaggactaccagctgctggaagaagctaccctctttgacttgttgggatgacctgcctgtggaaaggagctacccactgcaggtctcctctccactgagagctggacattcattgggatgacctgcctgcataaaggagctacccactttgggtctcttgagagctgttctgtcactcaatgtagctcttctctctgccttgctcaccccccagttgtctgtgtacctcattcttcctggacgtggggccagaactcaggatcttctaaatggcaggactgaaagagctgtaacaaaccaggctgaaacatgcctgtctcccacttgccatgttgtgggtgatgaagagagaagagctacagctggtagtgcaaactgagcacagccagctgggccaggtgggcagaatgaacccagagggcatgagttatactcaagcagagggcgccactggccacagaagtttctggctggcaaagtgacaccccaaggatcccatgacagcatgtgagatatatctgaaatctgcttcctagacagacatacctcatttcttcatcttcagctttttgctcaaccgtcatcctatcagtgaggccatccctaaccaccctacttcaagttgcagcatttgtttactccttggcaggctctttctcctttctctgctttatttttcatcaatacattcagtttcttgtaaaatattgtcttttaaagataattattatttggtttcatcccctttaataaaatgtaatttttctgtgaaggcagaaatttgcatgtgtttagttcattcctatcacctaggaaagtacttgaattttagtatatttcaaatggaatttgttgaataaagaatcaaataaagattcctggaacaaataatatgtacctctatcttaactgatgacctaaacaaatattttctatatagacttctctaaaatttgagaattgcaatttagaaccaaatttaatcaagtatttgcctatttattttttagccataataccttacatctttaaatgaagtagaggttatctcaaggaggattttggaagattttattgttcctgccataatttttaatgtagaatttttcaagaagggcatgcatattcatcttgtgatcagaaaaaaaattcataaatgtgttttactgactctttttaatgtttggaattgtgaatatctggactaaggatcaatactgaatgccactaacaaatgaagtatggagtgttactaattcagggtcatccagcatctcagtatttgtcatctttttatgtttctttgctatgtatttatgagggccaaaaagtaaaattgctagattcagaatgtatccttgccccaggaaaattctgtatatattccaaaagattattataagcaaaagtaagctagttggaatgaaaaggaaatagcacatttcaatatttattttttttctttagcgcttttgttgtttttttctaagttgatttctggcatgcatttattttatttttatccatgcttaatattactgagaacatggcttaagttttattctgacttttatcactttcttatacttttcattttactaaagtaagagaatgtttaagataacatagaatttatatgaagcccctttagaaggcatactaagagaatttataaaaaattgtcttaacacttcgatgatgtagatatggaacaaatagttgatttgtttttgttgatatgtttgagttgaacatctcatatgttcaagttgaaatcttgattcagcatgtggtatattttagctctttctgaaatattttctatgagccacatcttactgaagtatctgggggaatttgcagaatgtggcaattttggcacagaatcttcacatttaaatagatggcaggatgcagaagagaaaagagcctgggtttctcagttgttaggtgaatatgtgtaagtctgactgcagtatttcagatcttgaggaatgttggatctatggcttttgtattaggaacatatagtggtgaagaactctggctctgtagttataacagcttgaattaatatagtcaattgtaatttcatatcagaataatcttgggcttaatgtctctgagttccagtttcctcatctgtaaaatgcgtgccattttacacatatattatagctacctgcttgtctataaataccttattttccccaaaccatataaattagatgctaatgctgactttatgctaatgatcagagaggtttagtgatccaagagctcaaaattagtaaatggcagagtctggttaaggctgacacagctccagtactgctgctgttcccattatgcccgcaagaactggttggacctgtgggatccaacagaaacagaaacagacaatgaaaataagagagaggaagagaagtgttaggtcagggcctaaggatactttattgacttgagtaaaaatgaagtgaaccctaatcatgaaaatattaaaaaatatttttaaggggaaagtagagccatcatatcacttatccaaattcaactatagcactcgacatagataatagatacatacctttaaaatctattaaatatggaccttctatattagctactttatctctgcttggtgcccacctaaaaaacaaaaagcagaaacaaaatagcagttttagtctatgttgggagagtgtacaaaaacacaatgtactttatgcgtggtttgggggcttattgaaggtaattatgacaatatgaatttttttcatgtacttcattttggaacataacgcctgttagagatttcattgtggtgctaatgtgagctgttttctatgggttagattaatttttgcataatcggttactattcatggatttgtgccaacatctctacgttctgcaaacagctataactagcactaagttggatacattttatggcaatatgtaagtctcttatttcctggtttgcttatacttacgtagtttgcactttattcatgcagttgtactcattttcacatagaaacattgttataaataatggttcccttcccaggaaagccatccccaaaccctagaaactacagtagacctgaaataccccctttataatgaaagcaaccccacaataccaatttaaaagtgatctgccctggatgactcataaagctgaacacttacccatggaaatgctttgaaagccatggaagaaatgtgccatcaaaatgtaaatatgttttcacttaaaaagaaaaaaaaaatttctctgtggaaactggtttacataggatttggagttaacattccagtttttcaactgattgaaaccagtggctattttatttaccgatgttctttggacttagtaccatctgctgttcattgttagggcatgcaaaattcctggggttgtatatcctccagcagatttctttgctgtgttccttttttttttttttttttttttaagactgttggttcaacttttcttggtagctccagtattcttttttgctaaaagctgtgtcttggtatagttcttccctgacctgaactaccaattcctaatttccaaaggaaatgacaaagcctatgtaaattgttatagcttattctgaccttgttacctgcactaacatttttgcttttgctgactagatttttttcttcctcccgttttcatttgttcctcaaactaaaatcacttaacttacattgttaccagatattgtttatcagtacttcaccccactagcccatgaaataaagctccccctggtctgttgcttactatagaggttgaattttgccccccactccccacaaaaaaagtatgttggtgtcttaaccaccagtatctcagcatgtgaccttatttggaaacagtcttatagaggtaatcaagctaaaatgagattatttgggtgggccctaatccaatacgactgctgtctttatataaaggggaaatttggtaaaagaaaaaaaaaaaaaagacacatatggaaaacaccatgtgaatattgaaaatattggaacacactgccacaagccaagctctgccacaactacctagctaggatctggagattcttcctcagtgcctttggaagaagtatgtccctgaccatcctttgatcttggacttctcgcttccagaaccctgtgactatcagcttaagtcagtttctggtgttttgtaactgtagccctggcagatgaacatacctcctcatacttttgctcattccatctcttgatatccccatctgtgttcccaaacctttccaattctttgccttttttcattgctattcctttgtaatggactgccctgttattgcatccatatattcaaagtttacctttgttaaggtcctgttgctcaaatactggattgtttatgaacattttataaacaataaacttctcataaaaggtaggggtatctcctccatgagctacctttttgagatcctcagttcaaccccaaaaagccagaagtttttcttcatcagagtcagagcctgtgtattctgctatgtatatttattaaatgagttactggaagaagatgtgagagattcacagagaaactgacataattaggtgtagtgctctgggttgggggtaggaagtccacatttatggaaagatgcatggtgggtgggaaaattgtccatatctaacccacgtttagtttctgggcattccctcagaggccctagacacattttttctttattccatttatcccagctcagcacagatagaaaaatcttcctctatcatctaaaactgttctcctatattttattctagcttactctttttaatacttagcatttaatatgaaatttatttgggagtacagtatgacccaactgattttctacaagtcaattttttccaactcccttgaaataacccagttatttttcattgtacaatgattagcatatattaaaatttcatatactctgattgattttttagtttaagcttacattattttagttactgtaactccagaataaatttgcataccttgtaggatgcatctctttttaattaccttttttttttcttggtaaaacacttattatctagatgttttaaattcaaatgtatcaagaaaaatttaaatatattctttgttatctttgggtttaactaaactttattctagtaaaatggatatctttacaatatttggcactgtcattatttaatataaatttttattctttagagaaactttgtagttttatgaacacagcatattattgag

SEQ ID NO: 2614 - DNA, 1082 bp, Homo sapiens
cttcaccatcaggcacaggacatgccagtttcgagagacgtttaggatttatgtgcaaccaatgaataagatggagtgtcagagagagtggggcctacccactgtctcctggacgagctgggaccaaacccagcctacgcaggaggggtcataacatgaggcctgtatctgctttgttcccatggaatccggtaaagtggatccccagttcgactccagcaggcccatctctcacctgtctgccacgtccacactgccaccagggacagagctaacatctggctctgcttcatgaggcctccagccccagagcagctcagggacaggaaggatgaactctgcctggccttgctgagctagttctcggggctcccactgcaagctctgtggttaacgcctctgctgacagcggacaggacagactttctctgaaagtctgagtttctctgaatctctgaggtgcaggattctcagaaacccagcggcagccttgccacgcaccaccgctgcgacactggccactcccggcaatctgaggggcattttgtgtgtccccagcacctgtacagcctcacactttgaaggtgtccaatcacatctgctggaggaacaagtggcccaatgttgcatggatcctctgggtcggtgtcatctctctgggtcggtgtcatctgtcccctctcaccaacaggtacgctgctcagagcacagaagttactggtgacatacacatgtccttaaaaggctaagaatgctggctgtggcagaggcaaactactaaatgaaatggcgcgtcagtagctcctccagcagggcctgattagccgtgggtaatgttcacttgtgagagggggcaactcggcaggcctgggagcaagaactcacacagagggcctgccctggccctcgaagaaccatagacgccggggcagcagcctctcagcaccaccctcatctgtgaggactctgggcccacctaacaacctgcactctcttcccactcacccctggccttggtagggggtgagccagggacaacccttctgcctggagaaggggctcaggaagaagggtgtctaggg

SEQ ID NO: 2615 - DNA, 9594 bp, Homo sapiens
ctctgcacacagtcccggggcccctggagcaggtgacacctcgctgggcaggtccctgggcctctgcacatagtcccggggcccctggagcaggtgacaccttgccgggcaggtccctgggtctctggacacagtcttggggcccctggagcaggtgacacctcactgggcaggtccctgggcctctgcacatagtcccggagcccctggagcaggtgacaccttgccgggcaggtccctgggtctctggacacagtcttggggccatggcacagcactggcacctctgccctcaccagcctttcccaggactggaggccttgtctgtcgttcagggtcacagaatctggagtcctcgctgttcccagccacacccagcccagcctcctgctgggggccacattttaccccaatttttctgcatctcaggacttcacaaccatattaggagtggcagtgaagtccataacagactcgtaggctccttaaaaaaactctccctccacagcccccaggacttcctggtcactgcccgctctgagatcagggaagccgtggggcctctccctgccagcttccatccatgccccaaggatgggctactcacccctaattcctgtccctcccctgcaaatggagaacactggaaaattactcatcgcagtcattatttgtgagcaagaatgagatacttcatttaaagcggtgaatgcagtacctcggcaatcaccaaaaaacaaaaaataaaaatggagtcacaatataaagaacctcaggaaaaagtgattttgcatcttcccagaataaatcagtcactctatcacctggaacatgctagatgttcagccaatggtttgtaaattaattactttgttattttatttcatatttagtaggacctggttgtataaaaccagagtaaaacatgttagaagtcaagagctagttctgagcaagttgtgatacatgagagctattcaacaaaatatttaaaactttgtaacatgttttttaattttaaaaatcacatttaaaaagccatcaggaatgcagtagccacagcttttgctaaaacagtttttaaaaattatttttccatatctgggagatttgaccttttcgttttgcttaaacttttggttgacacatcacgagtgcacaggacagcagctgacaactgccccgcgtgctgggcacatgcttctgcctgctccaatatttcaaagctgacttattgtttgcttgaaatgtgaatgagttactgaaaaaatattatgtgtctcacagtatttctattttacagcctttaatagttgttttgcagctttaaatctgtttggaaaatgatgcccaatgactgtgtgtgggtttatgtcacctgtgctcacagacatgtgaagcaaaaaccttggcctgctccccagcctctgtgcaggacaagccaaagagcaggcagcggcagggccaagaggatccaggctccccctggaccacacacggtcaccgtaagcacatggtgctccggggggtcctgcttggtgggtggctcacccttatgtgtcaggcacccattttatagatcaaaacgtagaggtctggaagtctcagaagcagcaaggctgtggccgctcagtctcacagtctcacgtcccaggtctttacagagaaccaacacacatcctcatacttgaagctcgatgataagtactcagcgaaaagtatcaggccagtgccgtgactcacatctgcaatcccaacacagtatcatcaggccagtgccgtgactcacatctgcaatcccaacacagtatcaggccagtgccgtgactcacatctgcaatcccaacacagtatcatcaggccagtgccgtgactcacatctgcaatcccaacacagtatcaggccagtgccgtgactcacatctgcaatcccaacacagtatcaggccagtgccgtgactcacatctgcaatcccaacacagtatcatcaggccagtgccgtgactcacatctgcagtcccaacacagtatcaggccagtgccgtgactcacatctgcaatcccaacacagtatcaggccagtgccgtgactcacatctgcaatcccaacacagtatcatcaggccagtgccgtgactcacatctgcaatcccaacacagtatcaggccagtgccgtgactcacatctgcaatcccaacacagtatcaggccagtgccgtgactcacatctgcaatcccaacacagtatcatcaggccagtgccgtgactcacatctgcaatcccaacacagtatcaggccagtgccgtgactcacatctgcaatcccaacacagtatcatcaggccagtgccgtgactcacatctgcaatcccaacacagtatcaggccagtgccgtgactcacatctgcaatcccaacacagtatcaggccagtgccgtgactcacatctgcaatcccaacacagtatcatcaggccagtgccgtgactcacatctgcaatcccaacacagtattaggccagtgccgtgactcacatctgcaatcccaacacagtatcaggccagtgccatgactcacatctgcaatcccaacactttgggaggccgaggcgggaagatcacttgaggctaggagttcaagaccagcctgaccaacatggcaaaaccccatctctactaaaaatacaaaaaaaaattagctgggcgtggtggtgcccacctgtcatcccagctactcgggaggctgaggcacgagaatcagttgaacccaggaggtggaggttgcagagtcgagatcacaccactgcactccagtctaggtgacagagtgagaatccatctcaaaaaaaaaaaaaaaagagagagagagaaaaaaagaaaagcatcagtcctggatagagtttaggttgtatcaacttgcctgcaaactgtaggaaggtgagaataagaagggaaagatcttggctggtgctcagactgggtgggtgcaggagagactcttgttccagagcaggatcccctagggtcaaagcacaaagagaaataaacttcagcacctgaaaattctgtaataagagtctttgaaaatggaaaaaaaatctatgcttgaccattgttgtctaagagaagtttgctatcaatccctcctctaacgccctgaacagaatgttcttcaccagaaccctgtgtattcatcaccacacaggctgagaggcattccagcatttgtgcaacatcaagatttatgtgcaattatctttatggcaaatgttccacaagttatagctgttaaaagaaaataagatgcaaatgaacaagaagaagcagaggcgctgcctgcagcctgggaaaatttgggaagctagcctaatgagtgaatttgttttaaaaggaaagttggcaaaccttattccagttcattaaatttcaacaaacagcaaggattaaagtaagaatcaacacacaactctaaacaggaatcaagcgcttagaattaggagcaaagctctggccctgggggcttatggttttggagaagaaagattttggctttcatatatatatttaacataaacagcctttggaacaaggcaacttccttcttctttctgaaatgtggtatgttcttgcctaatgtgtccctgaattccacctcttttatgaacaatatgaatatgcataaaggagaatttgggggaaccgtgccatgcgcccctcagagcaggagcaatcttgagaaggcgcaggcagagagcagcgggcggcttctccagagcaagtaattaagtcccgtgactccctagaactcagtgttcagttctgaaaaaaaacttcgggttcaaactccctaagtctatggtccttgcatcagacgcctcttccctgggattgctgggaactgaggaaggaagggcgctgcagagctaacgatagcaaggggctcagagctggccaccccagctccctggtggcaggagagctaatgtgagctgatggaaactgagaagcagcagataaaggaaaagccatctgccctgcctctattgcctaaaagtagaacataaatccgcaaaagtgaccatttccctctccaacagaaaggacagaaattcatcaccagggaccccaggccctcaacagcctggaaccagccccagaggcatttgtgtggcaaacctctgcagccccggcctcccttcctgtagttgccccagagaggcctcctcaaaacgtgtttcctgggaactcaaagtcctttgctttggtcttgcagcttcttggaaaatgattgttcttttgctgaggggctgtgcagcagagttctaacgatccattcgagtttccatcttggggcgctcagggggctccctcgtggaagcaggagtccaggctaataacccctgtgagttttcctcctgtgactctgccttttgtcagtctaatttcaatgccccagaaaattaatctaagatgcagggagagaaaaggtttcttcttcccctacagatggatgtcagtcatctctattcagccaagaagtagttaacctaaacaatgaaaacaccaccggttccagtagagacttgagactatctgatgagagttatgtgtctctgggaggaagttttcaatacagaaatggatttattttatgaaacttaaaagactaataatctgcaagcctataagaatgttttaattctgtaaaatattttacaataagaaaagaaactagagactaagcaacatatgatcagttaaacttgaataacaatatattaatattggtcaataacaaggaatgatctctctagtaactgccgtttccaagcatagtagagaaggataagcatgtttctttatatttaatcagttggttcttaaataattgtcaagtgcctgctgaaaaccagcctttggtcttggtcgtgaatagcgcagaactttgcagagccctgaagagactctcagtgataggatgcatatacacaggtggtgtgagtgacagagctaattttttttctggtacctaaagatcagcaggatcaaaatttcataaaggaagagctgggagcttgagattgacaatttcatgagatgaaggataaattgtgcgttacctccacagctctgcaacatggagattggtcttgggcaggtggtggacgtcctggattctgaggaagacctgcacgcaattcagtgggcatcaggagccttcagatgctttcatcaaaggcacaggcacaagcaggccttggtttagaaaggtcacttgggtgacagcaggagggacagaaggatggtggggagatcagtgcaggagccagtcaagagctccttctactaaggcagtagaaagtgagactgacaacggccaggcaggagcagaacgttctcccagagacattatggggaaattcacaccacatggtgagtgaaaggcaaggaaagccacggctgggcttcttgcttggggacttgagctggtagggtggttatttcaggctgttaacacccctcaacagggaacagaggaggatggcgtgactcaggagagaagttcaagtggaaaacgggcgtttgggagaggaccaaaggagggtgagaggagagggcaaagatcagaggagccagaaatgcacccgaggtgacactcacaggagggagaccatggagagaagagagccacagtgaccgaggctgagagagagagtggccagagactgaaagcaaaaggcacgacggccgggagcactgaacgcttgccaggccctggaccaaaagccgtgcaaacctctctgtaaaaccatcctaagacgtaactctgtgcacttgccaggccctcagcccagagccgtgcaaacttctctcttcagagcacacttgcgaggccctcggccaagagctgtgcaaacttctctctaaaaccatcctaagatgtaactctgcagctaggagagaaaaccgcgccaggtgaagtgagctgccgcgtcactcggagattgatttgtctcactccagagcccatggccgtcacccctctgccacttaagaatgccggcaacatcccaaaagcaccagagtcctggggaggtggggggcggggctggttactgcatttggcaaataagcggtcgtgactgaccacagaatacaaaatgtgagttgagttgcctgggcagttgcagtgggtttagaaggaaataagaggaaaataaaggaaaattccaggtgtcttatatctcaagcttttgtgggaacaggaggttccctgattcttgagagctgaaagaaatctccataaagcccggaatgctggtccttgaggtccacacctgccaccgatcctgcgacgcccaggccgcccctcccctctcggctcctactcactcttggtggcatcgtcccacattgcactgtccccagcacgcacacattggcgtaaagccaggtcccctcttcagattccacacccagagcctgcagctctgacggctgtgctgggggtccccggcgagctgtgagcccgtgctaggtgttcctccctccctcctgcccttgccccagggagccccacaccggggggctctgttcattgctctctgcccaaccctgaggggtcaccctctgccccaagtgcttaaccactggttactcatcccagaacccaagagagatccagcacggaggttttcttaactttgctgtatcacactgtaagaaactgggtggccaatggaacagacggagcagggcagagtgagcaggaagaaatgatgctggggaatttgtgtgctccttgggtggggacgagcatggaaggcgcgtgggactgaagccttgaagaccccgcaggcgcctctcctggacagacctcgtgcaggcgcctctcctggaccgacctcgtgcaggcgccgcgctggaccgacctcgtgcaggcgccgcgctgggccatggggagagcgagagcctggtgtgcccctcagggacttctatttgcttttaggagccaattcattcctttggtgaagtattgatgctacgcaggtgaatttagtaacaggactgacgtgtgaacatggccggaaacacttgccgtcttcctgttaccgcgtccggaacttcacggtgatacccagaaatgggatcttaacctcttacacattccaggtgctaaaacaaataacacaggagtgctttcattggaaactactggtatagtggaattattttatcttttattaaatacacaagataggcaaatcttatcaactttaccactggctcaggtaaccagtgatgaatgttcagaacaaaagttattcggaatcatttgaagtggtttgggcaagtgcgaaattaaggtgagtagctctgatcccatcctccaggcagctccgtgcagtgggggtggacgcccctctgtagcggggaagtgaaggcctgtggagggaagcgaccccgggacctggctgcctgcctgtcccggaagccacgtgggcatcaccgcagcaagatgggcttgaggaacaaagcaacactgtcagtgaatcgctgaactgtcattgcgctttgactgtgtgacattctgttccgtaggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacaggtattgtttgtggattttcttaatcttctcgtgaaagttggatctgaacatgactagatgccatcatgaaggaacttctaccaccactggtggatctgtatccacccctgagcccctggttcctgtccttggcctccccgacatggcctcctgcatgcctggtggtgcctcaagcagcgtgccaagcagtactgtcattcccagccacaacgtcccatccacataggtgcttacaggtgactcttaacttcctaaccccacaaattccaccgcccttcacctaagagctcaagccacgtgcttaggcgccatccttgatttcgctagctccgctacccattgtttccaatgcacccccaagactgtcacttttacctccaaaatgagtcctctccactccctgtcaccttagctgaagccaaaataaccatccagctgccatcacgtggtggtcccctcactggttctcctaatttaactcttgctttccccattcacgctccctgttatggccaacaccatctcagcaccctccttctcaactcctccctcagtccccactgcactcagagtgagttcagatccgcccaacagtggtgactgcccacctcctctggtccacaatggcaggagatggacaggagctttggccacacacagaggcatgtgattcagtctggggttcagaatggttttctgaagaaggtgatatgcgagtgagccaaatcttaaaggatgagtgggcatttctcaaatggtccacagggtagagaagagggctttgcaaaggccggaaagagcaagatgcgtttgggctgaaacgtgcagcctttggcacacagaggggcagagggagagcagccgggattgtggcgcctgtggggtctgggggaaacagtgtgcccggtggtcacctagaagctttgtcacaatagtgtggcgccaggatggctgcaggcttgatgttcaccgatgcaggcagcaaaggtgcttagcatggaagaactcctcaaagggactcgagctcctcactgctgggtgtgctgaggtcagaaggaagatgccccccccgagagagggatcagcgggacccaggcagagccctggcttggacaggccctgtcctgagacagagagcaggggctttgcgacaatgaacaggaatcggggtcctgggtatatgatgatggttaagaacaacagctttgcaactggacagccctggatttgaaacctggaatcaccacctatcagagggcagtttgtttcaattctttgagctgtaagagcttgtttgttaagcccacagcaggaatgcataacctggccatgtgtgaggatctgatcttaggactgcggagccccggctggaagaggcagcctgtgctgaacacagagatgggtcagggccacacaggaggctgctgtccacccctcctgccctgaagcctgggggggggtctgtgccttcccgtggaagtgggctcagaggtggagatggcatgtgtcctgtcctcagagctcagtgggagacatagatgtagacaaaggatgcacaggagatgatgcctgggagtatggggacactgagatggctggtg

SEQ ID NO: 2616 - DNA, 919 bp, Homo sapiens
gggagatgtcgccaacttgttagtagcagaaccagggcaggaaaacttgttgcctgctcacagatggttttcttttctttttttttttaatactctcttgcatctgaaatattctgacttcagggtttctttttttttctttcttcttctactagaaatgaagatggcatatggaaaggcgattcttatactcagaaggaaaagttcccatggaagccatggattcattcatgacaaagtgggtggcctgtttgtttgcttgaggatcccagccatgttgccctcagtagccctccctccttggactgtgacagtttctccatcttcttttgtttacatgaccttgatcgctttgaggagtacagggtgagtattttgtagactgttcctcaatttgggcttgtcatattttttttgtcatgattagactggcactgtgggctttgggaaggacaccctacagataaagtgctgagccccacttgagtgagaaatctctatgtctttgctgccttttcttctcttcattttctctttctctcttttctgatttttctctcgcaagtggactcacactctaagtaagctgaagggaaatatgattgttctctggagggaaattagaatttggaactgaagaaagcattttgcttgtgccaacctccgttatacttgacatgccaaagaccaccacagggatttaaccttgcttatttctcccagctctcacatttgctggctctatattgacacatgacatgaaattgagggttccttcagttctatgttcatttcaagttgcaggtgctaacatttcagccacatgccctgggggtcttctgcttctctcctcagcatgcccatgtctccatctctgcacgctcatattgtgtcctttctttacagcccaggtcacatg

SEQ ID NO: 2617 - DNA, 7339 bp, Homo sapiens
tgctgccgccacgggttgcaagagaagagaagcaggcaggggaacagtcaatcgtgtattcatctggtgctcagtaaattggcacttcacataagataagttgaggtctttcttggccagtgcctgcctccctggcgcctgtggtttcagtgatggggattcttccatgcgtcacttggagcgacctcgtctgttcctgtggactcactgacacactaaagacaccagctcagccctgacctctcacctgagcgcctccttaccaagtcatccagatggctccccagggatgagcagcaacaaaacgggcacgtgggtgcccagcacacgtcaggtgatgttctaagccccttgcgcgtacccagtcacttaccgttcactgcagccccgggatgagctctgcgatgagcatccttttgcagacgaggacactgaagcacaggaaagttaggtcatttgcctaaggacatgcagctggatggggacagagccaggatcgggcttgcagtggcttcagaccccacctttctgaccacagcgctcgtgctcttggagcgccttgagatagtgggacaaggcggactggaggacgcagtttccagatgggatgccctggcgggcgactcccgtgcgcatgcccagcatcctgcgcaggcgctctcgtggccaggcctctgcaaacagtcagcacagaccgggagacagaaaactacactccctcagacgctttattgtttacaaaacagatggatcccatagggaaggaacacaatcattatgctgacagcagcgaacagagaggggaagaaaaaaggtgagctttaaagtaatcgcaaatcactgcctatgcgaagaggctgcttccgggcacctgggctgtgactcaggtgctgacatgaatacatcagcaaggtctcaattcagccacagtcccaagtcccccaaccttcctgattgcatctctattttaaatgacccagcctggacatcaaggacaatgatctaggaggcgggtcaaggagacagccaggcaaagtcagaacagacttggggcttccaggctatgcccggtgacagctgagctcttcagaaatgcgtcacattcagcgttcacttccttcgcttcctccactacctatgacatagcgggggaaagagacaaccatgagagaggggtccctcctcgctgccctcctcgcagctgtgcttgagtttcaaagggggagaggtttgtgagggaccggcacagggacagccagagccggcaccctccggcccaccgtggcacccctgacgatcgcggggtggggtaggagtgagggtgggggtcggggtgaggtagtgctgtggggagggcactgtgaatgatggaaacgtcccttctcagcctgggtcgtgcctaacctgggtctcaaatcccactctgccttcaccctggagtacactccagcgaagccgaggcccagccaacgctcgtgaagtttccacagagaagagcctgcaaaactcccactggaagaggagaaataaaggccatggaaagaaaccccagggaagagacaggcctcgttcacagaccctaggcagggaataaaaaattcaagtcattcacagaagtcttgaaaggcatgaggatttctgacagttcctagaaaaaggcaacattttctttatctttgtatccattggccaagaacgccgacatgtgagacttgcttcaccagccgccaccgcttccttacaatctcccgcactgctggagcgggctgggtaactacaggactgtgctctgtgtgataagatttggtgattccactttataagaaaggaaactgctttaattaaagcaggttaataattaaaacttcaaagtactgcacagccacagaattttcttgaagggagaaagcggtcactggccatatgatgcggagatggttttatctgaggcctgagaaccaacagatgtgcctgcgccctggcctgtgcagctgtgggcagatgtgtccccaggggcctgccctcactcgtgaccatgcaataccctgcaacataaacattttcttttccaaggatctgcaggggtggacatgatgctccaggcacagagtaggaagaaaagggggtgacctggggttcccagcaaacaggtccacctcatgctcactgcgttctcagggtgaggcatagggcctgacatatggtaggagctctagggatattcactgaacaaaagaacataggaaagaaaagaaacgaggtcggatggaagaaacgacccagccagttaggcaggccttgagtcaatgcctgaagtgaccgaaatcaccaccagatggcagcatggaaagcagttcagaccgcggcctccgtggggcccgggggtccagtgcccgcaccactatggggcccgggactgggctccctgtccagacctccaacccaggcacagttccaaaaagaacaaaacaaaacaaaagtgcactcctcttgtttttataaaagctgagtcctgatggccttgctcagtgtttccgttttgagttaaatgaactcgatgccttcgtatttcacgcttccgatcttggtctccggcaacaggaagcgcccgtccagcgtgaaggccatgatgtaggaggcgactctgccgctgtcctcctcggatttgagggccacaatgatctggtcgtcggtgttggggatgaacttgaaggacgagaagccgtgagtggggaccaccgccccgacgtggctcacagcgatgtcgccgaagtcaggggaggcgctcagcagcaggttggcgcccttgcgctcgtcgtccttctcgctgtagcgctcctggctggcgcggcgcggcaggaagaaccagcgctgcagcgtgtcactccagcaggcagactcatggatgaggtagcctgggaaccgggtgaccgcgggtcagacacgcatgcggcctggtgtgcccagccccacaccatcaggccgtgcgcagtagcaggcaaggggctgcgaccaccagggcccaccagctcacagcaacccgcccctccctgctctccaggattctggaaggttctgtgttctcggttatcccatgcagggaacctgcagcacccgctcccttgaagcctcctcccgttccaccgagagctgcctgtgagctgcatcagggatttgggctcatcggagcctcctcggggctgatccagaggaacccaaggaaagggaacaaacccccattggatgtggggaggcatcggcggggaggctgccttgaggctgcaaggaagaggagacagcgtctggggccccaggcacagactcagtcacttcctcctgaacctcaggcacctaaggcctactccatcctgactagggggaggccaaagtgctgctggccctatgttggtgtggaacaccacggcccagcgccaggggtagggacagggcctgacccaccagtgcagacaaccgggccacaggctgggatgctaggaggccagctgccagggcgagtggggcaggaaagagaaaacagctcatttgccgccagaatccactggcctgagggaagccaccatcagaggcaaccaaaatcactaaaatcaagcaagaaacggccttggaggctgggtgtggtggctcgcgcccgtaatgccagcactttgggaggccgaggcaggtggatcaccagatcacccgaagtcaggagttcgagaccatcctgggcaacatggtgaaaccctgtctccactaaaaatacaattagctgggcgtggtggtgcacacctgtagtcccagctactggggaggctgaggcagaaaaatcgtttgaacccaggaggtggaggttgcagtgagctgagatcgtgccactgcactctaaccggggtgacagagcaagactatgtctaaaataaaaaacggttttggaggcaaatgcaggaggaagcaggttcccagcgactgggctgtggaagccacactgtgggctggggcaggcgtctcttacctggcggctggatgccggcagcagcccgcagggcgttgtagttggacacccagttctcgtggtccacgctgcccttgtagcccaccaccttcacccactccgggttctcgttcaccacatcacccgtagtggtcgtccactccttgcccaggccgcccacgtacagacgctcgtccttcactgccagccattcggccttgaagcctggccaagcagagtgtccttaggccccgcacccagctcccgccgcacccctgcacctggctcccacccggccccgcacctgtccttagaccccgcacctgactcccgcccggctccacacctgcctcccctccggcccgcacctggctcccgcccagggccggccggctgccctcccctcagctcctgaaggttcagtgaccactctcaagtctcctctgatccccaactccccgctcctcaagctgtaaccccaaccttaggattatccttaaaggctagaaaagctgaaaagtgacagcactctgaaggggcacgtgtgtcccaggggagtgcgggtgctgccctcggccacacctgaggtctcaccgagcatcactctaactccagtggccggagaggggcttggtgctggggctcccagtcttcctttcaatggatttgttcagaagctgtttttgctttttttaaactgatttatttaaaataagcctaactttgaaggctgccacagttcaggctgtgtgggagcctgtgttctaccgtgtattcttatcatccctacaccctggtgttctaacttctgtttgctttccccaaattttgccagcttcttgcccctgagagctggagctgtgccctctgaactgcccgagactgtagtagcttctctgcagggccctggagggacctgcggtctcctggtctgcttgtgcgatgagacattctccatgccagggtcttccatccctcccggatgacctgagtacagcccaaccccagagctccctgtaccccgctttcctccctatccaagggaaggacagaactacactagggttgcctaaaaccctgacaagtgcgaggcaggaagtaggcgaccaacgcctcagttgatacctcaggtgaggtccgtcccctgcccagccctgggcaaacactgaagattttatcaccgggtgtggggagggcctggccggccatgaactgtgtgggccgttgtttagtgcagttcctccttgacctcagaaagcctgcggtggcatttagctttctagaaggtggggatccaccgccagctcagacaaacggagctcagaggagctggcagctcctctgccagcgtccttggcacctccccagctcctctctggaggaagacactggccaccgtgcctccccaaagcctgtccctgccctgtggaagcagcacctcctttctggtgaacaaaaaggctggcatcaggctccactccaggggggttggcacagctcacacatgccctccccctgctggggttcagggagaggagggctgggcagcagtttacccttcagtaacatgaaaccaaagtctgggttttgagtgagaaccatctgtccccatggctttcagggcaaggctcctggtaggcacatcctagcgtggtcttgagaacctttgaaggtgtaaaaagggcgtgttcccagaggctccgagagcagcagcggatacagccgaaaacatcttggagagattccccacgtctcccacaggcctctagcgataagctcttcctcctagaaactgctcagtgtgaagtgacagtaggctatgctcctggctaagggtaagggggccgcaggtcagagcaagagggagacgtgctccctcaccacatccctggcttctaggtgtgtgaattctttaccatgtgcctgtgtttgccagccaggccctgagctcccactccccacccacacctccataaaacctcagggtccagttacctttctccacggtgccgtcgccgtcggacagaatcacccagggcacggctttgctgccttcgatctggtagacgacccccgtccggtcatccacggagtagagtttcccattgaaaacaatcaggtcggatagctccatgcctctccccttctccgccaggtgggactccaggaccccatggtctttgtcccattccacggccaccttgtccccactgtctgacagggtcaggtagccctttttcaggtaactgaaccaggtgttttcctcttgggcccttgactctgtgtccaggtctgcgataactgcgattcgataccgaatcccagccggtgtcctttgtgggggagacagggggtaggtgtcattgtaccagttggcgggcgcctggccgagcctccagttgtgtgcattgtgggtggggggcctgccgggggccgggcggtgggagcagagcagccagaggatggcagcacccacaaagaacgtcaggatcaccttccagcgggggcggaagcgggggtccgcggccttggtcatggacgccagcacaggaaggccccccacactgatccggagggagtgcatagactcattccattccgggtgctcagacagctgcacgggcatcagcgtgacagacaggcgggacctgcacagccagggagggaggagaggagtcagcgcctccgcaagcccagtcacatcttagttccggaagctgcaggcgctggaggctgacttttccagaagaaacagtatttcactactctgtggccattcttactcccttggcttaatgaattcccgactctagattcccgactctagcagtatctttgcttactttcattcggcaagacgtgaagtctttccacagcaaaattactccatctcccctgtcccagctggcaacgtgggaagctgagtgaggaaggaagttccatgcaggctggtgctctgtggtccctctaaagagagaagcgcaggagagtcaggtgggaggggaaggctgacggggtgaagtgggataggatcatagacagggtacaggtctgtattttactcaaatgccacctcatccaggaagccctccctgactgccctgctgcagacatcaccctccgtccctgggtccttggcccttgtccccacctgacgttagagtattgtatacagttatcggtttgtttgtttctgtctccacctctgtatcctggctcctagaacagtgcctggcctggagcagacagatgtgcagtaaaggagtctccacttcctctgggttaggctcctgcagcattggaataccaaacacatccaaaccaaataaaaacactccttctttttcg

SEQ ID NO: 2618 - DNA, 7038 bp, Homo sapiens
gtagcgtgacttacggcagctctctagcagagcgccgttgctgggggaatgcagaagcggccgcgggctagcaagctcccggagccggcggcgcaccaccatgacccagtcggtggtcgtacaggtcggccagtgcggaaaccagatcggctgctgcttctgggacctggcactaagggagcacgccgcggtcaaccagaaaggaatttatgatgaggcaataagcagcttctttagaaatgtggacaccaggcagtcttgattgatatggaagaaggggtagtgaatgaaattctgcagggaccactgagagatgtatttgatacgaaacagctcatcactgatatttctggctcaggaaataattgggccgtgggtcacaaagttttcggcagtctttaccaagaccagattttagagaaattcagaaagtcggcagagcactgtgattgcttgcagtgtttctttataatacattccatgggaggaggtaaaatttttcactcatttgcctgtaacagtgttaaaggataagtgggaattcattttgcaaacgtaagtcttgtttttagacctgtgcttgataaagatagaactattcggagggtgtgtagtttgagtatataaacatacacctttttatcttaaaattttgtggaattatgtcactattttcttttcttttctttttttttttttttaatgtaagccctcttaagagtcaacagaactatactggaaaattttttttcttgtacctttagtttcttttacagaacattcagatacttttcaggatgtatgagcttttgagaaatgctgactttctccttagagtttgcctgtacagtcctatttcctagagtgaagcatttttgacgtgctcatgatgtgtgcttgccaaaggatattaataccctttctttaaccatcttcaaacctttcttgtctccaaaaagagaaaaaaaaggaaactagtttagtcaattcctttagatcatttattacatggcaattaatcaacttgaagtaaaaataaatgattggcattgctttcttcccccagggaagtctataccttagaactgaagtattttgctcccctgttctgtaaaaatagaaacagaatgtaacttgctgatttttaaatacgcttagcaaattttaaaagaacaaaatggtcacacttttttcctccaacctgagattaagattttatattcagcaagttaggtgtatgtacagttgatttttatacatattattcattgacatagcattttaagattaaaagttaaaattgctgtgtaaccatgtctttaaaagatcctcataatcatcggttaagaaacaaatttgtttctgtgctagtataattaacctgcaaatttgagctagctttttatttgatttatagttcgttatacctttttaaaaaatacctttactacccaacatctcagaagaacatacttacaattcacttaaaatagcaaaaataaatattaatactaaaggttaaaagtaaagttcttttttccccacatctaatgcctactccctgtccttacagatgatcaggtttgcagggtctttttatgtctgttctttcagatatattctatgcctatcaaagcatgtatgtatatttttacataaacaagattatccaatatatactatactgtaacttttccactttatctctttctcagacatctttccatatcagctctctgtcatagaatcaattatacagtttaaagtgagtttgttatttatgggtattaagtgtttatggtgtttagtttttacatccaatcatcagtgaaagtctgggacaaatacttctgtatttgtgccactatagctttagacagtattcctaagaaaaagataggaccaaagcatatgtacattttaaattttggctgatattacctatataccttcctacaatattgcaccagtgcttcttactggcaacaatgtgtatgagtttctatttccctacactagcaccaatactgagtatcatgagacataaatctattatattcaaaattgtatttagttttaatttgtatttccttaattagaagaaaggttgagcatctttacttctatttgcaatttgtatttcttttattatgagttaaatgtttctatcctttgcccatttcgtggtggcattattcgtattttttgttgttgatttgtgggaactctttcttagagaaacttagtccttcccatcatatgtattgaagggtttttttgtaagtttgtcttgttattttttatgggtttttttaagtatatatagaagttttgtttatttttaatgaaatcaaaactgtctcttctgtaatggctctggtttttttgtgacgcttagaaagtccttctcattaaagatcaccccaagaatctccctcactttgacttagtatttttagcatcatagccttttaatagttatctgcatggattagaacattggtgtttaaagttttttttaaccagaatagtatgaaatacattttatatatcacaatgcagcatacacacatgaaaaaatatattaagaaaatgttatttactcatactacatctgacatgttattttctactgtttcatttaagaaaacagtactaatctgttcattagtttcatagcctactaatagttcagaacccagtttgaaaaacatcggattagaggattccagttttaagttctgaaaaatttctgaatttatgtaaatgtaacttgatgtatcagaaagttatctttaatgagattcctcgagtttctgcttttaaataagtagtgtttcatatttgaaaatttttgaaattcgaggtaggcatgcttaattgtaaacagttttaactctgtttaagttgcttgatgacatgatagtttttttcatcaagattatatacacactacactaaagctgtcaagttagttttcttaagttgcttaatatcaaatgtagactgaacaccgtcttagttgaattttttacttgtgcatgtgcaattggttcttgtggcattatataggtataacttaaatatgaaaaggagtgagatatagacggccctcccaaactcactgtcagaaccaaagatggaattcaggacttcatttcctgaatgttgccttcatttccttatccaaaattagattagttaatatataatcacagaaataagctgaaaattatttttacaaatataaattctgaccaggtgtggtggctcatgcctgtaattccagcactttgggaggccaaggcagaagcttgcttgaacctaggagttcaagaccagcctgggcaacataggtagaccctatctctacacaaattaaaaagttagccaggcgtggtggctcatgcctgcggtcccagatacttgggaggctgaggcaggaggatcatttgaccctaggaggtcaaggctgcattgagctgattatgctgctgcactccagcctgggtgacagagcaagaccctgtctcaaaaaaaataaagtttcaaattcttcacaattatattctgaatcatttatgctaatttttaaaaacactttaatcctcaggaacaggatctggacttggcacatttcttttaaaggtgcttgaagacgaattcccagaagtatacagatttgtgacttccatttatccttctggtgaggatgatgtcataacctcaccttataatagcatcttggcaatgaaggaacttaatgagcatgcagactgtgtattgcccattgacaatcaagtaagaaatgacattggaacttatgaataaatgttatatatattcagtcctgtattatgtatgtgtgtttatatgaaacgttctcttcacttttcagccttcttagagaaaaaatcagtttaaattgtttttctttctctttcctagtagaatatcatctacatccactcttcttaatagcttctctcccaatgtttttccctcaaaagtctttatttgacatcattagcaaaatcgacctcatggtgaattctggaaagttgggtacaactgtgaagccaaagagtctggttacttcaagttctggggctttaaaaaagcagcataagaagccctttgatgcaatgaataacattgtggcaaatttgctcctcaacctaacgaggtaattctatccagggatagtcaaaaaactttattgtgcttttggagatattttgaatttttgtagtagcattttttagttattctaaattgtagaagctgcttctgtttttattttgtcttctatcttttcttggagtgatcacgcagaattttaccttctatgactccaaagcagcatttccccaagtatgttccatggaatatgaacagatatcatatgatgtaaaagattttgtggttgacacacttgtaaaacacgtagacaaaattaaacattttttagctgtagaatgtcttaatcatttaaaccaactaatctgtacctcctcattaactggtccaaaagatttctgtggctttttggtatcagagattgctttgacattattatattctagattatagagtatattaagcagattcttgaggaaattagttgtttctacagttactaattattgacttatatgtgtttaactcaaatataaagtttgttttaaataggatatttttatatgtgtaatgagcaactataatagtatattgattacacttcagataatccagaaagaatgactgtagggccagccatggtggctcatgcctgtaaatctcagcacattaggaggccaaggcaggtagattgcttgagcccaggagctggagatcagcctggggcacatggtaaaatcccatatctacaaaaaatacaaaaattagccaggcaaggtgttgtatgcctactgtagtctcagctgctcaggaggctgagatgggaggcggcggttgcagtgagctgagatcacaccactacactccagcctgggcaaccagagcgagaccctgtctcaaaaaaaaaaaaaaaagaaagaaaaaaaaaatgtagatgttgtgtgttatattttattttatacatgattgttctgatactaactttcactaatatggaagaaaagcatgtgttctgcactgaagaacagtgtacaaaagaatttaagaaactacctgctgaataaatcgagctacatttaaagtgtataattttaaaattaaaaattttctcattttaatgttaactttttagctctgcaagatttgaagggtcccttaatatggaccttaatgaaatcagcatgaatttagttccttttcctcaacttcattatctcgtgtcaagcctaacacctctgtatacactgacagatgttaacattcctcctagaaggtaaggtgtaactttgtttcaattttttgaggcctcaaattactttaaaaaacatttttaagagaaaaaagtttgcaataactctagttatttaattgtatcatcttatctgtgagagttgatgacatccatttttgcattagatgaatgcatctttatttagaagtaattgttgaaaaatgccagtattaaactatttgaacttaaatctaatgattaaatttgtaggcttatgaaaagtcctttgaagtctgacaaacacatttgaatcctaactgtcgctagctacaggactttgggcaagtgacttaaactttcttagtttttctcatctgtaaaaatgaaatagtacctacctcatatacttattgggtagattaaatgagagtttgttttaaagctactgtcacagcccagtaccatagaagaatttcagatgtaactctgtatgttttccagaacaccttgctttataactgtgtgtcattgttaagcataaagattacatcagtatacttaacaaaaaatgtagttttgaaagatactcttagcatgtatactgatgatgagcttgaaaagttcacagtggcattcacagttgactgagggaaaaagtcctgccaaactctgtaaggagacagtatgtaaataagaaagggaaaactaaattggctgagtgcagtggctcacacctgtaattccaacactttgaaaggatgagatgggaggatcacttgagcccaggagttcaagaccagccggggcaacatagtgtgagaccctgtctgcacttgtagtcccagctactctggagactgaagtgggaggatcacttgaacccaggagtttgaggctgcattgagctataattttgatcctgcactccagcttgggcaacaaaggaagacagaccctgtctctaaaacagattgaaaataattttttaaaagtttttaaagaaaactaaagattcttttttataactaaagttttgacaagataattctatacttcaggaatgtcacaagtgatattggtaagttttcatctaagccaacagcaaatgaccactttgccaactaatagataggactccgtttctgcatgggatgctgatgaccttaacaagctaagcaacatacacagtgtatgcaacatggtgattattaaatgtccattggcatcagcctagcattggagtctgtgtattgttagatataaactttgtcagtcacctttattttcttttgtcttttatccttcagttaaaagacttaggttaaaagtctctacttttaggagaactactatggagtttcatcttttataggagagcttcacattgtcctttgataatttcctcctgttaacaaaatttatgatataatatactttacaaagtaatagtcttaatgttctaggcttttaattagttttagtagtttggatactatgaaataaataaggtataccgaactaagtaataataatacaagtttcaaaaatcagtactacatagagttcataatgctacagtcaacattttgtagctacctgaaatcacccatatactgcagaagccttttcccccagaaaaagaaaatattatatgatttcttctcttc

SEQ ID NO: 2619 - DNA, 772 bp, Homo sapiens
taaacatccaatggtaagagaggggagaatgatgaaaaattacttagtgggtaccatgtacactaaggcccagacttcaccactgctcaatacatccatgtcacaaaactgcccttgtaccccttaaatttatacgattttcttaaaagacagcttataagttaatagagatgtttatgcagaatgctgagtaaattactcatttatttgaacttaagccactctttggaaatcattagcaaatgccattttacttcattattgtcattgttttattattgtcatttcttttaatattaatgtgattcttataattgtatttttatatcattagaagaaaaaaaaaccctgaattatacgaccaatttgcattctactagtgattttgatgagagatgagaggaaaactccatttcccttaaggagtgcatgttactggggaggtatggtttgaaaaggttctcaaagtgattatgttgtattcacctctgtgactctgtgaagaggacatccctcttgagaatcattacttaacgccaaggagattcctcttctgttcaaagacccttccatgtgctcctgcagccttagacatgtgccattcatcactttagggaaagattattggagccaaaccggaagacaaagaggtgaaaatcttagtttgaaaattattaaaggtgaggcaaaagcgcaaaaaaatatggtaggatacttaatgctgttcgtttgctcacatggtcatgaaataggtaaagtttttatgtgctgg

SEQ ID NO: 2620 - DNA, 934 bp, Homo sapiens
aggcggtggtggagttgcttcccctgctaggcgggctcgaaccgggcgggagtcactgtccaccttgcttcgccagggtgttatcgccagccagtccccttccgcatgcccaagggcagcctcaggaagcgagcccaccaccgtcggcccagcgcctgttgatcggccaggccttctgggccggtcatactgggcccttcctaacctgaggagattgcacagtagggctccctggtctggtcagggctcagttaggacccctctccagccttaggcttggtgaaagctttagcgaaacagaaaaaagaacgcatcgtggtgtagagtgtatggcctaagaagcattcgctccactcaaaaaaaagaaagtcctaatgcaagtaattgaaagtgaagatattgcaaaacaaataatgacagctgaattgatgatatgatgacaggctcatccctccattgtaaactatgctgcgtaagatatgcctgcttcctgtttgccttatgccatgattgtaagtttcctgaggcctccccagccatgcttctatacagcctgtggaaccatgggtcgattaaacctcttttcattacaaattacccagtctcaagtagttctttatagcaatgcaaaaacggacaaatacatggattgtttttggattctgaagattcagtgctatggatttcacatgagtttggctattttgattaaaatgtggctgtttgtctttccatctctgctttgtttcatatttcagactctggctctcactcactatttatgtctctttgccctttgaaatcaccgttcttggtcctgctgctgtcccactacattctaccactcagttggtactagggtgatggtggaatcataggcctccaatgaacctcaaaagctatctagtccaatctcctatctgatgcaatggct

SEQ ID NO: 2621 - DNA, 21878 bp, Homo sapiens
gttacatcgtttggctgtgtcccaaatctcatcttgaattgtagctcccataatttccacatgctatgggagggacctggtgggaggtaattgaatcacggggttgggtctttcccatgctattctagtgatagtgaataagtctcatgagatctgatggttttataaaggggagtttctctgcacaagttctcttctcttgtctgccaccatgtgagacatgcctttcaccttctgtcatgattttgaggcctcctcagccacgtggaaatatgagtccattaaacttctttcttttgtaaattgcccagttctctgatatgtctttatcagcagcatgaaaacggactaatacaaggcatcagatgattgctcattgtggttttgatttgctttttgttactcagttgtaggaatttatatattctagatattaatactcttatcagttatgtgatacgcaactgttttgtccttttctgcaggctgtcttttcactgtcttcgtagtgtcctatgacgcacaaaaatttttaatttttgatgaagttcatttattttattcttttgttgcctgtgctgttggtgtcatatctgagtagtcattgtcaaatccaatgtccatataaagatttttgcatatgttttcttctaagagtttaacagataattttatttcttcctttccaatttggatggctttcatttctttttcttacttaattgctctggctagagcttccaatactgtgttaagtagaagtgacaaaagcaagaattctgtcttgtttccactctttggggaaaagctttcactatttcgccattgagtatgatgtttgctgtggaatttataacagacattaacagatatttaattcccttgccttggtggaatgtttcgggaatgattctgtattctttgactgtcctgggactcttgcatcgagaatgtggtctagaagaccagaacgaggtggctggggagttgggagacacaagtaacatgattttgttttatgttatagtgtggcgtcagttcacctttctttccagacctagtggccattttgtggtcttgagggttacagcaaatgccttaggttttgagtgtctttcagaggcaaggggggttcttataccaaggttctcacaacttttttccctttttgtcttaaaatgattgagaccatagggccgtggtggtgttgaaggaggtcgcctgaatagatccacatccgcatcacaatttcacttcgcctcttgtacttcagtaccaggtttaggggacacatgtgccattcaagtgaggttggctttgtaatgacttttcagggtggattttggcttcctacaggtaagaactttctacctttgtaatatcctgactcatgagttgaaacaatagatatgatgaaggcccatgccccgtttagaagagtaagtctcatgttgccaggtcagaaatagatcctctttcctcttgttaagcattgtgctgaatcctgagagtggtaatcctgcagcaggcagagagaggaggacgttgccctgaagctgtggggaggcctggggttcattcctactgggctgcgggttctggtctcttctaccagtttaaacaaaatggcacagatagccaagagcagtatcagttgagagtagcacgaatcttgggcgctgatgtgtgctgtttagttttggctcctgttttaacacagggagagggcagatggtgaagctctggccacctgtgagtgttggcaaccccaggggggcagtccgtcctgctggctgtactttgaactggaaatactggacatatgacattttccttctgactctcgctgttcgtgtggcttatgcaggaggcaggggaggaacattctaaatgacctggagctatgcatcttgccagaatcaacaagcaggacaaacctttggggagaacagttgagccacttttcaaaggcagtgaccctctgggaccccctacttcaaactggccctggaggagtagactggtggagtggaccggaatggaatgtcctgctgattgtgtggagcaggctgagtagcacatggtttctggccagtgatgttcatttgtgtggccaggtctcaaattcaatattgtttttaagaaaatctttctgaatgaagaagtctccatggactcttactccataaaaactaagattctttgcagagtttcactgggcagcagttccatgtctaggggtggaggtttggcttctgtcagactgttccacagggcacattgaagtcctgggtgctgggcagggctgagattcccaggggagcacccccagggctgggtcctagggcgccttgacactgttaaaaattactgaaggccccaaagagctgtggttatgtggctgtatatattgaaatttactattttaggaattgacaggcatttaaaaaatattttttctccatgtaaaaagaatattcacccattatatgtaaacataacatcttttatggaaaaaagctgtattttcaaaaacaaaaaaaatgggaagagtgtcattgttttgtactttttaaatccctttaatgtctgctttaagagaaggtagttggatccccccatccccctgccacctgcaatcagtcttatgctatttggcctctagaaaactccgctgtgcattcgcgacggaatgcaagggacaaggacacatcgtatcttactatcttgaagataattttggctttaccactcctggaggtcttgccataggggtgaggtcactcataccagggtaccatgtgagaggctaccacaggtggaagcacaggtgtggggatttaggcagagaccttggaggccaggggctgcaacaccccctcactgaattcagatagatgcttgggaaccaccagttcctctgcttgttctcttgtgtctgttgtttgaatcagaaactcagcagcttaggcctcagagagatcttgaggatacttggtccgtaactattatgtgccaaatgagggaacttacttcttcagtcttctagaaaaattttatccctttttgtgttaaaacgtggatgcagcctggaagtggtaatgctagatgctgcataccaccttgatggaactagatgaagtgattagcttcagtcgcctgagtctagagagcctgggaccaggcagggcagcagcatttgagggactcttgggaagcttggcacagcttgagtgtgggggctgtgatgcacaagcataggcagctgtctctctgtctcttcccccagtgtttgttgagccagtgtgatgtgtcctgtgttggctgcccaggtatatacgaccgtttctatcctcaggtcacctttactggggggaagactgaaggtttgtaaaagaaactgtgataccaacgtcattcgatcatccacccgagagtgccttggaacaaaggagtgttaatcgacagcaacgggagaataagaaggctggctttttttttttacctgacatgtaaaggagctgaggagagaagggtgttgcagagaaagcagggatctgcattctcttcctccccactgctgttgcaggctgacagtctttgagtacacacacagatgtggctgtgttgtgccctgtcagaggccctgtgagtctcaccacctcctgaagcacaaaggtccttagtgtggtgctcagagacccctgaaccatggggtacagggtgcacaaaactggccatgagctgactttgtagaagggcagccttggagggagggtgagacattcatgaccgtggacccattttcctctgtcaggaaggatgggggaagtgaagaggacctgatctatatttgccaagagaagctaagcaggtggttttggtggatatgaaggacaggttctttctcgggtcccaggactctctttcctcctgggaagcccgacctcctgtgtggctccatggctctggtcagattcctgactacttagcatcacaacagtggaggacaatggaattctaaaaagattcagaggaaacttagtaatgttaacaggagacagtttgaaattcgattgttgtgactctttcaatggctcaaattgcggagaggaggatgtgtaatgaaatgctaagagtggattttgatggagtgaaggaagtttgaattagctttgattagaacacagcctcatcatggggactccattctcatggggagtagtggatgctttaagatggattcccctgagttcagaggtgggcatcagaatgatttgcctgcataccagtcgtgtctgtggtcccgggtagctttctgttcatcagcccagtgaatggggctccacttttctccctttggctttgcctctgttccaagaagtaaacgtcctgaaatagaaaaggaggagctgttctttggccaatgatttgagaatagctagaactaaagttaccaactgtggagggcggttccctgtgggcctcatcaacagctgagggccccctttcagacacttgtgaacaagctcctccagaatccttgcatgcagcttttgcagaactgataaaagcaatggtcggtcatgcttgccacaagctgcttctgttgagatcatcattctacgatcttgaccaatgggtgaagtttggttgcacttttggcatcttgcattcacagacctacagaaaccagattagggagcatgttggaggtggctctgtaagtgacaatgctaagattgagaacatagtgatgacatggtaagtgtgtactgagtgaattaatgaaagaatactgaatttcaggactaaggggaaacatagaggtgattataaaggaagtgaaaacagaactcccagctgaccacaatgaacctgggggtttatgaaggccttattagggcaattgaagtcttaatttggggattgaaggaggtagcaatggagtcttaaacttttctacccaagttacaagagccaggtaaaaagagaattagtgcagaatctggtatttgagcttcctgcatcgatttttctaaattatttgccaaattacaggttgtttactttctttagctaaggcaccactcagggtttgcctttatcgttgcacagtttgtcgccaggtcatgggagctgaggctgtgtctaggtggctgcaggcctgagaggtgtcaatgatggagtggagctgggggtgttgggagaggtttgagcggacccagctgggcagcaccatagggctgctgggtaggtatttttgggaagcagaatgctgagctctcactcagaaccccagtgtaggaggcagatgattacctgaggccctctgcacagagaaggaaccagctttggagagcatcatgggtttctgctgcttcctcaactggtctccccagttccaggaaggcagaacaggtcattgagaggcacagcttgggcttctcgattgcaacacaggagcaaagtggtagatgggtcatgtctgtgaacgaggtgtgagcagcccagtgtaggacacagtcagggtccccaacatggcgggcctagtggctcactgctgggtctgatttaagaaagatacctggataggacgatgtaagaactgtctttgggtccccaaggatgggttgggagctgaaatgtaccccctgctggccaggagccgcagggactcttgtaggtatggagggtatggcatgggggctgccatactgtgactcaagagtgcgatgggtggatgtgggcctcaaagtgggccagctctgcccagaccagagcattctgcttcctgtggagcatccctgaagtccttgtgaccgtgtggccagagagcatggtcttggggcaggcagatgacaagaggccgtaccaggatggaagtcgtctgcatttggaggcaggaaacaacacaggactccctgcagttgttaagtgtactcttaaggtgtcccatgcttgcctgcacctgcctgccctataccttcaggatccaggtgtccttttggaactggaggatcaggagccagaggggccggcagtctggtactcctgccttgggcatctgtgcgggcattctggtattcctgccttggacttcccggcagccaggcagtgggtacctgggaggatgttgcaccagtctgtgcaggagaccaagagaactaaatactggagatcatgcacactcattaaaaaagaatactgcagaaaagttcgattacattgctagataaagtcatttttaatgtgtccataccctgtgtcagttttcaatcttgtgctactgtatgatagtgatgcatttcagagccattaatcattgtttaccaaccattcctgtttgtaggaaccctctgtttccattgtctttgcaaaattcttgattttctgagttgaggattggttttccttattcatgtttatatagacattaccctgaaaacctagaacacacagtagttacttactgaatgtactaatgatatagagaatgaaaagatatcatcatctttagaatagaatgccaggccctagtgggctctggtgtgtgtgctggtgatgggctaatgttgataactggctgtttgggggtggtgataaagcgtccaaagcacattgactgtttccctacagctttcttcattgaggagaggagagatctttatcaactgtgcacgcctctccactccaaactatttactcctcgcacagttttaacgattacaattacattatgtttcctccacaagcaagaatgtctttcctctttacttttgaggtgtatccttttttctttaacccgccccttttttttaaaactcctttaactttttttaaaactcctttaagggaagaagaaaaggaaaagaaaggaagaaaaagaaaagaaaatagaagggcaaagtctttcagtatttccagaagctgcctgtatagaaaagggcctgtgcagttaatattcatgtgacttggcctcaagcacttaatagcctcattgtgtttaggtatagagcagtgatttctctggaattcctagaaagggagggggagccctccacaagggcagagggggatcacaagggaccctgagtataggtttttgtgtgaggagaagcatataggacccttggcctgaaactggatgaaaacattctttcttagataaattttaaagttgcatgagtaatttgtgatctttattttaaatagtcgaacccagaagtctgtagagagtgaaattctcacttcacttctcatggccctcctttgaggttggtgttcagggttcttttggctccttttgctctgcggaattaactaattactttttaattgatgcataatagataaacatagtttcaaggtacatgagataatttaatgcatgcatgtaatttgtaaaggtcaaatcagtgtacttaatatacccaccaccttaaatatttgtcttaactttagaaacattcaaattcttctcttcttgctattttgaagtgtacaatagattattgtagacggtagtcaccttattgatttatttaattaagtgtacttatttcaagaatgagcagaaataaggcctagtattatataaatcaataaggtgaccatatatttgtactcattaatcaacttttttttaatcctccatacccccctactcttccctgtctctggtaaccaccaatctactctctgtcttcatgagatccacttcatagcttgcacatgagtgagaacatgtcatatgtctttctatgcctgtcttccaggttaatgcatgctgttgcaaatgatagaatttcactccttttttatggttgaatagcactccactgtgtgtatgtaccaccttttttaaatgagttcattgttgttggacacttagatcgattccatatcttggctattgtgaataatgctgcagtaaacacgggtgtgcagatatctttttgatacagatcctttcttttgggtatatacccagcagtgaaattgctggatcatatgatagttctatttttagttttctgaggaacctccatattgttctccatgggggctgcactaatttacattcccaccggcagagtatagggggtcccctttggtacattctccccagtatccattattccctttttgataatagtcattttaactggggtgagatgatatcttattgtggttttgatttgtatttccctgataaatattggtgttgagcattttttggatacacctgttggctctttgtatgtcttcttttagagatgtctgttcacatgttttgcccatttttaaattgagttacttgtttttttgctatggaattgtttgaactccttatacattctggttattaatctcttgtcagatgagtagtttgcaaatagtttctctcattttctctgtttggaattcctgggtgcagacacccacagatatactgctttcccctttttacggcagtgttgcttattcctggtgcttagctctttgcctcctttattaaacacttgccttctgtcagtgctgtgtgaagcactctgtgggaattgcatcatttcatccttgcatgaagttgggacggttttgttctcagtttacagttgaggaaattgaggcagagagtggctgagcgcttgtgcaggctgcccccaccccagctggtggaggctgggttctgagccactttcacagctgcctcccacagaccagagctcatgtccctgtggctcctttagagcttttgcgtgccttccagtgctgctttccatgctggaggagtactgtgctctactatatttaagtcggctcctgtccaggcatttttttccataagttcagcaaagatttgagccacttggccctgtgctaagagatgggatacagcagtagtcaggacagatagagttctcggcctcagagctacctcttcttgggaaagggacacaaaaaaagttggcaggaagaagaacagcactagcaagcctgatgtgttctgcagaagaggcagccaagggctgagctatagacccatgtggagagggtctggagtgggtcaggcggcctgatccctcagggtggacagggacaggacagggtggatggggagccttggttctctgaggaggctaccagcaggggaaggtggaaggcagctggggccacaggtgtttgaaaaaattccaaatacaaggcagagagcatgcaaaggccatgagggaggatagagtctgagaacctggaggaggccaggctggtgagtgaggtgactccagcatgggacagcagtgtctgggcagcctggagaggaggcaggggccacacgcgtcaggcctggcagctgtcgctgagaatttgggtgcatttgaagtacagagggcaatggtgtcacctcatgggctccccagagctagggctggttaagtgggaagcagtgaggatgcttagagacagggcagctgagtcccagttcagatgaggggcagaggcctggagttggcagcagagatggaagggagtggatgactctcagatgcttccgcagccaatgagctgggctagcggattacatggatggaaggcagaagagaaagttaggaatggagagctcttgtttctgccttgtgcagtttggtgggtgccatgaactgggggagaggagggatttgggcagccacatttaggttgcttccagtttttctgtcttaaagtgtgtagtaaacattccgtgtgtgtgtatgcacgcgtgtgtatgcatgtgagtctttctgtaggataagctattccaagaaggatgcctgtgcctaagactaaagtctgaaagctgctgcccccactccagcgggcctccccatgcctgtacagtgtgatcccacctccggtttaggggagccctgttgctgttcagccatcctcaactctgggtagtcccagtccttttaattttcagctatcaattatagctcatgtgtttgtatatgtctccctggctcctagtgaagtttagcatgtttcacatgtctgttttgcaaattgtttgcttctatcctctccccatttttatgttgggctgcttacatcctatctcttatttcagtaaagaagagattaaattcagattgttggctgtgtggtaatggaaatattttgtcccaaggcttttttttttttttggagacggagtcttgctctgtcgcccagagtggagtgcagtggcacgatctcggctcgctgcaagctccgcctcccaggttcatgccattctcctgcctcagcctcctgagtagctgggactacaggcgtccaccaccatgctcagctaatttttttgtatttttagtagagatggggtttcaccgtgttagccaggatcgtctccatctcctgacctcatgatccacctgcctcagcctcccaaagtacagggattacaggcgtgagccactgcgccccgccggctttttgcctgtcttttgatttgtctatagggtcttttgctgaacagaagttagttttttcttcatggcttctaggttgagaatcttgcttatgaagatcttcctcactcagattttataacatttttcttctgtactatctcttagtagtttagtagttcttgtaatgtttaaggcacatatggaaggtgaggatatgaccgtgggatcttactgagcataagttgccagctatccatgatcttatttttaatttatgtgtcatcattcacctctggctgcattctcttacttttattctgtaaatggacatgtctgttcctgtatctgtaaatcagcaagctgagttccttgaagacagggccttccttgggatgatattgctttaacttactgaagtggaggtggagtgtccgtcagcaatgtgagggcttccctttaaaggaggtggtgcatttctaacccttctgatcttcttttggcttcctcaaaaattttttattttcttcaaaggatctcgtatgtattcttaagtgtgttgttttggttgcttctgctaattaaatcattttcaccattagacttcctaggtgtcttggagctgctgtgcagaagggctggggagggtttgtagtttgctctgggatcgcaatcttactaaacgttcagatcggttctaattatttttcagtgcatggtcttacatttcatctgtaaatagtgacggtgtattagtctgttcttgcactactacaaaggaatagttgagactgggtaattcataaagaaaagaggtttaattcactcttgattccgcaggctggacaggaagcacggcagcatctactcggcttctgaggcgtcctcaggaaacctacaatcaaggtggaaggcgacaggggaagcagacatgttttatgtggctggaggaagaggaagagaagtggggggaggtgccacacacttaaacaaccaggtctcttgagaactccatcacaacagcaccacgaggatggtgctaaaccattcatgaaggatccaccaccacagtccagtcaccttccaccaggctccacctccaacactgggggttacaatttgaaatgagatttggtagggacacagaaccaaaccatatcagacagttcttaaaaatctttttcaatttaacatttacacctcgtttctgtttcttcactgtgttttctagaaccctagaacagttacatctgatactgccattgtgagctttccggccctaatgttaatggggatgtcatttttgcttcttcattacctgtgccacttgcctgctggaagttttggatagatgctttttatcaggttaagggggttccttatttatacctcaccactaaaatctttcattcctggcatgcaggggattttaaaagaaattctgttatcttctatgctttggatttcaggctcactctagtagattttcttttccctaaaaggaaatgataaaatctgttccagcaagtgattgaaagaatcaaaatgaagagaaactttacaattattgtaaaagttttctatttttttccttatggtagaaatgatattttattaaaatcacaaaccgtgtggcagggattcatacatccaggtatctgttgacttgcatcttcgctctgccattgattaactgtgtggccttggcatataattaccgtctcctagccttggtttctgcatctgtaaaatgaggtaacagtgctgcctcaaaggattgatatctagttgttcttaattaaaacccacctatctttgcatgttgtgttttgtgtctcacatgcctttacttccttcaatttgatcttcaaaaagccctcccatgagagattgtaaagcatttggtaagattctgacaggtaataggttgtcaatcaagggtggctgccattgccctgagtacagttatcatagctgtcaccaccatcttgggtggcatcatctggagagtcaggaatggctgtgagccctgggattctagtcccagggatcctgtgtgctcgattgtggagtgaagacacgtgcccactcttgtttcagtgtagcttgtatagcacatggtgccatgataaaaatactcatgttcgtatttgcagatttgactcttctggatgaacagtagcatgtatttttgtgccaagtacacactattttaactacttttgctttagggtgcattttactagatgatgagtaattctcccttaatgctctatgattgaccatcttaccgcttattttattttgttagttttaggattattccactagttctaagaaaaaaactgcttgaatttagatagatacatactacatttcatttataaagttgttttggatatttatattacttttaagagaattaatccttatgatgtttaatctttccatttaggaacttagcgtgtttccattcatttaggtctttttatatctcctaagtgctatgatattttatggtttgtataggattattcttagggctaacctaaaatatgcatacctatgtatataaactattgtgagtgtggtcttttctgtaggttttctgctcagtcgctgttctgtgcatgtgtgcatgtatatttatcctgcctctcaccgctctgctggcctttggctagttttagagctgtgtgctgcctctttcaggtaggcagcctctgacctccctgtgcttctggtctgcatggccgtagagggaagcacgctctctggctaacccatctttgtgcttgctcggctggtggctcctggaggccccacactgaggattattgggcctgttggtcctgcttgaccctgaaattgagacctagatggagtctgggcctgtttacacattttggctaagttttgttggtttcagtgatggtggcagttcagaagctgctcccggggtgtccgcgctctgccccctggccattcactgtctctgtggccctctcctggtgtctgctggtggacaggttagtgagggaagaagggccttcctgggattgggcagatgactgggtccctggcagctgagttgctgctgagcctttctgtatgtttggtgatttgaaagtacagccgctctgctattccacagcttgtgcgtctgtgggttccacatccttggattcaactaaccatggataaaaatattcagtccccccataaacaatcaaatataacaataaaacaataaaataattcaaataaaaacaatacagcataaacaatatagcatttacatcatgtcaggtattgtaattaatctagaaatgttttaaagtgaatggaagtgtgtaggtcatatccaaatactacgccattttataccagggactggagcatcctctgatggattttggtgtctctggtgtcctggaaccgatccgccataggtgctgagagatgatgttggcagtgaggtgggatggtttctgttttcgcttccatctgctgcccgcttctgtgggcctcctgttctatcatcttcaccaggaaaggagctgtggctgctggatttgcattactgaatgaagaggccagaagatacacctgataaaagtggtgtgaagtttggcatttcttttctttttttttttttttttgaggcagagtctcactctgtcacccaggctggagtgcattggtgtgatctcagctcactgcagcctcgacttcctgggctcaagcgatcctcccacctaagcctcctaagtagctgggactacagtcacccaccaccacacccagctaatttttaaaagaagatttttatttgtagaaacagggtcacgctatatgccataactggtcttgaactcctgagctcaagcagtcttctagccttggcttcccaaagtgttgggtttacaggtgtgagccactgtgcctggcctgtatttcatagttgttgtttcagctttaagctgtccacaggtcctggcaataacattctgaaattttataattactttttagaaatgttccttttaattccattctatttacatatttctcaatttgtcttcataagcaccctcttactctgggaaaacacagtcatctctgagtctctgatatcagtacaatatggagtttaatttttttgtttaactaaaagtattctgtccccttctgagaaggcctagacttcactccagagctctctggccgaacaggctgaataccctcgtcatgaaagttaggatttgttgagtgtctaaatagtcactgttattactctaaatatttagtgtgagaaaactaggcagaaggaaaactttatattagctcaggaatttttggaagataccaaagatactaaacagaaatcaagaggccctttgtttctgggatattttggaagtaagttaagacattatttatttttccccaggttagtatattctttaagatctcaagtttaagtcgtatctaactggaaactgcctaagaaatctctcctgactgatagggaaatagctgagtgagccctttagactctgtaacttctgtccagtggtccgggtcagcgtgtgaagtgtgctggtctactctcggggtgttggtggtctgggtgtcggtgccagatgaggctactgtaaacagagccgagaggttgtgtttgcagcaggctttcccctgtgtgttgatgggcggacactgaggttattgaggaggcattgtatcttactaactcttcagtttatcaggttcaaagagcatgttgtctttgttttgtcaactgtaaagactaatatcaacttcctagaaaatagacaaaaatggatgaagtgatgatgggtttgacaggacaagtatatttcactttacctcagtgatgtatttaatttatcgtgcccatgagaaaaagcaaacctttcaagcacatgtcttacatttgaagccacatgcctgaagatgccttgggaagtggtcctgggcatttgaatcagaattggggaaaagattaggctctctagagatgggacacacatcaggatatgagaattagcagtgattcgtatgctgttgtgatggtgaccgtaagtccatttcccagtgttcccattgccatgtcacagaccctcatacttgtttgcccatgcacccttttttcttatcttttagtcacttaagctactagaacttagaaatattctagtcgacataatcatcttgatactttccaaacttccaaattctttgagacggttaaagcgatacccttaataaaatgcttttgcataggcaggtgatgttcaactttgatcagtctcataatcatgtatcacatatctccccttttggtcctaaaaagaccagcatcccctttaaacattagcaagcttcatagcttgcaggtggctggtgtgtttcacacctgaaaatgggagaattatttggcatgttgtagttaatgatgagtatacatttgtttaacgtttgctatacgttgaaccctgtcctaagcctttatatgcattagctcatttaatcctaataaaagctccgtgagagagatactattttcatgctgattttatagctgggaacactgaaccccaatgactcaataatttgcccagacatcagccgctaaggggtggcatctggagatgaaccaagactctctggtgcctggatttttagcaagcatgttcagcgggacctgtttcaaaaaacagccatttgactggtcttcttatatctgggcccaggacttcttgatgtcaggtaagaggcaggggcaggtttcattttcaccgtttaacaattaggaaaatttagcttctgactcttccatggagggatctgttgagatcacccacgttgcaggcaggggacctcctccagcccaacagcgataggaggctcctggatggcacccttgctgcatgccagtcacactgctaagccattctctgtgtatttcatttaaacatgttggaatccagtggcattccaatgcagtgtattaaaatcctcagtgaggtgggtttcatccccatgctctgcagtgggaccagagcctgggaagaccagtgagttgcccaggtcactataaagtctcctccggtaggggtttcaattggtctccaccctcttctccatgcctagaacccacctgtgaactgagggctctgcgccttgagctctcagttcataggacttgagtgatgaatcaaagatcagagccagaattggaaccccaggtctgcctgctctgcacccctctcgtggaacacatgtgctccatgcagagtgcccagcggaatctctgctgagaacagtaccaggcattgtgggctggggccaggtctgacatggaggcaggttcctgctgggtgggccgaaggttgtagcctgggaggaccctgacctgggcccgaagtgaattctaggtaactttgccttgcaagagggcaaaggtctgtgtgctttgtaccccgcctgccttggaggcagcgtgctttggagacgcagagatgtgtgggcagtgagcgtagagcccagtgcatcttccctctgtcctctgtctctgggcatcatgtgacaactagaaacctacatcttacttagtcacgtccttgttttgttcttcagaacactcttaaatgatcttcttggaaaaaaatattctttcatgtctgttttaaaagttttattcctgggctcagagtataagttcatttgtataaattctacggaagttcagtgatggcccgtttgactttccagctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacaggtgctgcagcgcagtaaatgtaatttgaagaaggcagaaggaacccatggctttagccggctgcccagattcctttttgcaccatccgtactaccaggtatgggcgagcacatatatctgatcctggcccgatggtgctggtcgagggccagggcacacatgtcgccagcagccatggatcgtttctgtagctctcaggtcactaggacacgctggagcaggggctggtgacaagtcccatggtgcagaggcccactgccctttctgcctcggtcttctgtgtcttgctttgccttgtaagatagcgtggtcatattcccgtttgactgtgcgtacttttctaaaagagtttggttgtagtacagagttgccccctgagagccgggcttccgtgtttggaatgaagcaagcactcactgtgtttttcaccttctgggtcgggccagacactcctgatgacgggttctgcagtgatggtggttgtcgggacattcacctggacacatgtgctcacgcgtgagggagtgggaaggagaaagggcttggtgtcttaacagatgttctagagggagtcctctccacagattggctctttcctttcctgagagccctaggtggaattttgtgggagaacaagttcatttctgttccttcactttctctagctcttcttcatgggctgctagaacagtttcatctgcaagttcccttcatcttctgaaacagattttatttgaactttcacttggtgtagacagattcattgttaggggatggtctttggttctttagatttgattcgcgaatcctggttcatccttactcgtgatttgtcattggaagtacttacaccatctctcccaggcctgtgacttttcggctggagcagtcctaggtttggaagtccttttatatgttcaggctgtggtcagctttttgcacttctttgaacttattttctctcttagtctgtgaagtctctttttagctactgtgatgagaaattgcctacagcattatggctgcaaaaagatgcctttgaacattttttttttttttttggtatctaagtgaagcaagccttcgaagaaaggctgaagattaggaataccgttcattctaatcgtcgaatgtgacacaaagccaaaattggttacaagccagaaaagaggattaaaaccttagcgaactgcaaagtttggtggtgacccctgagtctgtgtagtttgtgagctctggaacaggcatctgcctctccctctgcataattgtcttcttgttcttaaagaggctgtggttgcctccccccattgattaaagctctgtgctgcacccacaggtcacaagtccagttctcgtgtggccagttagtgttagctagttgtccgggcccgactgcacccttcacccctgcctgccacttcctactcagtcccaagagagtgcagtcagtgagctcaaagaacatccccaagggaaagtctctcttgaggtcattttcgtagtgctgtcctcggctgggtatagaataggcttttagggccagataatggccacagaggttctgtcagcttcccttcccttcctggcatttccagtttcctgctggtacctacagaagtggcagacttacaagctgtgtcagttcctcccttgatggccttgttaggtgtttgtagtcaccgatgccccaggctgctttcctggagccaggaagtcaggaaggaagggtgggctttccctgctatgtgctgtcatgctttgaggaaatactcattgcttctcagggccatttgaaagcactgtcttactctttaaaaaatttgacagcaagacttggcggcatatgtcccttgttcctggaaaataagatgacagttccagaatttctcagaatatgggatgatttacaatgggttccagtcttgagcagtcgtaattatattataataattagataaatctccagagttttatagagaaaaatttattcttaaaaccttcaacatacaaataattttctaattctagctgttcacttgcagcagtggcttggattagatagatggttcagtccgtgagtcactgatgtgatttttaaaatatgcacagaagcaccaaaattactgtatgcatttaatcatcctgctgttggagggcagcagttggggaggggttctggcaaggttggggatgacccacttcacttttaagacttaagtttttcctttagaatgtgacacatcataattctctgaccttggagaaatcctgcaactttccctaccgcagtttccataccgaagttttggtagaaaagggttagtggtatctgggttgtagcagggattagaggaaatatgtctaaattacccggcgcctggtcatcctttagaagctgagtcaagggctgtgatctttaattctttgatagagcaccagccaggtaccaggcacatgttttgggctagggagccagctttgagctcggcagacagatctttggggctcctggattccagtggaggagacagacatggaacaactggcaagtgagatagctgtgaataatgatactaattctgaagcaaataaaatgggacaacggggggagagagggccggctgccttggtcttcggggggggctccgttagtagggtcctatagctcattgtctgccatttttaaaatcaaaaggtctgaagcaagaaatttcctcatttattatgccacggcagagtccagagctttgccgaacacagggtctgcctgggaagtgggatggggtttatggagctccctctgggccctgcacatctgtgttcattgatgtggacactgtgttatcattctccattccccaaaactcttaattcttaaccatgtccagcctccaggcttttgaagaaggaattatgcacctatgacaaaattatggtaaataaaagcaacatttattatctttcagaaaaatgcaaaataggaaataaaatgtgcttggctacaaacttccgtacacaatgttgaactgagcattagaaatgaaacaacttgcatgtgaattttatgtaggtgattaaatttactgttgaatttccaaaagcaatgtttttattttcatagttttctgatttctgaattaaaaacaatcatgcttagaaatgagccatcttagaaactctccttgccatcctgccctgcagagcctcagcttttggtggagataatggcaacagcattagtgcacatacacgctgtccagccccaggacaccacaagatgtgtgttgtggttccatttcagtgctgtgtccctgaagcttcaggcggggaacctactcttctagtgcagggcttgacgaactgcaatctgcttttgcagataaagttttattggaggctggtcttggtggctcacgcctgtaatcccagcactttgggaggcagaggcgggtggaccacttgaggccaggagttcgagaccagcttggccaacatggggataccctgtctctattgaaaatacaaaaattagtcaggcgtggtggcgcacacctgttatcccagctactcaggaagctgaggcaggagaattgcttgaacccaggaggtggaggttgcagtgagccaagatcgtgccactgcattccagcctgggcgacagagcaagacccggtctcaaaaaataaaattaaagttttattggaacttggccattgggttttgtattgtctgtggctgcttccaagccccatcagcagagttgggtagtgtttgaccctttacagaagaaagttttttctgggacactgactgctagaatgaacctttttggatggacagaggctcaagggggcctccttgtatcagctcatctcctccccattttctgggttagaaacagtcctcagatgagacttcatctgctgatcacatacagctttggattttctgttgggtgccctagattccttaatcttttggcagtgcgtggaggagctgaaagatgacatcatctccgagagttgatttgggctcagttcctggaaatgaattccattcccaaagtctgtcactgttgttattattattattatttttagtgaaagagtgattctgtagtttttcatttttaagtactacaccccccccccatactttggctaaagaacattttattagactacattttctttaagaaatttgttgatagtacctgccactcttaacccttgaggtgggaagttacgaagatcatttgaaatgtctctctttaaattttatttgactgttccagctgataggacatttacctaaaatggttttccaagtcatttaaggttatgattctgaacttaggaacagcagctatgttatggagatattttgtgaggtaaaacaggcagtgtgttgactactattcacctgcatggctttaggcatggtgtttaaattctcc

SEQ ID NO: 2622 - DNA, 2371 bp, Homo sapiens
acaggatccttcttcatggggacccaggctcttcagtcaaaaaggggttattgtgcagttcttaagggaggcggcagcaaaagtaagaaatactggttggcttccccaaatgctcctttaagcagtgtgaagatgagggagaggaggagaatatgagaaatggaattcctgccaaaatctaagttgtcaggaccaaaaaacagaggggaaaggtgactttccaattttaatttttaaaataagtaatatccttaggagaatgtagaaaagaggagttcaagaagaatgggacttccatctagagaagaatttttctggccttagcaaaggagagacgtgagaagtgataaaaatatttcagaaacaaaatgaatactacgactccaatgttggcaggaaattagtgagaaagccgttggacttcaagaggtctggaggctgggaatgaggagcatttcagtggctaactgcatggatctttgggaaccaaataaaacaatgaccgtttcagagactgttgcatggctggtaacccaaggctatctttcatcaaatgtctttagtacactctcaagaacttagacctaatgcccatggaaattgtaggagaaaggaggccaaaattgcctgaaattaagtattgttctcttggtttttaaaagggaaattagattaattgtggttagaagtaaaatttaaattccctagagagtagcttaattcttaacatacaggaaaaattgccagaggaatctttacacatagatactcagaggatcatctatcaatcagttgtacttcttgggacttctagtgtgatgcacaaggtggatctcttagaattgacagatattttgcctctttctctgtgtaaattagggctggaatgggaggagcagccaagagatttcatcagccacagtgtgcatgatggatgagaacacgggacacataccagtgaagggcagaaaatgttacttatcgacactggactaaaaaaagactgtgcgtaacccatagataagccaactcttattgtgataaaacatcagacaaatccaaattgagaacattctacaaaatacctgaccagcactcctgaaaactaccaaggtcagtaaaaatgaaaaatgataactaaatgtaatatgatgtcctgaacatggttctggaacagaaaaggacattaggtaaaaactaaggaaaattgaataaaagtaagaaccttggttaataataatatattaatatttctcattaattttaacaaatatatcacactaatttaagacataataataggggaaaatgggtgttggacatatatatggctgctctctatatggcccaattttcctgtaaatataaaagtatcctaaaataaaaagtttatttttaaaaaattccccacctccaaaaaaaatcttataaatctgtttcatgtactgtagtatgaacatgatttcagagggtgaacagttaataaatgtttatatgacagttcaataaatcaatccccttctctaaggttttcaggtttactttctggcactacgagatactctaggctcaccttgcttactacttgccccagtccagccatcagccattcctgtttccttttattggagaatagaagaatgtaaggactgggttgttactggtgttttgttgcttctaggccctgacagctggctgacagaacaaggaaatatacctggtatattaacctatgtatatacacatatctatgaatatttctttgtgtaatcatatatatttatattaagctaaacatcagttcatatttaggactccaactctaaatcattaccctgtgggtcattccagccttctgtctttgtatatctgcagcctctcaatccatggatgttcttttacttggtcatcctcaccccatggttcaagggtatatgacttattaagagtgaaaatgagaagaggaggtggagcaagatggtcaaatagaaccattcactgatcatcctccctgcaggaacaccaaattgaaaaactatctacataataaagcaccttcataagaagcaaaaatcaggcaacagaatcatatggaagtgtgtgcaaggtatttgtcaaagccttgaagacaggggccctaaccagtacatggaggaactatactgctgggaatactctgataagagttggacagagtctctgccttcatttagtgtgtacactttataaataaactttttaaaaagatgactactgaatggagtccatttatttaaaaatgaaccagacacagccctggacagaaacttcctgatgagatacatgaaaattctgaaatacaaaacataatgaattgtaaacatctttctat

SEQ ID NO: 2623 - DNA, 3226 bp, Homo sapiens
ctcattccctgctctcagtcctagtgactagcgagggaaacgtgtctgcacagcttttctccctggatggaagccgagtgcctctggcctggagcctgtccctcaacctgtccctccaccagggaaagctgcaaaagggagtctgtggcctttccatcctgggtctgtgggagttcatcagagcagagggtgggctcctgacccagcctgtcctcatgggagtgctgcaagctgacacctaagagagaactgcctgattcctagggtgacctaccctgtcaacagaggagggtgtctctgttgcaaaggcctgggaggaggtggccggcagagcttcagagagccattctgggcaagaaggtggctgcctacaagccaggaagagagccctcaccagaacctgacagtgctggtcccttcatcctggacttccagcctccagagctgtgagaaataagccactcagtctatgatattttgttatggcagctcgagcagatgaatacagatgttaagaagctcagaacgcacagtaaagggtgatactacttgtccaggtaagagaggtgtcccagcctacagccaagctggatggaccaatgctgagccttgccttgaggcactggaagggtgctccacaggaatcaggagctgagaagctcagaactgcaaaatggcccctagcccctgctttttcatggaggagctgcagctacctgacagctctctgttctcacaggggttaggacccaggagctgcccttccatgatcacagctggctcgggcttctgctgacaggcgaggctgggctggcttgccagcagaacctcttatctccttcatgtggagtgagtggaaggcaggggacctttcttgacacttggaagagacaaagcccagctctaccatgactgaccacgagaccctggataaatcactgactcattcctgtcctcagtctctccagctgtagatgggatggcaatgtctacctctgcggactgttggaaggatcagttgcatgttagtctaagtggaactgatgctcagctggtacacagtgctatgaccgctctgcctcccattgtcaggggctggagtcccttctggctggcagctgcctgcacctcgccagggattaaaccattttactctaccccttggaactaaatcaagtattcttaagctccaattacctgctaccaaccagcacacctggtaaatacatttctatggggctggcctcccgtgctgagcttttacttctctgtaacagggaggtgtggattctcgagtgcctccctgtgagggagacatttggtcacctggagcctctggccagtagtctgttttaagcagcaccattgttcctgctattctcccctttccagaatgcctagtgggaagcctgtacacttcccccacctcttattcctgaccatagtctgagagctctgggagggaatgagggactgggggacagtcaagcaaggggagagagccagcagggacagcctcttcaagtgaccttcccagattttttttgaaagtatcattcagtgatacatctactcacgatgctatatttatctatgaaagaggcaggatatttttgagcggatgtaatttctggctctctcccttcaagaaaaaaaaaagtgtcattcctattcatttcttcctgcctctgcttctgtctctcacacatttcttttgtataaacataccccccacacatgcacacacacgcacatacacatacacacatctgtgcacacacacagaggcaggcacatggtccaagagctaaaattccgtgactctctttggctgattcagacttatctagcatgatgcatagaaaggcagatagacaggaggaacaggagaaacaaaaaggaaactgagtttgttcatttatatttttgcctccaacttcactgaacacttaatgttatgggaaattggatgagggcaagagaaagctctgagagacacctgccagggtagcagttgggtgaaccaggtcagaaagaacacttttctctctggcttccaagaagtcacagagagcagaggtaccccatttgcaggtgacccaaagctgagacctggggtaagggaagtctgaagcaagattcaggatttttagggcaagcctgaggaagagtaagatgaactgttaccaggatgagcatctttcattctgcatttaaattaaattaccaacacaaatgcctcaagtgtgggttggaggattcctacctacagggtgagcaggtgcctcctgtgtgatctgggcgctgggactgtcagagctgcaaaggtctccaggcagtaaatcagaaagggaggaggtgggggagcacttggctccaggtctctttagctgagttacagacagatgctgggttcaggtatcaaataattgaagagagagagaaaaatgaccaaatctagagaaaggaccaaatttgagacccagagaacatcagcagaaggtgtcttacaggctcaagaaccaggggtttgggaagggagagacagggttgggatctggtagaaaggggacaagagttgacctaagggactcaaacctaaggtaatttcctagtggaacttgggctgtgctgggggctgcagagccctgagctgcccctcccaagacagcagttccagcggcttttggagaataggacattacttagtgtatggatgagtgggtaaatgcttgcttgagtttggggtggggacccttcctggaggggccaccaggtcacagaagaagccagacagtgtgggagtccctggggatagcaccctccataccaaggtttacagctattgggggcaggaaccatcactagagtcagaagctctaggcctgtcgctgactcgctggaggaccgtgtgcagctcatcaaacctctctgagcctcaatttcttcatctgttacaggagagtggtgataatattgcagagggctttgtgaggattgaatgagctgggccatggaaaaggacttttaaaaagtgctttctaaatggtaaagcacaatacaagtgttgttttacttttctctaagaaaaggcagagggcttctatggaaagaacgtgggctttgaaaattgacaggtggaatcctggttatatcccctgtaagctgtgtggccatggggaagttctagaacataagtagataggtgtatagccatcccttccac

SEQ ID NO: 2624 - DNA, 13458 bp, Homo sapiens
cagcatagtcacaatcaggcttttttggggttatcaatttcctggtgaaataattatagtaacagcttaacagtcttttcttatcctttcttttagaagaagtaagcatgttttactaaagtcatgtacacagctgtgatttgaatggcaatatttatcttacatctgtgaaggctgattttcctgacctttgcttcagcataattgagttaaacactcaggggactgtgttactatatttaagacaatatgcataacgggtgttatttagctaagtggtgcctgcccagtaggtgctcaggatccagggagagaggcagactcaacatgcaaacaactcttctatgagggaggaagagaagaatgatcatcaatggcaaaaagcagttgcagcaaagcaaaaccaagagccagctttaagctcaggagagagcgctacatctcctcctcttggtttctggtgctctccaggttcagagacacttttctagtaataaactgaaaaaagatcactgaaagtatcatctttctgagacttctttaatcagatattttgtctggtcattctattcccaaattatcttccatttctcataatttaaaactttgttttattttttactctatattataatacccagattatatttcatcttctaaagctctaattaccttttttattcttgtacaatttaaattcataaagtataatttgtttggtttatttatgtgcttgactctacctagttgctgtgtatgtgtagtttatctcctacatattctatgacagttttattaaaagtttcttcatattatttcattagctgtgcatctgtgggataacatatcctggtaattttattttgttaattttctttaaaacataaaatattatgcattacacactgatttatttaaaagaaaaagattaagatcagtttgacaattttaggaagatcattttggcaatctagaatttttgtttattattagtttttttaaaatttagtaataatttattacaaagcactttgctactaccggggtgacactacaacagtaaataaaaagtttgacttctactagaggatgtacatcatacattacatggaaatcagttcccactatgtctggtccatgcagggtgagcctcaacaagaattagcaattgcagaatttataattgcagaatttataatgttcagcaataacaaattaaaaggtgttgtgtttgagggcaaagacttaagcatttagatttagtaaagctgaattcccaaattaggaaaaaaaatctgattttaagagtttggactcctgaagagatttgtcccacttccggtcacactgatttgctcactttattttgtgacttactggcttagcttgttttcttctatattgctttccttataacaacaatagagagaaaatgggatacattccatatttgttattgtcagaaccccagtggtttagatgtgattgatgaataagatacacgaagttacaacaaagcattgaataatgtgtagttaaaatccagcaggctttataaacaggcacatgtaaatcatttcagcaattttccctcttgtttatgccaattagttcccacataaatgtctacatgtttgaagctattttaaattgattcagcatttttctctcaaaattgcagatatcaaatatctagcatttaaatgctgctttagcctgagactagaagtgagctgcaatgcaactgtaaacacattttgaatgagtggttttgattttatctaccttcatagtttattagttttataatgacatgaagacacagaatacttatcaaaataaggattattttttctgttaaccaaaatgtaaacaattaggtgagttaagttctgggtgcactagctgtgcttctgctttactagtgtctttaaaaagacagaatactgataattttgtacctgtgctactattacagcctgctaaagaagaatagtggacatgatgttctgaaatcactttctggtcattaggttactgagattatatcactcagtgagagccttttcttaacaaggagaaagaactatgtccagagtttatagtgtcttccaaccatgcactgagacaattttcaatgactaattatagcttgagggagcaggaaaaggctaccagaaaaaaaaaaaaaatccatcagaggagttaatttgtagaaagaaggaggagtgcagtttcaaagcaattttgtaaattccaagtgtaactacttgcattcttcaaaacaatttccatcctactgactttaatgataggtcattggtatagaagagataaaacgttcatttcataactgcagtgcctatgtttgtataaggtgtgcccaggaaaaagtcaactagtttttttagaaatttattggaggaatatttgaaatattaaaggctatagtctatatagtcaattcatattataactaaagtctcactccctagttaggcttcagtgttctcacattggcaatcttttattgattattctgaaactttgaaaaaaaaaaaacaactagatagcccccactctaatttttaaatactttcttgaaattataaaattttgctgcatgtttcttgtagtaaaatacattttatagatttgtttaacttacagattttagtggcaccaaaaatttaaaaatataaagtagacttaatcttgccaaatgatgactgaggaatggaatgaaaacaagtgtatacctaaatcctttggctacatttaagttacttttagtaataaagatgtaatgaaaatgaagcaacagccaggcacagtggctcatgcctgcaataccagaactttgggaggctgaggcgggtggatcacctgaggtcaggagttcgagaccatcttgaccaacatggagataccccatctctactaaaaacacaaaattagccatgtatggtgacgcatgcctgtaatcccggctactcaggaggctgaggcagaagaatcgcttgaacctgggaggcggaggttgcggtgagctgagatcatgccattgcactccagcctgggcaacaagagcgaaactccatctcaaaacaaatacataaataagaaaatgaagcaacatatatatcattccaaagctgaagccaaaatcttatcctgaaattagataattattgtcagcaaaattagccataatgatctcatctaataacttacctgatttacatgcaaagccagaataatatcaagaattcagtcacctatcacacagagcacttcatgtgttttacttgaatagcttggtctttctctttcagccatgagtgccagagtgatattttatgcttgtatgaaagaaatacttcaaaaataagaaaaaaactataggataatatgaacacttatggaatagaaagaaggatgacatcacaacaaaataaagcaaaataaatggaggaacacatttggggcagtgaaaaattagaattttctgtggttgaggaagcaggagctgtagagtaaagttgggttgcccagtgagattaaaaaataaaagggctcaaaaaactggtgaagacttgaagaagaaccatccagggattttaagagtgaataaagagataaaatcaatatttaaaaacagttggtgtgataaacagatggaaaggttagaattaaacctggaaaattaaatggctcttaaagaattcaaagtaaatagtggtggggcttctatccagagtgatggcataactaattggaaataagctagagaaaaaaaactttaaaagaaaaaaaaggtaaatatttgatgtctactgcctcagaaacgactgtgatatccatggcactgaagcctggagggagtatgataccatgataaccacaggaaaatgtaggggttaggaggaatggcttaggctgaagtcatgttaaggacaatgagcagttgttaagtcagagatgtgggattcatttatagagaatatacacaagagcagaaaggtaaaaaggtggatattctatactgcattcaattgtttattgattatcaatctattaaccaggcatagtctgaaatactgatacatgtttttttttcaaaacacatattgcaaaagttagttttctattccaagatctctcagttcttttctctaataataacacatttatgtagccaataccgattttttaaaaggacaaacattcaaattttaacctagtccaatttttctaattcatgtgtgaagattttatgaagctctgagttaaaattttcaaaaactagattatttatataaaaattgaaaaactgcctaatggttatcattttacctgtaactcaatcaaagtgttaaccaaatttggactgtggtgaagaattgccagtgaacagtgggtgggatgagaaaggtagctaatttgttttcaaatcacttagattaaaattaatattgctttgccagcataggcctaaacatatgagaattcatttaggaattcagcaattgcaaataagtataatttgctgaacagttctatttacccctgaattctaataagacccattatcataatttatcatttaggaaagcatagtgaagttaaaaaaaaaaaacctttctgactagtcagtgactttacagaaagaagtgttagaatgattatatgtgggagaaggtatccttgcatcagtgcatggttccctttaagggagtaatcattaattatttatataagacaagaagttactctaatagcttgtcaaagtgttgctggtcagaatcatagtgtcttgaaatagcagtttaaaaacaattattattattgttattactatttttacctctgggagcctttattgaatcaaagtgcattttgaaacagacaacattcttgctgctgttaagacaacattctggtgtgcttatagcttggtttctttgatgctcccacccatttttccctccccctcttcttttaggactcagttacttctggactttctaacagaaggaccattctaatatgaaaacatttcattttaggaatacccacattgtaggagtgacacttttttgtgtccattgattgatagaccaattatcaagaggtttcaggctagaaacctcttactactctagggaaaggccctgctggtgaatgttttcatgaacagtaactagctgcatccatctgatttcttatccatgaagatacttggctacacgtgatcgtcctgtaataattgtggtagactgaataatggccccaaagacatctacaggcataccctgtttcattgcacttcacttttttgtgctttgcaggtactgtgatttttacaaactgaaggtttgtggcaaccctacattgtgcaagtctattgatgcactttttccaacagcaagtgctccctttgtgtctttgtgtcacttggtaattattacaatatatcaactttgaaaattattattattatatttgctatggtgatatgtgatcagtgatctttgttgttaccactgaaatcattctggggaaccacaaacaatgctgatataagatggcagactcgatcaacaagtggtgtgtgtgttctgacagctccactgactggtcatttctccatctctctccctctgcttgggtctctctatttcctgaggcacagcaatattgaaattaggccaatttataatactacaatggcttttaagtgtttcagtaaaagaaagggtttcacatctctcactttaaatcgaaagctagaaatgattaaacttagtgaggaaggcatgtcaaaagctgagataggcagaaatctaagcctcttgtgccagttagccaagatgtgaatgcaaaggtaagtccttgaaaaaaatgcaaagtgctactccagtggacacacgaatggtaagaaggtgaaagaccctcattgctgacatggagaaagtttcagtggtctggatagaagattaaaccaactgcaacattgccttaagccaaagcttcatctagagaatggccttaatgctcttctattctatgaagagagggaaggaagctgcgaagaaaagtttaaagctagaagaggttggatcatgaggtttaaggaaagaagtcttttctataaagtcttctttcactttgcacataaaattgcaaggtgaagcaccaagtgctgatgtagatgttgcagcaagatctagctaagatgattaatgaatgtggctacactcaataacaaattttcaacgtagattaaacagccttctactgtgttggaagaaaatgccatctagaactttcatagctaaagaggaggcaccaattcctggtttcagagcttaaaatgtaagctgattctcttgtgaggggctaatacagctggtgactttaggttgaagccaatgctcatttaccgttctaaaaatattaagatgcttaaggtttatcttaaatctactctgcctgtgctatataaatgaaacaacaaagcctgatgacagcacatctgtttacagcagggtttactgaatattttaagctccctgtggagagctactgctcagaaaagaggtttctttcaaaatatactgctcattgacaatgcacctagtcacccaagagctttgatggagatgtgcaagattactcttgttgtcatgcttgctgacacaacatacattaggtagcccgtggatgaaggagtcattctgactttcaagtcttatatttaaaaaatacattttgtaaggctacagctgccatagatagttatttctctcatggatctggcaaagtaaattgaggaaaggagtcgctcttctaggtgccattaagagcattcataattcatgaaaggagatcaaaatattaacattaacaggagtttggaagaaattgattctaaccctcatggatgacttcgaggagttcaagacttcagcagaagaagtaactgctaataaacattagcagaatggaaacagcaagagaactagaattagaagcagaggctgaagatgtgactgaattgctacgattacatgagaaaaaaattaatgtaaaaggagttgctttttatgaatgagagtaaaaaagtgtttttttgagatggagtctactcctggtgaagataatttaagcattgttgaaatgacaaaaaaaattataatattacataaacttagttgataaagtagtggtggggtttgaaaggattgactctaattttgaaagaagttccactgtgggtgaaattctatcaaacagcatggtatgctacagagaaatattttgtgaaaggaagagtcaattgatgtggtaatctccattgaagtcttattttaagaaattgccacagccaccttagccttcatcaaccaccaccctgatcagtcatcagccatcaacatctgaggcaggactctccaccagcaaaaacgctacaacctgctgaagactcagaagatttttggcatttttttgcaataaagtatttttaattaagatatgtacattgttcttttagacataatgctattacacatttaatagactacaatatattgtatatatgttttataattactgggaaacaaaaatatatgtgatttgctttgttgtgacgttattgttattgtctggaagctaacccaaaatatatttggggtatgcctgtacaatcctattctctggaacctgtaaatgttgacttacatgacaaaagggattttttcagatgtgattaagttgaagatcttgagagaaagagattatcatggataatcagggaaggacctaaatataatgactgtcttctatgaaaagggagacagtaaaatacatgattagagagaggagagagaggcaatgtaattatagaagcaaaaggttgcacaggtgcaaaaaaggcgtcatgggcgatggaatgtaggtagcctccagaagctaaaaaaaggcaaggggagaaatcttctcttagttcctccagaaggagctaacctctcaaacaccttcacattagctcaatgaagataatttcagcctcctgaactgaaagagaatacatttatgttgttctaagccatgaaggtgttggtagctggttatagcagccataggaaactaatgcatatgctaatcatgtaatgataaaactagtaagcatgcaatgtttatacaggaaaaagccttcctataaggaatggtagtatatttcactagtagagtactttacagattttagagttcttttaaattattactcccatttgattctcaaaacaattctataagtaagcaggaaagatattattataatacctattttactaatgaagaaattgaagctaagggagcttacatgtcttgtggtaaaaaaaagttatttgactctttgcctagtaatttcttctctatagggtcctgtttctttaaaaaggagctcagaaaagcatctgtaaccagctatatagaccacatttctttaaggaaggcaaatacttttctggtccatagtcagacgcattatccattgcaacactggcctgtgcttgcaaatgttttcttaaactggataaatagaaaattcatcatggaaagacaaccttctaccttaaattcatgttaagcagaagtttattgattggtagatgcaagatcctctctacacaagaaagaattaagcagaatattcatatgaatttatattacttaatatggggtatgccattgaaaggagttagcaagcttgctttaggcaaacagtaaggaaagggtcctggagagcctttgacctgccctgtaggtgcttgcaccagatgttttgtgcagataaaggaacttgcaaagggggcttgcctaaacgtacagactaagggcccacatacaactaggggaatgggatggagccaccagcaattcatgccttatataaatagggaacccaccttcatcagcttgtatgtaaaggcccttgtattcaactctgaagggggcaaccagcaacctgctattagaacccctctttttgctgagagctttccttttcacttaataaattctactccactcattttttcaatgtccgcatgcttattcttcctggtcatgagacaagaacctggacgtagctgagctaaggcacaaaaaacctgcatcattttgggggctcatctgggatacctggtgggtgagtaaatgcagtcccacagcctttcactttcatttctgagccttcttgtcctcagacttttcctgaaggcagatgcagcactgaacctctggtgagccaattaggaatgaatggcacagctacagaggacaggatgcaggagaggaccatgacacgcccacccccgtcatcctctggggttgggaatgtcggtctcgtcccaatccagtcttttctatggcgttttacttctttttttcagtactgtcacggcacctatctcttcttttgtaatgttaagggtgttgctgcaaactgcggagatattactaggtagaatgagcctttgacccagccatcagacatgcaattcagaataatgcgatttccttctgttcttagaggtgtcgcccacccccatcctgatggacatgtggggtgggaatgagctgtggctgccacctgggcccgggccccaggacagcctcggtagccaagggccccatgtggccagctggccagtgtttcctgcttaccatccccccgacgccatgcaccaacagagtctttcctcccgtggccaagccaggaagagggtacaatgattgaaagtttctctccctgttggaggaacccatttgcatagagctagaggattttccctcaggcatcttccctgccctgcccttaagctgttttttttttttttcttttccccacactgtcaggagttaccttttatgcaagaggtttttttttttcctttggaagacatcttattaggccagtaccccaattcacaagacatccttttctctcccttgtttgaggaggactcagctccatagctttaccttagcatgactaagtcctgctgaatttcatggatagaggaggtcatggtagcattcatggatagaggatgctcccacttcatggatagaggtcatgctagcattcatggcatagacaaggtctagggaactcaaaggctactgacagcattgggaaaaggccacatgtggataagtgtggataattcccaccccctcggccccctgttaatgtgggtgaaaacctctgttttccttatgaaaccccaggaattgaaagcagaaagatccctctcaaaacctttagggttcctaacctgtggtaagtaaagaatgttactttctaataggcccaggagacccatgttcttgagacctcaagaaaagaggaatttactcaactcataggtatttgaggctaccaacccatggctggcctcagctgtaaaaggtcttatctgagattccgtggggaacagggtgtcattaaagccgatttaaaggcctgtgtgaaaaacaattactcatgctgcactttacgcaaataatcaggccaagtataagactaaggtttattttacaagcaacttagtcctatcatgatttgtttttgacaaaaatggggactagagagagaaaaattatgtttcaatgcttaccatatacttgttattaaattctcgtctcatctgttgtttttaggtttttgcctacattctagactaaccctgtttatccccgtgaaccaaccagtgatctctggctgtatctcagaagaaacagacagatgggtaatataaagatctagatcaatagtctagttctggacaattatcctgcaaagcctgcaaggtggtaagaataaatggggtgcccataacccagaagtttctttgttatggaaaataagaccaagggagctaaccagagccaagccccatgcccccacatcttggcaggcataactatagccaccagttttctgggcatttcagcagccttggggtttttttgagctgcccttacccccttgtttcattttgatgtgcatcttctaataaccctaattgtttattcttgcttagcggccattaaacttcaaatggtgttgctaatggaaccaggtatgaatgtgtcatttttctggagacccttaaagtgacctcaagaggagccctaactgccgctttcctaaaacagtgccccctgtcagcaggaagcagttaagagctgtcattgaccactttccccaccagcagttggggtatccactcctcaagcggggaatgaaaggcattagccaccttgctttaggtagacagtaagggaagggtcccggagagcctctgacccaccccacaggtgcttgtaccagatgttttgtgcagataagggaacttgcaaagggggcttgattaaacatgccagcagccgactaagggcccacatgcacactgggggaatagggtggaggcaccaggaattttcaccttatacaaataaagaagtcagccccatcagtccgtatgtaaaagcccctgtattcagctgtgaacagggcaccagcaacctgcttttagggcccctctttttgctgagagctttcctttcctaataaatttcactccactcactcttcgacatctgcatgcctatttcttcctggttgtgagagaagaacctggaactagctgagctaaggagcaaaaatcctgcatcacaacttagcatagaacatagtgaatcctaaaatgaaaccagaaatattttagaaaataataatcttaaatatatagacagctaaatagaataaaaaactaaaataaaaagtataccacaaatgtgaaagtgatggtttcatatttctaaagatcacccaaggagacagtttagaaattaaaatgaaaagtacatttttagaatgtattaaagatattataactatgtccagctttattttcatgctgtgtctgcaatctccactaggatgacaatatgcctataaccaagaattttctcattttccatggtcaacattataattactgtaaaggcaaacagcatggctgagtacaaagtacattcaacaggtaaagcatacagtataaagtctatactgtagctatgcaaatgccatcatcctcaaaagcacaagtaaatattgattaagaactttaagcactttgaaggttgctggagcaaaatgaatacgtttagaagtttttagagattgttttgactctattgggttcctggaactgagttattcaatacttctgaaagaagggggcaacatattagatagcagaaagtggttcaagaccacacctcagagaaactttaaaaaaatgaaggattaagaaagtcattatttgatatttttaaaaataaataacctcagtagaaatccattttaattttaacctttatattactaactagaactcatcttttattctatttcctttcatataattcagatctgccctagtacgtcactgaagagagactaaagaaaaaattgtctaatttcataggacattataggtaagctgatttttacagaaatcctttacaaattggttagggccaatgttgttagacctgaagacaacattagaaattaactctggcgtttcatagcataaaaaagagaggcttagaatgatgtgtgatggtctcaccatccatgctgttaatcacattaaaaacctgaacaacaaacagaccccaagaacaccttatgtcctcaaaggcaatttgccatttaaaaataaattctcaaatctgtcgactatattctctcaaaccttgatagcctaagcttccaatttttctcctttggaaaacttcaatagcctacttactacccttgttcttcatcatcctatctcctttccctctaacttttgccccccataaagccagagtgattttgaagtttatatgtcatcatagaacttcgtagtaaaattatttcagtagcttctcactggtcttgtgatgaaggctaagttccctggcctcagccctggctgtttttcaactaaatctcacttcccatccagccccactcatcactcctttgcagccacaccagcctcctgtgcgttcttctcaccctggaggctttccttgcccagtccagttactccctcagacctcaactcaagcctgacttcctacaagtcttccctgactttctgacttatttactaaacccctgtcgtagactcttatagcgacatgtagctttctttcatggcacttatgacagttgtgatttcacatctgtatatatggcgtagtctccccatgaaactataagttccagaaaggcagtattagaatcatagtgttttctcaccaccagttactaaaagctgatcacaatttctaggccaataaaatgataaaagtgat

SEQ ID NO: 2625 - DNA, 1427 bp, Homo sapiens
cagttattctaccaaaaagacatatgcacttgcatgttcatcgcagcactattcacaatagcaaagacatggagtcagcctaggtgcccatcgacagtggattggatcaataaaatgtggtacatctacacagtatgattaggccattcttgcattgctatgaagaaatacctgaggctgggtaatttataaggaaaagagatttaattggctcacatctctgcaggctgtacaggaagcatggtgatggcatctgcatggcgcctgtggaggccccagggagcttttactcatgatggaaggcacagagggagtaggcacatcacatggtccgaggaggagcaagagaaaatgggagtggggctctttgtcctgggaagagtttgctgcatcttccagtttcagtaatcaaagaagcaaagttccctgcagttcttcaaggaaccttgagaattcagaaggtcttggggtggctgcatccatcctgcagacaaatgccaatcagcagaggggccattcccagggacacatgtctggctgacttgggccttggccaggtaagacacacagcatgcatgcctgcatttctgaatgccatagacctgacaagtcataaaatagcaaccaataattttatgttagagtgctcccttcctcacagaaatctcagcatatgtgaagataggttggaatgtgtaaagaaaagctaagaaagcagatttctgataagaacagcgtgtgacttgtacagcagctctgaattacagcccgtaggatggaatgctgacagttccttcttccttacctgtgatggctagaattttatttagcacatcgtttttgagccaatctcaaaatgagaaaacttttgaggaattatgcatagtgtgaagtatattctttcccttgttgcccgtggagattccactgtgacagggcagatttcccactgcagggtcgatggagatgctgctgctgtctttggacataatagtttatgacaaagagaccaaaataattcctgtttagccatgcggttgtctgtaaatctgcttagttggtcatccaaagtgatgacatttaagatatagttgatacactgtttatcttaaagaaacattttaaaattaattcttcagacctatgtaatattttatcttttctgtttaataatatccaaatgtgcttttgtgaagcacaaaacacatgtgtatttcttcataaatcagtcagatagctttgaaaatatatttcaagtatgtagcaaagaccctcaaaacacaattattgaagcattataaaaaggtgaatttgcttcagttttggacttttaatagacttcactgttatgtagtaaagatagaaatatgccataaaagtctctggttaagagccaagactttttctcctgtatcatttcagatccc

SEQ ID NO: 2626 - DNA, 2023 bp, Homo sapiens
ggaggcgtggggctcaaggacgggatgggcctgccttctgccccacagtgaccgacctggagatcaagtttcagtaccgggggcggccaccccgggccctcaccatcagcaacccccatggctgccggctcttctacagccagctggaggccacccaggagcaggtggaactcttcggccccataagcctggagcaagtgcgcttccccagccctgaggacatccccagtgacaagcagcgcttctacacgaaccagctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgactgctgctggagatgttctcaggggagctatcttggtcagctgatagtatccggctacagatctcaaacccagacctcaaagaccgcatggtggagcaattcaaggagctccatcacatctggcagtcccagcagcggttgcagcctgtggcccaggcccctcctggagcaggccttggtgttggccaggggccctggcctatgcacccagctggcatgcaataacaaggctgcagacggtgactggccctggcttcctgggtggcggtgcggactgatgtggagatgtgacagccccgatgagcacctggctggctgcagggtcctacctctgggtttcctggaagtggatttgggccaagaaggagagggagaaaggcccgagcccctgccttcccgggcctttctctcctgggctgtctctggtctggtcagcctggctctcgggaaattcagccatgagcagggaaagaactctcccaaccctggggcctagctgtataggaggaattgcctaagggtggcccactcttgtgattgccccatttcctctggcaacaaaagccagagtgttgtgggccaagtccccccacagggcctctgcagggcatggccctgatttccctggtttgagactcacttcctcatctccctgtcctctgagataatatgagtgagcacttaggtatcatatcagatgctcaaggctggcagctacccccttcttgagagtccaagaacctggagcagaaataatttttatgtatttttggattaatgaatgttaaaaacagactcagctgtttctttccttttactactaccagttgctcccatgctgctccaccaggccctgtttcggatgccaactggcccactccccaagcacttgcccccagcttgcgaccattggcactgggagggcctggcttctgggctgatgggtcagttgggccttcataaacactcacctggctggctttgccttccaggaggaagctggctgaagcaagggtgtggaattttaaatgtgtgcacagtctggaaaactgtcagaatcagttttcccataaaagggtgggctagcattgcagctgcatttgggaccattcaaatctgtcactctcttgtgtatattcctgtgctattaaatatatcagggcagtgcatgtaaatcatcctgatatatttaatatatttattatattgtcccccgaggtggggacagtgagtgagttctcttagtccccccagagctggttgttaaagagcctggcacctacccgctctcacttcatctgtgtcatctctgcacactccagcccactttctgccttcagccattgagtggaagctgccccaggcccttaccaggtgcagatgcccaatcttgatgcccagccatcagaactgtgagccaaataaacctttttctgtataaa

SEQ ID NO: 2627 - DNA, 1194 bp, Homo sapiens
agattggtgacctatgtgctctctagcagcacatttatgggtggcctttgctgctcaccttttaaatgcctggaaaggttctaacatagagagaagggggtagatgcaatattataaagccaatacttcctatcatttattgagcaactgctaaatgttaggctatgctgagtacttggtattttctctatttctcatggcaaccttgtgagagagtcattatctctcattttacagaccagccaaaggatctcagagaaacacctgctcaggactactcaacaagtatatggtggagccacctgccaacctgctaccttaaactgtcattcaaactatctacatatcaactgtcatctgctctatattgttggggcttaaggtcactgcacatcttttgcattcgttagctcctcttcactttctgccatgaatggaagcagcctgaggtccacaccagatgcagacactggatccatgcttcttgacagtctgtagaactgtgagccaaataaacctcttctttacaaattactcagccttgggttctcctttgtaggaacacaaacagacatagacagtgggtttaaccatcaaagatggatccttgaattattttaataagtgaggtactacaacgttatcacacattataatctcttttgcaatattaatatcacttccaggcagcatgtgcagaaagtcattaagatggattagctcaaggctgccaaacccttggtacacaggttgtcacttccccacctgtgtccaaagcagacatcataaatgattcactcatgtccactggatccagatatggcctcagaatatttctggacaacagcacttcaggaaaccatgaccaatgaattaaaagctggcacatgaagtgcatcctgtttgtcactgctggatgagaagactgccaaaggtccttcattcttgacactcatgatccaggtggtgtaggaagtggaactaattgtgagctcaacttgtgagtcctgggtctagcctgactctgacacttgttagctctgtgaccttggaaagttagtccctgtctgcaggcctcggtgtcttcatgtatcttttagctctgtagttccatctggctccaataacttgtgattcatgacagatcacctgatgggggttggacgtgaagtgatcctatggcttttgcatccc

SEQ ID NO: 2628 - DNA, 1123 bp, Homo sapiens
ttctactgctgctcaaattctttccttacgtaagaggttatggcagaattttgggggccagtatgtgtgttggaggtggtgggggcgatctggggaaacggtcttgaaagagctgtatttccaaaatgtctagaagttggtccggtgggacacccaaagcagttacaataataaaatgtttcatgataagaaattaaaatattctttatattattttaatttcttaaaattaagaattattaataatcattaagcttataataaaaaattaaaaaccagactaggaaatgaaccacatgagggtgtgaactggtaaatgtaataaacaggaaaattagccccttaagtatctgagacaatagaacaatttgaaaaagagtatcaaatagttatggtcaaaatacagagataaaatgataggacataggactatgaaaaaagaacaggtaaatttgaaaaagtacagctataatatgtagaaataaaaagtttagtcatttacatataaaaaacctcaatgattgaagtcaaaaatctaataaaaatagctcattgaaaaggggaaagaaaagtaatatattattgtttataaatatagaaatttaaaataatatattaacaaatagaattccagcagcttacatcattaatagatcaaaagagaaaaatggaaagatcatcaccatatatgctgaaaagccatcagataaaatttggcatcgacatataaacaaaccctctgtaacatggtaaaaacaaagggtaaagttcagcccccaaaccagtgttagaaatactagttctaaatgcaagatatgaatgtcctccttcacccctattctttttaaaaattataaattaggaatatgtttggctgcaagtaacggaataccagactgtaatttttatagtgtctaagactataaaaggcttaaacaaataaggatttgtttttctcacatcagaagcttgtatataggtggctattttgggtcagtgccttgatagtttcagggctgatcaaaggatatgtgcatttactattttggtatatattacaaaattgccctccaaagagatctcaccaatttgaactatttcccatagtatgatgattgccttt

SEQ ID NO: 2629 - DNA, 1045 bp, Homo sapiens
gttaccttttaaatactatgtttgttctcacgtttgcttaattatttctttaggatgaattcccaggaatgctattcctgaccctaagtatataaaccaccccctgggtctgaagtgttgtttccatttatatgtgtactagcaggatttttcattaaacatcatgtaacttcattaaaaaaaacacgaattaagttttggcttgtgtgatatgtttgttattacagcacaagtaataagtagatttactattgtgagatggggaacaactggattaaaagaatgcaagaaaaaaagcagcatgtgactaggagttgtattatgatgatgagaggttcctgttaacagcatgagaaaatattcatgaaccgatgatagaataatagtcacaaacagagtctccgatggagaatgccattttggaagacaaagatggctccatcttcagcaggaagcctgggctatggtttgaaagaaagcgagacaatgtcatctggactgtcccataacagcgagtccctagaatcccaatgccattccacattttcccaggaagtgtaagctcattaagacctaaaatatctttccccatccttgtaccactgctatcaatcttcatgaaagaatctcccagctcttcaagatgcagctcattggcacatacagtatattctccaggtgacaaagagacaactgagggggatacctggaagtaccaaccaccgttatcatggccaatcttctcagccggttaatcatgtggtccttccagttaccaaggtctttttaaatttagagggagagggttagagtaattagccttaccaggatcattgatcttaaagagatacactcgctcaaatgcttttattcatcttatacaattcgaaaaaagcagcttccaactccaaatctcctctcttatcttcagctcaaaatagcattgagttaaggttaatatcaactgggtttcacagaaatggctttcacactgaattaaacttgaaaggaaagaagttttatgatgaataaatctatgtgcctg

SEQ ID NO: 2630 - DNA, 546 bp, Homo sapiens
gggttgcggagggtgggcctgggaggggtggtttttgtctaaccctaactgagaagggcgtaggcgccgtgcttttgctccccgcgcgctgtttttctcgctgactttcagcgggcggaaaagcctcggcctgccgccttccaccgttcattctagagcaaacaaaaaatgtcagctgctggcccgttcgcccgggacctgcggcgggtcgcctgcccagcccccgaaccccgcctggaggccgcggtcggcccggggcttctccggaggcacccactgccaccgcgaagagttgggctctgtcagccgcgggtctctcgggggcgagggcgaggttcaggcctttcaggccgcaggaagaggaacggagcgagtccccgcgcgcggcgcgattccctgagctgtgggacgtgcacccaggactcggctcacacatgcagttcgctttcctgttggtggggggaacgccgatcgtgcgcatccgtcacccctcgccggcaatgggggcttgtgaacccccaaacctgactgactgggccaggcagg

SEQ ID NO: 2631 - DNA, 48858 bp, Homo sapiens
gtctcactctgttgcccaggctggagcgcagtgacatgatctcggctcactgaaacctccacctcctgggttcaggtgattctccttgaactcggcctcccacgtagctgggactacaggcatacgccaccatgcccggctagcttttctatttttagtagagacagggtttcaccatgttggccaggccagtctcaaactcctgacctcaagtgatccacccaccttggcctcccaaagtgctgggattacacacatgagccaccacgcctggccccattttatatacatgctgtatgtttgttgcatgtgtcaatcattttgaagttgcatttccacttcacacactctttttttttaaacggataattaggaaattcagccattttgaagttacttgactctggttatggttgttttctaagctctgttaacacacctggtcaaaagtttggaagtcagacatgttttgtttgtcgtttttttttttttttctctgtcagacatggcctgcaccataagcttctgaaaaactctttgaggccagagacttggcttcattgatcttagtatctttggcaatgttttgttcgtagggaagattcagtaaaaggacatttggcatcagactaaaggaaatgtgttccattagatgtttaaatcacggtggtttattttcaaagccatagttttgtagtgtttctttacaacgtgattgaatttaaatgcactgggatgacttcctccaagaagaaggaaactggggggccgagaagatgtggcaaaagcagaaacatgtccatctctcattgggtagggacatcattcatttatttgttcccgtatcattttgcagattccttttcaacctgtacactggctgtctttctctcatccccaagtttcaagatctctggtggtatttcttttccatatcctttacctaccttgccttgctcctccacattcccaattccttcaatttttttttcctctctaatctgctgttttatggatgtcaagatatactctagttactcagctcttaccttagaattgagacttcagagtttcccactaagttccctttgcgatacacaggaaagggaacattaagaggagcacactgagactttaagcaggaaaatcggtaaacgctgaccatactgaacaattaagtctactattacttactggttttcttcttcagagcataaaccgggcttccctttccccagacttggctactgtcccctggcttgcaataacccctggctcctcaaaactctatgccttatacatatgcctttccaagtactcttgccatttggaggatgggaagatactatgtcagagaatcccaggatctgattggatggatataattgtgactgcctcttcctccactgtcaggtaagtctctgaatgtgcctggctgctctgctttctctgagtgccttctgccatgagccaagcttttctgtcaccataagcaatccactcatctcttcaagcagggacacgcatctacgtgattggtggccagatcaaatttctgccttctagaaggcatctttcatatccagtctttcacccttaccagtaatgttatggtctagacttcattgacatggttcctccatggaagatcataatactgtttcccaacccagacatagcatctttctcaacacagaactctaggcaactgctttcattgattggagttgtcattcaaattcaaaatgaagcctacttggcatccctagcagctagtcttctcttgcctagatcattcctcttcatttatttctagccacttgcctcaaccccctcgagtttaaccattgccagttttgattggaaaacctatttattgaacatctctggtgatttttctgctgtacccagttacctctgaatgtgttgcccatctctggaagaagaggtattcctatatacacaccccacattcactgagggcttctctgtggttagttcataactctctttcatatgtggtagccaatgctccattaattaggaatgatgttgaccattctttcttctaaagtctgcacatattccttctggagttgtctgtcatgatagtgtcacacttcaacaatgttgaggctcctggtaaattctacagaaacatttccattttcctttgttttatgtacagaaatatagttattaattaggtccttgggcacaaaaatggaggcaggcatgtgccatttaacatgtgtgttagggttctccagagaaacagagctaataggagagagaaagagagatagacagataagaggagacttattatgggaattggctcatgtgatgatgaaagctgagaaactccataatctgcagtctgcaagctggagaaccagaagagctggtggtttaactcagtctgaaggcctgagaaccaggggagttgatggtgtaactaactcccaagaaccaggagctccaatatcccaggggaggaggaggtggatgtccttgctcaagaagagagagagtgaattccccctttccccatctttttgtcatattcaccttttcattgtattcaggcaggccctcaacagattgggtggtgtccgcccacattggtgagggcagatgtacttgactcagtctaccaattcaaatgccagtttcttctgaatacaccctgaaagactcatccagaaataaagttttaatagacatttgggtatcccttaacccagttcaactgacacataaaattaaccatcacaatatgcttcacatatgtttttaaaatagcttaattttttgtctataagtcttgtacatgggtagtggttgagttagtatcttatcccttgagtttgccaaccccttggatagggtcagtgtcttgggttctctgaatggcatttaacacatggtcacaaaaaccttggtctgaagaactttataatgataaagttcaaggtactttggtgtcttgaggaactccctggactgtgaggcagagactcgcttggctctagtcctggtgctggatctaactggctgccattgtggggctcccctaaagataaaggaactcagtttcctcatctgtgaaatgtgaggatggaattcatcaccatgtcccctcccagctctaaacttctctgagtcttgtttttccctgctctgtatcctccactttctggcatgttttttatatttactattataaatgtgtccctattttataagttgttacagcacgagagagaggtaaggaatagttaacaaaattgtattctgagtagcctaatattcttttttttttcctgctaaacttctttttcctcaccttctcctaacatttttgtgggggtgggtggactggtgggtgactgtagtgatattgatattcagagaggagtgaaaaatgcaaaattgcaaggttaacaacagatggttatatggtgccattttaggagtgttattaaaagaacaaatctattttcctgaatagtaggatgtcttaagtgtttaggcttaaatctactgttgaaatagaaaaagaggaggaagaggaggaggagaggaggaggggaaggaggaggagggggaggaaaagtcaaggaaacacttagaacatttttgcatgatctcaattttcttcttgttccaaggtttttaatttggacagtggtatgtgcttcagattgaatgcaaggaaatttgttgcaccatttgcctgacagttatcattttccttgacgaaaagtttttctgaatcttgctttgctggagctacctcttcccttgccctgaataacctcacttgcttaagtcatcgatgcagtggactgacaccacctttctcttaaggaattaccctgttctctgggtaggtctaatttacactcccactatcacccaaagaagagacactctctatattgataactagaaagaaggaactgagactgttgtccaaggacatcttatctttagcatagagcgaatatgtggtttatggtaggtgttcaacaaacttaaaaaaaaaaacttgtattagtctgctctcatgctgctgaataaagacatatcgaagactgggtaatttaaaaggaaagaggtttaatggattcacagttccacatggctggggaggcctcacagtcatgacagaaggcaaaagtcacgtcttatatggcagcaggcaagagagaatgagagccaagtaaaaggagaaaccccttataaaaccgtaagatttcacgagacttactcatttccatgagaacagtattggggaaatcactccccatgactcagttacctcccactgggtccctcccacaagacgtgggaattatgagagctacaattcaagatgagatttgggtagggacacagccaaaccatatcaaaacttaatcaaaaataattgaaatgtcaggaaatagagaaacttattgagcttttttagggaagtggtctttgaacctgttttgctctgcccactggagtatgctgtccatcaaattgttagttcagtgaattatggtacaaacactcagttacattaatatgactattttcttgtatgctaatttgagaacctactccctggagatatgttatcccatgtaatttccaagtgaaatggagagaggatgccttagactgttacttctcatgtttttcattccaatcttcctcagtgcccctctctataatcccaatcctatacatttttaaacaaaggaaagccactcagatcacagtagctcatggacattggtgagaaacgtgaggaaatgtagaggatccccaaattctcacacataaactaaggtgcagccactgggtatcaagcaaggtttcctcactggtttaatgactccagttttccacattgacatttgtgctgggagccttacatatatgattttgtaaaaccctttctgcagcccttcatggtaggtagcagaatatttaaccctattgtaagagacaggagaaaccaaactgctttttctattctcacccgccattctacacagttctccagcagaatcccactggatgtcctatagtttggcccggttctaacactgtctacctggagatagcctcagatctcacaggtaaagggctcagccccacaagactgcccttcacttaaaatgccaatcgcaagtcccagattgtggtctgtacttctgagcaactggccataaattgggggttcccccaggccctttgtcatgtttgattaatttgctagagtggctcacagaactcagggaaatgctttacttgctactgcccatttatcacaaaggattttttaaagatacaagtggacagccagatgaagagatagatgcatagaacatggtttggaagcatcctgagtgcaggagcttctgtccccatggaattggggaacactaccctttgggcacatggatgacatgcatgtgtttttgttcacaaactgagaagctctctgaacccagtccttttgggtttttatggaggcttcatcacataggcacaattgtttaaatcatttacataaatatgattgatcaactcttccctctcagatgttgaaggtgggactgagagtcccagccctctaatcatatggttggttcccctggcaaccaacccccatcctgaggctatccaggagcccccagccacaagtcaccctaatactatacaaaaggacgcttattttggagattccaagggttttaggagttgtgtgccagggatgaagaccaaatatatcttattataaatcacaatatcacacctattataaagcactacatataaagtttacactccaagaataaaagatacaaatatggaatcttcaaatgccaagggcctactggatactgtgaatgacaatataagctacatcacctgttattgaaaaccagaatgcaagtgtaaacttgaccagggaacctgcggagatggagaagtttgacacctctccagcagcatcatagaaatgaacatcatgagcgcattgagggggagggttaatgtcttcatcgttcttcctctggtagaattatatttgcatccttcctggtggaaacttgatacttcactgtagtgcacctgtacctgtttttttttttttttttttttttttactttcttggagggagagttcttctatctcagaagatagaagaaatagctggaaactctatattcctgtgccctagcacaggagaccaggggtctccaactggtctgtggccttttaggaactggaccacacagcaggaggtgagcagtgggcgagtaagcaaagcttcatctgtatttacagtgactccccatcactcatatttccacctgagttctgcgtcctatcagatcagcagcagcattagattctcattggagcacaagccctgttgtgaactgcatatgtgaggaatctaggatgtgtgctccttatgagaatctaatgcctgatgatctgtcactgtctcccatcacccccagatgggactgtctacagatgggactgtctagttgcagaaaaacaagctcagggctaccaccgatttgatactatggtgagtatgtaatgataataaagcgtacaataaatgtaatgtatttgaatcagcccaaagtcacccccaccgacccacccagtccatggaaaaattgtcttccatgaaaccagtccctgctgccaaaaaagttggggactgttgccctagcaggtagagcaagggtatttcacttaggcttgaccaatcgaatgccttcattctggattttggatctgggagaagtcttgcagagacgaagcaacatttgagaagggttttaaggctagtttgagtttagtgtgctggtcctggctgccatgcattgagcagatagttcctgtggtaagacctgctgcccaagccacccttggtttctgcctagttttctaacacttctgtcaattctccattcttgaatagtcttctaatataggccttttctgctttaggtagccagacagaactgttccttgcaaccagtgactgtctaattcagtcacttaatgttttgtagctttgttcagttactgggcacaacccactttctgctcaggcggcttggagacagccatgggccatatgaatcgctattattttaactttcatagtaagaacttgctccatgtgggaaagcataattattttggtttctgagtttaataagcagaaagcaaagaagaaaaaaaatactgtttgcactgagcattaaaatataaggaagtaaagttgtttatagatagagtttcagctaagcaccaaaggtttatttatattttttgccatttatattttctgcctagttctgcctaggaaccagggaaatccatggcaaggagaaaataaagcatcaaagaggatgaaaatgttgaataaagtattagaacccagaacacttaaatctttaacatccatagtaagagtccttcacattactcaggcagactttttttttttccacctcttggtattctgtgcctacacttgcatgtttaaataacgatttaaaaatcacatgagaaatgatcaggctttctttttcccacttgactctcagttatttcaattctttgagacttgttaaagaaaccgtttagtgttgtaaatgccaccaagtctctacctagtagagattagaaatcctctcaccaattccaagttaaaaaggtcctgacatattttgatggaattggcccatgttctcatttaccagtgaccagctcatctccatgctatgatgctccccaggaaatgtgcatggtttttgtagaaggtggcgagaagcttcatgggcaccagcatccacaacccacttcttgaaaaacaaaatcagatttatatttagctgaccacctggcaagatctcctgtaggaagagaaggaactatacccctattactatttcagcttttattcacaaagtctttatatttgaaaaatgctttataatcattttaattagtggtttctcaccaaagccctggatgtggtattattggcaccattttctgagaagaccgtgtgccattgagatggaattgacacaagatgttaatgggttagaagctggtactagaatcagaatgataggccataggactcagcaagccatgctatttactgtcatcttagagggctaggtagggtggagggaaggagttgatgactgattgttataagtgaaaagggcagcagtgacccaaaacaccattgcaaatgttaacagaggcctgttacagagttaaagctgggttttccaaaacaacacatctgagtaaaagcgcccttggtacattagccagtatggagccagcacctgagatcacactgtgtttgcccctttctgcaatggctattggtgctggttgcttgtcttggcctaagagttttcagctgggcttttgagcaagctgcatcttgaatctgaggatgcgggcaagccaggcacagaactgtgagggtccttgcaatgggctgctggtgttcctgtcattcataagcttggacttggtccccactgtgtttgatttgggagaggttctttgaccatacaactcttaccgtgtaaatgtgctacaatccttgtcaagacatagcaaactatatttgaacattgttttaccatttactgttgtgtgcatgtgggccatattttcctagtcagatggtgagttctgtgagggcaaaggctgagtcattctctatttacattttaagtaggcatccagagacttggttatattctgagtctgtattattgatcaaagccctcacctggagtttctggggccattcactgacccagaatctggtgacattgacacagggagggaataacatccagctacagatggttaacacaggtctttagtgccccaatccccattttgctgactcatctatgcctcaagaactccaatcttcatgcagattctgttgcccttgagtactcagttctgtctcttctgcatacctctgtggagccttggatcctgtcagactcttcgtgttgctgaagttctcagtcctctctctcagccgagtgtaatagtgccccagtgggcactgtagggacagaactgagtttcttcttttcttttaggagttgattctctccgggtaatatctggagctctctaaagtttcagagagaaatacgttccttataaaccttgtggttgtcatgctggtgactccttgagcctgtcctgtgctggaccgtgaggaaggacacaaggccatccagactcctggactcacagtgatttcttgtcctccccaaagatgcctttgcctggtgcactctttaatagcccatcacttcttgctggctgtgtccccagctgagttcctccaggatatggcatcaactctgaacacatctctgtatattccctcttaggaccataagattcatgttaaacttagtgccagaaataaccttgggtagccatgttccttatggttccttagattacattcctagattacacattttacattaaaaaaaaaaaaacaaaacccaaagcacctagaaccgtgctggattcttgataaatgcttgtatccattaaatacatattgaagtaacttctactccagtgacccctctcttgaggcttactgtttacctcctcactttggggagctacccagccaggaccttctgagagagaaaagtggtatatttagtagtcaccagatagttactgttaacggtgctgagttcttaaaaaaacctgttaattgtactagcttaagactaaagtatatgttcctctcctcgtagagtgatgatgatggttttataaatactggttggatagcactgtaattaatgggcacaccagcttttattttggtaacaatgtattcttataccacatttaagaggtttctctttcctgtggtcataaagtgattaaaaaaaaaaaagagaggagagagatgacatcctttttaataaggcatcccaagcagtctaagtacctatgaattataaatgaaaacttttcagtgattaaaataaatataccaatgcagtccccttctctgcgtcattgcttcgccaggcctgcatgaaaatcactcagaggaagtcccaaggggccctgagatcatttgcatctgttccatgtgtttctctgatttatatcagagtgcatcaagggcagtggccttccagctggtttgggaagagggattcttttatccagaggaggcatcagctgatggtcagttagggctctggagtgcagctccatgtaaacaactagcctttgtagtaatggccatataatataacctagtccatgttttgttccctcaagaaccaatttacaacatttaatgttcaaggatggttccattcctttctttgtttacacaggtgaggctttatttagtagtgggaagtgaagggcagatggtttaaggggttcttaatgctgcaggagaggcccataaactgaagtatccaagaaaatccattctaaataagaggcaaacagagtctcagatggatataaattagtattattcttaggaatccttccttcccatttctcagacttatagcaaagctcttactgatatcagtggccattgtgcaagtgggtagcagggaaatcaccctcaatgaccaaatggaagtacatgaggaaaaagatggagaatcctggataaagaagacaactggctgggctccatggctcacatctataatcccagcgctttgggaggctgatgcgggtggatcacttgatgttaggtgtttgagaccagcctgaccaacatgacaaaaccccatctctactaaaaataaaatacgtaaattagtcaggcgtggtggtgggcgtctgtaatcccagctgctcgggaggctgatgcaggagaatcgcttgaacccaagaggcagaggttgcagtgagccaagattgcaccactgcactccagcctgggcaacagagtgagactccatctcaaaaaaaaacacaaaaaactgtctttttctagccctatttatttcaccctacactccatttaccttttatttgttgttaattaaataacattaatttttgttgtaggattatacgtaagaaactattggccttttgctgattgtgctggaatttaaaagttgtagggattgtgggccattgttctaaaatggctcattttgccaaacatgattaatggcttttggggtgcagtttatgtcaaggcaaaattagtggacacttcagcaaactggaatgtggttctgagctaaggggatattcacttagccattcctagacctttcttctatcagaacacgtctttaaggttgaatatccaacattttcaaacattttagtcttaaattctacctttagagtattattgatggtctgattagataatgaaataaattttctctcagcaatgtctgtaataaaacataatgcaggaaagatagcatttaataaaatatttgtttaatgttaataatatttattaccatcagattagaatcaagttaacatcaaattagtaagagatatgtcagtcacaggacttgtagggatgcgagaaaaagaccaccagagaaactgaagaaacaactggaatcatctttgaagaatttcaaactcatcattgagacattggcgagactgggaaaattatttctgaatcttgaaagaatgatgccccaagaccagatcatttaaccattatgtgtctggagagccatcatgcttcctggtatatttactgtggaaaaccctgactctcaaaaattaaaggaaaattacaactgtaataaattggcctgaattgcatggattcataagaccactctctttccatttcttcctacttaatgttgttttcacatagtgatcacttagcagagtttgggaataataactggcaaaaaagctaaaattcttagtccctaaaggaaaagtttgcaaacttattatttaatgttttaaaacccctttcccccgatgaatgttaccctgtccctaggagaagcttctctttcatgagttcatagatcaacagtggaaagatgattgtatttttgagccttgaggttcaactttttctcttctaagtcttttattctgcaagagcccttttgaatgatttaaaatggcattctccatttattcgtatttatcgaaaatctatttggagcaaggtattacatttaaagacagagaagaaatggttcatccactcagctaatatttattgtgtgtacactatgtagctacaagctgggaacagagtggagagcaaaagaagacaccattcctgctcttctacagttgagtctggtagaggagacattcatgattcattttttttttttttttgaagcggtataaccacccagtgggttcacattgcctgctgccttcacagagccaatgtatcgagacaggggaattgcagtgaagaaagagtaattcacacagagccagctgtgcaggaatgagagttttattattactgaaatcagtctcctgaagcattcagggatcagagtttttaaagataatttggcaggtaggggctcaggaagcgaggagtgatgattggtcaggttggagatggaatcatagaggggtcgaagtgagtttttcttgctgtctatgttcctgggtggaatggcagaattggttgagccacattactggtctgggtggtgtcagctgatccatggagtgcagagtctgcaaaatatctcaagaactgatgttaggttttacaatagtgatgttatccccaggagcaatttggggaggttcagactcttggagccagaggctgcatgacccctaaactgtaatttctaatcttgtagctaatttgttagtactgcaaaggcagactggtccctaggcaagaagggggtctacgtgggaaagggctgctagcaattttgcttcagagtcaaaccatggacagaattccttcccaaagttagttcagcctacgcccaagaatgaacaaggacagcttaaaggatagaaacaagatggagtaggttaggtctgatttctttcaccatcataatttcctcagttaaaattttgtaaaggtggtttcaatggagcctcactctgttgcccaggttggagcgtactggttccatctcagcttactgcaacctctacctcctgggttcaagcgattcttgtgtctcagcctcccaagtaggtaggattacaggcatctgccaccacactgggctaatttttttgtggatttttagtagagatggggtttcaccatgttggccaggctgatctcaaacttctgacctcaagtgatccacctgccttggcctcccaaaatgctgggattacaggtgtgaaccaccacgcccagccatgaatctttagattactcaagtaaatgtaaaattataagtgtggtaaatgacaggagatgtatagtagaggaatctcatctgtctagggataaagggctcccctgtggaagtgatatttaagggaagattaaaggattaagaacaattaatttgggaagggatggtgtcttagtctgttctctgttacctgagactgagtaatttattttaaaaactcagaaatttattttttacggttccagaggctaagaagtccaaagttaatgggctgtcatttggcaagaaccttcttgctctatcatctcatggtggagggcaggaaagcaagagagcacacatgccacagagagcaacagagggccaaactcacttttataacaagcccagtcttatgatacaaacctactctcacaataatgacatcaatccattcatgagggctctgccctcatgacctaaccacctctaagttctacctctcaacactcttgcattgggggttaagtttccaactcatgaacttcagaggacacattcaaatcatagcattctgcctctggtattcaaaattcacattcttctcacatgtaaaatatatttatttcataccaattgctctaaaaatcttaactcattccaacatcagcttaaaagtccaaagtccatagtctcatctaaatcagatatgtgtgagactcaaggcatgattcaccctgaggcaaattcccctccagctgtgagcctgtgaaattaaacaatttatctatttttgatacaatggtgagacaggcataggatagccattcttattccaaaatggagaaataggcaagaaaaaaagagtaactagtcccaagtgagttcaaaacccaacaggaaaaacaacataaagtcgtaaatctggagaataatctccacacccttaatattgtctcccaaacatgcttttttcattctttacatggccaggctgaaaattttcaaaacttttactttcttcttcccttttagttacaaatttgtctttaaatcatttccttcttattttactgtaagtggctgaaagaagccatgcagcaccttcaactttgctacttaggcatttgctacttagcctagttcatcactcttaagttctgccttccataaagtcctaggacatagacacaattccaccaagtttgtaactgtatcacaaggatggcctttactccagtttccaatacactgttcctcagatccatctgagacttcatcaggatggccattactgtccatgtttctaccaacatactgatcatgacgtcttaagtaacctctaggaaatcccagtttctctgcagttcttttcttcctctgagttctcaccagaatcacccttaatgccccattcatgacaatctatgcttcttaaaatcttgctcctccaaattcttccagcctctacctattactaaattccaaagcttcttccgtgttttcaggtatttgttactgtaataaaccctcttctcgataccaattttttgtcttagtttattttgtgctgtttataacagaataccagagactgggtaatttataaagaaaagaaagccagcgtctggcaagaaccttcttgctgcatgatcctgtggcagaaggcagaagggcaagagaacatgtgcacaagagagaacaaaagagggccgaactcacttttataacaaaccactcttgcaataatgacattaatctattcatgagccctcatgacctaattgcctgttaaaggtcccacttcccaacactgttgcatggggattaggtttccagcacataaactttggagaacacattcaaatcgtagcacatggggtacagaattatattgcagatacagacagcagctcatgccaatgctgtgtggtaagagaaagcacagggctattgaaagaatgaacaagggtaagggcactggcacccagagggcaaggaagagtacaggtgggatgaatccagagtgggaggtggagactaccaccaggctatgcaggaccttataaccactttaaaaatttgagaagtctgggtgcagtggctcatgcctgtaatcccagcactttgggaggccaaggcgggcagatcacgaagtcaggagattgagaccatcctggctaacatggtgaaaccccatctctactaaaaatacaaaaaattagctgggcatggtggcaggcgtctgtagtcccagctattcaggagactaaggcaggagaatggcatgaacctgggaggcagagcttgcagtgagccgagattgcaccactgcactccagcctgggtgacagagcaagactccatctaaaaaaaaaaaaaaaaaaaaaaaaaattgagagataggagggtcacttgaggccaggagttcaagaccagcctgggcaacatagcaagaacccatctctacaaaaaaatagaaaaaaattatttgggtatggtgatgcaaacctgtagtctcagctactcaggaggctgagggtgggaagatcacttgtgtccatgagttcgaggctgcagtaagctggtattgtgccactgcactccagcctgggcaacagagtgagaccctgtcttttaaaaaaatgagggttttattcaaagaacaatggaaaatcattgatgggttttaagcagtaaacatgaagggaacacatttgtggtttgcaaagattgctttagtgcctttggagaggagtggtagtaagatcatccagggtgctattgttcccaggtgaaagatgcaataattcaggtggaccccttaaagaaagagatatggatgagttctagagatgtggaagaggcagaatcaatagaacttggtattgattgaatatggtgtgggggcagggttattagcatggcccctagatttctagcctgctgagtaggatgaatggtcacaccattcactgagatagaaagctgagataaaacaagatttaggaggaaagttgacttttactttggacaggttgaattcaaagtatagtatggtgtcataaagtaagctgttgttacatagcctaaaaatgagtggatttttaaaaggtcaagatgggcagaagtagagcattccagttatctaacattgcatgataaagtcccaacagttatggcttaaaacaacatttactgtgctcattaatctgaattttggcaaggcttggtggatagcttatctccgcaccacttggtgtcagctgggggagcctgaggctggggttggaatcataagacagcttgctcactcaaatgtatggcagttgatgctggctgttggccgaacttgagcaggggttgtggctggagcacctactcgtgtcctttacatgtggctgcttagcttcttcagagcttggtctgctgggtttcaaggtgagtgtcacaagaataaagtgagagccagacagagactatcacctttcatgacctcgcctcagaagtcatctagcatcacttccatggcattctgttcattagacatggcccagccatattcagggtaaggggaattagagttcactcttcaatggggggagtgttgaagaatttgacaacatgttttaaaaccaccacatggcggggcagagaagaaatcagttatcattccagctggaaggaacaggttgaaacgggaaggtagaaattatattcaatagaagtggagtggttgctgttggctggcctggagcatgtatgaagggttatgaacagtgtgaaatataggttaaaggaacgtttgggaccaaattatggtggagcccaaatttcctgaaacccattattttgaatctggaaacaaattgtcagagaggaatacaaatcagatttattaaataaagataaaaagtagaagcaaacagtgactggcatgggataggaataattctacttgctgataaaataattcatgccaattttggggtgtctagtctacagatttggggtcatatatctccaaatttaaattgtagacatattcaaatgtctttagttgggctttgtaccttatgccagtcaaaaacatgagtcaaaaaaatcatgcctgtatggttcccttcggaggtatctctcctttatcctttagcagattaagataagaatcttggtctttttgatcctggctgtggcttcaaatttttcccatcttactattgggctacccaaaaggactgcatcagacaagactggtgagttgaatagtgttcctcccaaattcacgtctacctggaacctcagaatgttactttatatggaaataggaactttgtagatgtaattagttaaggttcttgagatgaaatcatcctggatttagggtgggccctgaatccaattattgttgtcattaagaaattgagaaggcacagagacaaagcaaagaagcccatggggagatgcagaagctgaccttggagttatgcatctagaaccaaggaatgccaggagcaccagaagctggaagaggcaagaaaggattcttccctagagccttcagagggagcgtgaccctgtcaacaccttgattccagacttcgggcctctaaaactcagagagaataaatttctgttttaagccacgtagtttgtggcaacttcttatggcagtcctaggaaattatacacgaagttagagccaggcatgatgtattagtccattctcacactgctataaaaaattacctgagactgggtaatttgtaaagaaaagaggatccccaggctctatggaaagcatgcctggggagacttcaggaaacttacaatcatggcagaaggttaaggggaagcaggcacgtcttacatagcccaagcagaaggaagagaaattgctgcgaggtgctacatacttctaaacaaccagatctcgtaagaactcactcactgccaagagaacagcaagggggaaatccacccctaccacccagtcacctcccaccaggccctcctccacattgatccaatcacctcctaccaggcccctctttcaaccttggggattacaatttgacatgagatttgggtagggacgcaaatccaatccatgtcacgtggaaaatatgggtgttggtttgccagatgccaaacagaaacaacatttgatctgttgataattgtgtatcctctttatcaggtctatcttaaggaaatcagagagtagagcatattttcttcatggaatggtgagacacatattagcctgagacaggagctaaggagagtgagtggtgggctccaccaaagtgccttcatacaactacactggtaggtgatcagaacaaagggacacgtagaacgaagacccgggtgtgtaacccaaatgcctaacaaagtccattcaatgtatgaggtgttgctgctgtgtgctgaaggaggaaacctgggtcttagtctctgttatggtaaatagagaagaaatcaagccttcctacgacaataggggatttttaatgaagtaaaggagacagaagaaatgtcccaaaggagaatgaagtatgtcaaaaacagattgcgcatgtaattactttctcaggccttcctgacattatcagcaggacttgtgttttgatgaaaaaacttaattaaaacttaatttttttaagtggaaaatattcagcatggttacaggaagactgaaatcagggcactgtgtaattttaattgccttcgagagatgcacttcacgtgaagactagcatgggggaaaaaagctagaggcacaaagtctgaggggagtggccacgctgaatctctagctgtgtgcttgggcgccattttccccactcttacagttgacgggatggcatctcaggtttcacgtgtaggggaggagagtgggtctgttctggagtgtgccggtcaggccatacttggcatacacattgtagaaagtgtcttgatttttattctcctaaaaagggtaaaaagagattgaggagattacatatcccatgaggcagcagtttttaaatgccactctctggatcagttctatcagaaccatctggttctgattcatttaatctgttttaggacctgtgcacagtgtttctattttaaaaataaacctgtcctactcattcttggagtcaggtgtgggaactacaggtttttaatggaagaaacatgaacttgaaaatgagtaaatatgggctacgtcctttacttcccaaggagatttgggttgactgcttagtttcctccatcaaatggggataatatgcttatttgatggggttttgtgaaaataaaagataacacaggtaaagtgactgacacatacagttaagtggtctaaaaatgataaaactgtagaagaagagttggatcaggctgcttgctaaattgggaagggataaggtagtgttcttcagatatttcaagggcagctgcatgagagagagagagagagagagagagtgtgtgtgtgtgtgtgtgtgtgtgtgcgcatgcagcctttagaggtcagactcaagtccagcaggtagaagttatagggagataaatttcaacgcaacagaaagtggaactgtctagtgaatggtccagggatgtcatcagtttgctccagagggtagtacgttccaaatcactggagcaattaaagcagctgccatattttgaggatgtacagggctgtggggcagcaattgaatgagaccacttggttcagctctgtaatagggtttctggcttcctgtggggctgtggctgacatacagttgttttgtaaactaacaacacttgaagaaggttttagcagaaaacgtttaccagtaagatatgtcaggtcaagtacactgttttaggtattctttactggggacattcttgtgaccttcatcccaggcctttcagaaaagggatggggcatatttagaagttattaatgactgagaagctcctctggcacttcaggggagggaactagagctataaaatgtcctgtgattgttctaggactttctccttagtttagctaacatctgggtccttgtcacacggctatgaaatattaggcttacagacactttgaagggtgagaaaaatggaatttattgggtaaaaaggaaaaaaagggaaacagggatgctctgcagagccagattcctgctagtgtgcttcctgcctcacagactgaatcccaggtaccacccaggaagaggaggggccaggctcctccccactgcaaatggcatgaacttcccaagacccctcccccagtgtgcaggccacttggaggttctctggtgacccctttatatttggctgtctcattatgaatgggacaggagtgcgaaattatcccacttcaaatgtcacttgctctctgttgggaaaccctatacctcactgaagcccagatgatctccctgaaccagcctttgagggtcctttttggagccctttggaaacctggtattggatgggttgggttacagggctgctcagcctgacagcctcgcattatctggtgaccacagagtttaaagcagaacattgggaagaaggtagactgggccagttgcacaaagcagagtgtgaagagtgatgggagatgaaggctgtttgcctgcttttcactggggaccagatttggatggatgctggtccaatatgagtgacacagttaacttatcagtgagatccctcattcttctcatcagtgagatagctgggtattgggggaacctgcccccagtatttcaatgtaggttctttctattttccataatatcagctggctgagaaataaagagaaagagtacaaagagaggaattttacacctgggccgccgggggtgacatcacatatcggtaggaccttgatgcctgcccaagccttgaaaccagcaagtttttattaaggatttcaaaaggggagggggtgtacgaccagggagtaggtacaaagatcacatgcttcaaagggcaaaaggtagaacaaagatcatatgcttctggggaaacagaacaaagggcaaaaggcagaactcctgataagggtctatgttcagtggtgcacgtattatcttgataaacatcttaaacaacagaaaacagagttcgagagcagagaactggtctgaccaaaaatttaccagggtggagtttcccaatcctagtaagcctgaagttactgcaggagaccagggcgtatctcagtccttatctcaaccgcataggacagacattcccagagcggccgtttatagacctcgccccaggaatgcattcgtttcctagcgtattaatattaatattccttgctaggaaaataatttagtgatatctctcctacttgcacaaccgtttataggctctcggcaagaagaaaaatatgtctctttttgcctgaccccgcaggcagtcagaccttatggttgtcttcccttgttccctaaaagtcgctgttattctgttctttttcaaggtacactgatttcatattgttcaaacacacgttttacaatcaatttgtgcagttaacacaattatcacagtgatcctgaggtgatgtacctcctcagcttatgaagataacggtattaagagattaaagtaaagacaggtatgaattataaaagtattaatttgggaactgatacatgtccatattaaaatgaaatcttcacaatttatgttcctctgctgtggctccagccagtccctctgtttggggggggtccctgacttccaacagctggggaccacttaatcagggtaagggcagtagtttgtgttcacagtttgatctccctgcatggtgctaaccaggctgcatggggatctaatgtctgactttggccacggcatcaggctccagccaactgacgtgaaagcaagtttccaaatcgtctctttctaaatagataaatgatactcagtgttcctttagccttccttattttttgcaaatgcctgtccccagtggttctgttgtttgctctgattgccgttttccccagtaagtgggaaaaccccacatcttttccccatcagtattccctaatgaggcttgttccctcaaggggaccttgatgagttacaacagcatgaccatgttcccaagcagcatgctaagaaaaacaatccccagtgatgccctgcaggcaccatttaggagcgggcggtaatgaatccctgagagaattcagtcctccgtatgaaggtgatccagagtgaagtaaacaatttcaccgttaggtggttcaccctgcatgcctcattgctggctttctggaaagccagtaaataaggcagaaaaaatgtatcattccctccagagtgcagggtcccctgtcacccacacaggactcctgcctgtcactttgagtcacagctgggctttctggaacccggattcttgtctctggttagctcaggtcttgcagccatgccaaatccaaactgtgacattgtctgaacagtagggcatcctgttccctggtttggctgagctctgcggagcagaacagtggccgaggttaacatcagataatttcctccaccattcctgagtaccctgagggcttgttacctggaatcaaagacttgtcagaactcaagatgaccttaaaggccagcttattcaacctcccacccaggatatgacttccagaactaaccacccacaatgcagattagtaatatcatacgtggttactcaatgcaattgtgtcatttcaggagaaatgacctgttaccaaagtgtcatgaaacccacattaatgagctgggctgtagtggaggtttactttgatttctgaccttaattattagtggtttggattctttacgtttatgatggattttctgattaccaattatgattcactgtaagccatttttaaaaatatgacatgaagctctgacccacttttaacaacacagtggcaaatgccaaacaattggcaatttccccttctaatatcagctgtttgaatcatcacatctactgtggtggctggggaccactttatcttcattctctggcttcagtattcttttctggtattgtcattactgacctaggtgcatatctgtactaggctgggacctcagctctatgccagtgagaaaatgaggttcaactgggaaaacggcctggagcagttgctctcaggcttgtctgcagattagaatcacctgtagacttttaaaaaatactgacacttgggttccgctcttggaaattctaatggatctggggtgcagcctgggcatctggaattttacagtctacctgagtaattccaatgagcaggtgggtggccttgcaaaccggggtctgaaggggctggtcagcaaggagtatgggcaaaatagtgctggctggctgggcgcagtggcttacgcctgtgatcccagcatttgggaggctgaggcaggaggatcatgaggtcaagagttcgagaacagcctggccaacatggtgaaaccttgtctctactaaagatacaaaaaattagctgggcgtggtggcacgggcctgtaatcccagctacttgggaagctgaggcaggagaatcacttgaacccaggaggcagaggttgcagtgagccaagatcccacttggctgccactgcactccagcctgggtgacagggtgagactccatctcaaaaaaaaaaaaaaaaaaaaaaaaatagtggtggccaaggggtgtttataaaacagagttgtgatacatgttcatacattcacctttgaggtctgatttggtggtagcaggagtttcaggggaaatgtttactgatcaggttgatgagtgtccagggacaagatgtgtctgctaagagttagattgatggcaaagattgggcagattgatagttctctagcaaataagatgagatctgctatttcagcaggaaacaagtaaggaagttgaacaaaaagctagtggtatgggccatgtccacaagctgtggttaaaggcaaaggctgaagcctgattggcgtgcccacactgggctgggcactgtcagggacagccaggctgactccagagcctgccttctggttggcttctcccggcttaagtctggccctgcaggaaaaccgacaggagttttcatgccaaccaagactgagacaatcagagactggcaggtttggaaccaggaggtctggatggggaggttggctctgaatctgttgtcattatcaggtgagtcattaggaccacctggaaaagtgaagctgttcttcaccttctcttcttgtgaaagtgattcaatctcccaaacccaggttgatcataccctttaggtctaatataggaagtgttgaattaggtgatgtctctaaagaactctctctgggttccttagagaaaaatagcatttgaacattgtgcctcagcaggaaagaagatgcaatttaagtcctgcaccaaggcattcagggctcacctcaaagtggactcctaggaacaagaagcaaatgattccgtggagagggttagatgtctggccaatggaaacggggatgtagttcaggttttctagccccagaagttcagaacctttgggttcctcggtggacatgtctgttactcgcttgaaactagggaaagtctcttgtgtagaaaacctgttgcatgtcccttgactaccagtagcagcagaggtgctatgtgtggctgaagaattttcctcctttttctgagagatgatttcccaggtttccttctccacaattctgtgggcgtgtactgctgtgataagatgtttgttctctggcttataaattacaagatattttcaggaccacttggaagaaattggaacattttcctggaggcagtgggggagctgctggaggttttcggacaggcgggccacatgctgagagaggtattttgggaaaatgcacttggcagtcatgtgtgggtgaggataataatattaatacttaaccactggcttgttgggaagagtaaggggaacaatgtaagtgagtgtaaagatgcaggaccaccattcctttgttcattctttttttttctttttctttttttatactttacattctgggatacatgtgcagaacgtgcaggtttgttacataggtatacatgtgccatggtggtttgctgcacccatcaacctgccatctacattaggtatttctcctaatgctatccctcccttagccccgcactttgtccattcttttagtttctctgagacctggtgccccaaggataccatcttctcctgaccagtgtatcagtttgcgagagttgccataaaaaaatagcacagactgggtggcttcaacaacagaaatatattttctcatagttctgtaggtgggaagcctgagaatgaaaggcatcggtagggctggtccctcctcagggccgcgagggcagggtctattccaggccttcctccttggcttgtagatggtcaccctcttccctgtctcttcatgtcatcatctctctttgtgtccgaatttcttcttctcgtgaggacaccagtcatattggattagggcccaccctaatgactgcattttaacttaattacctctgaaaagatcctgtctccaaagatggtcatatgtgagatactggggttaggacttccacatataattttttgaggggatacaattcagtccataacagccagtctttttgaagactttctcttttgggggctttacacttaggtaattacaggatattttaaggggtatttcaagacccagcaacccccttctccacccaccatctcccccaaattatgttcgtcacctcctggtacctgttatatcatcactagaattgcttggttgaatcaagtaatgtttcaagataatttccgtaaacatgcactctttttatgtaagaggggtaataatagagccagtgaaatactggatgaattcatttaccaaactacgtaaaagtactgatatatgacaactacttagggaacctaagatttgggacatagagcagcctatttagaatatccggtataacattgcagggaatagcaagggctctagagctttccgcctgggttgaaatctcagctccacccttttctttctgtgtggcattcagcaagttacttaacccacctgtgattcttccttcatctgaacaagcagcataacaatagcatttacctcatgattctttagaaggtgaatgagctaatacctaatatagtgcttagagtagtgtcttgtctgtggttggctttcaataaatgttagctgctattgttgttgttaaactatttaacaaactacgaagcacattcctatctgctttcttctttgcccttgtaacagccctgtggagtagaaggagttagttacattttacagatgaagagactgaggctctaagacattatgcgaaccatctcagggcatatggcagtgttattcagaacatctatcggtaaagaacaagaattccaaaaatataggattttccccaggaaggagggccagagtgtgggctactgtgggatggcctccgggcagagtgtgagggtaggcgctccaaagagtaaggcatctggagaagagaaacaatgaaagaggcaaacgctggatgagaaggacctcaaagcagaactttgcctctcggcctctcagtcaattgtgatctgactgacatccagattgtgatcttgttcaggtggctgaactttgaacccttcttggccatttgatgctaaaggcagtctttgaatgtgatgttttcctagatcgtactggtggaatttagttgcctcagatttcccagtcatgtgccagcactgccaagtgatctccatgtgtgggttttatgatgtgtttccagtgctccacatatggcctgtgatttttttttcctatggctcctaatgaaacactcagaacactgcactgaatagaagtttctccctattctccagagtggggatccttattgcatcgtcaagcatggacaccaaaaataaatggggagaaatctctattctcttagtgatgaggcactcttggaggaagatattattaacatgactacgtcttgccaatttgaaactttgcaaatatctgtaaggttgaccagtttttataatttcaagattttaagttcaacttaaggtactttacaaaattatttttatcataataaattacagttctttacacctgtgtcttttaccgattagattgtgagctactttatgggtgagcaccagtatctacttaactttgtactaaatggctcaatattgcctggaaaatagtaggtgcccaataaatagtaaatgttgttcgatcaaatcataaatgtagatataagctaaacctcttccctgggcaactggaaatgcccatgttatgtcttaaaacacattgaattcaggtgggagaataaaaatgattttaacaaatccagtgtgctttttgaaggcagaactacaattacttcttttttccctcataatcaaatcaacctgtgaaattggaagccaataaatatgtaaaaaagtcatcaaatgtcataggagaggactactatttgattcacacgtgatctttgtcgtttaattgcgtgtggcaagaatgaatggaagtgatattaagtggagaaaaactcagtcccattggtgagttatttaccttgaccactgtgatgggctgaattgtgttcccctaaaattcctatgttgaagtcctaacccccagtatctcagaatgtgactgtatttggagatacagtctttcaaaaggtgattaagttaaagtgaaaatgaggcctttgggatgggtcctaatccaatatggttgttgtctttacaagaagaaaacatttggccacatggagagatacaagggatgcacatgcatggaggaaagaacatgtgaagacatttacaagccataaaaagagccctttcagagactaaccgtgctgacaccttgactttgaacttccagccctccaggactgtgagaaaataaatttctgttgcttaagtcacacagtctgtggtattttattatgatagccctaccaaactaatacaaccacctactttttagaatttgtagaatccaagcacttaagattacaaaaatgcatgtttattgtggcactattcacaatagtgaagacttggaaccaatccaaatgcacatcaatgatagactggataaagaaaatgtggcacatatacaccatggaatgctatgcagccataaaagaggatgagttcgtgtcctttgcagagacttggatgaagctggaaaccatcattctcagcaaactaacacgagaacagaaaaccaaacaccgcatgttctcactcataagttgaacaatgagaacacatgagcacaaggaggggaacatcacataccagggcctgttgggggctggggagctacaggagggatagcattagaagaaatacctaatgtagatgacgggttgatgggtgcaccaaaccaccatggcacgtgtatacctatgtaagaaacctgcatgttctgcacatgtatcccagaactttaaagtataataataaaaaaaagcaataaagaggaggtgatggtaataggcacagacttttgcttgcgttgaggaaatattctaagtttcacaatggggtgtggaagaatctgtgcgaatctccttctgacctctcgtggtaccatttcctcattactcagtgatgaccccagagccagtcttggatgaggcggggtggaattttccacacaggtgccatgagctagggggctcaaaacagacactgtggtgaggttattactgaaatattctgtttctatgaagtttctaacgtaattctgggccctctttctacaaccttagcaagttgctgaactacaggagtgcggagtaacaatgcctttcatgtcaattctgtttacagccaggcttgcttgcattaaactggacacatccatcaactagagtgctggataacagatgagaaaaagctaagtttgagttgtcttttatattgtataatggtgcttctattttctttgttttcttcttgttcttaagttctgtgggaaacccacgggaagaggagtctatccagggtatttgacttcaaatcatttcatctcttctgttcttcctctcatctagtcctctgtgttcttgtaatatacgcaagggcaagattaatagtagaacagaattctgctatgaaatttaagtgatgtgaattctttctcaaaattccaagaatgaaaactttgactatgatatagccaataatttgcacttgtttgcatttgacattgctcatttacattaactagcgtaaaatacctaattagtacagcagaaaaaaaaaaactatatgaggaaaaaaagaaatgattgctcttttactcactggagggaaaggttggatttatttcagctctgtgtttagaaaaatacctttgctgggcttcttggagtgtgaaaagagtggaccctgacccacctctattccctgctgggccatctggaaggattttcacaacaaagataaggctaaaccactctgcaaaatgaaaccagaggaatttcatgagttctggggagtagaaagaagtagggtgagctctgacaaggatgatggggttgggcatgtgatgtctggagttggggctaaggaggccagtccaggagatggtccctgaggtaggatgggagtggggccaggcaactgtaagacagcgatgtctcatgttattgagctttgctatttcgtaacctctatctgccacactttctaaaacctttgcataactactgggtatctaccgagaggaaaagaagtcattatacgaaaaagatacttgtatatgcatatttatggcagcacaattcgcaattgcaaaaatatgtaaccagtccaaatgcccatcaatcaatgagtggataaagacactgtgagatacacatatatatatacacacacacacatatatatacatatacatatgtgtgtatatatatatgatggaacaccacacagccataaaaaggaatgaataatggcatttgcagcaacctggatggaactggagaccattattctaagtgaagtaactcaggaatggaaacccaaacatcatatgttctcactcataagtgggagctaagctatgaggatgcaaaggcataagaataatacaatgaacttcggggacttgggagaaagaatgggaggtgggtgaggaataaaagactacaaattgggttcagtgtatactgctcaggtgatggatgcaccacggtctcacaaatcaccactaaaatacttactcatgtaaccaaataccacctgtttcccaaaaaccaatggaaataaaaaattaaaaaataataaaaataaaataaaatctttataagactactgtacctgttagagcctcctttctgggaaattaaaactctaattgtttccacattagcttatgaggtggttggtaaaagagaatgactacaggaaatgaaatgccaatgaggttgataattcagtgggaccaacaagtcacagtcaaccagtgatggagatggtaaacctactaggaatccacagaaattttgaggcaggtaccggactctcaagagtgtgtgagattggtgaggctttggcctgagccattgaaaataaatgcataaatagcaacacttagcagaccggaaaacatgggggaaaacccagacaagagacacttgggatttgtcagtaaaaaatggagttgtgaggctgggtgcagtggctcacgcctgtaatcccagtactttgggaggctgaggtgggcggatcacgaggtcaggcgttcgagaccagcctggccaacgtggtgaaaccccatctccactaaaaatacaaaaattagccaggtgtggtggcactcacctgtaatcgcaactactcaggaggctgaggtaggagaatcacttgaatctgggaggcaatggttgcagtgagccaagattgcaccactgcactccagcctgggcaacagagtgagactccatctcaaaaaaaaaaaaaaaaatgcagttgtggaagctttgaaatccctgctgtgaggttatggaaggagaatgtttctgttcaagtatgaatcttttttgggaggggtggcaagaggaaggtatgcaaagggaatggtgaataaaatgaaaaggttcgactttttggtggttagtcacctaagaaggttttgtgggggaaataatgtgttttagccagcaaggggattgtttaacctgccctctaccagtctgccgtgcctcacccacttgtctacagctgtcctgttagttgtagcattttgttttcttttatgcaaagggattttcttatgacactcaaggagaacccaggagagggaaggcatctctgccttccagggacaaagtttcagaactgtactgctctacagtggtaaaaagacaacaaagtctttgatttgcaggttgcttgtttcacttaccctgtgaagtggagctcagttggaatatttcatctggccactctttagatgttcacggcagccctgcctggccagccatgaggtcgggcggagaaaggaagcaaggatgagtgaggagggagagaaatggccctggagtttgttgttggagatcttctctgtgtcaaacatcttaagggaatcacctcatggaatcttcgccacaacccattgatatggggattattttccattttataatgaggaaatgaaaccttagaataacagcaagaagctcagacaactatgaagtggcagggtgcagttatgtgactcaaaaccagtgttattttcagaagtgggaaatgtcatgactttgccctcccctccccttctctctcttccttcctttttgttggctatcttgagctgaatggtgataacgcttaactagtggaggtacattttgaataaacagcgactgacttaaatttataatcataattttattctagagttttaacaaatggtaaaacatttagagttatttttccgcagacttgacaaaggtgatgcctgactgtgcctgccgtcatttttttctatttataaaatcagggtaaatttgcaaacttctaaagaagcagacatggcttcagcaaccagtcagggtggaggtgagaccaggaaggttggagctcatgaaaggtcctcctcttctgtctaaggggcacttacttcattggtagctcagctgatactttgggaattccaagaaagagccaggaaccctgctaggaatagagaagcaaagaatccagggctctcactttgaattgctcaccacgtctagaacatgagtcaggcacagacacagaaaagtcagcataatgcgtatgtgcagtgattatgagatgcccatgcagcgtctttacaccagccagggatgcaaggaagaatctccggagaacatctacccaacaggtggatttgcttgtggggaacagaatctgtcaaggagaaacaaagcagtgcagtagttgcatcatcatgaggaaggatgatgtgcagagttagtttcctaagtggcatcgcctataatgagcagcgtgttctcctaccaccttagctgcaagcagttatgctgtatagccaacatctttctcctagctcacaattcaaaagcacattgctgggattccttgggggctttgcgtttatttgttgtggtctagtggtttattctggcaaaatacactgcatggatttttacagtttgctttgtgcttggacatctttccacccaagcaaaatgtttacaaatgccagcacgtcgttttctgaaaatattgctgaaaagaacaaatgtgttgtgatgtgccatgtgtttgaagagaccaggcaaccaaacactaagattgcctcttcctgtcagtgtttttgctcggaatcattctttattgtgcctgtttctccagaactctgtaatccaaaatggtcctgttctctgtggacatgtgtttattctgcaagttaaaaccctttcaagcaattcttgctgtgttaaatataacaatgcactgataaaattctgtcatacattctagaaaatacctttgtataaagtactcatattactgaatttaccaaaacagcataggtaacagattctaagatatcttagagttaattgataatatgtatctgaatgttgtaaaatttatctttcctatgcaaatcccttcaaaccatcccttctagtcccatttttgagacacacacacacacacacacacacacacacacacacacacacacagactgactttgttattccttactggtttttactgatggtcatagacgtctttcttctctgctacttccattatcttcctgccttcaaaatctccactttagttgcagttttgttttactatatttcttatttttaaaaatatataggtaaatagaaattgaaaagctcccattttttgttagattcatgaattcctttatgtaattatttttccaaaattaatcctgaatacagactagtaaatttatatgacaaagaaaatttctatgacaaagcaaaattaatgctgaatacagactagaacatttatatgacaaagaaaatagggaactgtgttgtttcacatactcaggagcttctgaattcaggaattttctagatggagaagatctcattatatggtgacaccagctagccaggtgtactactgaggtctgtctgtgttagactttagaaatagaccaaggatggagggaggtttgagaaatctaagtaaggaagcataggagaccttcttgtttgaggtcaaagaataattggaaggagtggttccatctcacaatttgaaaatgttctaaggaacaaaacgtacttttttatagacctattgatctcagaagatataacacagctggtggagggtaatgatcaatcgccagactaccaccattctattttcttctctgtcaaacgtactcactatattgtgagtgttttcactgcctaatttttcatggcaatttttgaggactggtagctgaactaatttaattctcattctctcacttgttcaccaaatcatttcatgtgtgtttttgccaggtattgttttaaatattgggcactattttcggttcagtaattcaacctattttaatcccttactagcccagttgtaaatttcaaataagtcattttttttcataccagttccctgctttcgagtctctgatgaggctacgctcaagtattacccaggattaggtcctatctgaaagctcaactggggaaggatccacatttgagcttgtttatgcagttgttggtagaattcagttcccttaggacggttggactggggggcctcagctcctagctgactgtgggccagagatcacccttggttccttgacagatgggcctgcccattagggcaaattgaagcatctaagtcagtgagggagagactctactggcaagacagaagtcacaattatatataatggaatcactgaagtgacatctcattatctttgtcatattccattggttagaagcaagttacagcacccacccacatacattcaggagggtgtgtattacacaagcacgtaaacaccaagagatgggatctttggagaccatcatagactctttcctccataccatctgaacatttaatattaatgtagtctgtatttctacataacagttctctgaaaggaaactttgctgtgtgccagataatactttttgatcttcttattttacctttccttaccccacccatgattattactatcaaagctttagggcataacatagtgctaaaatagaacacttactccaaaaatttaattaacaagcaacatgaaataaaaggccatttgcatattgtaggcaaataaaaacattatcaccaggagaagtgagtcagaatatatcaaatataatagctaatattaaatagctgggggtgagagttggaataatgagcagcctctgtacagagggcatgtcaatcaattactctggccctattggagcacctgcctagaagtccttgctgtgcctggttaacccatcagttgctgaatagtggggaggtctctggtggggattctgggaagaggggctgagcagtaattgcggagaaccctaggggatcccagcagtcactatttactaagacatttttattacctaatactctatggctaaatagttaaaagaattaaaaattctcaaatgctttcaaggttggagccagttcatggggtcaggagagctatctccaggcctgcattctactccccttctttttccatccctgccccatccctttcaggcagcacctggtgcacactcaggtgacccagcctacatgtcgaggatccacgtaaacacccctcaaacagatggtcccccgcaggcctcggaatgtggcaaggtctaccattaggaatgtaggctcaggaaaggctccttcaggccctgagagtggacgtggaatcctgatggcggggaatcccagggtcctgtgacccagagcatggtctagaactgtgctgggcagcacagcagccgcacattggctccagagcactggtcgagatgttccttaaatgtaaagtacacaaccaatttcgaagacttaatacaaaaaataaagggcgtaagatatctcatcaataatttttatgttgattatgtgctgacacggtagtgttttggatatactattgggttaaataaaatatataattaaattagttctaactgtttttttctaatatagctactaacaagtttaaagttctatgtgtagcttccatttgtggctcccataacatttctgtggaacagcactgctctagaagggagaagtacggctctgctaggacacatctcctgctaccttggaccccttgccctgtgaggaggaggagctagagcagagccctctaaagcgtggagtcccaggcaggagcctttcttgccccagggtggttttgctttaaggtgatatttatagtctatttggtctcactctgtcatggctaaatgactccaaatctctctcctttgcctacttctgggttttgcccaaggcaagaaaatagtcttcctcaccttccacctgcccacccccactgccactgccaccaccaccgcttttgaatcaatataaccaggcacagaaagtaaaattgttctgtattgacatgtatctttcaagaagctgttattctttgggtgaaacagaatctaatcactaagcaatttttctacagagagagggagacttttcactccccttccccttggtttgtagagtacattcatctttgataattgattcttcgggtggagtaatgatgtaggctcaggaatacgttttttgattcaaagggtataaaaagtgctatgtgtgttaggggttaatgtaagctctgtggaattacaatacggatgtcttctaaagaaaattcactaatctaatctctagagaaggaaacttttagagagtcccttatgactcccttaagaaattattgtggatagtatgttgctgtatgatggctttaagaatttatggtgaatgcttcagaccatggctttagtgtttcaacagaaacagtggcttacttagggtggtggtgcatcttgctcttgaataaatctgatctgagcttacaagtaggaaggagtaatgatttagatgtctgaaatctctttagtttattgtttcttttcttatcgtggcagagagtgactgttaaaactttttcctcctgggcacgtagctggcctacatttcccagcatcccttacagatggctgtggccatgtgactgagactggccaatgggatgctagtggaggtgatatattcttgtccaatcatctactctttctccttttcttctgcctatgagatgcagagtataggggcacatgggcaccacctgagaactctttaggaatgcagaatctttaaccttctcctaggtgtagggaatcagaatctgcattttaccaagattcccaggtaatacctatgctcattaacatttgagaaatattgccctttgagatgacagagccagtagatggaaagatcttgggtccctgccttgtggcttagaggagagccacccaggagtgtggcttcttgaagcagcctgtttagattggtacataaacaggaagtccaattttatcatgatgaggtcactgagattttggagttgtttgttatagcagttagtcttccctggataatatactcacaaagtatttaaacaatgccatgtacctacaatgtatccccttcttaccaataaattctgccaaccaaaatgatcatattgtacctacaatgtccaaaatgtttaatacagactgaggtagaccttataaatggtattggtgaagcctagtggacaattttaagaaatcaccaacattacaaaacgttgactggcaaacttgcgttcaccctatatatgctctgtaaatgttcctagctccctcacttttttgtctttttcttcttcaacggcctccttcacttttcagtagcagcaagattaagaggtgaaaactgccattactccagtgaatgggtgaggtcactgatttgcacaattcctatgagagcccaattaaaagaagatacagagataagcatgtacgttttcatctctcttaactccattatcttattgtcatttggctatgatttatttaggtcaacattgatttctgtagcttatttagatagctagaatgataaaaatatctttttgttatcacaaggagtacaattatttacatatttacctattcatccattcattcttagtatacagaacagtccaatcaggaacaatctgtagtacctatgacaggtacagaaaagcccttaaagattagcctctaaggtgttaatgggagagatttactgatttatatttttccctatggatctggagatacagggtattaacaagatggatgagttattgggggtgcatttgtatgtctcagggtgcatgctgtctctgataattgctgtctgtgtttgattgggcagagccagtatcttaaaaccttcactagaatttcctatattgagacatctaaagttaagaaatctaggtaatttttgcttatcggtttaaattgtgcatagaactaaattattaaataaccagcatgtctaagccttacccttttctttaattacacacatatccatgcatgcacacacatacatgcacacacatacatgcacacgtgctgaggaggaaaaaaaagctgaagggattttgtctgtgcatacatgcgtacatatgcacagacacacacaagaggcacatgtacacatgtatggacctgtgcatgaacacacaaatcccatcaacttctttttttcagccagtcattatagagaggaatgacagcttttatttgctgcaaaaattcaagtggaagaacgtcatatacaagaactaccagcctagtggtagagaaaagaggattctttgaagctctttttagtcagtctgtactagcaatagtccagtgtttcccaacttgagggtgccctcaaggcgttgaaaacataaggtaccactgtgatcgaggttttaccaaattttaactttccttcacttctcacctaaaatatcttgagggtgatctgtgctcagatttgttttaagggttggggggagtattcaccttctgaagtaaaagaaggaacaatttgtcctctgtctggcttctatcatgaaacttcataacccaagagcacatcttgacttcagctttgttatttttagtggtagaggagaggaaacagtaatctgcaaagtgtgagttcaattaccctgacctttcatattgaaatctgaattcttaataagtgttttatgtgcattttatcatttaacccttacaacaaccctatgagataggtagtgttattataccactttgctgaggaggcaactgagacacagaaattaagtaacttgcccagcatttcttgggattctaacctaggccatctggctccagaagctgaactcttaaccacactgctctcctgcagggtcgatgagcttgccatgcctcttggtcattccctaaggtgtggcattttgtgattcgggatctggctaactcatttaaatatggaagtttcacaaagattcaggctgctcagggatacaaaatggctcattggcagggtggggcttccaaggaaatcgatttcattcctttcctaatgggctgcgctagtttgcaaaaatcaagaactgtgacgatttaagatgcatctgaactcttttagatttccatagaacctcactcagcagtcctttcgagatgatgtcatagttcttttgtgtaatctagtaatgccttttaggggaggaagccggtgtattttacaaatgttatcttatccttacaacacccttgaagcttagtaagtgatattagttactgtttgggggattacaaaaattaggttgtggtttttaatgtttatttttatagcaatgagaagtggtacacacacacccatacttatatgcatatttgtaaacatgtgttatgtatattattatatacacgtatgcatcctccccccagcattgatgtgtgtaattcaggtggtatttggttgactccctcctaatattttgcaactgccactaattgtgatggttgttgcactttaaaatgttaaacttttagaatatgtgagaagtgagcaatttggcattggatctagcactgtgtcctcaagtccctttcatgtgctcagtggatttttattgagtgccaattgtgtgccaggcagtggcattacaacagtgaccgaaacaaagtcactccacttgaggacctgaatgtctagtcaaggagctagagagaaaacaaatatatcctctgtcaggtgggggtaaagcgcttctgatgacaaataatgttggctgagctatggtgacatttcagcagaggactgcacgagctctcccaggcttttcttgctctaaagcagtagttctgaaccaggggtgagtttgcagtaactggagatatttttctgccctacctggggcagggctgctgccaggatttcccattcagagtgatttgagaggatctcagtccacctgtaaagaggaaaataccctcttagatttgtagggccacagcctcttttgctgtgcctggaacatactggcagacacctttcctgctggggattttgcaaaatctggggacgtttttggtggttatgcttcggggaagggtgctgctagcatctagtgtgtgaggctggaagtgctgctaacatcctgcagtgtacagggcagctgcccacaacagaatgatctggctcagaatgtcagtagtgccaaagtggataaacctctagaaccacactccccaggggttcagtagactttcccgagtgggcatggaaaggtaaactcaactccctttctgcacgacccctttttctggcccatgagagcctatgctgtggccagtcgctgtgacagaatggttttctgcagggcatccatgctcacagcaggatcagatgccatcttcatgctttgacttgccaaggacattcaccaataaaatgcgcgttcagggagacagctgtcatgacacaacacgtttttcccatgacacacatttcttccgtccctctccaataacctcgactcttgaatgggtgagggacatttcctcaagagctgtttatctgggctttggggctgtcttgtgaattctatttaaaaatactcaaagtccctgagatctttggatctaaataacatactggaaccttcccgtcccctcctctccttggggctatggtaccaacagaagatgaaagctttatttcattttcaaaagtattttatatttctttattttgtaccctcttgataattgatcctcagctgccaggatttcccattcagagtgattcgagaggatgcccaggccacctgtaaagaggataatacactcttagatgtgtagggacacagcctcttatgctgtgcctggaacacactggcagacccctttcctgctccgagtatgcggtaagggggcaagaagctgtatggtggcttctccctggagaagcagcttcagccccttgtgctcctgcactcctgtgctttaagggcgagaacacattggattctttttttttgaggtggggtttcactcttgttgcccaggctcaagtgcaaggcacgatctcagctcactgcgacctctgcctcccaggttcaagcaattctcctgcctcagcctcctgagtagctgggattacaggcataggccaccatgcccagctaattttgtagagatggggtttctccatgttggtcaggctggtctcgaactcctgacctcaggtgatctgcccgccttggccacccaaagtgctgggattacagttatgagccactgcgcccggtgaccacatctgatgctgaaccaaaggcagctcttgggaggtggctctgagcctcccagccgcaaggtaggggagctcaaagatgttttaggagtaagcttgacaagagggtatcaggaaaaattgtttttctttgaatctccccggaatatatcatgtaattcacctcttgaggggtcctagaaagaccacttgccatcccaatatctagccagtcctggagtggacccagtcagagtgcatgaactgtgatacaaggcctatgtcttggtttttttcacctcctgcaagctaggagcctcccaactacccacagattggaagggacttggtgcagggatatggcttcgggtgacaacccacctatcagagctattcaaccattgaacagcatggctgtcagtctgaggtcgcagtgatgtcaggaggtggcagttttggcagctgacagccctcacagatgcccttgtgcagaatgaacctatcaagcattttctctactggctatgaaatggaaagtgaggcaagacattcagttgctgcacaggaaggaaagcagtcagggtggttgcctgagcgtccaggtcccagacaggtctgttctccatggaatacattaagggattgatttacctgtcttggagctgcttcacattgcagtagagggactgtgccgagtgtcatgcaatggccagttatcttgcagaacttgtttgtttctgcaattattaaaagttttcctggcagtttttttgttttgaccgagagtctttcctccaaaaatcattctctccatcctctcagaaccctggataattctctcctgtttgtcgtttgcataccatgtacctggaactcttatgttctggttaagtattctagcataagagagaggaagcaaaataagtcagcagaggatactttcagcatactgtgacttttagaatgttcagttagtgatactaacgtttcatagcctgtaccaataatcaacttttctttcccctgaagacaaagtagcatggttgtgacctatctatactgacttgttttcttcatgcatgcattcaacaaatcttaattgagtgcatgttatgttctaggcgtggggctgggctgaccctctgggaaatgacaagatgaaatgagacacattcctcctttcaagaaagtttgtgtggaatgtagaagatcattcattggttgaggagattgtaaactatcctggaacacagtggtttaggatgaaacaaagcagtgcacaaatgaacgctctagtcagtgaggctccattagaggttcctcaagggtggggactgcgttgagtgtcacgagactcctagggtcagcacagtgcccagcggctggtacgtgctttctaagtatcagctgaaatgctacagcagcacggcctagtggggagggagagagaaagggaggaagagaggggaagggattgaggaaactgacctagattatgggcagtgctggtcccccactctcagcccatgtggcttgggagaatgagcctgtctcttgatgctgtgaactatcaccaagagatcccctaccttgctccccaagttcaccaccaggcttctctccatctcagagcttattgaaaggacatggaatcctctggagggagttctccattgaaaacaaagacaataaattccaagtggcaaatctcataggtggccctgagtccctgtgatttttccagtccaccccttagttgaagtaaggcaaaatttgttttggggtttcataacagtgatgtaagtgcattgctttgaagcagtttttgagggagaggggaaaagcctgagttttggagaactacatttgtggaacccaagaaagtgatacatcttccctcctcccacccctcattgggggagatgacatggggcatacttccctatgtgctttagggggtctctacagaaagggggaaatgggattttgctccttgagtttgctgagggtaggacctgcagacttgctgtggtgccttcagagcaagagggaaagaacacagaaatagataccaccaaaagggatgaggatttcagatggcacacagagcctgctgagcgcatagccatgcaccgctgtgctgtgccttttcctctgacatccctttgcccacatataggagacaatccccttacaaagagccaagagcaagcctgaaggcttctgggagtccagtcggcttggaagtgagggaggaagctgggaaagagtgagcttaggtccgtgaacagtgatgagttcatgaaaatatttgaatctacctgaatagaaagattattttaaactagggaaaatttattttaaactggaagaggctgaaaatataaagtccactaatcttgtctgtctccatgagcttttacacatacgcacatgtgcacacacacgctcgcccatgtaatgttcacttaggtcaagatacagaccaacccaccaccccagaaggagctcttgtgcccctttccaatctctccccaagataaccattattctgacttccatcaattaatcaattttgcctattctttaacttaacataaatgaaatgatatgtgtacttttttgtgtctgactttcttctcctcaatataacgtttatgaaatttatccaagattttgcatgtatcatttttttaatgctgtgtataattccacagcatgaataaaccacaatttgtttatccattcacctgttgatggaaatttgagttatttctaatttttgtttttttcaaatgaaactgccgtgaacatcttgtgcatatcttttggtggacataggcacccatgtctctcagatggataagattcgaattataggttccataggccacatataggtaggcctatttgtatctttatatttgatttgttctattcttctgcccatgacaaaggtagtaaacagggtgtctttgagcagggaggctgaaaatgctctcttgtgagcagggtaagtagatggcttgtgctggtgcagaaaggcaggatgctggagaaatcccaggggaagcatggcaccagtccaaccagagactagggaagactcattaagaataactttttactacatgtaggtccagggaaagctgacatgggaataatgattaaaaggaatcaagtaaaggggcagagaggtagatttaagtaatggaaagatttttggtctgctttctagttttgtcctctagcacaatacgaaataattggctgtgggtatattacaggatcccttagatcttattgtctcatttataaaatataaaggctgtacagggtagttcctaaatggcctttgagctttcatcttctcataattgcatcaataatggcttagttgtaaatgaccaattctagtaataggagaaaatcgcatggaaattactgagaaaagcccagtttacttcatgctgttatcttaacatccacaactacatgtcgagagaatacgaaaatgtgttcttaggcttttccttgttcaaccagtctagccatgtgccattggtccttcaagggcagtggctgagcctcttttcttcctcccccactttttgctccctaccagacaaccttctcccataggtgctagtctgtttcctccctgactcgcattcctgcagccaatgcacctgctggtctgctggctgttgtttctcactcactgaaaaccagatctcaggatggacataggttggtggaccattttcttccagtcattcattcattcacttacagattaactccagttacagtcactgtagctagcatcacatacactaagctatctctcatactcttccagacattgcctaaggctgtggccacccagcccctgccctactgggtggagcccacacttgtgatatctcagagtgcttcctccaaccaaagaacccagccttctgcaggagggacacccctttccccctcagacagtcctgattctggcatattaccagaggccagtctttcctgatctcctcctatcctgagacgttctaggcctccttgagttccagttcgctctttcaagagctgcaccaaaacatctttacaacttgtgtttattatttgctgaagtttagctatcttaataaagaattatacttgtgatgaagtcagggccaggtcagtttgtctttctattcttggttcttagcttgttatctggtatatacaaaatgtttcatgaaaattcttcgtattgaagaaagggaagggttttgccaaaagccctactcaaggctgggaggtactgacgcattactgacacctagggataggctacctaaattgcagggtcatggactatgacaaaacagagtgttagtagtgaacatctcaggtaataccacataactttttaaaggggaaaggtcttcctaatttctataaatagttcaaactttcagacttagaatagtcctgcacttgtggcagtgccctcatagatccagaaagaactgatgttatctgatcttggggaaagtccccgccttgggtttgtaaatatccttactgacggtttctagacatttatgcacgacgttttgtcatgtgggatccagcacatatttctgacctggcgaaaactaagaatatctcaatcataaaaataaccagaaaatcataaaacagaaatctggcccaagattttctctggaaaagtaagaagctgctttgaaaggtgaaaatagaccagtgagcccccgcattggaacagattattccaaaaattgtgagcaaaggtctttttctgtattgtgcaagttaatctcctttgcccctttttgtggctgaaatgcatgcctaatctgcatatgagtgcctgccccaggtgggatggggcatgctgggattcctaaaattcagctggcttgcttgaagagggctatcaggctagatttcatgtctcaacaatttctagccggtctccctgagctggcaagcaccgctcagtttataatagtgcctggcacatggtaggtccagtgtttattaaactaacagatattcccaacaggtgtgggcagcagtgctgctaattagcagtaacatagccgcatggcagggacaggaaaggggagccttctgtgtgtccctactatatgcaatgtatgactccaatctcaaaagaagcagagaatactcagccaaatatttgcattgattcctgccaacaccatttttttgtgatttgtatgttcccttccccaccccccaccccctgtactgttaacttcatatttgaagggggttatacttttaggttatttgtgaattgagtcagctcatgtaacagtgattctcaaagtgtggtcccaaaaccagtgggatgggcatcacctgggaacttgttacaaatgcagattattgggtcccaccccagacctactgaatcaaaaatcctggaggtgggtccagcaatcagtgttataatgagcctaccagatgattctaatgcacattgaagtttgaaaaccaccattgtttaaggatcacaacaaatccaacagcactgtcagaagaacaactccttattctaatgggtcaggtgctttctgtgttggctgtcctgcagagcatctctagtgatagttgtattttcaggattagaggtgcaaaactaatgggagtttaagaaggaagtttgagcctttactgctgggagaatcacaagccaagtttatttctcttccattatttgtatggtagctaaaactgccaaggactactgtgatccattgaaacatcagtgtatcacatctcttcttacatctgagctggcattttgggtgtagtgcttcagtaacagttgtattcccaagcaaataaaatcttagccaccagaaatcttgagttggactagacaaaggcacctctccagatagcagctgttgttggaattgaatataagagatgcttaatcaatgtttgtgtaattgaatagaatgggaaatgaatggctcactccaaactttatacaagacagatgaaggcaacttcgatcttaacctttatgatacatagcattttgtactacccttgagaaaatctcagtctcgggttatcatagactcaattggctatcatgggaaattctgtctcagtgatgctccatatctatttaattgaggtttattatcaatttgaaaaatggaaaattcacctcacatattttaaatagccaagatagccagagtgtatgttgtggtttcaatatgtccccaagagttcttgtgttaggagcttggttgcctttgcagtagtgttgagacgtggggcccttgggaggtgattgaatcgatgctgttatcatgggaatgagtttgctatcttgggagtggggtcctgatataaatgatacatttggctgccattttctcttgtttcatgtgcttgcttccaccttcccccttccaccatgggacaatcctctccagatgcctgtgccatgctcttggacttcccagcctccagaactgtgagaaataaatttctttataaattactgagcattctattatagcagcacagactaagacagtattgaagacatcattacaaagatgcaagatgacaagacagggggtgtgcccatcagaacagtcaagagctttctctccaaaatccccagtgtcgtcacaggactgagatgtagtgacctgactctcgtaagtttctggcttcttccttttggagccacaggtaagcaccagtctagaaccttcc

SEQ ID NO: 2632 - DNA, 1280 bp, Homo sapiens
ggaagttcagttggcaggatggcagcagcagacacacagggtggttaagaacaacaaacacaggagtcctcatgaaactagcgtggacaacactagattgaccactggctaccaaccggcgtaggaattcaacctacatgaagactcagagtcaggacccaccctgcacccccaaactgttgcgctttcccagagcccctgccgtgccgtccttccctgactttctagttcccacccctgaccagctcttgggctctctgcactgagctctctgccctgcaactttagtacatgggatacaagcttcatcagctccctggcccttgttcagaacagctgctcgccgtgaagtggacatgcatgtgctagaacatctttccttgtactgaggaatgataaagcgctggatgatgcccatcctgcttactgtctctggggacaaattgggaacatacaaggtgccaatcccagatgaaatggcatgatgctagcgtctgtgtcttgggggctctgaatactccaggtctggttctgcccctgaggactgaggagatcaatatctccactcagaatgtcctagtagtaaaactagtagtaaagctctgggccagggtttctcaaacttcagtgtgtgtcaggatccctgttaaggcttgttgaaatagattgctgggccccatccccactttctaatgggtaggcctggggtgctgcttaagaatctgcatttgtgagaagtgtccaggagatgttgatgccactggtggggaagaatactttgacagcgactgctacagaatatagcatttctaataggattcaatgaaaatttccactttcctttgatacatttctaaaatcaatcttttcgaacctgtatcccaagaaaatgtggtgcatatacaccatgggatactacatagtcataaaaaaaaaaaaaacaaaatgatgtcctctgcggcagcatggatgcagctggaggccattattctaagtgaatcaatatagaaacaagaaaccaaataccacatgttttcacttataagtggaagccaaatactgggtatatatgggcctacagataggaacaataaacactgaggactccaaaaaagaagagggagatgggcaagggtggaaaaaccacctattgggtacgatgttcactatttgggtgaggggctcaactgaagcccaaacctcagcatcatgcaatatgtccatgtaacaaacttgcacatgtaccccttgaatctaaaataaaatgaaaaaatccctac

SEQ ID NO: 2633 - DNA, 11505 bp, Homo sapiens
tgagtgttaagtgagaaaacttagatgaatgtgctatgataatgacatacaattgttattatcagtaagaatgacaatgattttcttccatatcctaccttacaactgttcatacctgcatgctgattatattcactcctcccattctcagttatcagtgctcccatggtagacattgataattcatctctgctctcttttcctcctttctcagtggtccagagggcccagcagcacagctggttgcactctgacttctgactgcttagcagtgggtaccaggctacttatacagcatagatcatgcatagatgagtgagatgagtgttcgcttatgatgtgaatggcaccacttagaatggtgcagtgcacaacttgtacaattgtatgtggaagccttggcatctacctgtccatccacagacatctagaattttttccctttagagcggtatttaggccacagttccagctttgccagtagggtttgtacaatgttagaggctatgttagacagtttttctcatctgagatatcaggagattccaaacacatggcagcatgtagagagaagaactgtgaataaggctgacatctaggagactggaatctagaagcaagcaggtaaatctaggtggttgcctaaatgaaggggtatgatgcagttagggggagaaatgagcaaccccagaacaagggaaaagaacaattgtaagtagacagaatgcacagggagcattgagttaactttctggacaagacagtatttgtctgagatttactttaatgtgtggaccataaacctgccaggttctgacgtggatgggctctgaagcagactgaattttgtttgcccccagattcatgtggaagctctaaccctaatgtgattgtatttggagatagggcttttaggagataattaaggttaaatgaggacataagcgtgggctcttaatctattagtattggtggccttacaagaagaagaaaagaggccgggcacaagtggctcaagcctgtaatcctagcactttgggaggccgaggtgggcagatgacctgagctcaggatgttcgagaccagcctgggcaacatggtgaaaccctgtctctactaaaatacgaaaaaaaaaaaaaattagccgggcatggtggcgtgtgcctgtagtcccagctgctccggaggctgaggcaggagaattgcttgagcccaggaggtggcgttgcagtgagccgagatggtgccactgcactccagcctggcgacagagcaagagtccctctcaaaaaaaaaaaaagaagaagaagagacaaagagaggagagatctgttttctctttctgctatgtgaggacacagtgaggaggcagctctttgcatggcaggaaaatggggcccttgtgagcacctggccatcccggcaccctgcccttagatttctagccttctgttgcttaagccacccagtctgtggtattttgttacagcagcttggatagactaagacagactttttataatagaaacctttaagcaacaatttattttaaatcttatgtaaaagaaagccggagtaggcatagccttataggatcattaagaagccagcctccttctatctttctgcttcagggcttccatctcaagattacttcatggctcaagactgctgtcagagctccaactataagagcagcatcccaggtaacatgacagaggatgggaagaagggcaaaaggaatgaaccttcctggctgagtctgctctttttaagtaatcctcctggaaggccctcatgctctgctacccatcattggccaacatttgtctcatggctatgtctaattaagaaggagatgaggaaacttggaattttagctgagtgcattcctgccgccaataaaattagagtgttgtttccaataaggaacaggaacaagggtattatagacaaatagcaggctttgccccaggggccttttgcatatctcttcatattactattttttttttggaactacctttcttaaaagcaactggcaaacacaggtgattgtgctgggctcaataaataccaactgggttattgaattagaacggctgttaaatcattatcctgattgaagggtaggggaaaatgtgagctcttctttttgaagacttggtagtcagggccagaaaaaacattccccaccatgtcaacctggcttgcagaaagcccaactgttccaaaacctcagcatgggtcagaacttgatctttcctttgttgctgcttcaaatgacagttttccattattatattgtgtaagatagctactggtgccatagaaaagaagttggtgactcatgaaattacttcttagccagaaatatattaagctaaaataatgaggcaatgacattattttttcacctatatcccacggcatcacttgccagtgattgcttaaggaaacttggccttgacatggcataccagtctatattgaatattgcaaacttttagggtcactcaataagtgcaaaagccaaaccatatgtgttagatcactagaagttcggcttggttgatttatgctttgaagtgtcaatcattacagcaaaaaaaattattgagcatatactgtgtcataatgttgtatgccggcacactgacaaagaactaatatttggtttttgctttaaagaccttaccagttagtgagggaggtaaaaggtgaatggtagagttaaacaaggtagaatgtgaggaggacactaatggagaagcagtgggaagccgagcagaggggtggggactccaaggaaagctgtacaggagaggtaaagagttgaaccttgaaggctggggaagctttagccccagatccatggagacagaggttgagagaatggagggggatttgcccaaaaaggaacagcatgaagacgggcctggagagaaggtgtcctggggcggctcagaaactgctgagaaatcaagctgtgctctgcggatgtcaatatgggaaaaagggccctaaaagcaataagtttggggaaatgccagagattttgattaaatgttaacatattgagaactttttttaaaggcaaactgacatctatttaattgtgttaaataagcaaaccaatttacatgagcaggaaagaagttgttgtttttttttttttcttttcctggaactagtatttcctgaaagctttcctataatattagtttgagaaatactaatatgcttggcataatggttttaggatcattagaaatgttgcctaacaatcatagttatactgaaggtaataaaatagcaaaatttaatttttgctggaatacaaggagcataaatgtagtcttgagaaatcaatgctggaaaggcacattgggatcagattgtaaagaatcttgagtgccacgtgtattagtcaaggttctccagagaaacagaacaaatagtagatatctgtatatctatctatctatgagataaattataaggtattggctcacatgattagggaggctgggagtcccatgatctactgcctataaactggagacccaggaatgctggtggtgtagtttgcaggcctgagagccagagatttgatggtgtagattccagcctgggtctgagggcctgagagccaggggcaccaaaggcaggaggagatcgaatgttcctgctcaacagtcaggcggagagtaggtccagccttcctctgcctttttgttctattgagaccctcaaatgattcggtgatgcccacacccacactgggaaaagccatctgctttttcccagttcaccagttcagatgctaatctcttccagaaacaccctcatagacacctccagaaataatatttcatcagatatctgggcattttatggctcattcaaggtgacacatgaaattaaccatcacaccatgctaaaatgtttggattttatgttgtaggcagagagaatactactactgtcacactgtgaatacaatctgcatagatttgcctcaataatgtaatgttaaaaagatgaatacctggattagacttcatggggtttagagatcacaacacttcccgtcatcatgtttggagtcttcaaagaacaaagcttaagatttcgttataaactaaaatgaatgtttgattacttaagtagaaccagtttggacaatatacaagttaactgaattaattacagccatggttttgatgttcctttgaaattcagactgatcaaaatggaagtggtggtttaaatgaagccatccatgtgtgataagaggacaccttccaatgtagcaagggcacacttctgaatcaaatcatggttaggatattagtagatgtgtaagtgaggataattaatggtttcatgtacacacacacacacatgcacatatatacacgtatttcttgcctatgtcaattttattgcagttattctttgtcaggaggttcttccgggaagctcctccaggcggttactcaggaatccatctaccttgtgctccaccatgtttaacacattgtttcaagtttgctctggtgtcatcagctgacagatgagaagacagaagcatggagaagaatgaaagaagggagaagggacccggcttgttggcttaaggtactttctcacacagatcaattttataaaataatgcacctttgataattatagatttggaactcattatatttgtgcccacatatgcctagggaggtctttatgaggatgtagctcagtttgaagattgctaatgtatggatgataaaaatggccctagagtgtggatacctcatttcgctcatagctggccatgctctcctaaataagttactgcacctcaaggcacctggtctcctgtttcaaagaatttggagccactttggcggccacatgctgattcccaggtatccctctgggggtgaaattaattgtataatgtaggctgtacttgctactgactgtatccaccaaattatcttttccaagcaattagattctgcagccgtcccatctcaacatatcaaacagatttatgaaagtaatctttgacctttgcaacaaccagaaaggaacatagacgaagagaacagagctttaaggcatttctttcctttccttttttttatggcttgattagatatttggtttccacagcttgcaagactaattctgtgcttcaatgactctcttataaccttagtacgtagagatggaaaagttcccccaacattttcaggagacatttattacaggctattttatgtgtctggtcagaatgggctaactgatttttcacaagaacagaatttggcagaaagcctggcctctcttagtcctccttttgccaaaaatcactctgaagccagcttggaggcctcttgatgtcccctgtgaggccaggttgagaaacggcctgggcgagagtaaccctttcaactacagtcagaaaaaaatccatggagaggtagagaacccctctttacctgcatttgaggaaaatgcaaggggaagcttagtggctctatctccctgggaagacctgatgacaagtcacacatgcgagttgggtagggcagagagaagccaggacacattcatcctcctaactagcaaggacactgtaggaatatggctgcccccacttctccttcaaaccttcccaaataccatggttcacctggctcagcagcttcccagcccttgtgtcacctccttccccctccagtgtggttacttggtccccatctgaagatgtagcctcactctgcctctcagggcaaatactgacaagagacaggaggtccccaagtctcaggaaggttttaaacgggggtgtgccaggctcaggtttcagttttcgatttactgctctgactgcagctgtgtggaggatgttcaggttacactgtggtgataaagttgttattctgctggagaactccaatgggttttacatgtgtgtttcctgtatgatgtggtgaaccctgatggcctctatggcttgcggcaggagctgttgtctcgtcatcttttattggagatgagcaaaccaggctgagtttcttaaaatgaatatttttaagaggttcttcactaagccggcttggtagactctgagctctggtctcagatggtccaggctctgatctcccacacctctgcttacttggcgaaatttcttggcgaaattactgaacatctctcagcctgttctttatctgtaaactgggaaggatccttgtgtctatttacaggattattgtgatgattatgctcctggtctgtataaatattatactatctgttttcctttttgaactagtgctgaggatagagtggagagaactatggttagaggaagcagagaaaaggaacgtggatatagaggtggcgtggaggatttgatgtccctgagttggatcggcagagatgctgcagttttgactaagaacagctcctggtttgatttgtctcagttctcgctgaaacatcccaactgatggcccagaggttggcagtggtctaaaaacgttttcgtttggtctctagagttagttgatctgaatagtaatagctgctctgttgaggtgggtgtgtaagtcagtgttttccagagaagtagaaccaataagatatatgtgtgtgtatgtatatatacacacacacacatatatatatagattgatttattttaagaaattggctgacatgatcacatgattgtggaggtgcaagtgaaaatctacaaggtaggctgccagatcagggaagagttgctgtcagagtccaaaggccctctgctggcagagtttcttcttgcttggtggaggccagtctttgtttaactaactggacacagtccacttgcattatggacagcaatttgcttccctcaaagtccacttatttaaatgttcatcttgtccaagaaaataccatcacagaaatatctaggataatgtttgaccaagtgtctgtgcaccatggcccagacaaatggacacatacaaataactatcctagtgggtacccgtggcagttggctgcaacctggattgcctaacacctgacccatgccattcatttacttatattcctgactctgatagatgtttgagtttgtggtctttactctagcttccttattcatgattatgtatcagattgcatcatcagacactacatgatgcaatttgacttgctggtcttgcgtcccccatctatcattatgaactggctaaaggaccactgtgtggcatgttggggggtctttgactctggtggatgtgctgaaacttatatgagcttaggtgtgaggcatgttgggattgcaacagcatggccctggatggagagaaagctaaagatagcaggctgggaaaactaattggcaggagcaaatgccccatggagcggcctaggggcctgacccctagtgtccaaaggatgtgacatgttcctgtgtgtttgggcgggtttgtgtttgggcagtgaggtccaatccaaaagtgaggcctcccttgagtgggagggtccaggaggctggcaatactctcaggcttggggcaactggtttcttcacaacaggctctgagccaggaggaaggcagtgtgaactaccttggttataggtttctcattcaaaaagctcaggttcagggaagtgttaagctctagcaggaaatggagctaggacccaggtgtagggaatggccaaggcatatgacagaggctagagtgaaggcttctgtggtttagaggccacatggtgagccctagttgatcctggtgtcgtggaatccagaccacaggcagcaggattcaccttagacgttgcctgctgctgctgctgaggctgctgccctgacttaaactgacaaggggatggggttgaggcggattgagagtggtgtggacatcactgtggactgcatagggccctcatccctgtgtgagtggcactgatggggcagtggtggatttccccatgagatggcgctcagagtttatctttctgtgtgcttttttttcttgctttgattaaaaataatgcatactctgcattgtactgttttagaattcatagaaatatgacttgtctttcctaatctcaaaagcagatttcatgtactttcatgattcccaggggattatatttctgatagttatttgtttttccttctgggatgtggtgacagaaggaggcagggcataggttataatctcttaccctgacacccttggatcctaccctctccctgagaagctcacagtcgttataagtaaagatccatctgttcttctgatacaagaggcgatgaaatgtgctatgctagagataaaaacaagatgccattattggacgagagagaaaaagactaattctgtgtggcatctccttgaggaaagattgggacattaataggccatagatgcagcttaatatttaaggtgaaacatactgtttctgaagactgggaagtagggacaccacaaacaactcaggtctccctgtgacaaagttgtccagggaaaatcttttcctaagagtcctttgagacagagaccttgtttgtgagtctgaaattaaagaaaagaagaagagacaaaatttaggaagtacccccaacttctggagacaagagggaccaggtaaatactagagcagggtcttggtaattaggaggtaatatgctcttttgaagttacttcaggcaagagctgacaagaggtagtaaaaatgcacagcctgggaatcaacaaataactaatagtacctttatattatactttatggtttagaaagcgggatcacaatgtaggaattttttgatatttctgtttaacaaatgaggaagcagaggcttagagaagttaagtgaattacttaaggtcatgtaaatagtaagtggctaaatccttttgaaggaacggatttggaccagtctgtttttatagccactgtgaaacttcaatgtttccctcttcaataaacatttattgagcacctattatgtgtacatactaggtatctgatggtttctgatacagttccttctatctgggagctcacagtctcatgaatggttctcaactgaggtgatgtttcccccaccaggggacatttggcagtgtttggagacatttttgttgtcatgactggggagtgggtgtcactgacatctagggggtagaggccaggaatgctgctaaatatcttacaaagttcaggacagcgcccacaacagggagcaatccagctgtcctagtcagtttgggctgctgtcatagaataccatagacaagtggctcaaacaacaatatttatttctcatggtctggaggctgggaagtgagggtgctggcaggtttcgtgtctagaaagggctacttcatggcttgtagacagctgccttccccttgtgtccacgggggagactaatctcattcatgatcatctcatctaaacctaattacctctaaaaaccccacctccaaataccatcccattaggggttagagtttcaactcattaattttggggacacaaacctgcagtgtgtaaccctcacccagactgtcaacagtatggcaattgagaaaatctggcctagctcatcattcattcatgtattgtatcatttttaaaataatatttctgaattattagacgtactaatgtacctacaaggggccaggcacagttggaagcacagaggatatggttccgaacaagacagagaaagcccctgctctcctgtcacttccattctaggtgtggggtggagggcagaggagaggcagagttggacattaacaggtaaacaaattagtaacaaggaaattgtcaggaggcgatgactgctatgcagaaatttcaggtgtgttggcacaattacgtgtaaccgggtggtggctttaggtttgctggtcacagaaggcctttctgaaggggtgataattaagattacatttgaatggcaagaaactgtgcaaggaaagggcatgttgtgctgagggaacagcaagtgcaaaggccctcatgtgggaaagaggttggcatgttctttcaagggacagaaggcaggtcaagatgttcggaaggtagcagcagagggggagagtgtgatggagctgatactggggagggtagcagggactccgtctgattagggctttgttggctaagataaggagtttgggttttcttctaaagccttacatgtagcttttctcagggtgaaaaatggtgagggttatgaagaaaacaaaatagggttttggggacaaagtgtgtgagagggtgtaacattgaatttgatggcgagagagagagtccctctgagacttggatgttgagatccagacagttgtgggatggcctggggaaacctacgagcttcctagggttatgggccaagttgtgtccccaccaccattcatatgttgaagccctaacccccccaccaccccaaccacagaatatgactgtatttggaaataggccctttaaagaggtaattaaagtaaactgaggccatgagggtaggacttaacctagtaggactgatgtcctttcaagaagaggaaacttggacacaaaaaagggacctcagggatgcctgagcatgggggaaaggccatgtgaggccacggggaaaggcggcagaaggaaccaagactgttgaaaacttgggcttttaccttcctgaactgtgagaaaataaatttctgttaagccccccacctgtggtattttgtgccagtgtcctgagctgactagcaaatctgaggttcagttttcttatctgttgaataagaagcagctgtgaatctttaagtttaggttgtttccagttttaagagttgttgactctaagaaatacatgggcttagtgttggggctacctgcaccccataagccttagctacgtgtcccttaatcagagaataaggacagagcagtcctgacgggaaacagaagagcccttgggaggaacttggaatttgatataaattttccatcaatttcaaagaagagggctcaggctgggagaatagcccagtcattctgctcccacataagagggatttaaaactccagatgggactctgcgagatcacaatggcgtgcatgtctccactggggacaggcagaatttgtgccagagtttccagagagaagatggaacgtcaagaatttttccttggaaagagttcactagagcccgaggggccccatggggaaatttcagtccccttggtgctggctggatgcaccattccaggcgtaggggaatccctgcattccatgtgaaaggagcctcattggctcatcacgtcctttgtggctcttgtctctgagagggaaggtcggaggatgcgactggctccagggctcaggaacgaggtggtcaaagctctgcaaaattcacaggtgcccaacttgatggaagagaatctgacctaggaaatggc

SEQ ID NO: 2634 - DNA, 5712 bp, Homo sapiens
cccagaccttcattgctggtatgggcattgctagtcctgcctcaactagattgttgaatttaatcacagggcatgagaatactaacatatgtccattccaaacatacatccccctatgccctttatgtggcagcaactcaattttgtcatgacaggcaggagtgattccctcagtgtattcagcaaaccccttttcggcctattgattcacaggcacaagggatcccaaaatggccagatggaagtttccaattccagttcaatgaaatcattgttgtgctattagaaattctcccttcagaacgaagaccactagcccagtagaacccaaaattgaggggacaggaagcacaatgttgccaatggatcactagagacccaggtaattttagagtcactctggagggaagattcgtatcttgaaaaattcttccaggtgatttggacatacctttctgcctcccagccacccccccccgccatggctcatagccacgtctccgggattcctcagctctatttctggatttggtcagaaaacagcctgctctgctggattagctcatctctccatggaaatgccaccctggagttatgagagcacggcctctttctaaggctttctggtgcaatgcaaccctcctcgatggccacagctgattgactggagtgaacctgtgacctgaactgggccagtcagatttttcatactggaaatttggcgtcggagccctgagaaacaagtcaggtggtctcgggggctgaagctacccctgtggggtgactagtggaactcctggtagtgagaaaaagtgagatgagactgatgatcttcagaaggaaaagtttggactaaacacccagaggaaagctgaaatgagagaccacatggaatgaaggagaacaaagccaatcactgagacaagtattgccagggaagaaggcttttttgggtgctacagctgaggagctgggaggtcaaaacagtgtgggaaaagaaatttaaaaaaatgttattaaagaagctactgtcaacctaaaggaagaaactgaggcaaaattaatgtaagtaaagagtttatttgggccaagatgaggacagctgctcagaagattcaggcccaagtgatcttggataggagctctgtttggcctttgttaccagcaggtttttaaaggcaaaagcaaggggatacgtagggggatgatacaaagttgcttgtcaggaattctctttggtttacagaaatgtcattcattagttattgcctatacattgttgacatatagattatgacctaatgatatctatcatgtggtgtcattaggttaattttgagctacttgtgagaaaaggcctagagtccacatagcaagcaaattcaagagatgattatttagctcaggaggggaagtgggatgtgactgtagcctcattctcatgcctcactgggcctgataatttaaaggaggttcacattcctcagatagaaagtttcttttctttctcgctataagcctctgtctttcttgtctctctattgctaagtggtttggcataaaatcatgtgctctggtagaaacctaagggctttttattcagctgttgaaattcatacccactggagattctagagccatcagtggccatggttcctgccactggaggaaactgtctttagagagtgaaggtgaagctgacatttataaacagccacggtgagaggcagggctggaaagcaggcctggctctgttccagttcctgtgtccattttggagacgagtttccgtttcctatggtttgattacgtgatcccatgaatctccatctcctgcttaagctgttttgagtgtcttgtccatacatgaagtgtcagggtgtcctaagaagacagtggaaagtgatggggtccagcatctgggatgttgggcatcttagtactgggggagtgtgtcagtctatagcaaaatcttcacttctgggctgggcttcaggatggaactcaagtcttttggagggaggaggagttcctagaggaactggggtcgcaaatgagttccaagtcaaggactcaagaccatgagtcaaatatagatgcctgagtgctgtcctcagcaagcagtcaagggtgttggacccagacgcccagatggagtccagggtaggcatcacttacaggtcgtctttgatgcatagaaataaaaaaggcaatctaaagggcagaatttgggttgaagccccataataaaaatcaagcagcttgttctaagtagcagttgtcatttggaagaggctaggcagaaagggtgacatggtaacatttacagatagaaagaaggataagcagatgagagaggaaaacttcaaagaaaaatgaaggaggtagaatctgaaaaaaaaaagtcctggactgaagagaacatggtgttgctgcttttgtaagttatctgtgggctaggttgtggatatagagaaagctgctaaaggtgatagttcactgaagatggcaaaagcaccatgagcagaactgggacacaggatcagggccagatgagactacaagatgacaaattttgggggtcaggaggggaagtgagatgtgactatggcctcattggtagacttttccattcatggcccccaagggaccgtgtctctcagtattcatgctcttgtgcattgtctcccatattggactctgggcttggcaaggtgacttgctttggccaataatatgaacaaattaaatagggataaattagaggcctgataggcatttgcatattggacctatgctctttgaattctgagattgccagaggatggattgactagctgtcattaccttactacaagcctatggatgaagccagcacaggaggtaatggaaggaattgcagagctacgaagctgtgactgtaatgcagcatgcctagtccccttcctacctctagtcttcttgttatatgaactgataacttatagtttaaacttctcagtaagttcactttcttgcaactgaaagtgtcctaatgacacagtgtattagtccattttcatactactctaaagaacttcctgagcctgggtaatttataaatgaaagaggtttaattgactcacagcttagcatggctggggaggcctcaggaaacttacaattatggtggaaagcaaagaggaagcaagagaccttcttcataggcagcaggaaggagaagtgctgagcgaagcagggaagagccccttataaaaccatcagaccttgtgagaactcactcactatcacaagaacagcgtgagggaaactgccctctgattcaattacctccacctggtctctcccttgacatgtggggattatggggattacaaatcaagatgagatttgggtggggacacaaagcctaaccacatcacacagccttttgtttttaattttttgaggcaaattcccataatgacatggttttttttttgaagctgggaattctataagtaaaaatatttgcaaggcacttaacagcttcgatggggaaactctatccctgtgtccatgctttctacttacctgatcccctaagtaccattttctgaaatgctgtccactgggatgcagcaaggagtccagttggtgattttagagcatcacagccatgaagagttactgagttgtgcgtactcatctgaaactaagacagcctttttggttccagttgtcagcttgtgatctatttatctttgctcccagggggctatataaaggataccagaaacaggtacttctcatgtcccttctagctcaatgagtaatagacttgatggtttttccctctgatgtctgaaactttaaaaagacaataaaaacacacagatcaatatactgaataagtatatcttccaaacctcatactctgtttctcattataaacatataaattagcctcatgcaaagaaaagaagcatagcttgtaacatcttttctatctgacatgtgctgctgcctagaagactccttaacatgctccctttattacatctcccatcatattctccacttgagtatccagcaactggaatacagtgttatagaaatgagtagttatatatctgtaattatttccagcttcaaccgtgtctataataagccaatgtacttaggtcactaagctctaaataggccagagggtatggaagacatatctatccccaccactggaagaaagctcaaagcttgtccttgttgctcacgctgtgatgttttcccaaagggagggcagcagggctgttatttggggacagctgagacctgcgaatgcataagagcagaaatgatcaatggagcatccccattgtccatcacagggaaaacccagagagggaaaatagggcatattttccctcactgccctgaatgcaatacaaatctcatcactccatctccctttttagcctgtgctggagcaaatagttttagaacatgcacaatttgaagcaaccccattaagtcaggatggcaaatgctataatttatccatgctccctccttggagaagttgaacaaatattgcagatgagctttataggtaaagactgtagcagagccttattaactaggtttagaacagtaggttgaagccctttctcagacaagaaccacagactctgtttcctcttgatgtgatagatctgttaggggtgcttgtgtctgcactaagattacagctctaggcagggtagttcttgagacacttagaccacagctctgctctttgaggaatgaggcaattcaagtgttaaatgggctccatgttttaatctttagcacttgaacttattctatttctgtccccttctttgcaatgttaggctcagctgtctgtggtgacaggacttcttctgcagccaaccagcatacagctggtcactacagccctaggtgctgccaaaggctgagaggaatgggaaatgctagtactttccttcgtgcaagagtgggagatggtgcaagggcatttctgtctagttcaagtaagcatatattgagttctccctactggctaggccattagagacatagaaatgaataaagcatggcccctgcctcaaaagctttcattgtctacagtaaggtttggcaaactatacctgtgagggtgaagatgctgcctgttgtaaataaagttttatttaaacacaaccatgcacactcatttacatatcgtctatggctgcttttgtttctacaatggcagagtaggtctaacaagatcatatgggcccaacagcctaaaatatctactaactgatccttcacagaaaatgtttgctcacctctgcacaacttagtaatttttggtatatttacagaattatgcagccactaccactaccaaatttcagcattttcatcaccccaggcgacatctcatatccattagcagtcagccccagcccttgataaccactaatctattctctatctttatgaatttgtctattcctgacattgcataaaagtgtagtaaggcaaaatgtggccttttgtgactggcttctttcacttgcaatactgttttaaaggttcattaatgttttagcatgcatcagtgcttcatttctttttattgcctaatagcagtccattatatgtatataccatatttggtttatcttttcctcagttgatgaatgtttcggttatttccac

SEQ ID NO: 2635 - DNA, 31618 bp, Homo sapiens
tatatatgtattttttttttttgagatggagtctcactctgttgcccaggctggagtgccttggtgtgatctcagctcactgcaacctccacttcccaggttcaagagattctgcagcttcagcctcctgagtagctgggactacaggcgcatgccactgcatccagctagtttttgaatttttagtagagatggggtttcaccacgttggacaggttggactagaactcctgacctcaggtgatccacccgccttggcctcccaaagcactgggattacaggcatgagccacggcgcctgaccagaacagataattttcaaaacaagacatacaagtgaccaaaaaacatgaaagaaatgctaaccaggttgttaaccaggatgcaaagaaaactgaatgcttatacactgttgttgggaatgtatatcataacaacctttatggaaaacagtatgaagctttctcaaagaactaaaaatagaactgccattagattcagcagtctcaccactgggtatatacccaaaggaaaatctatatataccatggaatactattcagccatagaaaaggatgaaatcatgtcttttgtagcaacatggatgggactgaaggctattatcctcagtgaaataactcagaaagtcaaatacagcaagttctcacttattgttgggagctaaacaatggatacacatggacatacagtgtggcataatagaccctaaagactataaaaggtgggagggtcaaagttgggagagtgttgaaaaactacttactggttacaatgttcactattcagacaatgggtacactaaaagcctagacttgccctatacacaatatatacatgtaggaaacttgtaactgtaccccctaaatatatacaaattaattaattacaaaaaatattatgttgtagtgttaactggtatatcttgtcttgggaaaatatggcagctcctatgaaacatctcggaaaatttgtaactgatgttacaaaacacccagaagaaataagtggtctggtgagaaaacttactcatctttgcctacatatgtatacatgagtaatttgattacacatttgtgcgggataatataactgaaaagaaaatgtaaaatttaacttaaattgtatttgtaagttgtaatttcattaattctgcattattgaagtacatgtaggaaaggtgcagaaatgcatcaggcagttaatacaaatacgttttttttttttttttttttttttttgagatggagtctcgctctgtcacccaggctggagtgcagtggcgtgatcttggttcactgcaagctccgcctcccaggttcacaccatcctcctgcctcagcctcccgagtagctgggactacaggcgcctgccacctcgcctggctactttttgtatatttagtagagacggggttcaccgtgttagccaggatggtctcaatctctatacctcgtgatccgcccacctcggcctcccaaagtgctgggattacaggcatgagccactgcgcccagccaatacaaatatgttttgctcaattttgtaatgtttatgctaccatcagttttttgaaatatgtaacttttactttttttcttagagtcctccaaattatgtttcaggctccttaaaaactttttatctatccctgataaatattcctcaataataattttaaaaatccatttggttaaatgaacatgaactctaagtcttttaaccagaaataagctattaggttgatgcaaaatatttgcattttttgccattgaaagtagtggcaacaaagaaataaaattgtatttttggaatagttttctcttaagctcttgataataaacctgtaagtattaactgccttacaaatggcaaaagaggccacttgaaggaaaggaaattccttaacaggactttccttagcaggaaagttagttgcctgggtcatcatttggataagaaaaaaatccattaaaaaatggcagtattattagtatcatatgcataattacatatataaaacttgccatatattgtgtgaaatatagttctttagtataggaaaaatatattgatatctataaaggtaaaattattttaactctttcacatacatgttatttgataaaatttgctttcgtgttttttctttgtcaggtttcattgatactcaaaattcatttcctttgacatagctcaggagatttgttagtaaaaatctcacccaaattcataagaattttccaataaaatatttcagaaatgaaacattttgaaagaattggtcaattatcactttctgctagatagagcatgatagtttggtgtatattttaatatatcagtgatatagtttggatattactccccacccaaatctcgtgttgaactgtaatccccagtgttagatgtgaggcctggtgggaggtgtttgggtgacaggggcaaatcccttatgtcttggtgctgtcctctagatagcgagtgagttctcttgaggtctggttgttgtaaagtgtggcacctccactcccaactctctctcttgctcctgctttcgtcatattaagtgcccactcctgctccaccacctgccatgatgataaggttcctgaggcctccccagaagcaaatgccattgccaagcttcctgtacagcctgcagaactgtgagctaattaaacctctttacttataaattacccagtgttgggtatttctttatagcaatgcaagaaaggcctaatacagaaaattggtactaggagtgaggcatggctattaagatatctgaaaatgtgaaagcaaattaggaactgggtaacaagcagcagtccaaagagtttgaatggctcagaagacaggaagatgaaggaaagtttggaacctcttagagactggttaagtggttgttaccaaaatgctgattgtgatatgaactttgaagttcaggctgctgaggtctcagatagaaatcagaaatgtattgggatcaaagattatgcatattatttcttagtaaacagcttggctgcattgtgtttatgccctagagatctgtggaagtttgaagttgagaatgatgacctagagtatctggtggaagaaatttctaagcagcaaagtgttcaagatgtggcctggatgcttctaacaacctatgctcagatgtaggcacaaaggaatgacttacatttggaacttacatttaaacaggaagcagagcctaaaagttcagaaaatttgcaggctgatcatgtggcaaataaataaaaaccttttacaagagagaaactcaagcaggctgttgagcaaccatttgctagagatatctgcataactgaaaaggagccaaatgctaatagccaagacaatgggaaaaaggtttcagtgacatttcagagaacttcctggcagcccttcttaccacaggccctgaagcctaggaggactgaatggttttgtaggccaggcccagtaccttgctagcctgcacagccttgagacacggctccccaaattctggtcactctggccccagcctcagctcaaaggggcactggtaaaacttgggccatcacttcagaggacacgagctataatcattggcagattccacatggtgttaagcatgtgggtgcacagagtgcaagagttaagaaggcttggtagcctctgcctagacttcagaggatgtatagaaaaggctggtgttcaggcagaaggctgctgcaggagtggagccctcacagagaacttctagtagagcagtggggaggggaaatgtgggtttggaagcccacagagtccccagtggggtattgcctaatgaagctgtgagaagggggccaccatcatccagaaccaagaatggtagatccattggcagcttgcactctatgcctggaaaagctgcaggcactcagctgtagcacttgagaggagccatggggctacatcctgcaaattcacaggggaagagctgcccaaagccttgggagcccaccccttgcattaacgtgccatggatgtgaggcatggagtcaaaagagattatttcagagctttaagatttaatgactgtcctgctagttttcggacctgtgtgagctctagtccctttctttgcctgacttctttctcttgtaatgggaatgtttacccaatgctggcaccctcattgtatcttggaagtaaatgacttgttttgattttacaggctcacaggtggaaggaactcattttcagatgggactttggacttgggacttttgattgagttgttgcagaaatgagttaagattttggggaattgctgagaaggcatgattgtattttgccatgtgaaaagaataggtaatttgggggaagacaagggtagaatgatatagtttaggtatttgtccacactgaaatttcatgttgaattgtaatccccaatgttggaagtgtggcctggtgggaggtgtttaggtcatgggggttgatccctcatgtcttggtgctgtcctctcaataatgaatgagttctctcaagatttggttgttgtaaagtgtggtacctccacccccaactctttctcttgctcctacattcaccatgtcaagtacctgttcccactttgccttccaccatgattgtgaagttcctgaggcctctcggaaagcagatgccagcactatgcttcctgtacagcctgcaaaactgtgagccaattaaacctcttttcttataaagtacccagtctcaggtatttctttatagcaatgcaagaacagcctaatacaatcagtaaatatgtcagattctacaatgaggctactataatgtgaagatatttttcttaatcatttacatttacaaatagactaaaattcttgttttatgttattgtcttagttcattttgtgctgctataacggaatactacagactggtaattaataaacaacagaagtttatttggctcatgtctctggagattgggaagtctaagactgaggggcctcatctagtgaaggtcttgctatgtcataacataacatggtggaagtcatcacatggtgaaagcatgtgtaaaagaggaagacaggagaactcatactcttatcaggatcccactcccacaatatctagccctctcccaggataacagcactgattatcttagaagggtctcaactctcaggactgttgcattggggattacatttcaaacacgtggatcttgggagacacatttaaaccacaacagtgatgttttgaataataaatatacatctacaaatgtgtttcttccacctggcaatgccttcttctgatagttttattctgcaaatttcaattattcaaataaaatttcctcattggccctctttaacactttttcctctgaaatcttatattacttgttgctttacaaatactctttaaaaattattccacactggtatctaaattcttccttttttcccagtcttatcttcccaattggcttttaatttccatcaggaaaggatccatgtgttttgacttcttggtactgctcacagtaatacgtaaataattaagatttaatataattgggtttaatttaatttcatgtagattccaattgatttttccaattagatgtgtgagatttttattcattaaaatacgcaattatactagcatccatttttacttgtccaaagaatgagctaagatttaagttatattttgcgatcttgagatacatttcatatgctcttcgttgaatcacttttctattcatcttcaaattccagctataaaatatgatatgcaattgtcttagctcagattgatcacaaatccttgttctacaagataccatgtattcatatattcataaaaatatcaacagaaataatatattaataaatatttaagtatgtaatttcagaaagagatggtaatgtatcaggacagattttagttaggagacacaatatgcttatccgagcacaaagttggtttttatcaattgatgttagtttttgattatatactatatgtaagttctctatttataattataattttctcattaataataataataaatcatacctatattgtaccttgaaattatcaaagcccctttcatttccacctcattttctctctttctctttttctctttctttttccctgttcttttagtctctgtctctccttcagaaaaaatatcagttacttagcaggacatatattattgtttccatgttacaggttggaaatgaaatttcaaaggaataagttattttttatggtcttatagctaataattattaataattgatatatgtaggattgggatcccaaggtttaactcctaatcatgtgacttcagacaaaaaaacgtagaaataacagtttttctggattgttacatggggtcttaggcaatttgagtcattataacaaagtaccataaactgggtagttttaaacaacagagatttattttgcagagttctagaggctacaagtctgacatcagggtgccagcatggttaggtcccagtgagggtcctcttttgagtagattgctgccattttattgtctcatcacagggtgaaaaacaatgtgagctagctctttggcctatttttataagggctctaatcccattcatgagggttccaccctcataatgtaactacttcccaaaagccctatctccaaataccaggatactggggattcgattttaacatatgaattttgggggaaaatgaacattcactttataacacatagagagtgaggtagtctggataaatgatctagcgtgttcactcataaatgttattttcatgctccttttctaagccttttctattataacagcaatgcagtttgtaactttaagaattattccatgtagaatgtaaattgatatagccattatagaaagcagtgtgaagggttgggcatggttgctcatacctctaatcccagcactttgggaggcctaggtgggaggattgcttgagcccaggtgtttgagaccagcttgagaaacacagaagggcctggtcactacaaataataaaggaaaattagccaggcatggagatacatgcctgtggtcccagctagtcaggaggctgaggtgataaaggctgcagtgagttgtgatcgtcaccactgcactctagcttgggcgacagagtgagaccctgtctcaaaaaaaaaatcaccaaaaccaaccaaccaaacaaaaaaacacacaacaacaaaaacagtgtaaagtttcctcaaaaaataaaaaatacaactaccatatgatccagaaattccactactatttacccaaaggaaatgaaatcagtactttgaagagatatctacattcctatgtttattgcagcagcattcacaacacacaagatatggaatcaacccaagtgtccaccagtgaatgaatggataaagaaaacatatataggcaatggagtacaattcagctgtaaaaaataatgaaaccctgtcattttcagcaacatgaaggaaactagaggacatgttaagtgaaataagccaggcacagaaagacaaatagcacataatctcactcattgcggaatctaaaaaaaatatacatcaatagaaatagagagtaatatagtgatttccagaggttggggagggttgggaaagagggaatggggacagattgatcaatgggtacaaaattacagttacgtgggaagaatacattttggtgttctatagcacagtagggtgaatatagtaaacaatgttatggtgtatatttcaactacaagagaggattctaaatgtctcatcacaaagaaatgataaatgtttgaggtgatgaatatgctaaataccatgctttgatcattatacaatgtatacatgtgttgaaacatcacaccgtactccataatatgtataattactatgtgtgaattataaacaaaatatcattccatgtaatgtgaggaaattgtttctctttgaaaaaaatgtagctatcaacaatactggtaaaagcagatgaagaagcaaaatatcaaaaacccataatcctgcaagagccttaacaagattaaatatttgattatttctaggacacaggaccttttaaaacatttcctgttgttctttggatggtccactgtgggtagtttgaaacagtctacgagacttctctctgtatcaaaggaagcaatgagatcagagtaaaaatatcagagaaagattttttaaaatgaattaaggaaggtaaatccaagcagagtttttataacattcacaaaagcatgtagctttgtgttaaatcgtgtttttaaaaaatattctcttcttgcttcgtatctttgagtcagaaagctggatgtgtgtctaaacaaactaggcaatgctaataccaagaatcccggaaaatgtgctaaattcactattctatgtaagtttgctcagatggtggagaaagtgcattaaccagtactgcaaactgaatcttttgtgtgtgtgtgtgtgtgtgtgtgtgtgtgtgagagagagagagagagagagagagagagagacagagagagagaaacagacagagaaagagagagagagaagatatttgaaaaaaatacaagaaataaagaaagaaatattcaaggaaatagatagcatgaatgaaaagcaatctaaacttcaggtagcaatgaacacacttacagaatgcaaaaggctctggaaagtctcagcaatagaattgaacaagtagaagaaagaatctgagctcaaagacaaggtctttgaattaacccaattcaaccaagacaaagaaaaaagaataagaaaatacaaacacagcctccaagaagtctggaattatgttaaatgaccaaacataacaataatcagtgttcctgagaaaaaagatgaatctaaaagtttggaaaacatatttgggggaatcattgaggaaaatttccccatcttttctagaggcctaaacatcctaacacaagaagcacaaagaatacctgggaaattcatcacaaaaagatcatcacctaggcacattgtcatcaagttatctaaagttaagatgaaggaaagagtctaagagctgtgagacaaaagcaccaggtaactgtaaggaaaacctatcagtttaacagcagatttctcagcagaaaccctacaagttagaagcgataggaaccctatcttcagcctcctcaaacacgacaattatcagccaagaattttgtatccagttaaactaagcttcatatatgaaggaaagatatggtgtttttcagaaaaacaaatgctgagagaattggcactaccaagccaccactacaagaactgttaaaaggagctccaaatcttgaaacaaatcctggaaacacatcaaaacagaacctctttacagcataaatctcgcatgacctataaaacaaaaatacaatttaaaaaacataaacaaaaatttaaaaaccaaggtatacagacaacaaatagcacgatgaatggaatggcacctcacatctcagtactaacgttgcctataagtggcctaaatggtccacttaaaaggtacagaactgcagaatggataagaattcaccagccatctactgccttcaaaagactcacctaacacataaggacccatgcaaatttaaggtaaaggggcgaggaggggaagacatttcatgtaaacagacaccaaaagtaagcaggagtagctattcttatatcagacaaaacaaactttaaagcaacaatagttaaaaaagacaaagagggacattatataatggtaaaaggccttgtacaacaggaaaatatcacaatcctaaacatatgtgcacctaacactggagcttccaaatttataaaacaattactaatagacctaagaaatgagatagacagcaacacaataataatgggggacttcaatactcccctgatagcactaggcagttcatcaagataaaaagtcaacaaagaaacaatggatttaaactgtaccttggaacaaacggacttaatgtatatgaaacattccatccaacaaccacagaacatatattctgttaaacagcacatggaactttctctaggatagaccatatgataggccacaaaacaaacctcaataaatttaaaaaaattgaaattataccaagcactctctcagaccacagtggaataaaactgaaaatcaactcaaaaaggaaccttcaaaaccatgcaaacacatggaaattaaataacctgctcccaaatgataattgggtcaaaagtgaaatcaagatgaaaattaaatattattctaactgaatgacaatagtgacacaacctatcaaaacctctcagacacaggagaggtggtgcgaagaggaaagttcacagccctaaatgcctacatcaaaaagtctggaagaacacagacaatctaaggtcacaactcaaacaactagagaaacaagaacaaaccaaacccaaaaccagcagtagaaaagtattaaccaagattaaagcaaaactaaataaaattgaaaccaaaaaaagtacaaaagataaatgaaacaaaaatctgtttctttgaaaagataaataaaatggatagtccattagcaagattaaccaagaaaagaataaataaaatccaatcgagctcaataagaaatgaaacgagaccactgaaattacaactgacaccactgaaatacaaaataccattcaaggctactacgaacacctttatgtgcataaactagaaaacctagaagagatggataaattcctggaaagttacaaccctcctagcttaaatgaggaagaattagataccctgaacatactaataacaagcagcaagatagaaatggtaattgaaaatattaccaacaaaaaaaatccagggccagtttgattcgcagcagaattctaccagatattcaaagaagaattggtaccaattctactgacactattccacaagatagagaaaaaggcaactctccataagttattctgtgaagccagtatcaccctagtacaaaaatcagaaaaggacataatcaaaaaagaaaactatggactgatatctctgatgaacatagatgctaaaatccttaacaaaatactatctaatcaaatccaacaacatatcaaaatgataatctaacatgatcaagtgcgttttataccagggatgcagggatggtttaacatatgcaagttagtaaatgtgatacaccacataaacagaattaaaaacaaaaatcacttgatcatctcaatagatgcagaaaaagcattttacaaaatccagcatctctttatgatgaaagctctcagcaaaattggcatacaagtgacatatctcagaataataaaagccctctatgacaaacccacagccaacataatactgaatggggaaaagattgaagcattccctctgagaattggaacaagacaaggatgcccactctcaccactcctcttcaacatattactagaagtcctagctagagcgcagacaagagaaagaaataaagggcatccaaactggcaaagaggaagtcaaactgtcgctatttgctgatgatatgattgtttacctagaaaaccctaaggactcctccagaaaacccctagaactgataaaaaaaattcagcaaagtttctggatacaagattaatgcacacaaatcagcagctcatcaatacaccaacagtgaccaagctgagaatcaaatcaagaactcaagaaatctccacactgttcaaatcaagaaatcaagagccccttttacaatagctgcaaaaaatacaacaacaacaacaacaacaacaaacttaggaatacacctaacaaaggaagtaaaagtcctctacaaggaaaactacaaaacactgctgaaataaaccatagatgatacaaacaaatggaaacgcattccatgctcatagataagtaaaatcaatattgtgaaaatgaccctactgccaaaagcaatctagaaatccaacacaattcccatccaaatacaaccatcatttttcatggaattagaaaaaaatctaaaattcacaaggaaccaaaaaagagctctcatagccaaagcatggctaagcaaaaagaacaaatctggaggcatcacattacctgatttcaaactatactgtaaggccatgatcaccgaaacagcatggtactggtataaaactaggcacatagaccaatggaacagaatggagaacctagaaataaagccaaatacttacagccaactgatcttcaacagagcaaacaaaaacataaaatggggaaaggatacccttttcaacaaatggtgctgggataattggctagccacatgtaggagaatgaaactcgatcctcatctctcaccttatacaaaaatcaactcaggatgggttaaggacttaaatctaagacctgaaactataaaaattatagaagataacattggaaaaatccttctagacgttgacttaggcaaggatttcatgaccaagaatcccaaagcaaatgcagtaaaaacaaagataaattgctgggacttaattaaactaaagagcttttgcacagcaaaagaaacagtcagcagtgcaaacagacaacccacagagtgagaaaaaattttcacaatctgtacatctgacagacgactaatatccagaatctacagtgaactcaaacaaatccataagaataaaaaaacaaacaatctcatcaagaagtgggctaaggacatgaatggaaaattctcaaaagaagatatacaaatggccagaaaacatattaaaaaatgctcaacatcactagtgatcagggaaatgcgaatcaaaacaacaatgcgataccacctcactcctgcaagaatggccataatcaaaaaatagtagatgttggcatggatgtggtgatgtgggaacacttgtacactgctggtaggaatgtaaactatacaaccactatggaaaacaatgtggagattccttaaagaactaaaagtagaaccaccatttgatccagcaatccccctactgggtatctacccagaggaaaagaagtcattatatgaaaaagatacttgcatatggatgtttatagcagcacaattcgcaattgcaaaacctgacaccagcccaaatgcccatcgatcaaccagtggataaagaaactgtgagacatataaatacacacacacacacacacacacacacacacacacacacaatggaatactactcagccataaaaaggactgaattaatggcattcacagcaacctgcaagagattggagactattattctaagtgaagtaactcaggaacagaaaaccaaacactgtatgttctcactgatatgtgggagctaagctaagaggatgcaaatgcacaagaaggacacaatggactttggggactcagggggaaaggtggaagggggtgagggataaaagactacaaacatggtgtagtgtatactgcccgggtgatggatgcaccaaagtctcacaaatcaccactaaagaacttactcatgtaaccaaacactacctgtcccccaacaacctatagaaaaagaatttttttagttaaattaaattaaacagaaaaaatttaaaaaataaaaacagaagccacaggccaagtgcagtggttcacgcctgtaatcccagtactttgggaggccaaggcaggtgtatcacttgaggtcagaagttcaaaaccagcctggccaacatgacgaaactcccatctccaccaaaaatacaaaaattagctgggcgtggttgtgcatacctgtaatcccagctacttgggaggctgaggtacgagaattgcttgaacctggtgggggcagaggttacagtaagccgagttcacgtcactgcactccagcctgggtgacagagtgagagtctgtctcaatgaataaataaataaataagccacagagagacacacaggaagaaaggccatgtgaagatatagaaagattgaaattctgcatctatgagcaaagaaacattaaaattactggcagacaccaaaagtacataagagatgtagaataaattctccctcagagcctccacaaggaagcaacacttccaacaccttgattttggacttctgcactccagaaatgttagataatacatatctcctagtttacatcacttaatttgtgctaatttattatggcagccttgggaaactaatacagactcatgatgcctccatggcagccatccaaatgtttgctctgttggcttgcatgtgtgagttcttaagagaatcctagagagtttctctactgcatttcccaggtctggaaggtcacccttaaacttaactttcccttcctcttcattcctgtaacttggagtatatccaaagctcatgcggatgtcatcctcttgtcttgaggtaaattttaatatatggtgtgcagttctggcaagaaagtttagtcctttggtggcatcccactgatctttgagaaactcagaaattctcaaagtgccagatgtaaaaaacaggttgctctattcccttcacttctgtagctgtctccagttttcttgctctgctctaggagatctactgtctaacagacaactaactaggaggatggtatgccaggctttcttcttgtcagaaatccatttctaaaagtgtcatatgttttccaattttttgagaagcagctcccctgtccctttggggatgggagttaataatttttctctaagagcttatagtttctacaagaacaacaacctgatatctttatctccttaattccatactgactcaccttctttcctggattgggaaggaaagtggcattgtagctggtggtagagttaatgctggttctccaatcccataaattcaggagtaagtgtgggggaatgcaatgcttgccttaactgttaaccagctttctttaaaacgttaggtagttaatgcctcattgtcctcaaatttgggccagggttactgattcttgggcactggattacatttcccttaaccactagctatacatgcttaacacaaaatccctccactagcatcagatgagtttgtgggtttggaactttagagtgaaaaagcacttagcaagatttgatttcactatatatttgacattcaactcaactgttcaacttacctttttgtgaggtgagggaatttgactaaaatcagcaattgcttacccaaacgatttcaggagctagaaggaaaagtaaatgcaggaagtaattattttgaatggggactgtgaccagtttgagagtggtaataccaacctgagtcgttgaattttaggccttcttgaagcgagtttctaagctctgagagatgttttaatgtccattccacatttaaatgtccatatatccactctttatgggcaggtagataacatatgagggcatttttcccttgtcataatgtttgggagtgggtgctactagccattttagtaagtagggatcagaaatgtgatatatgcaattgtcctttgtctcccatgattttcaaatgatacataaggtattaacgcagaaactgttcatattaacttgagcataatccaaattctgctttatatagagcttagatagacagacagaagagtaaagtattttgcatattttccagaaatacaattgctatttatattgagtaactattgcactttattttgtttattgttttccatcattatctagattcagccaccctttcagaaaatcatttcagcgatagcaagttgctgatagaatttgagtccataacacttcacacttaagtcaggcagcatttgtagtttttaactcatgtgattatacagatagaggtcagcatctgactatttcatacaatcttctcatgtagtcatgcctgaatatacataatgaacttcagatttcttcttaatgaactgctttcttgttatttatacttaaatttcagataaggcattatatagactttttcaaaaagctatttgtgggaagatctttatatccatggtcttcatttcaggtggtaaagcatttattacaaagtactttttataaaaatggaaaattgttttgatagcactgctctatatccactgtcagaggtctacaaaatctcagaggtcatcaatattctaatgtatatatatacacacatatatcagtcttcacctatcccttggccatattctttaacatgttatggttctcaggctataatattctcttagtcaccaggggcctaaagtaatctggttttacttgtagcatagtaaaaacttcaacctgagactgactgccagaggacctattcatttgatggtttcctgagtaggtacagttttcaagtctagatttaatatgaaagaagtatagccccctaaatattgtgtatggttatttgtagatatattcaaaattattgttttgccatgattaaaatatttatgagactgaggagattttaaaatttaaactaataaattggatcaactcactgttaactggtaaagcattttcatcattataaagagaatgcatcatctaattttcaaatgttttatctttctaattgaatttctaattagcacatgctagtaaaatgaaaatattaatgagatcctcataggtgcttaatatagtgatatcaagtactatcatacatatgtgtgtatatatacatatatatgcatgtgcataagttctgaagaaaatttttattatgcaagataattaagtgtcatttgacataaaaattttgcaaagaggtaaaaagtggcataaaattaaagaaagttaattatctgatctttctcctttcggcaatttactttcttttgtccacagatcaatcatcctaatgctcatttctttaattccctttaattacaactgagaagtaagcaagtgagatagtaatttctactgaaatttccatgcttaatctgcaaatgtagtgagcactgatatagtcaaggaacagtgtggctgttgtgagaaatagaaaatggaggacaggaattatactcagtttcccccattattcagcaataatagaaaaagttaatttacattttcttctttaaaatgtacattttaaaatttcaatacatttattgaattgagcaacaaaagtaatgtgtagggtaggcatttctgtaactttttctccctattttgtattttcatttttctgtattttttctgtaaagttttgtatatatataaactaaactaaactaaacttggaggttgaaataaaacccagattgacactgtatatagacagcagtacaatccagaaggaatctctttatatggtcagtgagaaacatttctatttttaacactactaaggggctccactaatgaagtttgtctggcagaggatgtgacctcagtattttataacacagaaatttctcctcaaggtagaaagctggctcgaagaaacctgtgactgtcatgtccctgaggggtgctttagagttcatagcttcaggatatctgtgaagttctgaaattgcaggcaataatttaagcattagtccccatgtttgtgtgtgtgtgcatgtgtgtgcacacctgcatgatactttggggggaagtggcccatttggtatgatccagttctaaaatatgattatccatgaccccctcaaagcttaagatcccctgaaatttcagctttctgcttttttgcaggcaaagatctaatttctcctctcttttaagtgaattatcctgccctttaacaaatagtggcgatacgttattttggtctttacaatccaggaacactattggttttgacaggctttgctcaaataaagactagtttcacttcatttccaaggcattcaactctacccaagtgacatttgtgaaagccatatatttcatttgtgcattccaatgatttaatttagtaagctcaataagcttatctctagtcaaagataacatggcatttatgactgtagagtgcgtgattgaatgggattcttcctgcttcagtttcaacttagactccattttgttgttatcagacaccaaagatcccgtgagaaaaattgacatatggagattttaaaagacactggttgaaactcttaattccggaactctttcacgtacttaggaaatacgcaagagagtcatggtctcaagagaaggttttaagaaaggggttattaaaactattgctttggagagtgcacttcacatgcaggctgttccatcctcttttgggggagaggcattaggcaggggtttactttccagtcccaatattgaagagggtgggcttctaggcatccaattgaagatctttgaaatagtcaaaaaaccttgaggataagtgcctgatcccaacaaaggaagctaaagcagttagtgttctgaggtcttttcttcccaggaggtccaggagaagagagagggtctgactaacagtgctggtggctgagccgggagatgctgctatgttgagattggttcactttctcctagcttgtcaggacaccggatgtgtgtcctgattgtttctggtgaattggatgtgggctatgtggtacaggatcctcttgggcctgtccatttgggatctcaggagggataagggctgcaagtgtattgcgggatgcccttggacaagggaagggtcagaagaatccacatatagacactgatacgcccaagacaagggaatttcagacaagaggaggagcagggaactattcccaggctcctataatcaaaatcatgagacagagagagtagattttaatcatctgccaagtttatgaagaataccagcttcactgatctactctgtccagatagcacaaagccacccaaagtaaatgtggcacagagccaaacagcagcttgcaagtgcaggaagaaagggaactgcagagagtagatagtagaggcaccagataccaccttagcccattttcctcaagcatctaattggggaaaaaagagatttaaggctacatcaagattggaatattttgagtatctatcttgtaatggacattctaattactggactgaaaggcatttgcaaactaaagtgatcatattgtgatatattccctaagaatgtgcaaaaaaaaaaaaaaaaaaaaaaaaccttgggacctacctgagcttctattcagggatggggaagatggcctgtatgtcttttcctaacctaccatcccctaagtgggagagaaaaaaaaaaaggttgtactttattcatatctgaagaccagtctgattatcatatgagttacactgcttaacagaatccaagcagtaaatactatgattgataattgtggtgattaatactgaatgtcaacttgattggattagaggatgcaaagtattatgcctgggtgtgtctggagggtgttgccaatggagattaacatttgagtcagttgactgggaaaggtaaacccatacttaatcttggtgagcacaatctaatcagctgccagcatggccagaataaaaagcaggcagaataacatgaagactagactggcttagcctctccgcctacctctttctccagtgctggatgttccatgccctcaaacattggactccaagctcttcagctttgggacttcaactggcttccttgctcctcggcttacagatggcctattgtgggaccctgtgatcgtgtgagttaatatgccttaataaactcacctttatacatacatcaatcctattagttctgtccctctagagaactgtgactaatacagattttggtaccaggagtggttctagaggaaaagaatattaaaaatggagttcttttgttggttttcaggtttctggagttggcttcttaaagtgattagccataaaaatgctaaggactctaattctaatagtatggagaacagacagtccttggtgtgaacaatttagagagttattatgcaaaataaatgcatttgatactcttgattcaccgctcatgaaaggcaaggagtttagtgactcaatacctaatacctttgaccatatgtggagaaccaaggaacataatgaagttggttggttgctcctaagttcactggacagagtgatgaaaaaaaacgaactcagggattctaactaactcctggcttcagaagcagatactgagcctcaaatctgctaagattgccctgagtgagtcttatctcctgcagagaaagagctgaaattgtggaaaatcagacacaggctattaccatgtgagtggttgacctgcaacaaaaggtgcacgcacagcctcgccaggtgtctactattaaagtgagagcattgattggaaaacaatgggaccttgcaacttggaatggggatatgtgagaggactttgatgaagctggggacattgagcttgtaaactctgatgaaccttttctgccagaaggaacagcttccccatccccagtagtggtaacatcccctccccaacccatgctgctattagcctttccatctttgtctgaggagatgaaccctgctctgcctgaggcaagagtgatggcctcccctgaggcagttgctaggcaagataatgttgattctcctcaggagcccccctccccccaacacccctgcttgcttctagacttataactaaagttttggcaggcccctagaggtgaagttcagagtgtgacccacaaggaggtgcactacactcgaaaagaactccttgagttttccaatctatataaatagaaatctggagaacagatatgggaatgaatattaaggatatgagaaatggtagaaggaacatacagttggatcgggctgaatttattgatttgggcccattaagtagggactctgcaattaatgttgcagctcagggagttaataaaggttctaatggttaatttgcttcattagctgaaatatggattaaaagatggctcactgtgagagaactggaaatgcctgatttcctcccttggtttaatgtagagaaagggattcaaaggcttagggagattgggatgctggagtggattagtcactttaggcctactcatcccagctgggaaagtccagaagatgtaccttttaccaatgctttggaaaacagatttgtgaaggcagcacctgcgtctttgaagagttctgtatctgttgcttttctccggataccatatctaacagtgggaaccatagtcactcaacaacaaaatttaaatgcaatggggataattggaacccaaggtggcaggagccaagtggtggcactcatccatcaaaggcacagtgggcatagctaccatcatggacaacagaggcaaagcagcaatcgggatagattgatttgtgtagagctctggcattggctagttaatcacagtgatcctagaagtgaaattgataggaaacttactgcattcctacttaatttaaataagcagaaaacttccaggccgaatggacaaaagactaatttgaattataaaaacagagcatcatggcccctcaattaattttcagactagagccagtttacagaaccctttgcatgaaggggaggccaggtccccttgaggaaggaccccactacactaccaacaatttatgctgttaatctttctcccatccttccccaaagggacctttggcctttcaccagggtaactgtgcatgggggaaaggaaatattcagacatttcagggattattggacactggctctgagcagacattgattccaggggacccaaaacatcactgtggtcctccagttaaggtagggggttacggaggtcaggtgattaatggagttctagctcaggttgaacttacagtgggcccagtgggttctgggactcatcctgtggttatttcccctgtgccagaatgcaaacttgacatagacatacttagcagctggcagaacccccacattagctccctgacttgtagggtgagggctattatggtgggaaaggccaaatggaagccattagagctgcctctacctagaaaaatagtaaatcaaaaacaatatcgcatccttggagggattgtggagattagtgacaccatcaaggacttgaaagacacaggggtggtgaaccccaccacatccccattcaactctcctatttttcctgtgctgaagacatggatcttggagaatgacagtgtattattgtaagcttaaccaagtggtgactccagttgcagctgctgtaccagatgtggtttcattgcttaagcaaattaacacatttcttggtacctgatatgcagccctttatttgtcaaatgcctttttctccattcctgtctgtaaggctcaccagaagcagtttgccttcagctggcaaggccagcaatatagctttgctgtcctgcctcaggggtatatcaactctttggctttgtgtcatagtcttgttcagagagaccttgatctatttgcccttccacaagatatcacactggtccattacattgaggactaaactctgatttttttttaacttgcccaaattcctatctaagctatctggtgagtcatgccctacaaatcatacattctcatcagatgggttttatttaaccctatatatcgtaactttccaacctgactctggcataacattactagacaaagaagaaaatcaaaatattttacccccaaaacacatttctttgatatattttgaagtagccctggaaagctgttctttgttgggggaaatttgcatatgtaaagaatctctattaacatagctagatttttttcttccagactctctcaatcctaaagaaattaactaaaatctgaataggaaacatttgtcatctgttgtctcgaagggcagccagtataaggcttcaaaataaccttagtctccacaatcttttatcttaacctgaacattccctttctatcaatcccaggtctttagacacaaacaaccaattgtccagcagaaaatatttaaattcacctatagcctggaagcccccactttgatttgtcttgcctttctggaccaaaccaatgtatttcttaaatgtgtttgattgatgtctcatgcctctgttaaatgtatgaaaccaagctgtgccccgaccaccttggtaacatgttctcaggacctcctgagtgctgtatcatgagccatggccactcgtatttggctcagaataaatctcttcaaatattttacagagttcaactcttttcattgacaacattatgacattatgctgattggatccagtgagtcataagtagcaaacacactgggctcatgctcatagaattcatcttaccatgttccccatcatcctgaagaagctggattgatagaactgtggaatggccttttgaagtcacaatgataatgccagctaggtaacaatactttgcagagctggggcaaagttctccagaatgtcgtgtatgctctgaagcagtgtccaacacatggtgctgtttctcccatagccaggattcacaggtccagaaatcaaggggtggaagtggaagtggcaccactcaccatcacccctagtgacccactagcaaaatttttgcttcctgttcctgtgacattatgttctgctggcctagaggtcttagttccagagggaggaatgctgccacctggagacacaataacgatttcattaaactgggagttaagattgccacctggacactttgggctcctcctaccttaaagtcaacaggctaagagggggtaactgtgttgactggggtgattgacctggactatcaagatgaaatcagtatactactccacaatggaggtaagtaagagtatgcatagaatacaggagatccattagggcgtctcttagaatcaccatgccctgtgattaaggtcaatgggaagctacaacagcccagtccaagcaggactacaaaatggcccagatctgtcaaaaatgaagatttcggtcactccatcaggaaaaaaaccccatgacctactgaggtgcttgctgaaggcagagggaatacagaatgggtagtagaagaagatagtcactaataccagctacgaacacatgaccagttgcagaaatgaggactgtaattgtcatgagtatttccttattcttttgttaaaaacatgtttgtgcatgtatacacttgtactagaaaatttcttcattttatttccttttttcctttatcatgtgacataagatttattgacttcatatcagcgtttaagtgttgttaattttgtgtaatagcatttgggttgtggattggtgcatttctggttgtattttgttaggtgtaattatgaccttattattgtctttatttgaagattacatatgatttcaggaaatgtgtatgaattcaagttgacaaggggtgaacttgtgatggttaatactgagtgtcaacttgattggactgaaggatgcatagtattgttcctgggtgtgtctgtaagggtattgacaaaggagattaacatttgagtcagtggactgggaaaggcagactcacccttaatctgggtgggcacaatctaatcatcggccaacacagctagaataaaagcagacagaagatcatgaaaagactacactggcctagcctcccagcctacatctttctctggtgctggatgcttcttgccctcaaacatcggactccaagttcttcagctttgggacttggactggcttccttgctcttcagcttggagatggcttactgtgggaccttgtgatcgtgggaattaatactctttaataaactcccctttatatatacatcaattctattaattgttctgttaatagttctgtccctctagagaaccctaatacaataattcttttttttgtttgtttctttttttaattttttattttattatactttaagttttagggtacatgtgcacaacatgcaggtttgttacacatgtatacatgtgccatgttggtgtgctgcacccattaacccgtcatttaacattaggtatccctaatgctatccctcccccctccccccacccacaacaggccccggtgtgtgatgttccccttcctgtgtccatgtgttctcattgttaaattcccacctatgagtgagaacatgtggtgttttgttttttgtccttgcaatagtttgctgagaatgatggtttccagcttcatctgtgtccctacaaaggacgtgaactcatcattttttatggctgcatagtattccatggtgcatatgtgccacattttcttaatccagtctatcattgttggacttttggcttggttccaagtctttgctattgtgaatagtgccgcaataaacatatgtgtgcatgtgcctttatagcagcatgatttatatatacccagtggtgggatggctgggtcaaatggtatttctagttctagatccctgaggaatcaccacactgacttccacagtggttgaactagtttacagtcctaccaacagtgtaaaagtgttcctatttctccacatcctgttgtttcctgactttttaatgattgccattctaactggtgtgaaatggtatctcactgtggttttgatttgcatttctctgatggccagtgatgatgagcattttttcatgtgtctgttggctgcataaatgtcttcttttgagaagtgtctgttcatatccttcgcccacttgttgatggggttgtttgtttttttcttgtaaatttattgcagtttattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccctgcccatgcctatgtcctgaatggtattgcctaggttttcttctagggtttttatggttttacgtctaacatttaagtcttgaatccatctcgaattaatctttttttaaatgaaatattccttttttttctcagtgccatagataatagatgggtggactgtaacagtacctagttttcagctgaagcattttaatctccatcatttccactattaaaagaactaaatcatgcctgcttaatacgtcgtgtgtgttcgatactatttaggttatataatagtatagctcatttgaaacttagtgattctcagaaaaatctgagtattgcttatgttactaagagtttgtcatctggggtcaatacttatcatgccatattgctgtgtcccctatctcccattggagatgagaaaactctgacttttagtgtcagactgtctggaaatcacaatgtgaaattatcttctaaactaattcagctaaatcacatttaatatcagattttagtgactttctcatgactgtttatcaactcccaaatgactctttaattaattgtttctcctttactggctcattttctgtcagatccctttccttagagtgttgttttatccctgtgtggcagaaagactgtctgagattgtgctgttattaaatgtagtctggcataatttaagcacattaccttgatgatggtgatgtcactcaggtacttggcctacaaggagctagtacaatttcacttatttcattttaatggatccccttggttttgagcctataaactaaaataccattgcagtaccctccctccagcaatctcaaacttaattattccactccaggaagctgtctgatggccctgcagagacctgtttttgcactaaaacgcaatcccttattgtgtgacaaaattacttttgtttcatgttcttttctttatttatttacaaacagcatggaaaagcacttctcagcacaacttaataggtgattaccacaaatttgattttgagatttagattgaatagttgttaaagttttctttgtattctttcctttgtaatcatgatgacttcttaaatactattccaagtactgggcattgtgggtaatgtggcataaattgccaagatagctgactcaaatcttttcccctacttagttttgatattatttattaagtttcatagcttggatgacacctcttataagcccatctctaccaatatcttttttgctgctttgagcaaatttagttttctaagctaaaatttctaagtggttttgcagaaagcagaaaagacagagacacattgcagaaaaaggtgtggaaagattagagattcatagatgttgccatttgcagtacaaagttatctatgacaatggtcagtaatatatttcataaatgatcaaaagttttcacttacaatttcaacattttcacaattgtataataaccaagaaatacttagttttgttcatagtcaaaaagaaggttgaattgagagccagaaactctgtagtattttgcaagggacatatttgtctctagtcatcactttggtctatggggactaataggaaacgaacttcgtgcttctgtcacattttttgaagacaaagggacagcccatggatgtgctgtattttctattaataacatgttctttctcttcctagtttcctaggctttgaaaaaaatggtgaagagagagagaaaagagtaagagggactggcatacttacactttatgtgtgcatgcagtttttaattttgtgcttttcaaccctctctcatcagtgcaagaaattaaatgcatgagaattaatatgctcaagtcaataggtgaagcaataagctataacggaagagaaagggcttccatcatgcacaagctttatagacatttaattccctatgtggacaggaggtttacttatctgcacaagagcttcacacaaaacaagaattagattctcttcattttgagtttgcaatcctacttcatacaacaactgtggaattgagaaagaaaaataaatgcagagatagacaatatttggaaaaggagtcagaatgaaactgaattacacttgtttattttgagtttgggagaatgtggagaaaaacagattgaattaacacacacagaaaccacaaacacttttttcaaaaactcattttagtttatcttccctgaacaaactgagcaatatttagtgaagctctgtcttagtccctgtgaccacttttaaattacaggatggtcagaggaggattggtgagcacctggaagattgacaagtcacttccggcagagcaggcagatgtgagtttcacttaatcttttgtctcaaaaatgaaaggttccccataaaatgagttactatattttgcaggcacattgacagagatacagattttcatagaagttatttggtaagtcttagagataaacaaacactaatattaagaactcataaaaaatgtgaatttaaatattcttcctaagatctattatcaaagattttaagactgaaggctaatatatcataacataaaacctatatactgttaccacacaactgaggctcatagtttcttattcaaagagagctaataggttaaaatgggacaatagtcctgaattaattttgaaaatgtttagaatgttatcaataaacctgcagcattgatttttattttgatcacaatacatttctttttttgctacccttacaaagatagtatttttcatgttcaacaaaacaaatattacatattttttaaaagtgtctttgggctgggcacggtggctcacgcctgtaatcctttgggaggccgcggcaggcagatcatgaggtcaggagttcgagaccagcctgaccaacatggtaaaaccctgtctctactaaaaatacaaacattagccaggcgtggtggcatgtgcctgtaatcctagttacttaggaggctgaggcaggagaatcgcttgaacctgggagatggagattgcagtgagccaagatcgggccactgcactccagcctgggcaacagagcgagacgctgtctcaaaaaaaaaattaaaaaaaaaataaagtgtctttctattgtgaggtagatttatccaacaaatactaattaatggtactttgtgttgtatggttaggtttgttttaatctatcaaataaaagaattttaggcagggtgcatacagattttgtagttcctaaagcttataaaaatgtggaagctttctaaaaggaataaaatactaaattacaaacatacaactactggggctactcctaggaccttggcatgggtgtgatttagtgagggccttgaagtttaagcttctaaattagcttcatagttaatccttccctgttctcatgtaaccctataaagagcataattcttttatcctttgaatcgaaagcaaatggcctcaaccttaaaaaacaaagagaaaataatatactgtcctttgcttttcaataccaggctgaacatgatgtttctaaatgttctagcatcaaatgtgatcaacatgccttcccctgtctccttcgtggtatttttataaagacacagtgtttgaaggacattaatctaaatgacgggtcacaggaaatgaatgtgataacaacaggaagtgtattatggagatatggttcaatacaagcaagaccgagtttcattctgtctcccaggctggagtgcagtggtgcaatcttggctcactgcaatctctgcctcctagattcaagagattctcctgtctcagcctcccaactagctaggactacaggtgcgtgccaccatgcccagctaagtttttgtattttttttagtagagatagggtttcaccatgttggccagggtagtgtagaactccagacctcaagtgatccaccgacctcagcctcccgcagtcctgggattacaggtgcgagtcatggtgcctgtgtatttcctttttaactttaacagattttatttgaatagataacatgtttacatatttctgtgatggcctggtttgcctgtctggtttacaaataccaataaaagaggatacaaacaaatggaagaacattccatgctcatagataggaagaatcaatattgtgaaaatggccatactgcccaaggtaatttacagattcaatgccatccccatcaagctaccaatgactttcttcacagaattggaaaaaactactttaaagttcatatggaaccaaaaaaaagcccgcattcccaagtcaatcctaagccaaaagaacaaagctggggcatcacgctacctgacttcaaatatattacaaggctacagtaaccaaaacagcatggtactggtaccaaaacagagatatagatcaatggaacagaacagagccctcagaagtaatgtcacacatctacaaccatctgatcttttacaaacctgacaaaaacaagaaatagggaaaggattccctatttaacaaatcgtgctgggaaaactggctagccatatgtagaaagctgaaactggatcccttccttacaccttatacaaaaattaattcaagatggattaaacacttaaatgttagacataaaaccataaaaaccctagaagaaaacctaggtaataccattcaggacataggcatgggcaaggacttcatgtctaaaacaccaaaagcaatggcaacaaaagccaaaattgacaaatggcatctaattaaactaaagagcttctgcacagcaaaagaaactaccaccagagtgaacagtcaacctacagaatgggagaaaatttttcaatctactcatctgacaaagggctaatatccagaatctacaaaaactcaaacacatttacaagaaaaaaacaaacaaccccatcaacaagtgggcgaaggatatgaacagacacttctcaaaagaagacatttatgcagccaacagacacatgaaaaaatgctcatcatcactggccatcagagaaatgcaaatcaaaatgacaatgagataccatctcacaccagttagaatggcgattattacactgttgctgggactgtaaactagttcaaccattctggaagtcagtgtggtgattccttagggatctagaactagaaataccatttgacccagccatccattactgggtatatacccaaaggattataagtaatactgctataaagacacatgcacaagtatgtttattgtggcactattcacaatagcaaagacttggaaccaacctgaatgtccatcaatgatagattggattaagaatatgtgaaaaaaaaaaaaaagaatatgtggcacatatacaccatggaatactatgcagccataaaaaaggatgagttcatgtcctttgcagggacatagatgaagctggaaatcatcattctcagcaaactatcgcaaggacaaaaaaaccaaacaccgcatgttctcactcataggtgggaattgaacaatgagaacacatggacacaggaaggggaacatcacac

SEQ ID NO: 2636 - DNA, 16311 bp, Homo sapiens
ataaaggaaagaaaaataaataagaactgatggatagatagattagaaagaaagctagattgataggtgtgtgtgtgtgcgtgtgtgtttgtgttagtatatacccactctgtataccgtttgccttcagcaagcacctcagtgggttgtgttttttattcgtggtggagcgacccaaacattcattcctgaagggtctaggtcatttgtagtcctgcctggatttggctgttgtagtttcccattgacctgaatcacagggcatggtaatactaaaagatgccctaaaggatttcctgtattctacacatactcttccttacttccattgcggagtagtagactgatttcattttgatagtctgggtcagtcactccaaccaacactgtaactcctttcttagcctgttgacttagaggtaggaggagcccaaagtaactaggtgacaagcttaacttcaagttcaatggaatcattgtgtctcctgatggcagcattcccccttctggtactaagatgtctaggctagcagaacataatgtggtgggaacaggaagcaaaaattttgttaatgggtcattaggggtgatggtgagtggtgccacttccacttccaccccttcattaatgtacccatgaatcctgactatgggagaaacagtaccatatattggacacagattcaggacatacacagccttctggagaactttgccacagcactgcaaagtattgtcatctagttagcattgtaattgtgatttcaaaaggccattccattgttctatcattccagctgcttcaggatgatggagaacacagaaagaccagtgaattccgtgagcatgagtgcactgtcacacttctttagctgtagactgagtgcctttgtcagaggcaatgatcactgtgagcattggtgccatatcaaaggctcagtgttggtctctgctgccagtaaagagggcactcagtggtggctgtagccagatcaaccttggtgagtggaagtccatgtagctgagcccatgggtaaactccatccctgccaccatggccactttgttcatgagcctattgggcaatgacaggggtggctggggagagagacagagtgctgtccatagaacaagtcatcctatccgtttgattattaaaatcctcctctgctgaggtcacactttggtgagcattcacatgagataccaatatcttcacagtttttgaccactcaggtccatccacatacctcttccccaaatttctttgtcaccaattttccaattatgcttcttccaagtccctgactatccagccaatcattgtctatagcccatgaatcagtatatgatcgcacaactggccatttctccttccgagcaaagtgaacaaccaggtgcactgctcaaagttctgtccactgggaagattttcctttgccactgtccttcagggatggcctagaaaggggctatagtgctgcagctgtccacttttgggtggtgcctgcatatcatgcagaaccatctgtgaatcaggccctagtcttctcttcttctgtcaactgatcacagggaactacccatgtgaccgtcggtgcaggctgggggagggcaggcagattggcaggagcggagaacctaggcatttgagccacttcgtcatgtaacttacttgtgccttccagaactgctcgagcttgatcacatatataccgcttccatctgatgatggaatgctgctgtgcatgcccaattttatgaacaaatggcttagaaagcacccaatttatgatagtcagctcaggtcatatggtgacttgatgaccaatagtcaaacgttgtgtttctactgtagcccagcaacaagccaagagctgtctctcaaagggagagtagttatctgcaaaggatggcaaggctttgctccaaaactggagaggccaccactgttattcacctatgggggcgtggcaaaggctccaaacagcatctctatctgcaactgacacctcaaccaccattggatccgctgatcatatggcccaagtggcagagcagcttgcacagcagcctggaccccttctggagccttctcctgttctggaccccactcaaaactggcagcctttttggtcactcgataaatgggccagagtaacacacccaaatgggaaatgtgttgcctccaaaatccaaataggcacactaggccttgtgcctctttcttggttgtaggaggggccaaatgcagcaacttatttttcacctcagaaggaattatctcgacaggccccacaccattagacccctaagaatttcattgaggtcgaagatccctgaattttagtcagatttatttctatcctctggcactcatatgtctcaccaataagtccagcgtgtttgggacttcttgctcactggattcaatcagcataatgtcaccaatgtaatggaccagtgtgatatcttgtggaagggaaaagtgattcagatctttgcaaagaatattataacacaaagccagagatttgatatgcccctgaggtaggacagtaaaggtattgctggccttgtcagctgaaggcaaattgcctctgctgggccttatggacaggaatggagaaaaagacatttaccaaatcaatggctgtataccagttaccaagagatgtgttaatttgctccagcaatgaaaccacatctggtacagcagctgcaattagagttaccacttggttaagcttatgatgatctactgtcattctccaagatccatctgtcttctgcaaaggccgaataggagaggtgaacaaagatgtggtgggaatcaccaccactgcatttttcaagcccttgatggtggcactaatctctgcaatccctttagggatgcgatattattttgtatttactatatttctaggtagaggcagctctaatggcttccatttggcctttctcaccataatagccctcatgccaccagtcagggagccaatgtgaggattctgccagctgctaagtatgtgtatgccaattatgtgttctggcattaaggaaatgactacaggatgagtctggggacttactggacccattgtaagctggacctgaactaaaagtccattaattacctgacctccataagcccctactttaactggaggaccacaatgacgttttgagtcccctggaatcaatgtcagctcagagccagtatccactagtccctgaaaagtctgatcattcccctttccccagtgcacagttactctggtaaaatgctggaggtctccttggggaaggatagaagtattaacagcataaattgttggtagtgaagtggggtccttcctcaaggggacccagtctccccttgattcaaggagttctgggtctgtaaactgattcaagtctaaaaattgattgaggggctgtaattctctatttttataattcaaattactcttttgtacagtcaaactcgaagttttctgcttattcaaattaagtaagaatgcagtaggtttcctgtcaatttcacttccaggaacatcatgattaattagccaacgccagagctctacacgagtcagactattctgattgcttctttgcctctgctgtccattatggtaactgtgcccaccttgcctttgacggttgagtgctgccacttggtccctgctgcctcagaatccaattattctcattgcatttaaattttctaattgagttactgtggttcccattgttagatctggcatgcagagaagagcaatcacagcagagctcttcaaggatccagatgctcacctcataaatatatttcacaaagtattagtgaaggttatgtcttctggatgccccccaccggaacgaataggtctgaagtgactaatccacttcagcatcccaatctccctaagcctttggatccatcccttcccctacattaaaccacaggagatcaggcattttcagctcgctcacatggaccatcttttgatccatatttcagctaaccaagcaaataaactattagaaccttttttaaatccctgagctgcaacattaaatgcaggatccctgcttagtgggcccatatcaatacattcagcctgatccaacttttgttccttccaccattatcccacacctttaatatccattcccatgcctgttctccagatttctgctcatataaatgagaaaattcaagcaattcttttggagtgtagtgtacctccttgtgggtcacactctgtgtttcacctctaggggcctgctgggactttagttataggtcaagaagcaaacaagggtgttggggggcagatcctgaggaggatcagcattgccttgcttggcaactgcctcaggggaggccatcatgttgcttcaggcagtgcatggttaatctcctcagacaaaggtgcaaaggctgatggcagcctggacgggggaagggatgttgccaccactgggtgtgacgaggctgtttcctctggcaaataaggcttatcagaatttaggagctcagtgcccacagccttatcagggtcctcccatacatctccattccaagttgcagggtcccattcttttctaatcaatgccctcactttaacagtagacacctcctgaggctgatcatgcaccttttgttgcaggtcagccactctcatgataagagcttgtgtttgattttctgtaattttttccctttatctacaggagataagactctcgctcagggtaaccttagaaagaattgaggctcagtaggtgcttctggagctgggagttattatccctgagctcatccttttctttcttcactttgtccagcaaacctaggtgcaaccaactaacttcattatattccttggttctccacatagggccaaaggtattgtgtatagagccactaaacttcttgcctctcaccagcggtgaatcaggagtatcaaatgcatttattttacataacactctaaacagttcatgccaaagactatcagtgttctccatactattagaagtagagttcttagcattttggggtctaatcacgttaagtggccaactccagaaaacccaaaaccaactaaagaaatccatccttaaaattctcttcctttagaatgactcccagtaccaaaatctgtattaatcagggttctctaaagggacagataaagtaatagatgtatatatgaaggggagtttattaaggagtattgcctcacaggatcacaaggtaaagtcccacaataggccatctgcaaggtgaggaacaaaaaagacagtacatgtcccaaaacctcaaaagtagggaagctgacagtgcgggcttcagtctgtggccgatggcccaagagcccctggccaatcactggtgtaagtccaagagtccaaaagctgaagaacttagagtttaatgttggagggcaggaagtatccagcacgagagaaatatggaggctggaagactgtgcaagacaagtccttccacattcttttgcctgctttattctagccatgctggcagcagattattatgagatagtgacaacccagattgagggtggatctgcctctcccagtccactgactcaattgttaatctcctttggtaacaccctcccagacatacctaggaacaatgttttgcttccttcaatctaatcaagctgacattcaatattaactgtcactagggaaaactgggtgtgaagtatatgagaattttctgcactatcttcacaattattgtgtacattttataactcttctaaaatatgcaaaaacattatttaaaaatgtatgacaactcattctattagtgaggctgtgaggaaatatgcactcatacgtacagattcacattctggtgggaatacaaattgctataactcttatgaaggggaattggacgatatctaacaaaaatatacatgggtttatcattcaagccatcagttcgtcttctaggaatttactcagaaaatatactttcaacagtacaaaaatacacaaggttatttgaggcagcaatgttttgaaatacataatgctgaaaacatcctaaatgacctcacttaagacaatggttgaatacattatggcgcatccacataatgggttgttatgcaacagcaaaaaagaatgaagaagaatagataaactgctatggagtaacattcaggatatattattaaatgaaaaacttaagtgccaagagtatctatgttatgctacttttgtgtaataattacatgaaagtaacagaacattgtgcacagatatctgctcatttttagaaaaaaataggaaagataagttagaaactaaaaggattagttacttatgaggggcgaataaagataaaagaaagaatggtagataggaatgagttagaagggattgggtgcaagttagacttttctaagtatatctttctgaatagttttaatttttgcaaccaggctcatgttttacatactaataaataagtagatatatgaaaacataaacaaaaaatatatacatacatacatttaacaaggatgggagagagacttggaaatgaagtacaagcagaaataaattagactgtttgtcacataaataacataagcataatcacattgaaggtaggtagggagatggtaatttacccaagtaattcttgaagatactattttgactctacagcctcaggttaaagacatacagaatggtaaacaaatattgtactccaaataagtaggttgacttttcataggagcaaagggttagcaattcttaaacaaatttatacatgttccaagattaagcaaatcagttaatacattgtgaagaaggagaatcaattttctcactgtctttgaatgaattacaaatgaggaaacaagaaaggctggaatgaaccttgtgatattggattagaatcagtatgaattcagcattttaaacatataaacacatagctatagaaataaagatgtacatgggtaagtatatatatacttatgttccctagctctgtccattaagagggcctagaagcaaggatactctagtaccaatgagcacaccaaatgcctaaggaggctgagtctcagcctagagcctagcatagtgcttagacctggatgttcaataaatgataaatatcatcatcatcatcatcatctcactttagtatcataaggaaagttgactgcatgtacagaaaaactttaaacaaatgaaggcaagagaatgaagacacaaataaagaaaggataattgaagggccacacttctgatggagtaggaaggaatagccttccctatgtaagaaattttcaccttggaaaaaaagttacttctgcctctaagagaggagggaggagaagaaaataattgaagacatatgtagacatgttaagattgaaaagaaaatacctttaattgcctcagaaaaaaatatgactaaagccatctaattacagcaaggaatgtggatggagaagggaatattggacaaggtcaggaccgccacttctagagaaatgtgataccgggacaagatatgactaaaaatgtctgcagagcagcagagagtgcctacctcaagttaagtaacatgaatttgcggtgaattcagtgcatttcataatactagagttattattaaaaagacactgtttattatttaattggttttgaattgtttcttatgaattaactttgtctctccaattataactttcttaggcaagaggacatttctgacataatgtttatatcttccattgcacttattacagtgctagcgatataacacatacccagcagaaggttgatagcatataaacaactacattttcaacttggcctttatgatgtccctgcttctggattttgtttagttcttctgctattttccaggtagaagtatgatagttgaactttattgtgctctagaaaaagcaataaacccttctgcaaacttcataagatagcacagtaaaaggaactctacaccaagaggacattttcccttcaaaataacaaagcagaacacaaagtaaatcaaagcatataaacggagaaaggaattccgttgcctttgaaattgaactccagaaataatttacttaaaaagagttcctcagatatagcttgaagtctaaagacaatcattgatcatcaactggtattctcttactccatcagcactccagatacaaagcaagagaaaacccagagtaaaaaatttaaatggacaatatttcatctgcaacctggaaagtcttctatgcttgctgttgtattgactttcctacttatctcagaaaattgtgcatttaatcatctctctctattttctttgactcttttccagtgagagagtataagattgtttacctaaagacctcgaagtctagcaagataggaagcaagttgttacttaagcaggttgggggggcattatgggcacaatgaaaattaatcattggttctctttgcctatcaaaatacatcgttcacataggacccctttccccaataaatttagatcatgcctactctagaaaaggaatcacagcattgtcacttcttgatgttgtgaagtaatttgtaatgcgcagaaatgatttgaatacatgtcccaacagagctttgtgaaggaaactcaaagctattctgacataatagcaaatgatagcagagaagggactgaagcactgcagcaaacccaaaattgttccaatattcagctgctagaacaaaaaagaaaagcctcactactgaacctttttcatttcgtatagctgctcaaaatttagaaaactcatagaccataatccattaaaacagcatctattacatcaagttctaattgctaaacttgctggtaaatccttggggtaaagagattggaactcttccattttcaataaagattatttgtaaaactaaaaaaaaatccatgagacaatctgatagatgtctcattattcctgatctgtgttcttttttatttcttagccctacctctacaaccgattaaaatgcttagcctaaatactttcaccatttcaaagaaaccactacaaaaagtgctattttttggccgggcgtggtggctcacgcctgtaatcccagcactttgggaggccaggcgggcggatcacgagatcaggagatcgagaccatcctagctaacacggtgaaaccctgtttctactaaaaaaatacaaaaacataattagccgggcgtggtggcaggtgcctgtagtcccagctactcgggaggctgaggcaggagaatggcgtgaacccggaaggcggagcctgcagtgagccgagcacgccactgcactccagcctgggcgacagagcgagactgtctcaaaaaaaaaaaaaaaaaaaaaaatgctgtttttttcctggattttatgaggataaaatttagataatcttttaaaaatatgtacaatataccaaactatttaaatagacattagcattttctgttaaagtactgacatagtatttgcaactattttttaaatcatttttctactcttgatcgtttatagtcagaatttcagtcaagtttagcactatccaaaaaaatcagacaggatgtgttgcttcacaaataagaagctacatgtaagtcctgaagcacaaggtttaaggaaaggatttcagcaatgacttattcagcagatactcatcatatttcctcttgtgagttctgttatatagtccatattcctatgcttagagcagggattattctgcctcattggccttaaactacatcagccctataacctctacttccccacaggtttcagtgatctcccaattctgtcgcagaaagcttttccaacaaagtacacatttatattacaaccacaccccatatgtcctccatgaactcttattaattctccaatacacatgccattttattgctctgtgaagtcttccatgttttttccacgcatgctttctctgctggcctctgtgtatacctctattatatcatatagttctgtgcttatcacgaatttttgataatgcatttctggcaataaaggagaataaaacagaccctccaaagagtttggatgaattagagcaaggtggcttaccatcagcataaaatttcttccttaaagattagtttaattttattttagatataggggtacatgtgcaggtttgttatatggaaatattgcatgatgctgaggtttggaatatagatcccaccaccaggtagtgagatgctaccaggtagtgatacagatgctcccaccaagtagtgagcacagtacgggttaagtagtttttcaacccatgtttccctccgccattcctcctctactagtctgcagtgtctattgttcccatgtttatatgcatgtgtgttcaatgtttagttcccacttataagtgagaacgtgtagtatttgcctttctgttcctgccttaattcacttaggaaaatgacctccaactgcatccatgttgctgcaaaggacatgatttcttgaaatcatatgttttatccggtaaaaataccttaaaatatttcatgctatgccattatgtgtccttttaaattatttgtcattaataaaattgaagtttaaaattatttctaatgttcagcctttgttttgtgttctctttgcattagcactgtacacattcagtttaagaatcacctttttagattcccaacaaatggaaaagtgatatttgtataatatatatattttgtaaaacacaaaacaatatgcagcagaaaaattattgcactaagcacatgtattagaaaagaagattctcaagtaaatgacatcagcttctacatttttttcattatactttaagttctgggatacatgtgcagaatgtgcacgtttgttacataggcgtacacatatcatggtggtttgctgtacccatcaacctgtcatctacattaggtatttctcctaatgctatccctcccctacccccacccccaacaggccccagtgtgtgatgttccctccctgtgtccatgtgttctcattgacaactcccacttatgagtgagaacatgcggtgtttggttttctgttcctctgttagttggctgagcaagatggtttccagcttcacccaaggacatgaaaacatccttttttatggctgcaaagtattctatggtatatatgtgccacattttctttaaccagtctatcatcgatgggcatttgggttggttccaagtttttgctattgtgaatagtgctgcaataaacatatgtgcacatttgtctttatagtagaatgatttataatcctttgggtatatacccagtaatggaattgctgggtcaaatagtatttctggttctagatccttgagaatcgccacactgtcttccacaatggttgctaattaaactaaagagcttctgcacagcaaaagaaactatcatcagagtgaacaggcaacctacagaatgggaaaaaatttttgcaatctattcatctgacaaaggattctggattctgtagatccagaatctacatggaagaaactgcatcaaaattgggtgaaggatatgaacagacacttctcaaaagaagacatttatgttaccaacgaaaaaacaaacaaaaaaagctcatcatcactggtcattagagaaaagcaaatcaaaaccactatgagataccatctcatgccagttagaatggggatcgttaagtagtcaggaaacaacaggtgctggagaggatgtggagaaacagaaatgcttttacactgttggtgggagtgtaaattagttcagcctctatttttaacaaaaaaagaagggcaaattaaacccagagataaaggaagaaaataaacaataaagatcaaaagaggaattagtgaaaaagaaaacagaaatttagaaaatcaatgaaactaaaattagttttattgagattaataaacaactagccaagaaatggaaaaaaatgacaaaatatcaatatgagaaatgacagagatgacatgactatagattctatggatattaaaataataacagaatattatgacaataaattttaaaacttagatgaaatgggtgaatcttttgaaagacagaaactaacaaaaagtcactcataaaaatagaaaacctgaatatcttcatatctattaaagaaatgtattaataattaaatatcctctgaaaaagcaaataccaggccccatgtagaatcactaatgaattctatcaaatattttgaaaagaaataatattaattcttcaagaactttaacagaaaatttgagaagggaaaatatcttccaaatcattttatgagtccaactttaacctaataccaaaaccatataaaatattacaagaaaataatactatggaccagtaatcttcatgagtatggataaaaaaacctttaacaaaactttagcaagttaaataaaacaatatttaataaaaacaatatgttatagcccaatggagttcagtctagcaatgccaggttagtttaacattcaaaatcaattaaatgtaattcattatgttaatgaattaataaaagacacaatcatctcaatttatgcaaagtatttgtcaaaaccaacatctatacatccatttataataaaaagttctcaacaaaactaaaaatagacggaaattttctcaacatgtaaaggttatctatgataaacttacagctaacatccatcatacttactggtgaaagactaaattattttcccttaagattacgaaaaaagcaagtgtgtctgcttacaccatttctattcaaccttgtactgaatgttctagccagtgcaatgaggcaagagaaaaaaactaaagacattcagattggagaggggaaagtaaaactttccttattctcttatgagagaatcaccaatgtagaaaacctgtgtgttctacaaatattagttctagaattaataagtaagtttagcaagcttgcaggataaaaaccaatgtaaaaatatcaccagtatttttatgaactataaataaaaaaataggaaattaaaatttaaaactcttgcaggaagtcagggaccctaaatggagggaccagctgaagccatgtcagaagaacataaattgtgaagatttcatggacatttattagttccccaaattaatacttttataatttcttatgcctgtctttactgcaatctctgaacataaattgtgaagatttcatggacacttatcacttccccaatcaatacccttgtgatttcctatgcctgtctttactttaatctcttaatcccgtcatcttcgtaagctgaggaggatgtatgtcacctcaggaccctgtgatgattgcgttaactgcacaaattgtttgtagagcatgtgtgtttgaacaatatgaaatctgggcatcttgaaaaaagaacaggataacaacaatgttcagggaacaagggagataaccttaaactctgactgccggttagccaggtgcaacagagccatatttctcttctttcaaaagcaaatgggagaaatatcgctgaattctttttctctgcaaggaacatccctgagaaagagaatgtgtccctgaggggaggcctctgaactgaccgctttggggacggctgtcttttacggtcatagcagagggatgaaataagccccattctcctgtagtgctcccaggtttattaggacgaggaaattcccacctaataaattttggtcagaccggttgtctgctctcaaaccctgtttcctgataagatgttatcaatgacaatacatgcgtcaaacttcactagcaatttaaatttcacactggtcctgtggtcctgtgatctcgccctgcctccatttaccttgtgatatcttattaccttgtgatatcttattaccttgtgaagcatgtaatctctgtgacccacaccctattcgtacactccctccccttttgaaaatcactaataaaaacttgctggttttacggttcagggggcatcacggaacctgccaacatgtgatgtctcccccggacacccatctttaaaatttctctcttttgtactctgtccctttatttctcagactggccaacacatagggaaaatagaaaagaacctatatgaaatatcaggggctgaatttcccccgataaaaacatatcgtttatggtaacatttaagcacatgaactatggcactagcatgaaaataggcacatagatcaatgaaacagaatagagaactcaaaaagccacatatctacagccaactgatctttgacaaagttgacaaaaacatacactgggaaaggatgtccttttcaataaatggtgctggaaaaactggatttccatatgcagaagaataaaactgggcccctatctctcaccatatacaaaaattgactcaagatgatttaaatgtaagaactgaaagtattaaaatactaaaagaaaacatagggaaaactcttctggacattggtctagatgaagaattcataactgagaactcaaaagcacaaacaacaaaaacaaaaatagacacatgggatttaattaaactagaaagcttcagcacagcaatagaaataatcaacagaatggacaaacaacctagggaatgggagaaaatatttgccaaatacacatatggcaaggaactgatatccagaatttataaggaacttaaacaactcaacaaaaacaacaacaaaataaataaccccattaaaaagttggcaaaggacatgtatagatttttcaatataaggcatacaaatggtcaaaaagcatgtgaaataatgaacaacttcacttatcatcagagaaatgcaaagtaaaactaatcataatggctgttattaaaaagtaaaacaaaataacagatgttggtgaggatgtggagaaaagagaacactcataaactgttggtgggaatgctaattagggaatcctctatggaaagcagtatggagatttcttaaagaactaaaaataaaactatcattcaatcttgcaatcccattaccaggtatctacccaaaagaaaacgaatcattattttcaaaagataactacactcgtatgtttatcatggcactatcacaatagcaaagatatggattcaacctgtacccatcaatggattaatggataaagaaaatatagtatacatatacatacatagaatgaaatactattgcaccattaaaaatgaaattgtatctttcacagcaacatggatggaactggtggccattatcttaagtaaaataactcagaagtcaaatactgcatgttcttacttataagcgggagctaaactgtgtgtacacatggatgcaaagtgtgaaataatagacattggaaactcaggtgggagtgtgtgggggagtgagggatgagaaattacttaatgggtacaatgtacactatggctccaccaaacacccagacttcaccaatatgccatatatccttgtaaccaaaaaataaaacatagaaaataattaggcaaaagatgtgtaatccttgtacacttaaaaatgcaaacacattactgagataaaataaaagcctgaatgagtgtagagatatcctgtgtttatgggttggaagacttaatattgttaaaatgttagttctcaaattgatgtagaaattcaatacaatcccaatcaagatctcagcaagtctttttgtagaaatagacaagacaattctaaacttcatatggaaatgtgaaagatgtagaatattcaagccaatttgaaaaagaatgaagttgaaggaattacatggccctatttcaagacttactataaatctacagccataaatatagtgtgttattggcataaagacagacgtgcttattaatggaacaaaattaagtacagaaataggccggctataaaaggtcaattgattttttatagagattcaaaggcaggtcaatggggaaaggatagtcttttcaaaaacaaatatactggaacatttaaatattcatattcgaaaacaagaatgaacaaaagaaagaagtctcaatcaacaccatgcatcatagacaaaatttaactcaaaatgatcataggactaactgcaagtgctaaaactataaacttcataaaaggaaagatagtgtaaatctttatggccttggactaggcaatggtgtcttagatacaatagcaaaaatatcatctgtaaaataac

SEQ ID NO: 2637 - DNA, 2085 bp, Homo sapiens
gttccctcctcaaagcataccccaggctcctacctggacgttccagtggcctgggactacccacctccatactcacttcagtcccacacataccctgtgcctgctgtcttccaggcccctgcgaagagaataaaggatgaagtggaggcttcgttctctgggtctagacagtttcaaagtgaaacagaagttcttcgctggcagccaggagccaatggccacctttcctgtgccatatgatttgcctccagaactgtatggaagtaaagatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttacaaaatctttccaaaggtcactcttatgaatggatgttggttatacttttaatggacattaacattcctaataaagtattagtttcttaattcacttttatatgttttggaaagaaaattagtgaacttctctatgttaaaaatacgtactgcttgagtatcccctgtctgaaatgcttgggaccagaagtgtttcagcttttggatttttttgaattttggaatatttgcatagcataatgagatatcttgggaatgggacccaaatctaaacacaaaattcatttatgtttcatatacaccttatatacaataacctaaaggtgattttatatgatattttgagtaattttatgcatgaaacaaagttttgacaggcttttgaccgtgattcatcacatgagttcaggcatggaaattttcatttggagcatcatgtcagcactcaaaaagttctggatcttggagcagttcagattttcagattagggatgctcaaatctatatagatataaaattatcctcacagtaacatagaatctcttggtgctgtcagctgttgggaattgaagattgactttgtgcttccaccctccatccagaaaggcacccttcattccaccagaactttacccaggaagaacacgatcatttcctttttcaccgatgccctctctcagctttctgagtacgtctcttggggtcgctggaggtgatcctaggatctgtctctgagaccaatgtgctgtttcagccccctgcagctaagaattgtattgactgtcctcacagcggcttttcatagctttcagcttcagctttacgaggcttctcctctctccctggcaccctgctggctgcctcactgcttacagacaggtcccaccaaacccaaacacctgcctagggtaaatgggtctctcttctatccccagaaactttcagaggaagcagctcatagaaacatacaaaagcacacaagtattttgggaaaaaatcctaaaaggtgacttaatttgatgccttaaattcacaagtgaggaagctaaggcctagaaggttaaggatgtccccagggtcacacagtgagcggggctcagagcttgagtgtctttgtgctttgtgtacattgtgttctccctagggtgctttagaccctgtttgttttcttctgcatgaggctgatttccagtttgtcatcaacctctttatcttataatttaggatagagttgaacgttagtcttgaaagattttctaaagtagtctttcaaactgttcctcagaggcctaggattttccaaaagtaccttaggaaccttgtaggctgcagtgggggtgtggcgatagagcaggaggcagggagacagggctgcagggcctcccaccttccaacagacaggctctgctgtatctgttgtacatactgggattctgtaaaggacattatctggggtgttgtatgtatttttgtgtgttctgctttttttaaataaacttgaaaagctactgaactaatttaaccagttgattttgcagataaggcttaagccttttgtgaccctaccctctatgtacgaaaacattacaactcgacatcagatgagctcaacagccatgaaaggaaacagggag

SEQ ID NO: 2638 - DNA, 1704 bp, Homo sapiens
aatcaagtacaatataactgatgactttcttgattcagtaatcagtaatttgtgatcaattttacctgatggtgacagcttggtgtataagttagtgctaatgtatattactgcatttcatttctgtggagcctgtcagctgagcaaaggagggaaactcaggatggagaactcctccccctccatccataagtggcacaccactggcctcctggtgttattaaaggaaaattggaaaagtttccagaagattaagcagaaagcttacaacttgcacaagactctcaattttccagtggctctgacagaaggataaatcttcggctgttttaactaaaatggacggtcaagttggtatccatcgtgaagctaaatgaatatctggacaggagtcagacaaagggaaggagaatccaggggaagatgaagcagctgcaggcctgtctgctaccctatatccggggaagagccagaaattgctgaccatagagagttacattgtccagcttttcctccacgaaatggagcagcaacaaaaggccagatcattcaacctatgcttcctcaagtctgataacattagcgtttctctcagatatcagttcaagtaaggagttgccaatagaagcaaagatgccaggaatcatcgtttttatttcagtgtccttacgaagacctttgagcacaatggaacgatgaggcaacattaaatattactggaatggggtatgaaagcagctactagaaaatcctgcaagaaaaatagatggagaaactgagtgctaagagtcttgccttttagctgtcaacagtttgaagatgaaacaaatctggaacagctgatttctattgtggcagctattacccatttttgttatgcatctgtctcttcccagactataaattatttaaggtgtgagtcggagacctaggcatttcttatggccagaaccttaagcaatgtctgggatatagcagatataacagactctcagctattgcgtgaattaaggaatgagcttgagaaatacttttaagtattttcttcctggaaaagagactccaactgtcttttgtacagtgcttgaaactcataccattaatcactctttgagactaaagctctgataacctgagtgaagaattggttacaaggacgttacaatgcaccatgctaccttcagccatttgtgcttctgcataaattgttttgaccgattagccaatcagtcaccaacaagacccaaaaggaatgagaatctaaacagattgtcaccatttggtgggtttgaacaccaagaggatagagcctagagcattgtggtctgctttaagacttctgagaggcaataaggagccctgagagaagctgagggcttcaagcaatgagatttgagcctacctcccttcatcaaaagtgcagctagaaaaacttggagaagcaaccagaacgggagttgggagggtaatacttttacatcaaaacaacactagctttattggctgtaataagagcaaagtatgtaagtagaaatgatattaatctgtcatgcatatcacttctcaagtggttcctcaacaatagtgttaatcaagctttgccctacttttatcggaaacctggtgaagaatagctttgacatttatcagacataggacactaagaaaattgccatatgtataaataaatttatgccttgaaaa

SEQ ID NO: 2639 - DNA, 10009 bp, Homo sapiens
ctcagatgcaggcacccctcaccccgcagtcactgcttctctaccagctccttttcagctgctgctgcagcctcagtttctcagggaggctctccaccagcttagaggtgggcggggggaagcagtgaacacgttccaggctgagccctcccagtgggcagcaagggcttgggaggaacttgagtgacggagtgtggggaaggaaaggtcaaggcctgcatgggcaccatgcggcaggcagcagggatcgggcatgggggagcctgtgggagccatgcaggccagtcggaagcacagtgcaggggggcagctgctgagcacctggtcctgggcagcctccagggcccactgctcagctctcagctctgagtctcaagcttccagcacattgcagaccttctcgagctcagtctgcatctcagccagctctgaacccacctcctgcaaagaagtctgtgatggaggagggtggggctggcgcgtatcttgatctgcaggctccccaagaacttcgctcccccttggattcagagctccagcctcacaggggccttcctagggactgttcttcgccccaaagaggccaccatggcggcatcaggtgcagtgctgacggaacagcaccaggggagggggcaagagggctcaccttcccctccaagctgtgcaggtgactgaagtccagaacacttgccctgaacccctgatccttcactccctcttttaccctgagtcccgcagcgctccccatacgggtagtactgcctagcccaggagcccctgagggcaggcctcacatcgccctccatctccacatcctttccagggtccctgcacagtttgcctgcacagggctgggcccgcaaagcctcgctccccaacgcacttgtttcatcacttcaattggtgagtccaccctgccaaggagtgaggcctagtcccctctcagggccacgctgaggttgtacgaggacagggcagccggggttacgggcctgggatgagtctaggctgagtccttggtgctcaatggagaacccccatcccaattcattggttccaacaagccaggcttcctactccaacccctgccccccggcccaggccctgccttcacttcacatggtccctgtctcagctcctccagctcctggaaacaagggcccagtgtggtcccagagggcccagtccacatggcaatgggagaccagagccaagttctctgcctgggaggtcccacctccatccagcctgatctcagggagggcaaccagggctgccccacaccagctctcacccctggatggggctgtcccagctccaccccagtctgcccttgagctcacccattggcctctggtggagtccacactgcagactccagctccttggcagacctgggctcccacagctcctgggggatgggaggcagaaacgctgctggggtgtggcagggacagcaggaccctgtccccttgcccccaccccgttctgtgttctgtgcatcattagctccaccaaggccactgggtaactcaaatgtggcacaggcccagttctatacagctggggagaccgacgcagggacagtgacccagtgagtaaactgaacagggtcataggatcactgagtgtcagagctccccagagtccccccagcaccacacccaatgtacagatggaacctgagccccagagtagtgaggggcttggccaaggccactggccagtttgtggcagagctgggactgccacagtcccatcagtgtttgtggaacccgtcgctttactggccagtgaggattcccagcggccccacccacaggctgtggggctggaggtgtgtgggtgggtcttggctggtgcccactcaggtaaatgcctgtgtagtacccaggagaagccacagtgggctgggtggggcaggggtgaggtgggacccacctttcatttgcagactccgggggctggcctggggtctctgctgcggtctgccctgtgggcagaggggaggtggcaaggactcaggagcacttgggctgctccagggtggctgccctcccttcaggctggcaggattgtccagattcttatgtccctgtccttgggtgggcaggctcaggccaccttgacctgggggcacccgaccctcacccctagcagctggtgctgagggttctggtgccagtggtggccaaagtcctgcttctgtccacaggcacccagctcaagctggagggcaaggccctttctgttcacggacagatgggccatagtagccctggaggccccacacccctgggcctgagctccccggtactcagggccagggtggggagcttgggacccattaaacaatcaggaagctgaggccccatgagaagagctgtggctgtggcacagcccgggcctccactttattgcacaaggcccctgacttcaggcttggggagggctctagggtacttaggaggggttctttgggggccctgactgtaggtggggccacctcacaccaccccaggcagcccagctcctgcccaccttttgcctctggatcccagcagccatctggtcattctccctctccagagcctgcatcctgctcctgtggctgactggggaggggccagctgcatccccatctaggggccctgctcccccatcctctcatgcctgcagaaaccttcaccctggctcttgggtttgggcaggtccagcctgcagaggggagcggatctcctcctgggccctggcctgccctccctggctggcatgtggactaggggcctgggggctcactggatggtgcccgcccagactcacggcagctcctcctgcgtgcactctggcctgtgcagctgtgtaagggtcctgcggttacatgatgggaaaagcaagagggagcatctggggccctgaagtcccaagtcacacccaaaccaaaccacccagccaggaagatagcaggaagcaaattggaggcgttctgggttgaactgtatccccagcaacaacaacaaaaagatatattgacatccccagtacctcctaatgagacagaatcattacagaggtaatcagactaaaatgaagtcaataggctgggctttcatccaaggtgactatacaaaggggaaatgtggacacgggcacacacagagggagacaccacgcggacatcctggaggaatgtcaaagcctgctggcaaagcaccagaagctggggacaaggcctagaacagaccctccctcacaggcctcaggaggaaccaaccctgccgacaccctgacctgaacttcagccttcagaaccaagagacaatgaatgcctgccattgaagctaccgtcttcagcactttgttatcacagccctagcaaactcacagaggaccctatccagctgctgccccatctccaagagcctcgccctgctggaagtgcactgctagtctggttcatcagccactctgcacaggacccctgcccaggacccagggtctgcattttaggccatccttgctggataggcccagagcccagggtccccacctgcctgtagaagggcaactgccagccggtgccagcgtgccttccaatattcagccatctcctcatgaagcctgggatgtgattcttgtgcctctagctctttcctgaggggcactggtacctccaggacctggagtgtactggaagaaatggtgcagtccaggtacagcatggaccccagatcacccccaccccactccctttcagtgattattgtcttatgaactaggagggggagtggggcagagatgcctctttcatggctccctgcacacacagaacccctttgtactgggcacttctactcccaaggaccctgacttgcacccagcagctaaggtcatctcacccccacctcccacctgcccctgggccagcaggaggggcttggccatatgtaggcgagacaggacttcttgaagctgaaagatttcccaccccataaaagagccagaatgtgacaaccaggagcgctgatacctggggaagggagactggctctggtcgtgtgattccgggtttagggctctgggccattccccctcagccagctggtgacagagactggcccaccgcctgctgagagggccatctcacctacagtgagaacagagcccccaccccagcctggcttggacactctgaggatgggcccaagcagccacctaccaggactcttggcccggggccacacccagtgctgctagcagccccaccttctcctgaagtagccaggtgtgctctgcctccagggcctgcaatggccccccaacaccatctgctctccctgcagatgctgcagctgctccaagcaggcccctagttgctggtggctctggcccagctcttctgagtctcttgttcacctggggagatccccaccccaccgagttgtggctcagcctccaccagggttgtggagctccagcctttacccatgcagcccctcctcagaggccccgaactccacttcctctgggtctcagcccttccaggaggcctctctgaccaccccagcccgcagaggcttctctacactccaggctacgactctggaccagtgcctggctgcacactagcaggggggccagttatgtgaagatgaggatggtgctctctggagtgtcactgtgtggacgccctgctagaatctctctctcctggtcattctcctttcctctgtgcccctagagccccttgccctacattggaatcccccaggaatggggcccaggctcccttgcctctgccccctggtacagatgggcatggcctggatcagctaatgcccagattccctttcctgtggggctgcccctgccagctgtcttgaccaacctcagtgagtatcagcaactgctcctgcagacggactgtgtcctgagcctgggcaggggtctcagctgctggcatggagactctgggtcccgaagctcctgggccctgcctccatcccagctctgctcttggatctgcaggcctggcaccagcatctcctgtagatacacttggtccagaatcctggggtctccttccagcttccagaccacactggggtggtcttggcagaccgttgatgcctcagggcatgttgtggcagggtcctggccccaactcaagttatgactctgaacaagctctcctctgctctctggtctcagttttcccatctgaaccaggagggaagtcactgaatgatcccagggtattcccaaatgttggaagaggatccctctcttggctggactaagcccctgcgctgccttccttctctagataatgcttcaataatgaggaccagagaataaagtgtggggcagagtcaaaggtacagcagggccagtgcgcagggcctgccatgcacccacttgggggatccccaggctgggctctgggccaacaggctgttgggtcatttggtccaaatgccgctaggccttttccacttctgtctgcagcagcaggatcctgtgggtagaagggatggtctgcctgttccctgccaccccacccctcccccacagcccagccccactcacttgtcttctatgttctggtctggcctcctccactcagcctgtccctgggatccctgcatctggtgcctctcctgctccaggcaggccagggagcactccacctgctaggaggaggctgagtgggagggctgaaggcagcacagagcctcagataggtagggctagcttccctgcctcccaccaggcagggcagtgtctgcagcctttgataacgcaggcggactggcagccagcagcccagctgacagcccaacatggacccatgccctggcttatatacaagggactgtgccctggggccctgaggggctgcttttggctgttatctatcacgacaggctccagctgtgcatctctacctccagctgggcccgagatacaccgcctctccagctgctctccagctgctgacagcttcagggtggaggccagcaggactgctgtggcatgctaaagggcaggcagacatgaggttgtcaactgggtcccaagggtcccccaggcctggtagggagcagtggctccaggtgggccagctgtgagctaagacacagagtcactgaaggcttgcgtaactgggccatcacacggtgtccctttcctaccctcacatgaggcagagatcctggtaaccttcccaagaaccctcagcttgcacagccatctccccctctctggggctcgcctgtttcactcggggagattgggcttctaaggaagctcttcagtctatggagctaaaaccagcccctccctccctcagattctccctggggggccacagggaccctggcccttccttcacctccagcagtgtccctagccacccccagcatatgcctctcaggcaacaccctgcacccttccaggggcaccattcagagacatctctgttcaacaccgcagccttgctggggactccatttccctttctcctctgggtgccccagaccccggaaagcctccctgagaatatggcaccagatgtggacaccagctctgggcattctggagcttcagcctgctaaggggatcttgctagctcaggggacctcctttcagctacagaaagcccaggaagaaggaatgggggaggacagggcctcactttctgctttagggaccagccaagtcccagcttgtgctcccgcctctgcagcaccagggcttgctccgacagggcctccggcactgcccgaagacggcttgccagctcggccctctgctgcctgctttctgccagctgctcccacaggtccttctctgcccgcctccagtcccgctcgggggccctgttggagcacatgccagggaaagaggagccagacttcagcccaggccccagggggctgccatgcccaactttcctatgctcacctgcacccttcagtggggcttggtgggcagacacggtccaatgccccgaggaaataggagttccagagacagcgggcagggctgggcatcaagtccatgggctctgcctcagtgggacctgagaacaggacagatcctggagctggggtagtcttggcttcccaaagcaccaggctctgaggcctcttctcagactcagaattgaggccctttggctgagcacgcactaaaacccttcaaccctgatcctctggcccgaaagtctcctggtgattggaacttcactaaacaccagcctcaactccactaaacagttctcagttcccagtggtttccatgagctgtgggtgctgccaggggtggccacttgctgaacacaaaccccattatcctcacagcagctggtctggggaggcgcagcaggcactcctgaggggaaattggtgcccaagtccggcagggagtcccgtgaggagctgcaatccccacccaacactgtctgcaccagagccacgttcccccttccagtgtggaagtctggaaatggcaggggagcatttgggggccaccacagtttagctatgatgtgggggtcagagcccttaagtcaagtcactgctcaggtacctctctggcttccatagcttcagctgtaatatggaggccctgacggacctctcacccaccagcttggtgaggaaggtcagagggtagacaggggctattctgccagtgttgccatccctacacccctcaccatcaccctcctcacctctagggtctgggcccaagtccactgcctcccaactcccaaccctgggcacgaggcaccctgccctggctctgaaagggcacaggagttgtcttcacctaagcagtggttacacctagcacctctaccacccccaccctgacctccccactcctcacattcccaggccttctccactcaggatggcaccatcgcccaccaggccttctccccactggacagcttgactctcctctccccttactccaggcccaggctcctgcagccccctccaaaattgtctcccctccaaaatgtcactgccacacaaggcttctctaagacagaccatgaggactggccgctgcccccacctcccatactgggtacagctcccacaatgccactctacctgggtgctctgtcttgccagttagaagtgacaggctttccatggcagccccctgcccttagtgagaagctgagctgtgcccagcttggtccgggaggggctcatggtccacagaatggagtgcacatgcaggccagattgtcctgagcaggggggcaggccagggcagccccaggaaggctttccagggaggtgaccctggggccaaggctcagaggtgaattaactgcctccagagaaggcaaagtcagatgaggcagacagaggagacagtaaggacaatagaacaaggagggcatcagagcagctgggcctggcgggcagtgaactgagccctaagcttggtggaagtggaggtggggggcaaaagggagaccaaaaggggtgagaggagctgtggggtttgggaggatgcagggcagcggcacctccccagtgcccttgagatatgctacagacctcaactccacagaggctgaggacccagacaggagcttgggcctgaggggcagtggaggtggagcaagcctcctctgaggtggggatgggagtggaggagttacccaaacctcacctgggggcagatctttctccaagtttctgaaaggtgtgaaagtcacaaaagaatgaagctctaagggtagaatctcaggcaggatggcctccaggctgcaaagtgtggagagggagacagctgggagatggcttctgttccacctcagaaaaagagagttgcttcgtggctgggaggtagggactcctggattctcagtggtgggcagttttgtgggaaggtgactaacttaccccatcagagcctatagctcagggcagggctggggacagaagcttctctgagaacatccatcccggggacagaagcttctctgagaacatccatccctcagggctagtatcctggagccatggaaactcaggcaacactaagtggtgggaggaggagacaccagagaggcctcctactccacctcatctgagctgatgaaaccccgagatggaacctggctagtgtggtcgaggccatgggtaccaggcaggaatggcatctcagatggcctgggatttttcaaaatcttcagcttttgagataggaccttagggggcaggacctcagcagccaatctgggtcacccactgtacactgaagcggctcctaactttcttttttgagacggagttttgctctcttgcgcaggctgcagtgaagtggcgcgatctcggctcactgcaatctctgcctcccgggtttaagtgattctcccacctcagcctcccgagcatctgggactacaggcgcgtgccaccacgtctagctaatttttgtatttttagtagagacggggtttcgccatgttggccagactggtctcgaattcctgacctcaggtgatcatccacctcagcctcccaaagtactgggattagaggggtgaaccaccgcgcttggccgattttttgtttattttttgagacagggtctccttctgtcgaccaggctggagtgcagtggtgtgatcatagctcactgcaatctcaacctcctgggatcaagcgatcctcctgcctcagtcccctgcaaggagctggaactacaggcatgcgccacccagtccggctaatttttgtaattttttggaaggggacccagttttgaattagcttctgttgtttacttcggatagccatggtggagctggcagagatttaggggatactaaacacccctacaaatcacgccttgaaaccccccgtttcagggagagccgctggcgaaggacttgatgcgcagccgcagctcggaagcggggggctcccctgcgacacctccccgcttcaggggcgggcccagacccgcg

SEQ ID NO: 2640 - DNA, 6493 bp, Homo sapiens
accccggaatgcggacgtgcaaaccctccaccccacccccagccacacacgtcgcggtcagagaactgggaagggggcgcggggtccgaggttctggaaaagcaagaactcacctgcaaacaggcagtcctcagctctggacttctggatcacgacgtcgatatccttctgaattcggtcttgccttgaacacatccccattaaataaatccttggaaaagaagcagccgctatttccaccccacccccctcgcacgctttcagctttcagaggacatcttgctgtgttttccaggctggacctgaatgaacttctgggctcaatcaatccttccacctcagcctaacatttacactgggagcagagatgcatttggagtaggtgatgattttggaatgctttagaagcaacataggtatctgatttcatcaggtcaagccatcaaaaatgaccaataaatctctgacctcttagaagcaatttgaagacccaaattttggccatcatcaaaattcgtgttcattcaaaattagacattctggagagcaaggacaatcattttgctgatgctgcagctaagaatgcagctctgaagttgacatcagacacagaactcctcgaaatgaccttgctgacttatgacccattgaagacttcattagaagtacaagtgggctgggcatggtggctcatgcctgtaatcccagcactttgggaggccaaggctggcagatcacctgaggtcaggagtttgagaccagcctggccaacatggtgaaatcctgtctctactaaaaatacaaaaattagctggtgtggtgacacatgtctataatccctgctacttgggaggcagaggcatgagaattgcttgaacctgggaggcggaggttgcagtgaggtgagattgcaccactgcactccagcctgggtgacagagcaagactctggcaaaaaaaaaaaaaaagaagcataagtgggagctcccaagcaggagagggatctctggaaggataaagggaacaaatttcttccagaaacagtcatatggtatgggcccaatgatacactgatctatcccttaggcttcaattacccttttacagtacttcataagctgactcattggaattcagacaaaatgttggcatggggaaagcaatggtattgaaaatcattgcctatgattgcagaaaatgtttagtcttgccatactgtctgtcccaaacataatcctggaaaaccccttcatgggtcacagggacattttgcctttgggacccttcgagacatggcagttagactttatccagctgtctccatctcagggtcacagatactttctggtgctaatttgtatatgctcactggggtgagcatttccatgctgatgagccacagcccaagtagtaggtagattgtgattagaaaaggtaattcctcatggggggtgccatctgaactccatagaaactgaggaacacacttcgttggtcaggtaatttgatccatttgtaacatttttgcctaagtcccaacatttccattgtgcctgtcacccctaatcctctgggccgatggaatgcactaatgatacaataaaaactcaattggcaaagctaacagaagtttttaacctttcttggacaaggatctcccactggttgtggaaaatgtccacactctccctctttgaaataataacaggaagacccttgcagtggttagatgaaggcgcttatgaatctgcacttcttaaaggtgacattctccattactgctaagatctcacagaacttactaagaactctacattaacaaagaattccattcataatgaactcctgggagatgaaaatatcaaaaatcttggcctataacctggagatgttgttgtttactggaaacaacatcaaataaaatattcttcccaagactgttggaagggaccacatcagctattattattactttatatatttttttgagatgggatctcattctattccccaagccagaatgcagtggcacaatcatgactcactgtagccttgaactcctgggctcaagccacccttctgcctcaaccttccaaatatttgggaccacaggcataggccactgcacctaactgacgacaggtattactgaccaatctgtgccagtaaacttaagggcgttgacacatggattcatgtttctcttgtaaaaggcaaccctaccagagtggacatctgtcagtggagattttcacttaaaggtaactcacaatcttcctgacagagatggcaagtagctgacatctggtgtagtccactttcacccaagatactggcctgtataatcagttacaattccagtgctgaccgtgcctgagagagttagtctcttttttgctgactggaatacatacaccattagggctcctttaagttgtaggggttgtctcttggtggttttggtaaaatcaccctatatgcatattctcttaagatatgacacactactcctgttgcgtgtatgtgtatatacatatacatacatacatacatagcagaatacctgtgatcagatttctgttttactgtccctaattaatttgattacagcagggagggataattctctgattagaatctcacaaaccattacctctgtgggaaatttgacaaggttccaggtttgccactcaaaaccacaaaccacttttgaccataatgacccattggtacatcctgtgctaaatttcacctgtattcctcctgattgcactcacgatgcaactcagggtcatatcaagcaaaacctgtttatctaatctgtctgactcaccctaactttcctgccgcacgtctcagtttaacccatcgtaatcgtattgtcaaaataactgcctgtaatcccagcactttgggaggccaaggcagaaggatcacttgagcacaggggtttgagactagcctgggcaaaatggtgaaacactgactctataaaatatatacaaattagctgggtgtggtggtgcccacctgtagtcccagctactcaggagcatgaggtgagaggatgacttgagctaaggagttcaagcctgcagcgaaccctgatgacgccactgcactccagcctgggcaacagagtgagaccctgtctcaaaaaataaataaataagctgcgtgtggtggtgtgtgcctgtagtcccagctgcttgggaggatgagccattgagccttggaggtcaagaggtcaaggctgtactgagctgtgatcttgtcactgaattccagcctgggagacagagtccttgtcttaaaaagtaattataataaaaataaaaagtacaaaaccaaccaaacaaaaaattgtttcttcactctgaaataacagtggttaacaccatgatgccactggaaagttaaaagaaaaacactccctcctgctatcaggatccaacctgccctcttgctctaaatttctgacccatggtttaaatgcccaaaagctgatgtactcaaattatagcgcacttacttgttcggcgtttatttttgtctcttgaaaagatcaccatccatggccctataaatgtcgaagggcatggaatgatgaagtgcaatgtcattattgttatgtatctctcatcgttttacttctgggaaaactaatttcatggtattctgaagagtagagatgattcaataagtgacagcagctgtagacttaactgaggcctctctctctctctctcttttttttttttgccactctatgatgccctttttttttttaagaccgagtctcactctgtcacccaggctggagtgcagtggtgtgatattagctcagtgcagcctcaaactcccaggctcaagcagtcctcctacctcagcctcctgaatagctgggactaaggtgtgtgccactacacctggctaactttgtattttttgtagagatggggtttcaccatgttgcccaggctggttttgaactcctggactcaggcaatccacgtatcttggcctcctgaagtgctgggactacaggtgtgagccaccatgcctggctgtaatgccctttcaattggacttttgggcattcttaaaaattcctcagtgaggtggcttctttcctcccctgtcccctgcttgggacaggactatccgggaatgagcctttctggcaaagagggacaaccttgacttagcttttgatcatcgatgctttcaagaagaaagattaaaaaaactttttatctgaggaatgtgagccctttcaaatgatcaggcccagagagacgttaaatcgagacagcaaccactttccgctccttccttttgagctgcgctgagctatgtattcatccgttgaaactgcttgctattgcctcaagtagctgtaaattaacctaataatgccacaccaatccctatacccccataccctataacttaacaacatatagccaatcaccaagcaatgttatttctgtaaaccaatgagaattcctgataggcacctatcagcccactgtctgtccctgcttttgaactttaaaaacctgcttgtgggcagggtgcggtggctcacgcctgtaatcccagcactttgggaggccgaggcaggcggatcatgaggtcaggagatcgagaccatcctggctaacacggtgaaaccccgtctctattaaaaaaatacaaaaaaaattagctgggcgtggtggcgggtgcctgtaatcccagctactagggaggctgaggcaggagaatggcgagaacccgggaggcggagcagagttcgcgccactgcactccagcctgggcgacagagtgagactccgtctcaaaataaataaataaataaaaaataaaaaataaaaacctgcttgtgacaaaggcaaaagggagctcagatccaagcttccttggtgtgagtcttccaggcagttgtcttcatgttgactcaagtaaactctaaattatattttgtgcttcagcctccttcttttaggtcaacatgttcaacaacagtagaataaatacataagttaatgtatattcctacaaaggaatacacgtagaaccaaataaccatatgaataacatgaaaaattcatagacataggactgagtgaaagaagtcagacctatgcctctgcttctgcaaccgcctttgcaaaaattacaactgggacaattaccacagtgaaagagatctgatctaactgattccatcttgcttctaacgtacaagctgtccttgttgattgctgggcacaggccgaaataactttgggaggaaattagtttatggtttagctgtgaaacaaagatgataatatccctgtcccgaagcaaacccccttcctgcctggggactagactgcctttgccggactaacaaattagccacgagattagaaattatggtttaggagtcatgtagcctctggctgcaagattctaaacctccccaaattgttcctggagatcacatcgttattggaaaacctaagatcagtgcttgagatattttgccgaccctgcactcagtggatcagctggcaccagctagactgataacctggctcagctggtcttgtggcccccaagcaggaactgacccagcacaagaccacagcttcagctccctgtgatttcatctccgacctggccaagcagaactctcaattcaccggcccccaatcaccaaataaagagtgcagctctttattgcaattcccctgtgtcgaaaaattggctctgtctaggcagcaggcagggtgtacctgttgggcagtaacactccccccaaaacccactacagactgtgactcagcttatatgaaagtaaagggcaggaaaaacttgcctggtagatttgcagagacgggggtggaaaccattaataagtctgtggagtattctcagagtttggtgttgtagtctacatattaaaagtaatcagttaaacacctgaaataaaacttctcccaaatatttttgccaaatttggatgactgtgtttctgtcttcgcagcatataaagtgttaacatgaggtaagcgctaaggtctagagaaggcagtgaagagatgacaaactccagcaccatgcctgaatgtccagtgtgctctgctggggcagcacatttttgtacattgctgtatctgaaaaaaaccctacaagattcatgaaactggacgaccgtctttataatactcctagtgataaaacaagtaaggatggctggtttgcagtcatctgagcagcctctctagtttcatagatacggtttctctctgatattgaacgacttccaaatgtcaagcgaaatgctacatcacaaggataaccgtatgtgaaaagaaccgtttttctttgtaatcctaaactttctagtctgagctttaaaagccattatttgaagaaaagcgcacaggctccagctggccgccaaaggggtcctttgcatcacaggctaaggacctac

SEQ ID NO: 2641 - DNA, 2779 bp, Homo sapiens
atttaacctccccttgctggctgcttggattccaagtatgtgtgattatgatgttttcctgtgatctctttaggaatcacctttggttgctgaagcatccaaagtggaagaactctcagaggaaacggaagttaaatcaccatcttcttctgtggctaaacctataacagtaagagggcaggaggaaaattcctgactatgacctggatttctcctactctcttagcctctggagtagggataactcaattcaacttttctgctctgacttgtattttgaaggccaaggaaacaaggcccatgcacgcatgtgcgcgcgcacctccccaccccccacacacactcaggttcattgttttcccaattccccagcagttcacatatttctgtagaccaagtcctttccagtatccccacaatcttttttcagaggctatcttaccatgatctcaccaagcccatggcaggatagcccttcacaagtttcttcctaaggattcctcaacctgcagagctaaagacttctgtccgatctgggaatctactgcctttctcagccatttggacagcttctgaatactgtcagaatttgaacctgaaaatttccaaatgagagacaatgaagagcttgctattggcctttaattgagttgctcctataactgaaggacatgaactaatcctcaaacttgaaatacatataatgtcttggttgatgtcagagaagcattctaatggacaagacaatgccaagaagaattctatgacaaatagaaatggtttgtacaggaacatgctaccaggggaatgcaagcaggtactcatgagcattcagcttcctttgtcctggggatgactttggaaccaactgcagagctgccagagcttattgctatttgttcagtgctccatgaccagttctcaacttaccaacaaaaagccacatggtatatggatgagtagctgcaaagtgaatggacaggatcctgtttgaaaggccactgctctggtagaagaagctaaaagcaaatcagatcagggggcggaattgcatgctatttgtccctgtgtttgttttctaacaagtcatgggtagtatggtaagacaaggggaagttggcctattaaatagaagcttgcatggagcttggccctatggaaatcactgtaggaatttagagggtgcattagacatgtcaatgcccatcagaagaacttccttccaagactagaagatgattaggaccagttagtagatattctgatgtgctccctggaagtggacatcttggtccactaaattagtggacattgggggcccatagcaatgctgaaatgagctgaatctagacataattctcttccacactctcacaaataaaatgcctataaaattgtactatttgccatttggagagacaaagactgcaaatggtgatgggggaagttccctgggtgggaaggcatcacacatagctggtaactgggactgatattggtagccctaggggcctacagatgcgtcctggcaggagcttagagtagactgggcttgtcatagccagtggtagagagaaattgtcaaagtactataaaagcaccagagcagaaaatattgcaccactttgagtcacattttttcagactaagaagtacacttttcagcccatagtgtccaacagcgcatagagagatatcctccttagggtaagagtttgacatagacttgaaaaagacaagtggaacatttgttgtctaaaagaaagggagatgaggcaaggaggggtggctaacctgctttcgtgagcctatgcttacacttaacatgagagtggccaagggaaaatttccgaaagatagatttctccacttaactggaggatttaggaaggagtgggtagaaaagaatactggtatgactattctttttcctcttttccccacatcacctcaacttccccttttctttcctgatttagtggtctcaaggtcaggactgcaattataggtccaagaatcaggaatatctctaagaaagagagtataactatattgttaaagctttaagtcggaatttgtaaaggcctgatggggtgaattgtgtcttcaccccatttggaaatattggagttgacagtaaatgcagtcaattgcccagtggttaagaaagctcaccagttctgtatgtctatagctctcccctatttaagtggaaatggactgaactggcggggggcacttggtagactaataatgctgttggaaatatggactagcacagcagtcaaacttaacattccttctaaagggtgaaaaagtttggataaaatgattaagtggagagaaggaggaacactagttgagggtaaaggaattaataaaagaattatgcaccaagggaaatccaatattacattgccactcagagcaagagataatgttatctcttagctcaatgataccagatgcctgaaaggaggaagccatgtgttgccaagatcatatctgttctcacaatctgacaagttcaaaagaaagctaatgaaactaagtgaaatctctctgggacgttttggttctgtgtgatgatggactggactaattattgatgactaagtgggactctggtaatgcatcactatctcatttttcaagtcacgtcaaccacactgtgccatgatataacactggtggtgttggtaagatgataataccagtactgatggtcaaatgtattggaaaaatgaggtaaaatcctcctatccccagaacatactag

SEQ ID NO: 2642 - DNA, 8365 bp, Homo sapiens
tgaagctcaaagcaattagaaatattttcccaaatttatgggattagctatggagaaagtacataaatggatagtccgtcttgaaatttatgctgttaactccaatactaacatgtctctcaattaaacctagagaagagagctacctcaactaagactaaacacttggttacagattatgtttagactaaattcaggtttcttgacttcaattccatgctttttattcagtctgcctcaacaaatgacactaataatttttctacttttccatgtgaaataaacagtaattaagttaattaagatgtgtttttctaaaaatgtaaggctgaaaaccctacacaagatgtacattgggcatagcaggataccaatcaggggtcattaaataaaagcaagttaattaaggacattaaactgtttctagatagggtgatctgacctaaaaaatacacagccttttcctgctctattaaatttgaattgtgcccttgtagatccctgccttttggaaaaagccaaaagataactggaagtagaaaattagaacatcagaggatatttacaatcacagaggaatgtcttattaaatgtgcctaaatagttttcattctggatgttttaacaagagagaagtgcttattatgaaagacaagtgctttcctcctcctgcccctcaggttgatgttctttcactgcgaaggatgcatggaaactgaaaaaaagacatacagaaaaaaagagctatgtcagctaaatgaattgacttacgttcagttaatagacagctgttcatgttaatgccctctcacgccgtctttcactaggctacattcagagaagaggaactgttgagcaactgatttttgattatttcctgagttgttctgcaggcttgaaaggatagtttcttgttggtcaaatcacagaaaagtcttatacaagaattatcatcgggtcaagttctcagacttacattgtaattaattgcttagcctcattacttccacactatataatagttttactctttgttctttctattaaactggttttactttagaattttgtttcactgtaatgaatgccataagaatattctttaattcgatcattattattattattattttgagacggagtctcacactatcgtcggggccggagtgcagtggtgtgcaatctcggctcactgcaacctctgcctcctaggtacaagggattctcctgcctcagcctcccgagtagctgggattacaggcgcctgccaccatgcttggctaattttttgtatttttgaagagacggggtttcaccatgttggccgggctagtccccaactcgtgacctcgtgatctgcccacctcggcctcccaaagtgctgggattacaggcatgagccaccgcgcccagcctcggtgtttatttttacaaacaagatagctcacatttccctccaacaccattttaaaataaagcttgtcatttctatttgaccttttgttatctcttcctgattttctgagaatgatttatactaaatattatatcttttatattgtgtacatatatatgttatttataatcccatatctgaatatctgaattccaaaatactccaaaatctgactttttgagcacagcactgacatgacactcaaaggaaatgctctttggagcactttggattttggattttcagattagggatactttacggtttcaaaatctgaaaatctctgaaatctgtaacatttctggtctccagtgttttggattgggaatagtcaatctgtaacatacatgcatattacactgtgttttctttaattaaagtaattgcattaatttgtctaagctagggatgtatcaaaagtacatatttcattttgatccttaaatcaattttgacatatttcttcttatgattaaatacacatgattcatagaagaaataaggtcctccactgggatctttttgttttgtaaaagactttcattatacagctctgttggctatttatccagacccagctcctgtcataaacctttatgctttatgttacagtaataatgaattatttgcaattcctaaaatatcacaattgcattatataattccaattgttggcattgaagccaaggactgtgatttttccatagttattgtctcagcaactagcagtatggtggcataaatatctgttgaaacaacaaacagcttttctttcacagtagttactacataaatatttgctgaaagaaattaataaacagcttgtctttccaacatttcttgtatttgaaatacttccatctaatctttctttattatctgcatgctttctcctaagtatgagccatttactcaccaatttgagttttatttagctccacaatcttgaagcattttagcatggcgagatgatttgaattgccttaatgacagtcaggcatatgaaacaggtttgctaaatcctacttttctagactttttcggggaccctagaacagtattttgaaatagcaattataacaaaattatttcaatgtattaatatatacatatttttaaattctgagcaggtgttgatttttttttataacaagaaacctttcagaagtgaaagataacagatttacgatccttgtcaataaagcaagtattggcaatttcacttaacagttttaatgaaggaattgtagcaccgagtctgttgcaaagttcttgataaaagtgctactctttgtgatgaaaataattatcactgtagagtaggcataaaaataccccacaatagtcagacacccagaaataaaagttagagaaatttgtggaaacatgattgaatgtgcataagatgacttaatctaggtccaattactcttattttaatatcatttaaaatgaaatcatattgggcttcaaatggtttttcatatctagagtcagtgtcataacagcaatgactgccattagtacaggtagtttatagctcaaatttttacctttgtatttacctagtctcactgttttgcgctgtctcccttcagtcccttgattaaatgatatcctgtacattccaaaaagctcagtgcaatgttggtttggggagaactcaatggagcttatataatgatgcatttggtaatcagttatggcaaaatacacagttattaaccagaaattataatatccttgttgacttttttaagcactccctattatctttagctttataatcgagattacatctttggtagcatatagtttattaatactttctaacatataataatgaaagagtgtgtgtgtgggtgtgtaagtgtgtctatgacagaatagtctttttggttttacaaaagccaaactagataaattttatttatatcatttctgtattcaatatttatcatgaagtacatattaaataattattttgtaaactttatggcggcatttaaaatgcacagtctttattgtaacaaaataatacttactaggcttaatctggcaaacgtgagcagaagggatttgccagtaggaatactaaatgcagggatttacaaggagaatactgcaacttgtcctttgtaattttgcaataatatctgaatatcaaggcacctattcttgatcaccaaattttgctttcattcagcccacagaggctgttacaaatccttcccaaacacccttccttaagcagagaatcccacccgcttctcctacgctcaacaggcaaccttgcttcttatttaagaaaaaaaaaaatagaagccatctgttggaacttttctaaattttcttcttttctacctctaaagttgcctagagggaacagaagccccttctatacactcgagtatgcacctttgcatctttttggtaaagttgatctttctggtctaagttcctttattttcaatctctaaccctataatgaatactgcttcctcccaaagcacacactcaaaaaaaaaaatgaaaataaagaaaataaacaaaaaagtgctcacatttccatttccaaccacattgtgccagttttttaaccatcaaatttccccaaaataacttagcctcccaatttatttcttcctcatccctccctttctctttcactatacatttcttgagtcaaaatatttattaaatacttaatatgcacaggctattttgctatatgctggactatagctgatatggtttggctgtgtccctacccaaatctcatcttgaattatagttcccataatccccatgtgtcatgggagggacccagtggaaggtaattggatcatgggggcagttttccccatgctattctcatgatagtgagtaagttctcatgagatctgatggttttgcaaggggctttcctgacttcactcagctctcattcttctccttcatgccaccatgtgaagaaggatgtgtttgctttcccttccgccataattgtacatttcctgaggcctccccagccctgtagaactgtcagtcaattcaacctttttcctttgtaaattacccagtcttgggtgtttcttcttagtagcatggaaggaactaatacagtagccaaaggaaatatcctgcttaaaagtcacagttacacaagtctgaccaataataacacaattacaatacattttgataagtactatgaaaacataattgagaaatatatgaaagagaactgctattccttttgtttgtttgtttgtttaatttaagttctggcatacacatgcagaagaacgttcaggtttgttacaccggtatacatgtaccatggtggtttgctgcacctatcaccctatcatctaggttttaagccatgcatccattagctatttgtccctcccctcacccctcattccttgacagcctatttcataagttagacattctttaaaattcagctagagaaaaagaaacatatccaacacatattcaagagttacccatttatcttctcattggcttcagttaataatgtcatgtccagggtcaggttccagcccatgctgaggtctgaagggagtgagtgcaagagtggcagattgctgaaagaacacttggggggctgtaggcaggtgaaagatggttttattcagcagcttccttacactgtctgtctctgtcttagttgcctgctcttgttctgcagctccttccactctcatgcatagctgcatggctggctctcccttacagggtcaacagcttaactctttctctctctgggtgcgagcaagctgagctgggtcctggctccccccgtctatctgaaagacagaaagctctggctccccctctttttctctggatgcaagtgtgcctatacagtgtcagcagggcagttataccttttacagtcaatagttgctctgagccaggttatgagccttcccatgttatggctacatagctgtgattatgtaataagtggagttacgctcctgcgctccaaactcgctgagtcacacaggatgtttaccttggcctatgcctgcctggctgcagtgcaggcatattccttacaaataaacatttcctgagaaacacctacatgctgggcactctattaggcattaagtattgataacagaatgaaactggcatggcactcaggtaaatgagtattttgtgatggtaatgggataactataaaggcataggagaagtgcctattccagcctggggatagcagataaagattctaaggggatcattttttatttaagcataggatccctgcaattagcagggtgaaaccttgaagggacagagggtgcctatacacaggctagcatagggctctcaagtttttccataaaactttactacagaagataatgtttcatattctcaggggctcaaaatgttatgcatcaagaacaagatttccccactttagtttaaaatgtatagcaaattgtacatatttatgataaggagcttagattttattatctgaattatacaggaagaaaacagggtattcagatggaaagtgacatgactatatttaatatttagatatgtcattttgtcagccttgttaagaagaggctcaagtcaggttgggattacaaattgatgctggagttaaaagtctactcacaggtgcagagtgtgaatgaagatactgaccataataatgaagagaatgatagagatttgaaatattaaggaaatatgatgcaatgcctttattggctatttgggggaggagtttaggactgaaagaggagtccctgacaactctcaagtttataggctgcacttctgagtgaaagaaggtgctctttattgagctgtgtaacataaaaggagaagttttgcaggaaggaaagattatagtataaccaattaaagaaaaatctcttcatttctgtattgatttttatattgttgtgtaacaaataacaactatagcagcttaaaaacaacacttatttattaactcattgccatagagggcagaagtccaggcatgacatgactgggttctctgcctgggcatcatcagactgaaataaaagtgtccactggggctggagtttccatttgaactttatgcttttcttccagtctcacttgttgtggtaggttaaaaactgacccaccaacaggtactctcatcataatcactgggacctgtgaatgttactttatcaggccaagtctttgcagatgtgattaagtatcttgtggttattctggtggtccctaactgcaaccaagagggaggcagaaggatatttgacaaatacacacactgaagagaaagctatgtgaagatagagcagatagagagttgaagatgctggcctgggaaattgaactaatgtggccacagaatgctggcaaccactagaagctgaaacaggccaagaacattctcccctagagccttcagagagagttttggccctgctaaaatcttaattttggcccagtaatacagattttggacttatagatttcaaaactgtgagaggatacatttctgttgctttaagccaccaagtttgtggtaatttattatagcagccacaggaaattaatatgctagttgttcgcaaaattgatattcctgtggttgtacaactgaggtctccattttcctaatagatcatggccaagacaactcagtttctttccatgtggttctcatatcaatgcatacctacatggatgtttgctttctttcaaaccatatggagtgagtctcatttactttccattctgtaatcagctggagaaaactctctgaatctaaagggctcaggtaatgaggtcaggcccaccaggataatcttaaggcaactgatttgagaccttatttatatctgcaaaatccctttacaacagtttctagtgtttgattaaataagggagaagttgtgtgtataaaatttggggagccatcttagaattcttcctaccactctctcattatccatatgctgtttcctatatcactatgacgagaagaatcacctgggcgtttgataaaaatgcttattccaagatctcaattcagacttacagaaacaaaatctctaggattagaatgtgggaacatgcttttcttagcttccctatgagaatcttaaaatcagtctactgaatactgcaagtctgtccttgcagagtataccagatccacaaataaatctaaacttctaaaactggccataaaatgaccatttatgtatttctcagtccttgaaatagccatttgacagtctgtatcaaaagttttgagagagaaagcggttgctagctctctacaactagatgttgttagaattctggtctctcaatcagataaatttaattagaaatatgttatgactcaataagaagaaattattattaattttgttgggagataattacatagtggtggtgtactaaaaaagaagtccatacatatttaaagatggatgtaggggtattatgtgtgaaaagacataatgtctgagatgtgtgtttaaaaagcagatggagactaaataagattgacataatgttgcatattttcaaactatatactttggagtttcttatacaatgtctctactttcagcaatggggcttccttagcaataatctagaatgttattgaagcctccaaaaaagaaaactgagtttttgtttcaacagttgggtaagaatcacctgccagtctaaaacaaccttgaatagttatgtgatcaaagaacacacttttggccaggtgccgtggctcacgcctgtaatcccagcactttgggaggccgaggcgggcggatctcctgaagtcaggagtttgagagcagcctggccaacatggtgaaaccctgt

SEQ ID NO: 2643 - DNA, 1013 bp, Homo sapiens
gctcaaattcggaaagaggggacggaaatggaacctcttcatgggaggaagtttttgctgaagcaccaaaatagaggcaaagttttgtagaggccaagtgctaccttattctcaaatggagttttagatcatccatgaattacttgcaaaagggacgtcctgaaactctgcaccactagaccatcgtacacctttaatgaattcttagatgcattttatatatgatgtatgtacataaaaatgaatgaattcattagaagacattttaaaaatgggaatttccgtggacaaagagttttaggaaagttgagtatttcttttgaagctacgtgaggagagcttttggaaaagcactaaggaatcttgatgcgtatgcttcgtgcttctgtagacacacagttggcacctgactcagatataaaaaagtctcaaggttttattatcgctggcagagcaagaggagagatggcaagagtgagacactgcaacccacccactgatgttggggcgaagatgccctaggccagacctataacacataaatagaaaggagctggacttgagggacttgattttgaacaggacactgtcaaaagcccccacctgggaaactgtactaatagcccccacctgggaaactgtactaatagaagagtcagcgtggggtggtgtgttagtttgttttgatgctgctgatgaagacatacccaagactaggcgatttacaagagaaagaagaggttgaattgcacttacatttccgcacggctggggaagcctcacaatcatggcggaaggtgaggaggagcaagtcacatcttaacgtggatggcggcaggcaaagacacaaagaatgagagccaagtgaaacagatttccccttatcaaaccagcagatctcacgagacttattcactaccacgaggacagcatgggagaacccacccccacaatccaaccatctcccaccacgtccctcccagaacacgcgggaattatgggagtacaattca

SEQ ID NO: 2644 - DNA, 7548 bp, Homo sapiens
ttttcttttcttttcttttcacagagtcttgctctgtcagccaggctggagtgcagtggcatgatctctgctcactgcagcctggacatcccggactcacgcgatcatctcatctcagctctgccagtcagctgggactacaggtgtgcatcaccatgcccagctaatttttgtatttttttgtagagagggggtttcaccgtgttggtcaggcttttctttttctttcttttttaactttcagagggggtataattatttgtgttcctgaatatttatgaattttcttctaaacttattgttaaaactatttattgtataacatttttggatggttttagtaatgtcactagcataagcagatgccagcaaaatgtatcgtatcagtcacacataagtaaattgctacaaaactcaagaagtaaattgtgaagaaaatttccttctgagggaaatatgatctcaaatgacatgttttttagtgttcaacttttattttcgatgcagggggcacatgtacagtcttgttatatgggtatattgtatccaggtggtgagcatagtacctaatagtaattttcaagttacattttatatttgtaaatagaatatttgattttattttgtgacttctactttatagaatagttttagatttatagaaaaattgtgaagacagtagaaagaatttctatgaactccatactccatgcttgtatttttaataaacagctgtgtatggttgtcagaagagctaattaagctcttaggtgcatctgttgaaattgtttccaaaataaaggggataatagaaccattctatattgttccagacagatggagcacagggaaatgtgtcttggcattctaaaaaagaatgaatggagaaccctggacactgttcccataaggagtacatgaagggacttgggatatttaattggataatagaagattgaagggtatgtggcaactgtcttcatatattgcagagggtgtaatgtggaagcgacagactcggaggggtcaatggatggaagataattactcagaatatggaagtctatgtattgattacatatttgaaagtgacaggcctgttgtgtatgggcagagggttccgggttaaatctcaaaaataataatagcaggggctagtagtaatacattctgaaaaaccagcgtatcaaaaagagagggaatactcccctctcttagatctgctcccctgggtgctgattgtaagtagctttgtatgttttattttagaaaatacatatagaaacacaatattttaaaaaaatagaattgtattcttcttattctgcaacttgttacttgtatttaatagtgtgtcttgggcctcttccttgatcttcattatattttataatggtcttaggattttattgttgaccatcatgcgtgactgcctttcccatatcaatgaaagtttagattatatataacttttgtcttaaaaaaaccaatgttttgaggattgaacatcctggttcgtgtatcttggtacacttattctaagtatttctatagtatgaaatatttgaatttggactgctgattatgaggcctgcatattttagaatttgttaaaactgagaaattataatgatgagagtgtccatttctctgcaactccaccaacatcgttatcaagcttttaattttttctgataggtaaaaacaattcattttattgtatcaattctttgtcagtggagttttgcagcttttcatgtgtttgtttactatgtttctttttgacctttaaaagttgttttgtgggtttttgttgttgttgttgttgttttgttttgttttgttttttttgtctcgctgctgtgtatgcagtggcacaatctcggctcactgcaacctctgcctccggggttcaagcaattctcctgccccagcctctggagtagctgggataacaggcacccgtcatcacactcagctaatttttatatttttagtagagacagggtttgccatgttggccaggctggtctcgaactcctgaactcaagtgatccagccacctgggcctgccaaagtgctgggattgcaggcatgagccactgtgcccggctatgtgttatgtttttgctttttccatagacgtaacattttgtctcttatgtgcattacatagtttcttccaagatgtcaacttatagttcatttatggtctctgctttgtagaacttcaaaatttctctacaatcacagttatatattttttctgggttcatatgttgcttagaacacttccctatacgaaaaacatgaaaattttttttcatattttctttcataagtgtctatttacatataggttatttattactcttgcgttaattttgtggtatagtgacatagaggagtctacctttccccctctaatgaggtattgtcccaacacagtgttgcataaatcttttttccaaatgtcagcttttatcacttatcaattctcattgtacttgagtctgttttagattgtctcttatattgatcttttagtttataggaaagctgctttactttttttttttttttttttttttttttttttttttgcaacacatttttatctagccacattaccaaactttctttctggttctgatagtttttccattgatgtctggattttctaggcaggttatcatataatctacaaatagtaataactttctaatatttatacttctttactttcttgtcgtgctagaacttccagaacaattttgaattgcagtgatgatgggcttgcccttattttgtttctgactctaaagtgaagaatgcctttagtgtctcactgtttcatttactgttagtatataatagatagcctttatttcattaagaaagtttccttggccaggcgcggtggctcacgcctgtaataccagcattttgggaggccaaggtgggcggatcacgaggtcaggagattgaggccatcctggctaacatggtgaaaccccgtctctactaaaaatacaaaaaattagctgggcatcgtggtgggcgcctgtagtcccagctactcggtaggctgaggcaggagaatggcgtgaacccgggaggcggaggtttcagtgagctgagatcgcgccaccgcactccagcctgggcgacagagtgagactccgtctcaaaaaacaaaaaaaaaaaaaaaaaaagaaagtttccttttggtttatataaaccaggataattttaaaaattaaattaaagatagatgttgaaagtatataatgtgtgaattgtaactcaataaagcagtaaaaaatgaatgttaaattttttaaaaatggctttaaaaatattttggggattattatatattttttctccttattaataactacacttgtttttaaaatttggtaagaatgcttaacatgtgatctaccctcttaacgattttttaattgtataatacagtattgtggactataagtataacattctatagtcgatctctcgaacttattcatctggcttaactgaaacttttaaaatattcagtaaatcatgctgtgacagatgtgctgtcatccaggctttgttgttccatttgtagagtagaggcagagtagatttagcataattctgaaaaaaggcctcaggattttcaaagtggtaaatgaacattggcttcaaccgaaagtcaccagctgcattagtccataacgaggtcattcttttttggatttttcataaaaccagcttttggttttattccttatatttatgaaggttgttctccattttattaatctctgtttatatgtttatgtccttagtttttcttttggtgcacttttgttgtttttctgtgtctaaagttcacatcatttattatcaatcattattgtgtcctagtaaatacatttaaagttataactttttctttgaagaaaacgcacactgtatcccatgatgtgtgtagcattaccattaatgttgatttctgtgtagtctgtgatttgagttttgatcatttaatccaaaatcacttagaagaatgtcttaaaatgtctaactagttttaggccgggttcggtggctcatgcctataatcccagcactttgggaggccaaggcgggcggatcacgaggtcaggagatcgagaccatcctggccaacacggtgaaaccctgtctccactaaaaatacacaaattagctgggtgtggtggcacacacctgtaatcgcagctactcgggaggctgaggcaggagaatcgctggaacccaggagttggaggttgcagtgagccaagattgccactgcactccagcctggcaacagtgcgaggctctgtctcaataataataataataataataataataataataatttttaaaaatgtctaactagtttcttctgttgtatattttgcctttaaaattaacttgctatctattgagatggatgttcagttttagtaaatgctctgtgaggattttttaaatgttcatttcttatttaggggaagttcaaagttacatgttatatcatgttattaatagtgctattccaaatggtctagtacatcaacttatttttctactttatctgttttcttagaatgctatcttcacatacaacattaaaaatgaatttttcaaaattgtcttgtaattttaatagtgtttgctttatatagatagtgctgttgttcattgcatgattattataggattgtacttttattataaaggatattctttgctttacttagtggttttttgctgtaaatttttctttgtataaaattaatattgccacatctgctttcttttttatagattttcctggtttacctgtatttatgcttttttttaacatttttgtgacattttggtttaggtatatttctcattgttagattttttctattcaaattcctctaatacccgttttctaattggtgaatttaacccattttcatattaactgtgataactgctgtgtttgtacttctctctgccatctgattttatgttttctattcatcgtgcttttcaaaaattattttcttgatactcgctgaattgttagctatatcccatttctgtatttcctggtggtttctcttaaattattatcaaatgtattcatcttgatattaagaattcatcagcatctaaaacctgttaccaccaacgatagtagctaacagttattatttcctgtgtgtctgacagtattttaagcttcttaccagtattaactcaataaatcctcacagtcaccttgtgagaagggagtcagttattcccattatttgcagatgaggaaaccaataagaaggtaagtaattttctgaaaggcacacagctagtgagtagtggaggcagaattcgtactcaggctctgtacctagagacctgcttgcttcagcgctgagctgttggaatatttctacttgcccctgcctagacaccctctccttccaggttatgctgaaatttactttctagattgttgtcttatctgttatgttttaagaagtctctaaacacttacattaaagacaccagcaatctttggacttgacttcaaattttactgatttatttttccttgacatgtagaattggcatgctttctgggtgctttcttacctgaaaaaatggctttattttgccctcatatttgattgatagattggttaatagatatttatgggtttcattcaacattttgttgacattgcttctttgtgttctagcattgagcattacagatgaaaattcctatacagtttttctctctggaaattcataagcttctctttggcatatctcaactgccagcatcactgctcttgaactttggggccattattaagtcagaaaagggttacttcaaaacaagcactgagataccaccagagtccatctgataactaagatggtaactacatgactaacaggccggtgacgtatagagcatggatatgctggacaaaggggtgagtcatatcccaggtaggatgaagcagggtgacttgagatttcactattcagtatggtgcacaatttaaaacttaggaattgtttatttcttggaacttttcgtttaatgtttttggactgcagttagccacaggtaactgaaactgtggaaagtgaggattggaggataagcagagactgtggtattcatttcattgcacagtgcctagaatacagtaggtgtactataaatattttgtaaagggacaacttttctgaaactaaaaatatttatgttttacccaataatttttcttctggaaatttatgctaaggaaatattcagagatgcttacaaagttttatgcatgagtgtccatgttatttgtaattgtgaaaaatgaaaataactcaaaagtttaacagtggtcatctaaagtattgtatacactgtatatataggttgaatagaaggtcatcctattcatttattaatgagaggtacaatctctagggatctgtaaaatctattttgtcttaaccaaagaacaaatttttgacatatcttgaataggatgactataaattatgacttttaaattgttgtaatttttgtactattatctgatatttttatttttatgtattttcgtaagtagtttagagatagtcacattttaaaaatctaagatcaagcaaatgaagcttatttttatgtattcatagtataaaagaccttcagtaaataggtaatatttttgttttattctagaaaacagctccttgaacacagtgaggtaaagctttcattttaatctctggtagacttgtgtattaaattgtagtttgaggataattgacaaaggtataaccttgctgctgatgcaccttcagtagtgagttgttcagcattggtgataaatttctgctgatccttctcactctttcatctgctcttacttttgaatagtaataaggatttaaaagctagaaggctgatttatgactatagtacagaattaaattaaattgcattcatttaacaataacaagcattcagtttctagcctgctgagctaatcagctacagtccattagggcaggcacccttggccctgtgactggtggccatctgccaccacgtagatttgctggtcagtcagtgacaagctcagaagtgttgaaggatacacaagatactaaagtcatgttcctgcccttcagtatggtaattttacaaaggagacaaataagacaacattttatatggtgtaaaattattttgtggcataaaaaggaaaagatcagtgtgggctggaaatatttcctatttgatagaactttaagtgggtcttgaggtaaaggtcaactttacaggagtgggtaactgaatttgaacttaatagagatagtttatgacacatgttgagtatcccttatccaaaatgcttaggactagaggcttttcagatttcagattttattgaattttggaatatttacagtgtagttactagttgagcatccctaacctgaaaaccc

SEQ ID NO: 2645 - DNA, 1056 bp, Homo sapiens
cttaggttaggcaaagatttcctagattctttatccaaaacattatctatttttaaaaattgataacatttaaaccttttactctgaaatatgttgttcagtgaaggaaaagacaggctagactgaaagaaaatactggcaaatagtatatctaacaaaatatttatatcagaatatttaattaatgctcaaaatttaacaattaagaaaacacagcaaaaaattggtcaaatatttgagcagatatttcactaaagaaaatatatgttaacaaataagcacatggaaatatgctcaacatcatttactcactagggaaatgtaaattaaccccaatgaaatagtaatgcacactgaatagagtagctacaattaaaaattgaccatatccaggtactgtgactcacgcctgtaatcccaacattttgggaggccgaggtgggaggttcgcttgaacccagcagttcaagaccagtctgggcaatataggaagaacctgtctcattaaaaaaaaattgaccacaccaaatatttataaatacatggaggaacccaaactcaactacactgctggttggaatgtaaaatggtacgactaccttaggagaccgtttttttaaaagttaaacatacacttatcatataatccagccattctacaccttggtatctacccaacagaaaagaaagcatatagctatacaaagacttgtacaactcaaaacaacctagatatctattagcaagtgaataagtaatcaaattataccatttccatacacagcaatactactcagcaataaaaaggaatgaactatttatatatcacacaacatggatgactcttaaaataattaggctgagtgaaagcctgactctcctccttcccctccccaaagtacataatggattattctatttgtgtaaaattattggagattcatactaatccacagtgacaataaaattattgattacttggagagggaatagctagagaagagaactttggggggtaatggatacgtttattaccttgattatggcaaaggtaca

SEQ ID NO: 2646 - DNA, 1914 bp, Homo sapiens
ggaaggatttgcggacgcacgctcttgaacgtgcgtgttctcagaactctgatatgtgtgtctcggcagctgacaccacgtgtccacatctatctttgcagactgccccatccagcttagtgaacagctgataaatgcctgtagcaagcagagcgaggcagctgagccagaacttttacaaatgggagcaaacatctgccgtggttgctcgtggtagaggggctgttattagtgttattacagttggggatggataaactgcggagcctcagatggttctgtggagatggaccaacaatggcaccacaggtaagaagaggaaaggcacacccggcagccactccctcttgttcaaatgttgttctcttggttgtttgttgattctcccattgtattagttcattctcacactgctataaggacatacctgagactgggtaatttacaatggaaagagatttgattgactcacagttccacagggctgaggaggcctcaggaaacttgcaatcatggtggaaggagaagcatatgcatccttcttcacatggcagcagcaaggagaagcacagagcaaaagggggagaagctccttataaaaccatcagatctcatgagaaacgcactatcgcgagaacaggatgggggaaactgccccccatgattcaattatctccacctggtccctcccatgacacatggggattatagggactacaattcaaggtgagatgtggggacaggcacggtggctcactcgtgtaatcccagcactttgggaggctgaggagggcagatcacttgaggtcagaagtttgagaccagcctggccaacatggtgaaaccccatctgtactaaatcccattagtatataaattagtctggcataaaatataaaaattagtctggcatggtggcaggcgcctgtagtcccagctactcgggaggctgaagcaggagatcacttcaacccagtaggtggaggttgcagtgagccgagatcacgccactgcactccagcctgggagacagagcaagactccctctcaaaaaaaaaaaaaaaaaaaaaaaaaaaaaaaaaaaagaaaagaaaagaaaagaaaaaaaagaagaaagaaagaaaaaaagagatttgggtggggacacagccaaaccataccacccatcaaagcagggcactctcttccctcacctgctttacttttcctcaaagcacccaccatcccctctggcataaacgcctggatttattcccagtccccttcctggaacatgaaccctaggggaggcttccgggatgttctgctcacacatgggaggagctcaaagagcctttgttgattgaatcgatgatagacaagctatctcagaggaagatttgaagtgactgggagctccttctcaaccctctccctgagacctgctcacagagcatgaagtctaaattctggctctgaatgagtctgagcaacgcctgagtgcccagcaacctcagctaagcacagcaagtttcggtttgtggcttcctccctgtgccgagcagatcccatccttggggagtccccagccggtctccacagtgtccagacaccacggttctcatgaggctctaccctccctgacttccactcatccaagggcctccaagtcttcaaggccagctcaggcccagccctccaagaaacagtttcttctgatgacaccaacccatcctgatgtttcctgattcccagttcctatgggctccaggcctattgcagtccagggctctgctactgaagctctgggtctcaccaagtgggaggtatgactgttcatgggatcaacagaccccagagtccaaggtccagggctcttagattaggtagaatctggtaagatagtaagatactaccagatactggtcaggcgtg

SEQ ID NO: 2647 - DNA, 5193 bp, Homo sapiens
gtggggtgggggcggggcctggctgggcgccgggacgggaggagtcccggcggcgcctcggacttttgctcccacaagtcctgcctcggaggcgggggagctggaccagcagccgcctggagcgtccgagtcaccgtcgccggggctcccgcgctccccagaacggtgggacgcggggctcggcagccgccagcggaacatggcgccctggacgctgtggcgctgctgccagcgcgtcgtgggctgggtgccggtgctcttcatcaccttcgtggtcgtctggtcctactacgcgtacgtggtggagctctgcgtgtttctacttgtccaattctgaaaaggaacgttatgaaaaagaattcagccaagaaagacaacaagaaattttgagaagagcagcaagagctttacctatctataccacatcagcttcaaaaactatcagatattgtgaaaaatgtcagctgattaaacctgatcgggcgcatcactgctcagcctgtgactcatgtattcttaagatggatcatcactgtccttgggtgaataactgtgtgggattttctaattacaaattcttcctgctgtttttattgtattccctattatattgccttttcgtggctgcaacagttttagagtactttataaaattttggacgaatgaactgacagatacacgtgcaaaattccacgtactttttcttttctttgtgtctgcaatgttcttcatcagcgtcctctcacttttcagctaccactgctggctagttggaaaaaatagaacaacaatagaatcattccgcgcacccacgttttcatacggacctgatggaaatggtttctctcttggatgcagtaaaaattggagacaagtctttggtgatgaaaagaaatattggctacttccaatattttcaagcttgggtgatggttgcagttttccaactcgccttgtggggatggatccagaacaagcttctgttacaaaccagaatgagtatgccagaagtggctcaaatcaaccttttcctatcaaaccacttagtgaatcaaaaaaccgcttgttggacagtgaatctcagtggctggagaatggagctgaagaaggcatcgtcaaatcaggtgtatgaaaacattatagactggtattttcaattttcatttgcaagaaaatgatcagtggaatgaaataactgaagtataacagaagatatattttttaaaacggaaagcctttgtacagttcctgggattcacagaagcactactccagagcagaatgatgccttaatcttaagtgtccatttgtgcagcattgacttagagctacaaaagtgacttaatgttattctggaaataatacttacctgttatgagttgctataatatgagctgtcatcacattttaacatgcatatgtattttttgatacctgaattacattattagaataagtatccatatacattttcactccaaaaacacaagcttaaaaactttaaagtacatctagggcaaatggtggctgaaagtgaataatattcaaattactgttgcttgtactgtataaggaaaactgcttttttaaattgggtatttgctaatttataattactattttatacttttcaacatttttaataactttttttattgttggctataacagaaggattcagatatctaaatatcatttagaacatagaacacattggtctaattcatcgaaagcttagttatgagcattaatacaaccatgtagtagagcaagtgcccaaggtttaaagggaacttggcagtataagaaatattttgggttctctctgctattttatagctttttttgttgaactttcaggggtatgtacatgggcagagaaacacaaaggtacatgtgctggagaatactggacacagtaggaagaagtataggtgtccagaagaaaatctaagaggaatattgtaatttgttaaaaaaaatagttttgagttttaacagcagttagaataaagcatgctgttgacttcactttcaaatttcagtgtaggtaatgactaaaaattactttgaaactttttacagtaatactgtaatagcttaaacagtgatttaaaatgcaatttaaactaggcaaaaaaaactttagagtaagttttcctcctggctgtcagttggaaattctaacctgagtggtcattttacattcccagtctcttgagaagtggattctactcttagacgcacagtctgaagtctgacttcctaacggcaacccctttatgactagacacatttctcctttttccttttaaaatctaagcgacaggaggtgttgcattaactccaaggaaaagtacagaataaacaatgtagaaatgtcactcctcatttacaccttttagacagacagacacacacacacacacaccccccccaaaataattgattgcttccagtgagtgggtggagatgaatctcagcagcatctgtgagtactacaggttggagcttcctgtctgtaaaatgggactgcaggggagggggtgttgtgaataagttggactggatgacttctaacattctgtgatgcctaattttgcaaaatcacttttcattcacccaataaatttttttcttcttttttccacagagttttgctctgtctcccaggcaggagtgcagtggcgggatcttggctcgctgcaacctctgccttccaggttcaatagagtctcctgcctcagcctcccaagtagctgggattacaggctcatgccaccatgcccggctaattttcacatttttagaagagacgaggtttcaccatgttgaccaggctgatcactaactcctgacctcaaataatccacccacctcagcttcccaaagtgctgggattacaggcgtgagccaccacgccccgccccggtaaattttttggagtaccttctgtatgctaaataataaactaggaatagctctgtcatttcctagtacagcataaattttatggttgctactgtaggtttataatttgtttataatttggcctaatttccatcagccatactaatattggattttaaaaggaggcaactttttttctttttgaaccaaaggaatgagttagctttgaaaacataatttgggatattatagtatggattcttctacctttgtttcaactccttagtaatcttgattctagcaaactagaatgagatttaagagataccaattattgctgggtgtggtggctcatgcctgtaatcccagcactttgggaggccaaggctggcggatcacctgaggtcaggggttcgagattagcctggtcaaaatggcaaaaccctgtctccactaaaaatacaaaaaaaccccaaaactgtccaggcatggtggcacacgcctgtagtcccaactactcgggaggtggaggcaggagaatcacttgaacccaggaggtggaggtcgcagtgagccgagatcgtgccactgcactccagcctgggcgacgagtgaaactccatctcaaaaatatatatatatatcaattaccaactaaaaacataactccagtttggcagtttgcatattataaggagataaatgttaaaacatacttgactactttcagaaatgttctcctggtactttttgcatttctacattcagataaaaagatttgcatgcacctggctaacgccaagggaacttcatttttttcttcactattatgcactttcatggtatagtctttctcagttcttttaatttttgttatttaacatctttaatagcacagcaaacatcttttcagaaattttcagttaaagcctttgaattacttatctttgatttaatttacagccagcattttgccacgttctaaataatatttagctcaactgattcatacgtattaatgaccattctagcaaaggcctacaagtggtgtgggaatcagggaaaggctgcctctttggtatctcaactggtattgattattgctatcaactatttggggagaaaaaatcaaaatgaagccctgtcaaattttagaagtactatctttggtccttcaaacactttgtgatgacaccttaagaaaaataaagttgaagttcaggtcttgccattgccattacagacaaattaggagacttggtttacctgggaacaaatttacttgaatattcagtacctgaaactatgccaaaccaaagagcagctgcagtacattcgttattttaaatgaacaagtttacaaagtttattttcatctatacgtaaggatgatttttttaaaactttttacatattagtggttatgatccaatgtgtcatgagtgaatttaactgtaaggtggtttaaatcaaatatgcaatgtttacttgaattgtatttctattagcagattttgactatgtttacaggacggtttaaattaaggattatcaggcatgtgagatctttcagttatctttaaagtagatgtatattaagggcttagatttaggatctacatattctgggcattgaataggcagtaacttacaaataagttttgcttaccttttgttctagggactagcactgctatcaatggaaagtatttttaactaatctgttattaagaaagtcatatttttgcatttcagccaaaataaagaccgcctgtaataatctgttagaaacagataatacatgtctgaaatccatatgtttcatatgatctaaactgtattttccaatttaaattaaaaatgtaatatagattcagaaaggttcatatttttctaatgacttcattctatattattttgttaggttgcataaagaagcaaggaattgtacttgtattaaaagatgaagaaagctattaggtatatttgtacatgactgcaaatgagtctatgcccgtttaaaagaaaagatggacactattttaaagtgagctttaatatgcttttatataaacaaatttgaagtacagtttagtttggttgtgtttacctaacaagtaccataagccttgtgtttgttcttatttgtataatcctagcctgtgacttaatgttgatgctttgctttgtcttttggctggcctaacctacattgacatgtacacagaacattttaaaactttttttttcaaaagtcataatgaattactttattaataaac

SEQ ID NO: 2648 - DNA, 9945 bp, Homo sapiens
ctggattaggccatcatgtgcattaacacacttggctgtgagcactaggtgcagccaagatgctgatgggaaagaaaagtctaggttttgccccctgcgtcgttcctcgtgacaggattatgctgagggagggcacattagattgactcacacatactgaaatggtcatagttattgaggttacccagtttccaggcctgaactagtaaacccagcaatgagaatcagccagcattagcaagttttccgtgtgggagtggggtgggggtggggactggagggagcaggcgctgaaccaggaaaggaggaggatgctcatcattggctaaagatccatgcctggaaattaacggcgttaaagtgagacttgcttcaggttccaacccggtaaggcaaatggagaggctgtcaggagaccagaagtttacctcagctattgcaccgacgcaccacgtgctctggtgcacatccaccgcctcttcctgcctcagtttctccttttgtaaaacaacagcttgtaaaggcctggggatcttctcatccacgggagttttctaaggatgcaggcgaaagaggatctcactctgttgcctaggctggaatgtggtggcatgatcacagctcactgcagccacaaattcctgggctcaagcaatcctcctgcttcagcctcctgagtagctgggactataggcaagcgctactgtgctcagctctcactctctggctgaatgtagaggactctgaaggcttaggcaagaggggagttataaggcaccacagaaccctgaatgactgcatggagcagaacccttcgcaaacctgctcttcaggcctcctttttgagacagctggaaaagattctttctccttttctagcaattacttcctccctccgactcaaatgcctactcagcctctagtattcagtgatctcacacgttcacccatgccggagtgcagctgtatgatcttggttcactgcaacttctgcctctcaggctcaagagatcctcccacttcagcctcctgagtacctgggacaacaggtacgtgccaccacgcccagctaatttttgtattttttgtaaagatgggattttgtcatgttgcctgggtaggtcttgaacacctgagctcaagtaatctgccctcctcaaagtgctgggattataggtatgagccactgcacttagcctactcttctactccttttttttttttgagatggagtcactttgtcacccaggctggagtgcagtggtgcaatcttggctccctgcaagctccacctcccgggttcatgccattctcctgcctcagccttccgagtagctgggactacaggtaccagccaccatgccctaattttttgtatttttagtagtgacagggtttcactgtgttagccaggatggttttgatctcctgacctcgtgatccacctgcctcggcctcccaaagtgctgggattacaggcgtgagccaccgtgcccagcctactcctcttaataaaagaaaaaaggtatagagtaatttatgccatagattattaatgataccaacaaagcttgtagagggctaagagagataaaagatacatggaagcattgtctgctagaggaaaagaaatagacattaacttttaaaatattgatggtttacgtgtagctatgtgtcttaataacttaagaataaccccaggatattaaaagtagaatgcataacttctaagcaacgagaaggaaatttgatctatctaatgaaagttgagaggaaaaaaggggacaaatagaagttttgtaaatggaaacacaaaatgtggtagaagtaatttctaacaaaggaggaattacaataaatataaatgaattatcttaccagtcaaaatcaaaagcagatcctttcagattggattaaaaacaagatccacacttatgttatctgcataagctgcatttaaacaaaagcttacagaaagattaaaaataaagacataaaatgacatcagacaaatatgatcagatagcaaattaagatagcaatttcaaaattggctcattagaaatggagacaagttatcattgtcaaaaatcatagatttaatatattggcaacataaacaatatatcaatgtaccttatgttttaaatacataaagcaagaatgacagaactgtggtgaaataaaggcaaatgaatagctgagctagagagtctttaaaaattgttagtttaaacagataaaaaagaaaaagcaaggacataaaagttgtaaacaagaacatttagaaggaaatctggtgctttaaatacctctaaaagaataataattaaatacattttccactgaagaagctaaggtgaaagctctttacaccaattacacaacactgatgaaagaaatcagagatgacaccaacaaatggaaaaacattccatgctcatttataagaagaatgaatattgttaaaagagctatacttcccaaagcaatttacagattcaatgctatttctatcaaattaccaatgtcattttccgcagaattagaaaaaactattctaaaatttgtgtggaaccaaaaaagagcctgaatagacaaagcaatcctaagcaaaaaggacaaagctggaggtatcaaactaaaaaacttcaaactatattacaaggctacggtaacaaaacagcatggtactagtataaaaacagacacatagaccaatggaacagggttgagaacccagaaataaagccacacacctacaaccatatgatatttgacaaagtcaacaataacaagtaataaggaaaggacttcttacttaattaatggtactgggataactggctagtcatatgcggaagattgaaactgaacccctacctttcaccatatacaaaaattaactcaagatggattaaagacttaaatgtaagacctcaaactataaaaacctagaagcaaacctaggaaatatcattctgtacatcaccttggaaaataatttatgactaagtccccaaaaacaattgcaacaaaaacaaaaattgacaaatgtgacctgattaaactaaagagcttctttctgcacagcaaaataaactgtcaataaacaggcatcatacagaatgggagaaaatattggcaaactatgcatctgacatatgtgtactatctagaatctataaggaacttaatccagcaagcaaaaaccaagtaaccccattaaaatgggcagaagacatgaatagacacttctcaaaagaaggcatacatgtgaccaacaaatatattaaaaagtacatcactattcattagagtgaatcaaaaactacaatgagataccaactcatactagtcagaatggccattactaaaatgtcaaaaaataacagatgttggggaagttgcagagaaaaggaaacacttatacactgttagtgggaatgtaaattagtgcatctagcgtggaaagtagttttgagatttctcgaagaacttaaaacagaactaccattctacccagcaatccccttactgggtctatacccagaggaaaataaattgttctaccaaaaagacaaatgcacttgtatgttcattgaagcactattcacaataggaaagacatggaatcaatctagatgcccattactagtggattggataaagaaaatatggtccatatacaccatggaatattatgcacctatgaaaaaaaacaaaatcctgtcctttgcagcaacatggatggtcattatcttaagtgaattaatgaaggaacagaaaaacacatactgcatgttctcatttgtaagtgggagctaaacattgagtacacacagacacaaagatgggaacaataaacatggggaccactagagaggggagggtagaatggggctagggttgagaaactactagtgtaaaattagtactgttgggtactatgctcactacttgggtgacaggatcatttgtacaccaaatctcagtgtcatgcaatttacacatgtaagaaacctgcacatgtaccccatgaacctaaaataaaaattacaaaaccccactaatgtgtggaaaaagttaagggaatggacacccatgaagttgagataagttataggagataaggaagctataattgtttgcatatgtaaaaatataaaaagagcaacaacataatgctatcccagacaaaggaggaataataaaataataaagataatataaaattcaagaaataagaaataataacaccatatacgtgacaacagacaaataagtttgaattctttggaaagatgagtaacatatacaggtatctggtaacactggtaacaaaaagttgaaaattagcaaaatatagaataaaaaaggtgatgtaaatttagatgtaatgtacagatggataattatagatgtaatgaagattataaagacagtaaatactattaatgagatctataaaccgattaaatgaaaccaaatcattttttaaaaattccagaatcagcagaagaagaaataaaaaatttgaaaggtctaaaaatcataagataaactgacatagttatcaaaaaagtccccattcttactcctactcctgccccaccaaaatccgaggcccaaatgatttataagtgacttctgaaaaaaaaaacgaaacaaatatttaaaaaaaaaatcaccctcctttcctcatacaagttgtcctagataatagaataatagaaaaggccaaagtgccttaatcattctttgatactcatgaaacagtaattatttttacttgataaaaatattgtctataaaaaattatagaacaaatttatttataaatttgtgtgtaaaaattctacgaaaatcattagatcacacactaaaatattatttgagaaaagaaaaaaacatgatgaacatgtatgatttacctcagtaacataaggaggatttcatatcagaagctctatcaatgtaacagtagtaatttactaaggaaacaaatcatatgtttagctcaatataagtagaaaaattattaaataaaatgtaatttctgtttataatacaacttttcacaaaatcaggcataaatgagaaccttattaactagttaaaggctgtatatgaacaactttcagtaagtattttttaaagaagaaacttaaggtatatttaatattagacaagaaaacattatgtcgccactactagttaacctagtactagtgggacataaccaaatataatgaaacaagaaatacaatgagatatcactgctggaagatgaaagagcttcagatgatttaatcatttatggaaactaacagtcttctccaagattttgtatacaactagtaagagtatttctggataaaatatattaaacaaccaacaatattttctaccagtagtaaattagtaagatatatccatcaagtataatataccagcaaaactttaagatataaatatattaacctattaagaagtctaaagattgttttggagaaactaccatctctatcaaaaggcatacaagatctgaatgaatacagagataaaccatgttcatggatggggcaacttagtattttaaagaggtcaaattttgccaaattaaataaaaaatgtatagaattccaatcaaaacttatacagagaaacttaggtctaaaatatattgtgaaaaacaaaagtccataagtaaatgataattttggaagagcaaaaaggaataccttccctaccctctattattatataaccataaaagaaaaaaaaatagcctgccacatgatcagacaagtaaaacaatgggataaagaaccataaaccgtcccttatggaatatggtataaaattaaggtgactattttaatttgcctgtgaaaattttactgcatttatgcctattggcctagcaaaattaaaaataatgtcctcttttacttttcagtttggaatatattgtatgatgtcttcatatataatcaattgatataataaatcaatggaggaaagataggctttttaaaagcatatagtattggcaaaactggcttgttaaatggagaaaagtaaaatttgataaaattttgaattaaacattagtatgtaaaatgtaaagataaactggtgagaaaataatggaaagtaccttggcaacttcggggtggggaatgatttctggaacaatactcccaaaattaaaagtataatgggaaaaaaatgaatggatctgatacataataattatgaatttctgttcattgaaggacactgtagataaaggtaacagatgggagacagactgggggaagataattacaacatttaaaactgacaagggattaatacctagaataattaagcaattcctgcaaatcaacaaagaaaagagagtaattggcaaaaaaaaaaaaaaaatgaatagacaattcacagaagggcaaacccaaattacttacatgctcatgaagacatccccaacatcataagtaatgagagagctataaattaaaaccataatgagactcattttacacccatcagattggtaaaaatgagaaagtcagatggtatcattgttggcacagatgtgaaaaaatgagaatcctcatgcactgctggtgggagtggaaactggtgagccattctggagggcaatctgttggaagtatatgtatatatataccccttgacccagaaattcccggagggaaacctatgcagggtcacatgtgacatatacaaggatatagctatctagatgaaatagcattacagtttgggtagggaggtgttgctttatggaaatgttcagaaagaaatggagcacagtgaacccagagctggctctctgtaggcttatattctttgctgaatcttcagtaagaagaaagcaaaggttacttccattccaccccagtcctaggcattgtcaaggcccaggtacacccttgttcctggcactctccaaactttcagggccctgttgtgaaattctctgggaagttaaatacatgaatgatgttagaaattgaaaggagcattttaaaaaatgagggttaccacaagatgagggcaacgtttaactgaaaggggaaaatgatacaatataggtttcagtgatagctaaacaacagaaatctgtgacatcactgagtgcagacacttagaggccccaacagaaatttggagacctctttagatctttccttctgtgtagtgaaaagaaagcaatttcataagagaacatgacagtgaacatttctattgaaaaccacaaagtttttgcaattttagcagaagtctagttttgaagatcaaatcattgagagagaatgtacacttgtttttttgtcatttactgaaagccagaaaaataggtgaagcttgtcttaattcagatggcaccttggaaaggagatcattctgatatcttcttctcactcctatttttttttttgacttttcaaagagcaacagaacattggagctagaagtagcctctaaagttaagtaacacagctccagtctgctatggaattcttcctacaaacatgcatttccttatatgtaaacctcaagaatctactggaaccagaccattgatccattactttaagatacattactccttccttaagggagttatgtaagctctttctatagaggctatgcctggaaagctgcctccctgacaccctagggccaggttataactcttggacctagcttgcctccactaaactccaaatttgggggttacattttttataagtcatgttttctcttgaatggcctcattgtggtagatgaaagaaacgaattttaatgaaagtgaattaatcttaatgaaaattaaatagacttttatgactccttagacatttaggaaaacagcgaaatattgaacttctatcccttctttagccatcctcctagttatttacaggtattcccagaggtatacatgatggacaaataagcctcctcagttttggttgccaaaatgtttgtttccctggtagtttcatcactgttgctgctggtggtattccccatggatggtgccaagagagttataccaagggttctgtcttctcttgctctcaaaataccacctcaggccattgcttggcttcctgctgtggctaaggctcttggcatctctcagtgggagcacaatgccattctgtccaccattaagagtactgctgttcttgccccctgatactggtgctacttctgctcatatcttctgcaatggaaaaaacccctttctcccaaccttgtaccattgtctgttacactggtcccacagtggtatgatcccttactctcaaagtcttaaagaaacgatgggtaaaacattccatccaggttgttttctttccccatgatttgggcacaagtccctagggactgagccacgagatgagtcaaagggtggtcctcagtgtcattcttcctctattgctcagaggcacttttcaggcatctctgcctgggctttggcagctattccttagattgacttacttcccaagaggctcctcaagcctgttcagccctggtcgcccctccacagtcttctggtctttccctgactgtttccattttaggctgagagcacctgcatcttgaaccagggtgcctttgcactttagcctggataacatcacagctctagatttggtgaaaggaaacagaatcagggaacccctgagccacagccattttaggatgtcgctaggctcctctacttcctctttccttattgctcccaattctttgcttccttcttgctaagttggaaggagcccacctccccctagaaagaggatcatttcataagctggattctcatgtagcatggtcattgcattccttaaactcacctctaggtcccaaatgataaactaaaagctgcttgagttattcaagtaacaggaaaaatatagtattgcaactaagaatctgaactttgaaatcagagagtctcggattcaaatcctggctcttccctttctggctgtatgctttgggcagattatttaacaactctgagcctctttagcacgtacttcacaggactattgtgattaagtaagcactcaatgtgtgggagatattattgtttctaattagggagcaaagcaaaactgcacatggggcatgggcaaggcactcatggcttcccttctcaccccatgtggggaggtggaacaagcttcctagtcttagccctttactcagatgccagcaattttctgccatgttacctggtgatggggccctctggtggcaggagagaatgtgatttctttttgagagaccagcttgcccttagatctgctttcaagtggaggcgaagggttggggaaaaccccagcagattctgaaactgccatgcacaaaggcctcagactcagatgctgagctgtccctgttgctgcagaactgtttatttccttaggatgttgaacgtaaaatatacaactagacactgccttctcttgctctcaaaataccatctcaggccattgcttgagcctcacccaataatttggattctgatatgaaaatcaacttccctacctccagccttaggatgcttctgtattgttaatgccaatgttagcagcttgtttctgaatcattggggagctctgtaaacacatgttgatgggaattgacctatcttcttaaggttaggtccttaagaagccctaaacattgaacaatgaaaatatcctcaattttagaaattaaaaaaaaatctgaaattataaaacaagtattaaaaagtcaaagaaagataaacttttagctataatgacaaccttaacgtccttttttgaactatcaagaatatatttcttttccaatttcagcttttttggttaattttatttttctagtatcttacct

SEQ ID NO: 2649 - DNA, 992 bp, Homo sapiens
tggcaggaaattagtgagaaagccgttggacttcaagaggtctggaggctgggaatgaggagcatttcagtggctaactgcatggatctttgggaaccaaataaaacaatgaccgtttcagagactgttgcatggctggtaacccaaggctatctttcatcaaatgtctttagtacactctcaagaacttagacctaatgcccatggaaattgtaggagaaaggaggccaaaattgcctgaaattaagtattgttctcttggtttttaaaagggaaattagattaattgtggttagaagtaaaatttaaattccctagagagtagcttaattcttaacatacaggaaaaattgccagaggaatctttacacatagatactcagaggatcatctatcaatcagttgtacttcttgggacttctagtgtgatgcacaaggtggatctcttagaattgacagatattttgcctctttctctgtgtaaattagggctggaatgggaggagcagccaagagatttcatcagccacagtgtgcatgatggatgagaacacgggacacataccagtgaagggcagaaaatgttacttatcgacactggactaaaaaaagactgtgcgtaacccatagataagccaactcttattgtgataaaacatcagacaaatccaaattgagaacattctacaaaatacctgaccagcactcctgaaaactaccaagcctctcaatccatggatgttcttttacttggtcatcctcaccccatggttcaagggtatatgacttattaagagtgaaaatgagaagaggaggtggagcaagatggtcaaatagaaccattcactgatcatcctccctgcaggaacaccaaattgaaaaactatctacataataaagcaccttcataagaagcaaaaatcaggtgagtggtcacagtacctgattttaacttatatccactgacagaggcactgaatggggtaggaaag

SEQ ID NO: 2650 - DNA, 993 bp, Homo sapiens
tggggcttgtgccagccgcggccgccgaggcccgtgccccgcggggggaacagatgaagcacatctggacagctgtgcggcctcctcgcgggccgacgtcagccgagcacgtcccccacgtcctctccttctcgccacttattatttattcgttttcccaaagaagcgactagggacccaagtttaaaaattcctccccccacccaatgcgagacgtggccagatcccatccaacacacggtttaattttcatggggctctgggatcaaaagaacagaaacagcaacaacaaaagcccagccgctgtctgattttaagctggcaaagtgggaaaaataaagtgttgagtaaacagaccaagttggaaacttttcagcattacctaagaagcaaaggctcaattttggctgcttcattcttatctcttctgccacagttctaacgtgcctgatctactgagaccaaggatgaccaatgactcagaagggaaaatgggatttaaacacccaaagatcatggggaatttcagaggtcatgccctccctggaaccttcttttttattattggtctttggtggtgtacaaagagtattctgaagtatatctgcaaaaagcaaaagcgaacctgctatcttggttccaaaacattattctatcgattggaaattttggagggaattacaatagttggcatggctttaactggcatggctggggagcagtttattcctggagggccccatctgatgttatatgactataaacaaggtcactggaatcaactcctgggctggcatcatttcaccatgtatttcttctttgggctgttgggtgtggcagatatcttatgtttcaccatcagttcacttcctgtgtccttaaccaagttaatgttgtcaaatgccttatttgtggagggtaagtgttagtgagtattttcatgtacctttctctattagtgagcatttatgtagcccttcatattaatatacc

SEQ ID NO: 2651 - DNA, 992 bp, Homo sapiens
ttttaacaaacgtacccattgaatacagtgaagctggggaagcccagcccaggagcattgcctcactgggtcagtcccactgctgggctaggacacctgtggtcccttcttctcaccctggagctgtgtctgtgtgaggggcttgcccctaagccagcccacctggcaccatgaggcccctgccttatacaacggcgagtcgccccagttcgccattgcagccccggacgtgcgcctcccgcggagccgctcgctctcctgagtcggagtcgggaacccggcgtccgttgccatggcgactcccagaagggaaagtctccatggtaaatgaaggaagctccagtgctgcccccagctggactctgagaacgctggcagttggggtcctatcacacaagtaagagattggaagtctcctcgctatcaaggttgaaaagacccagagaaaagacccaaagacaccaacactgaaggtctcccagtgaaatggcccagttaggccacagcatcatgaggctcacagttggctttcttcacctccagcagaatacaaaatcatctttttagtttccaattcttaaatataaacagattgcaaagaatcactggatatttgagaaaagcctaaaacacgatggacagaagaggaaccagcaccaaggaaaacagaagaaaaaataacttggaagaaacagagactatgcacaatataaaaacttgaaaaacgtcatcattaatcattagtaatactctcagaccgttaagagaagacgtatcactggcctgtgctttgggatctggagataatacttagcatcagctgggtgtggtggctcatgcctgtaatcccagcactttgggaagccgaggcaggcagatcacctgaggtcaggagttcaaggccagcctgaccaacatggggaaaccctgtctctactaaaaaacagacaaacaaacaaacaaaaaaacacaaaaattaaccgggcgtgatg

SEQ ID NO: 2652 - DNA, 8240 bp, Homo sapiens
ctcaacataaaaaatatatatatatgtggttacagccaaaaggaactgtttgcttgcaatctgttcttcctggcaccctgtatgttccatgagagataagcatctactgaagcataaaaagtgtcttacaaaatcatagtaagtaaatcagtcactacattctgtattatcaatagtcctgggtgtcattaaggttctgtctgtatagaaaagattaggtttgtgtatatgatattctcctaaagcattttaacataaagtcatggtcactgaaatctgaaaatattcacatttcagtcttaatcaaatctagtacctcaggatttttcaatcatattcagaaagttcaaccatttcgatgtgttagctctagctctaagttcccaggctgaatatccagtggtctagttgcataaattattgtaatttgggcagagaattcaaactgtttgtaaactcaatttcaattgaaaaataccacaatgtcactaataatcaacacttaaattaagtaatcttcagccccacagcttcctcagaacccccaaaagtaggatgtgtaatctaaaaagattcattgagcaaatatttatttgtgctatcaaagaagatggcttcccccaaaagaattcctccaaatgttaaagttggtaattttctgcaggattaatatgtagcacaatcagaaaaaacaaaaacaaaaacttatataaggcagcattccctaggagagccacttggcagtcctgcctgcatgtgccctacatgagaattccatgcttcctctgaatcttcacaagcatatcatttaaattaagagcataaatgaggccacataaatgctttcttttccagtttttttaaaatttacttcccccttccagagcagattgcaacagtctggtataattgatcttgtccacaaaaaatcgaccgtaatacattaaatagttctgtaatgtggcaccgttaaaaaggatctgcttcaaatgactgtgaactgacaaggaaagaaaatgttatatagttggctgggcgcggtggctcacgcctgtaatcccagcactttgggaggccgaggcgggtggatcatttgaggtcaggagtttgagaccagcctggccaatatggtgaaaccccatctctactaaaaatacaaaattagctgggcatagtggtgcacatctgtaatcctagctacttgagaggctgaggcaagagaatcgcttgaacctgggaggcagatgttgcagtgagccaagatggcgccactgcactccagcctgggcaacagagcgagacttcatctcaaaaagaaaagaaaagaaaagaaaatggtatatagtttaccaacaggtagcctaagatagttatatgcagtgattaacgattacaaacatacaatgtggatactgataatcatttttactgccctcctttaaggaaatggagaaatgtcaggagacaaggtacagctgaaaattttcctccagtttgatctattctgcaaatctcttccatccttgtccaggttattgacactatttccgcaggattttcaggctgttcttttctcatctggactattccttagagcaggaattttattactaatctccaaactacctctcgaatattagaattattcacattccaaattataatacaaagatttcagcaactgctctctgatgatattttttttcttccagtattgtctgttaaatatttgaaggcaggtacacactgcctcaggaacaactctgtcctctctccaaatgctccagattcttctctccctcacagccctctttaactgctgtaatctgtaagatctactcttcgggcaagcctctatgtttaagaaaacactttcaggccgggtgcagtggctcatgcctgtaatccagcattttgggaggctaaggcgggcggatcatgaggtcaagagattgagaccatcctggccaacatggtgaaaccccgtctctattaaaaatacaaaaattagctgggagtggtggcgtgtgcctgtagtcccagttacttgggaggctgaggcagaagaatcacttgaaccctgaaggcagaggttgcagtgagccgaggtagtgccactgtactccagcctggtgacagagcagagcaagactccatctcaaaaaacaacgacaacaacaacaacaacaaaataagaaaacactttcagttgggggtctgctcagatatggtctaaatggcaggtgaaattgagacaattacttggataaatcaaatcacatcctcctacgcaattcattcgaatatattcagtcattaaacaaatattttttaaagaacctattacagactcaatattatgctgagtgctgaagagaaaatggtgagcaaaatcaaataaagtccttgccctcatgggtaacagcctaatggtgatgatagccaacatttattcactgcctattatgtgcatgaaacacttttcatgactcctgtcatctaactttcagcaaaataaatatgagttattagtacaaaaaaacacaccatacagagacaaaagaagttgtgtgtgtgtgtgtgtgtgtgtgtgtgtgtgtttgtatttattttaaataatcaacccttttcctgcttttccccagaatatatgaactcaagtcttctctagttcgagaacagggctgggggtgatggcagggggttgctttacattgctttgtattggaatttgtattgtccagggggaactcattaccacctatagatacatagccacttgcccatgttttctcagctatttagcagacacaggatttgaacccaagatttcacattcaggagcttatgctctttcttactccactggcacacctgtgtacccctacactcttctgcccctaaggtagataaatagagaaaaagaacaagaggggtgatatggcaaaagtatctcaatagttgcatcaattctcctttgctttgtgaattctggatgaaacaaaggacaactataataattcttgcttgctcttctctttaaacatgtagtagtcctatttgagaataagtgataatgacaactttttagaaaaaaatctacatgacccatcattaaatgggaaaccatttttttcagaaaaaaaaaattgttataatggagattacaataagatgcctacagaagattcccattgtgctatagtctaacttaaatcacaaatacgcatttatattattatatcattaatattagctcattgaataggcatttattgagaatggactataagaagagctatatgttaagagacatattcattcagacagacattgcttattgtccacaacaacgatgacttttaaaagtaagaagaggaagtaaagtaaaggggcaggagtgagtagagggaggagtctaaggtgacaaccagctttctgacttaagctgctatgcatcctgaggccactggaagaaaatctggtttgagatttattggaggttttttcttttcttttctttttttgcctttttgagttttattttcttttccactttgagggtgttttgttttgtttccatcggatgctctagaagaggcagagtgctcattggaggttgacagtgtcataacccttgtctgattatctcgattttatgagcccaattaaggatgataaaatatgtgttttagagatttctgccatccttacagccccttaccatccctaaggatacttctcctgactattaatcacattttaatttttttctcttttcagtacaattatgtgagtttgtgttattgcatggccatgcctcagtggtctacccttccttcacaccacttttctatagggaaaccaaaggtgcatttataccataatttagttgaattcagcagtagttacaaatgatgttattaaaatctattgggaaaaatgattcatcttgattcattcaaaatgattcattcaaaaacagaggacaaaggaatgtggggaagttaaatgatatatcattgaataaaggcacttcagaaagctctctgtcttcataactgctacaagtgtcctttataacttcattttacccaaatgttttccaaaacatctgtctaaacttttcaactaagtttagttgttattcttgcttcttgtaatttcagagagacctgtgtggttcgatgcattctctgacgttattctgagaagaaacaattaaatgcatactggaagacattttgctcttctacatgttggaaattcggtgtcaccaatgcacagctgcagaatgcacagttctattgttttctttctcatcacagatctgacccctcaccatcttcccccgcccttgagcctgatccttttctgactttgagcctggcaccttgctggtgccggcaggcatcatgaaggcatgggctgggagccagactcagccttgcaaaggaggctcagggaagccgactgacatgggctcaataattagttcaatgccggacacaatgctcaataaggagctgctgggttaatggatgtgtgtgctagctagctgtagtaaacaattcaagttgataacatggggctgattgtctgaacagtacaaaagaaaatggaggactgaccagctctttggtcctccaaggtcaatacaacatttaaagccttcttatagagatatacaagttttgttcatttttaatattcatgtcaataatttaagcaatgtgaaaacttaaacattctcaagcatttatttattttttttggtagagaccaggtctcactctgcttcccagcctgtagggcagtggcatgatcctagctcactataaccttgaactcctgggctcaaacaatccctgctgtctcagcctcctgaacagcttggactataggtgcacgacaccatgcccggctaatttttttatttttattattgtagagatagggtcttgttatgtttcccaggcttgtcattttatgtattgtcttgaataataaaagaaacttggacagagaatagcaggtagcaaattttcagatgtagatttaggataatacaaaattttataatgtgaagtacctcagtaccaaaatcttagctatttataatatgatagcccttgatgtagagctaacttaaattcaacatttccatgactaaataatttgtgggctctaaaatattctcaaaattcctagagttagcatttcttaattgatttctttagcctttttcacattcaactatattataaatacaaaatgaatccattaacatattttataatgtgtctttcagtgtgcttcttagatttagtttgatttcagaaagctaagaaagaaaaaggaattttgcaagccacactcaatcatatctgcataggcatagctatatagacacccataaaattatgcataacccccaggttttcaaatgaacacctcccacagtctcagcaacacagggcaacctccaccctctggcatattcatgtgtccatttcactgtgaaattcttatcttcatcactgctcctcagggggcctctacaactctgcaatgttattgttctgagagaaaatggttattttgtaaaattttccttcaaaaaacctatttaatagaatcacaagtttattctcttcagcagcaagtttgctgaagtacattatttgtccaaaaatagttgaaggccacattgattgaggaagggatgaatactcatactaatgagctttctgtcccgttgttgtggaaattttctgtgaatttgctgggattttctgctgggtcatgcagaacctccttggaatgttatagcctgggaaatgtaattaccccatgacgtttcatttttctcacaatttctggtgtcagaggatggaacaatcaagtcctcactctgaaaggactctctcacatgcccatcagggcagaagggctatcattacagaaatacagcattctcctctgtttttcaagctggtttatctccatcccactacccgaaaagtggaattcagagttcccttagttctctgcttttctgtacatagaactacaacatccaacccagcaaacactcccttcctatacagatattctttaccagcagtattttatgtggaaaacattaacaagagattagtgacaaaagaaattactttgggggagtccattgatctttgccttctaaaatttataagctgctttatataattgtccatgattgccttctttaccctcatcatcaacttccacatatgaaaaagtaacaagaatggggactgagaagaaatagtaagatggttcagactgaacgaagccattcagtttttatacgtgtgtgtgattatttcactataaactctgcttccatgactaaaatcatcacaattaccaagcaatggctttatcccagagttactttagaacaaaaaagaaggcatttgtcatgcagtggcatatctcggggacagctcacccctgtgaaccatgtctgccctttcttcctccttcttttaattaacatttggaaaagaacagtgatgttagcagatagcagagctgggaagggagactcagaaagtgatgtgagctttgtcaatcttcaaccttgccaaggaggacacattaaagtgtttttcatggaaaatcaggctttgtcaacacaaattcaaagcaatgtgaccttgacggatggagatatatatatatatatatatatatatatatatatatatatatatatatatatgcatgctaagtaagaatagcacagactgaagcatctttagagaatataagtgaaccaaataaaaggaggaaaagcatcctaaaagaagatgttaaatccaggaaaaagttgtcaagtgtatttccttctacttaccttttctgctgactgggctgtaccaaaaaagatggggatgaaagctaaccaaatgatgcaggtggtatacatggtaaatccaataggtttggcttcattgaaagtctctgggacacctctcgttttaatggcataaacagtacaagtgaccatcaagaggatactgtatccaagtgaacaaatgagtgagagatcagaaatgtcacacttgagcactcccctggccttctctggatctagtgtccgctgctctccatagtcaatgatgatgtgggggggatccacaacaaaccagacaaacactccaaggagctggacggagatgaggctgaaggtgatcaccagctgagatgctggactaatgaacttgggcgctgtgacagatttcttcccctgctcaaatattcggtggatacggtttgttttggtcagaagggctgcatagctgaaacacatgccaagtcctaggaagacccgtcggaaggagcatatgattgtatctggtgctgcaatcattaaaaacgtgattgaataacagagaaaaatccccgttaggagcacgtaactaagttcgcgtcctgaagccctcacgataggtgtgtcattatagcggacaaaggtcacgatcacaaaggtggtggcgatgattcccaatattgcaacaaacacaggcaccacagcccagggagaatgccactccaatttgatgatggggataagctggcagcctgtgcggttcatgttgggtctctgatccagagggcaaagttcacaggacagctcatccacctggtagttgtaaccttcacagcgttcacagtgccagcagcaagggacccctttcaccgttttcttcctctcccctggcttacacggcaggctgcagacagacgccggacacagtaattttagcagaatgctaataggacaaaactgaaaattacagatgacgggagaccacttactatgaaaagcagctactataaaaggtaagctctatgaagtgagtaattttttcactggtgtgaacaaacagtgactggcatacaatttgccctcgatacatatttgttgaattcatgagggagaaaggatgggaaaggcactagagcagagccctgaggaataaggagacagcttggaagtactgggatatggaaatagagggtactcaagaggcacagcaaagggagatgaaggaatgtttcagaaaaaaagaacaacttattttcataagttcgcctttactaataatccaaaagaattactatactgtgtggtagtcagtctccaccgtggcccccaataacctcacttctgaaaattgatgtactcc

SEQ ID NO: 2653 - DNA, 12336 bp, Homo sapiens
cgccactctcacggacagctgctgactttggagtcgctttagaggaagaaaagaagggctggtcactgcagaaacgacgtaacaatgtccaactcggattaccttcccgactacccactcaactcagatttagtgaagagattaaagtctgccctggatgccaaagatgaggagagagtgagggatttaatctgcactgaaatcacgcctgtggacgctgtgatagaactggccaatgacgactggatgaaagacccctcggctcagctgcccaccggcatgctgctaggtgcgcgcaggcgctgctggagcacggggcctcggtgcagcgcgtgggcggcacgggccgggacacgccgctgcacgtggcggcgcagcgcggcctggacgagcacgcgcgcctgtacctgggccgcggggcgcacgtggacgcgaggaacggccgcggagagacggctctgagcgcggcctgcggtgcggcgcggaggcccgacgagcacgggcgctgcctgcgcctgtgcgcgctgctgctgcggcgcggggcggaggcggacgcgcgcgacgaggacgagcgcagcccgctgcacaaagcctgcggccacgcgagccacagcctggcgcgcctcctactgcggcacggcgccgacgcgggcgcgctcgactatggcggggcctcgccgctgggccgcgtgctccagaccgcatcctgcgctctccaggcctcaccgcagcgcacggtgcaggcgctgctcaaccacggctctcccaccgtgtggcccgacgccttccccaaggtaaggcaggatccagcccggctggcacgtgccctggagttttgccacttagtgaccggcctgggagctgggttgcatgcggcgctctcaaagtgtaatggcccaggcacccctggggacttgtgaaaatgcagaatctgctctgccggtctggggtgggagagcctgcattgccaacaagctcccgggtgtggcctagactgctgttcctgggaccccattttgaggaacaggggcctagaagccttctggttagagccacgagacaattaaggggttgcatgtgaagaatgcatcctttcaaagtagtcacctggggacggacgccaggcacttatttcgatgatgcagtcagagctcaaaatattttggcagctcatcatcagtgtcattttcagaacgatgaaaatcagtcttttgccacatctggcatttgatctgaaacaaaattacccaatctgatcatccaccttgttaatgagagtgcttcgtacatttgcagacttctctcattcggtcctcaccacattgcagtgaaacacgagaggcaggtgatattctccctctacctggggttcggtcaggtgaagtgccctgcccaggtcattgcagtgttgggacctcacccccattctgctggctcacccttgcagacttgactctgaacaactcatccttgttccacccgtcagatctaccctgaaataataatgataaagaataaagatttctcacctcagaaaataacccaaaagactgaaaatgtttccaaaatattggctggagtaacaggttgtcctcccgaaaagacttcattgaagggaagtcattccattagatgtaaaatccgggtgtgtttaatttaaaaattatctccatcaaccaagactcatcactcatagacataagacatattttggcctgattagttttgaacaaatagctgaaaagctaatattcaaaagtacagtgttctcagtggtctgaaccatcgagaagtgagattcactcatttctctcaaatgctaactttccattatagatgcgttcagagtagactgtgcctctgaaaggttagaaaatcccccgagacaactcccctagtgtttgctcacttgacaaacaggatggcactttcccgatgctgtctcaccccctctttgggtaattgtcttgtggtgctccactaaggcaatgatttcaatatagtggactcctgaaagggaagaaatgctagcatttttatgttctgtgacagctaccttttatatttataatttacattttaatgtttcccatcattagcaggcttagttcatcaacttataacatggaaacaagactcactgcccttcccatgcacactgtgtctgcattaaaccaacacacacttcagcccttgtcatatgcaactgcataaagaatgaaaagaggccaggcatggtgactcacacctgtaatcccagcactttgggaggctgaggcaggaggatcacttgagtccaggagtttaagaccagcctgggcaacatagcaagatcctatctctacaaaaatttttttaaaaaaattagcagggcctggtggcatgcacctgtagtcccagctactcaggaggctgaggcaggaggattacctaaacccaggatgtggaggctgcagtgagctgtgatagcaacactacactccagcctgggtgatagagcaagaccctgtctccaaaaaaaggaatgaaaagagaaaacaaagttacaggatgggccaaaaggggaaaatatctgggccaattatttttttctgacttacttattcagggaagaatggggcaatttattttaaagaaaaaaaaaggagtcaatatatttcagtagcgactagaaataatcctttgttagccttgaaattgtttcaatttgagtgatctctgaccaggctttcaaatcctaggggcagccccacaggcatcatttctaggaacaggacctctgacccctggactctgtttccaaggctgtagaaattacactgccttgactagagatgcaggacaaagcacagcacctcctctctaggtgctcaggggccctgttctgggatgggatccccagtactatgtcagccacacagaaatggggtcagtcagtggtgcaactcatcctccattcaggttgggggtaggtttagatttgttgtacctgggggccaaaaagccatgggaagtgcttgacaaggaatcttgtcagttcccacccatcctggaaggaattggagttttcttgagaaatcttaataccttgaggcttttgcaaaaagcgttgcccaccgctgcctccctgaacatggcgcctgcaagcacagaccttccatcagtgtttgttgaatgaatgaaagggattccagccactgcaggctcatggcctgcattaaatctttggaaataaggattccacctttttgcactgggattcccccacacctccagtgggtacccctacacctggccaggagaggatggtggatgaggatgcattcaccatgctgagaatcccacaagcaaaggcagcagtgcctgtaatgttctagcttggtccccacaaccgaagcaaaactctgtggaaagctagaggcagcctcttcctccacccagtctccctgcaatcgctcctccagggacggcatctaatcatgtgcgacatcaaagcaacagacgctgcagccagccacaaagatgctgggcaggcaccacacgggcgccatggcgagccgagcgtagagtcaccagcactgtcacagggcaagccgtccgtgggcagcagccgtactgtgaatagatgtaaagagacacccatggagcgcagaattaccgaggcaaaaggtttcacagcgagcttatgacataaatcacagctccccatgcccagacaaaggcaccatcgtcgcggcaggcggacacagggcatccttccgagccggcgcagtgctctgcagtgagaatcaaagtagtgtcacggcttcggaagcccacgtgttgacagtgccaggcctttctgcctggctgaccgctagttaacactgggggcagggacagggcaccgagggcaggcatagggggcaggctgtggattctggcaggtttggattctggaagatgtcagggcaggctggggctgggcctgttggacagcaggtaggaaggcagagaagcacacacagacgtggacctgaacttgtttggcatctgccacaggtgactttttgggctggatgcttggtctggataaaaggctgtgctcaggggtctctctccttcagcctctccttacctggaatacgaatctgtgaaacagtcatgaagtcccatgtgatctttttccaaggaagcactactttgctcttctctcctctttgaggagcacatttctggtttgaccccagaaaatgatggagcatcaaagcgtgtgggaagatgtaagtccagccccgctccaagatgggacacagagctgacagtagcagcacgcagccagggctcaaacccctgccctccactgcctccttcacaggtgttcctttgggaacctccttgattcaccgctcagtttacatggccagctttatttgtccctggatgtcacctgacacccgtccatgaacacttttcatttgcagtcagcatgcgtggccagcacattccagcccctcctaccctgtctcctattttgtgctatttcccaaaggccttctgtttcctgtggtgcagaggccagcagcagcccgggaaaacgcacctgcaggtgactgtaaagagttcagactctcacctggcagaggagatgccatgatcacaaaggtggttttctcagggtgagacttatggattgcattccgggtctgatgacccgcacggttttcccagatatgagaaactcatagatgcagaaactgcataatttatggttgagagggactgcatttctactttaccctgtgtaaaaatgaaatactaataatacttcagactcatacttgtccaccagtcggggaagtgcagggacaacaccagtaatgaaggatttcccccaagtcatgtaggcatcggctatgcttcccacgggcatccctttagtacttatgtattcattcaacaaacattttgggggaacttgggtgcttggtactggagtcacagtgaggagcaggagcatgtgtatttcccaccctggtggagctgcctgtcacgtggatcagacaagtacacacactaaggtgaagttgccatggtgagaagtgctgcaaagccgaggctcacttcaccttgaaagcacagaacaggggtttcacctggctggggggcagggtccaaggctccctcaagtgtgtgatgagtgagccgagatctgaaggctgaaggcttatctttgtgaagcgggggacaaacattctagacagacgtcctgggcaaatgtcctggagcaggacaggcacggcaatgtgtgcagttggaaaaatgagctagtcgttggagaggaaacagctagggggcaccagttgagactaggcagccaggcagggccttaagggcctgggcctctgactttggaatattgggagttgattacatcattttcaaggaaggagatgacatcatccaatcagtattttggaatttctaagctcgacgtagagaacacaccaggtagggggctgatggaaaccacaggctgtggtggcagtccaggtaagggattcacatagcttgcatgggggatggaggttggtgcaagaataacagattctaggccagaggcaatagctcacgcctataatcctagcactctgggaggcacaaggatgacttgagcccagcagtttgagactggcctagacaacatagtgagacaccatctccacaaaaaattaaattacctgggcatggtggcatgcaactgtagtcccagttactcaggaggctgagacaggaggattacctaaacccagggggtggaagctgcagtgagccatgattgcaatactacactccagcctggacgacagagcaagaccttgtcttaaaaaaaaaaaaaaaaagcagattctagaaacatctgcaaatctctggtcttgtctcagcttctgggcactaaccatactgaaaatggagacctaaagttttcatgttttctttttacctaattactaaatcaggtaaagggacttcgcttatcccaattccacaggatttttagtgggagatttctggagtagcagtagtcaaaaaccagggctccccctcccatcttcacagagttgcgtgcacccagtccccagtgggaggagagaggggagatcataagtagggcgcctgtgtttttcttgctgtcgttttatttctccatctacatataaagcaatgtgcctgtgtgatttttccccttaattttctttctgccgcctcattagctgaagagagtgtggtgtgcgtggacactaatgacatcagcatgtcagagtaatgtggcagccgcctctccgcagacagcaaggaggccgcggagatttttaaactgtgttggcgtaaaaataatgaaggcagccagctgcctggcaaacatgagggggcacgatgcagaggacggggaggggcagggagccccagagaggtggaacagaggagagacagaaaatgaattcccagagacaggcaataagactctgtcacagtctgtgacccggtgggggaggggcgggaggaggtggtgcttttgctctaatggagggcacctcttcccagggtggggcatgtccgggttacctgcagtccctgggagccatttaacattttgcagagaagtgacagggccagtgggagggtcgctggaggtttgcagtgagcaagacctgagcatcgcctagggtaccagataaatagcagcagactccatcccgaggggtccagcgtgagtccttcttaatggcgtgatttttttcccaacacagaaggggatgattgaaatcagagactgccgtgcacgaggaaatggcatgttagtggggctcgtgtgagccagaaatatcaacatgtgtggggcgcagagagggacagggctggcgagatgggctgggaagaccgtgctggccccaggcctcctgccaggcactccctctgtggcttggtttctccgtgtctccgtgttcatgctctgtctctctctttccgtaaagcctgccaagcctgactcagtgacagtaatggatgagaacaaaaataattgggcatggggaggggaccaccgataatagctcttatgatgtcgatatgatgcccagtctagaaagaacagctcctgtcctccaaaagatagctttgaaggcacagatgagaggaaggaagaaagaaaaggagggaaagagagagaggaaatccacagcaacaaggcaacctcatgtctgagtctaggaagacccagacccaatgtccttctgctgcacggccgtaagtttccaggctgtcaggcagacattaccaaaaaaaaaaaaaaaaagtcagccaggcagtgggggaagcctgtgaagccacagtaaagtgcagatgtgaaaatcgggggaacccagctttcagagcaacttgccaactgccaggaagagggtagcaggaagaagcctccaggccgaagctcaagtccaccgggcaaaccgtccaaccgggaacggggctgggccaggccctcgtccccctccctccacgtctcccggctgggcacagagtaggaccacagacttcccctgcatgttggcaaaatttgcatctggttctctccttaatcaaagactaataaagagaaaaaggaatagattcatgggggaaaagaggacaaaccgaaaaatagaacagcatccagaaaacaggagatccaagaaaatctcagaaagtatgtgccatcctctatggagtacaagaagacatagcttgtgggattcatcgaaacagtactggttaagatgaaaactcaatagaatgacatgaaaaggaagatggaggagatagttacaccaagaaactaacagcacagtcagattgaagtatacactaaagaaggaaaaggcagagttgattcataaagaaagaatcaaatccgtgctgggccattggcccgtgtgccctcagaccctttcctgctgttcctgggtcctgctctgcatcctgggtgacagggggaaagggaaagccccctcaagctgcactcagagcccccatcagctggcttctagtcggactcagccaatgggagacaccatgggaaacgagtgtggaggaagaaagaaaccagggtatttctctcttttgtctctgtcttgtgtagcttcaccagcagcacctgcatcgtctctgtgacaccaacacccaccagacagtccctcccttcatggccccagtccccagtgggtagcccctgactcaacttgcttccagcggatggccctggtctctggactctgattagactacctcatcccactatcccaccaactcttaagagtaatgacagctttctatttcgctaatctctaggctacttcaccttccccttgttggaatctcagcagtttgattacctacgtaaccaattccatgtgtaaagttgtttctggttgaaatacctagagtggtttcctttgcctgattggactctgatacaggtggtttaaatcacaagtagcagaaaacccaattcaaacaggtttaaataaggaaatgcatctttttatctcatataacagtaagtgcagaagtagcaggcttcagaattggttgtttcagtgtctggatgatgtcctcaaagaacctggtgcttcccaactctctgctctgccaacctcagtgagtcagctttgtcctcagaatgcctccctcatggtcacaagatggcttccagcaacaatgggcccgtttccttgttcatatcctgttgttccttttttctagaaaccctgaggaggtgtcctcagttggcttaaacctacccttctctgaaccaataactggcaaaggagattggtttaccatgattggattaaactaatcatctgaattgttggaaagtcaacctcagtgttcactataatgaaatactaatgacaaaaactattcttaagtgcaaaaaaaaaaaaaacccaagaaactaaaagagaaagtgatggtaataaaggatagagagccaacccacagataagtgatgttactgcagaaggagcctaggacaaatggatcagaaataataaccaaagacataatagaagaaaacttagctgcactgaaagtcttaacttttggttggcaatcgaaaagggtgttctctgcaaatcaatgacaggaggcacatacctatatacattctaacaaaaatgttctaaaaagacatggaaaaatctggcaaagtatttaagcagaaaacaggctattcataaaggaataaaaaccaggctggactcagatgtttctgctgtaatagtaacataagacaatgaaatatcatccaccgattttgaaaggaaaatttggacactagaattttagactcagtgaagatactttcattttgatgatgaaagacacttttagatatcaagggttcataaaacatgcctttctaatgcattttctgaaaaagaaaaaatacttcaattatttatcaaaaagtatttgctgagcaccagtcatgtcccagcaatatactaggcacataggataagtgagtgaacagataaggggaaagaagtattcctgcctatgtggagcttacattctaatggggaagacaggcattaaatattgagcatgatcaacagaccaaaaaagtgataaggactatagagaaattaaaagggtggaaggcagttgcaattttaagtcaggcagttagggtcagtgactgctgaacaaagacttgagagatgtgagggacccactgtgtggatgtctggggaagagcagcccagcagaggaccagccatctgtagcctaaggctggagtgggccagccctgcgcacagaaccacaggggaccagtgtggccggagatggaaggagctagtgggatgggagtaggagatgagattaggggtggtaagggagagggcacaggttgtgtggggtcttacaggacattgtaatgactttgaccattggagggatttgagcagaggagtgacgcaatccaacaatattttgtaaagatcctcctcttaacatctgccatgttaagcagatgcttgagaaagaggagaacagatgtcgaaagatgagttaggagggtgttgctgtgattcacaggaggggtgatggtggtgtggacaagggaggcgatctgaccctggatatattttggaggtagagccaacaggattttttaacagatgggatgtggagtgtaggagaaacaggagcaatggacgactctgattctagcccaagagactgcaagaatgagtttgctatcacttgggaatggggcaggttatgggtggcacagcaggttgggacctggtgaacaagggagttcagtttttggtatgtggagtgtaggagaaacaggagcaatggatgactctgattccagcccaagagactacaagaatgagtttgctatcacttgggaatggggcaggttatgggtggcacagcaggttgggacctggtgaacaagggagttcagtttttggtatgttgagtgtgggatacagccaggtgtagctacaatgtaagcagctggatatcgaagcccaaagtttgagagggagagatttggccaacctggagatatacctttgagggtcagtgacaaaggatggtatttaaagccaggaaaccagataagatcaccagcaagtgagagtaaacggaaaagaggaacaggcctgaatgcagggatggtcgaacatctgaaggacggagatgagacagcagctaaggaaaccgaggaggggcaaccagtgaggtggaaggaatgagagcacaccttcctcaaagccaagtgaaggctgcattgaggtggaagacatcgtcaacatgtcaggcgtggctgacacagcaagtaaagtgaggcagagcatggaccactggcgaggcagagcctgggccaagagcagcattggtgccattggtaaggacagtatgggggagtggctggggctaatggcccattgaggtagatgtactccagctgacaaagagataacactaacgaagagctcaggaagggggaaatccatccccagattctccccactcttccccctaaatatatctcaaaatctcctaccctcctgactgccaccacctgaggtgaggccaccaccatctctcccctagatggacacatcttcttcactgggctctctgtctcctctaaactattccccagatccagccttggtgatatgtccttgtttggttggttggttggttggttggttggtttggtttggtttggtttttgagagggggtgtcactctgttgcctaggctggagtgcagcagtgcaatcatagctcactgcagcgtcgaccttccaggctcaagcaattcttccacctcagtctcctgggtagctgggattacagatgcacaccatcacacccagctaagtttttgtattttttgtagaaacagggtttctccatgttgcccaggctagtctcaaactcctagactcaagtcatctgcctgccttggcttcccaaagtgctgggattacaggcatgagccaccacacccagccttggtgatatttctaaaattaaaatcagacccagcctctcctccactcatacctggcaagtgctccctgtgccagcctccttctcaggcagataatggactccatggtcttccctgctttcctctcctgtttcatttccgagcactccccatgtcagactcatgccccagccaacattatttgctccttctcacctcccaaacctggcataatacgttttctctgcctagaacactcttgtccccagaactctccatgcctttttttccccctgctaactcctgctccagagccaggtctcggcttggatgtcacttcttccagaaatcttcccctgaactccccctcatatgaccacagcactgtattgttgttgttatatttgggactgtaaagctctgtgaaggtggagctggccatcataacatgcagacataacacaatccctgctttctagtaggagctcggcaaatacctacagaagggatggcttaaaggacaggtggtgagcatacaacccagctataacagggacaaataattgggaaacacattgtaaaactaaatgcaaataccaaaattgttactgaaggagatacgcaatataaatatgatcatataataatgacaacctggaactaaaactccagtattattaagaaaggaagggagaagaactggttaagagagaaatgtaagagaaaggatgatggcatatccggaacataaaagatactatttagatttttagagaactataggtg

SEQ ID NO: 2654 - DNA, 2185 bp, Homo sapiens
attaatagcagttttcccgggagagaaggagggaaatggcattccagatagaggcatgtgcaaaggcttgaaggtgcaatcagcagctttgatcgcccactgtgggcagagccctgtcttggggagaccagagaaccggaagacccagcccctgccctcaaggagctttttgtcttgccgggggaaccaaggtcacagctgcaccaactcccgaagaaccctctttccgagctgcctgtcgtcaaatccaagcgagtggcattaagccttgaagatgatggactaccctgaggatgggatcacccccttcgtgcctcatggaattcagtcccatgcactacactctggatggtgtatgactggatgaatgggtttctatatatgggtctgtgtgagtgtatgtgtgtgtgtgattttttttttaaatttatgttgcggaaaggtaaccacaaagttatgatgaactgcaaacatccaaaggatgtgagagtttttctatgtataatgttttatacactttttaactggttgcactacccatgaggaattcgtggaatggctactgctgactaacatgatgcacataaccaaatgggggccaatggcacagtaccttactcatcatttaaaaactatatttacagaagatgtttggttgctgggggggcttttttaggttttggggcatttgttttttgtaaataagatgattatgctttgtggctatccatcaacataagtaaaaaaaaaaaaaaaacacttcaactccctcccccatttagattatttattaacatattttaaaaatcagatgagttctataaataatttagagaagtgagagtatttatttttggcatgtttggcccaccacacagactctgtgtgtgtatgtgtgtgtttatatgtgtatgtgtgtgacagaaaaatctgtagagaagaggcacatctatggctactgttcaaatacataaagataaatttattttcacacagtccacaaggggtatatcttgtagttttcagaaaagcctttggaaatctggatcagaaaatagataccatggtttgtgcaattatgtagtaaaaaaggcaaatcttttcacctctggctattcctgagaccccaggaagtcaggaaaagcctttcagctcacccatggctgctgtgactcctaccagggctttcttggctttggcgaaggtcagtgtacagacattccatggtaccagagtgctcagaaactcaagataggatatgcctcaccctcagctactccttgttttaaagttcagctctttgagtaacttcttcaatttctttcaggacacttgggttgaattcagtaagtttcctctgaagcaccctgaagggtgccatccttacagagctaagtggagacgtttccagatcagcccaagtttactatagagactggcccaggcactgaatgtctaggacatgctgtggatgaagataaagatggtggaataggttttatcacatctcttatttctcttttccccttactctctaccatttcctttatgtggggaaacattttaaggtaataaataggttacttaccatcatatgttcatatagatgaaactaatttttggcttaagtcagaacaactggccaaaattgaagtcatatttgaggggggaaatggcatacgcaatattatattatattggatatttatgttcacacaggaatttggtttactgctttgtaaataaaaggaaaaactccgggtatatgtatagatgttcttcattatagacatcttctttgcttttcttggccttgggggaggaagggagaagtgctcttttctacttgtggggtctcccattggaaacataatcctatagtcccagaaggattcagtccccagtggctttcccatccaaagagaaagagtttgagtttcttaactctgctgttctgccacttactcccactagacaaccagggacaaggtgcaacatggaagtgtttgacttaagtaggagcagaggagctgcatctaatctcatcatacctggaacttgacacacttaagcaaatgccttcccatccctacctgccagatgcccccaactcaatgaagttggatgtctcaccagcttgataccctttgaattttcagtcagacattctggagttctagcatcc

SEQ ID NO: 2655 - DNA, 506 bp, Homo sapiens
gaatacattttctgtgaatgctatttcaaaaaaaccacagcagcaagtcacttcagagtgcactggggcaaatcacatcatgtcattatgtcatggatcataatgaagcacagaggctaattgaaccaacaggcctcaacgctaatctccatgccagactagaggcttgagaagttttctgatggggataaaggagaggagattgaaagctgaagttaatgattaaagccaaatgaaccccacagttgtctccctttatccatgagggacatcttccaaggcccccagtggatgtctgaaaccgcaggtagtaccaaatcctatatgcattatgttttttcctatacatacatacctatgataaagtttattaattagttacagtaagagattgacagcaatagctaacaataaagtagaacaactataacaatatgccatcagcattactcttggggctattatttagtaaaataaaggttacctgaacacaagcactgcgatac

SEQ ID NO: 2656 - DNA, 1052 bp, Homo sapiens
gacagagccttactctgttgcataggctggagtgcagtggcacgatcttggctcactgcaacctctgcctcctgggctcaggtgattgtcccacctcaacctctcaagtagctgggaccacaggtgtgcaccaacatgcgcagctaatttttgtagagatggggtttcgccgtgttggccaagctggtctcgaactcctgggccaagcaatcggcctcccaaagtgttgagattacaggcgtgagctactgcaccaggccacacatgcttattttactcagtcttgcccctgaatacccgaaggtctaaacttaggaaaaagtcaggggagggatgagtttgtcattctttggagtcgttatatttgggtgagtgctggcactatgggtaggatattatttagaagctgagttgtgtgctgagcaaatgtttctttaaaaaccaaagccgtatgagatctgttatagaggcacagtgtggctaaatagtgtgcgataagataagcatagggctcctgaggtgttgctgttctcccactgtaatgagtttactcttcttcctaaggaaagtgatcctttatcacctctcctctcaaattcactggcttgtttcgtgagtgtgccttcatggaatcatgtctccttctcttccctcagttctctccttccctcccttacgtatgactcctcccataatccgcacacatggattgaaccaagtgagggtatttttctgtttcctacctcatagaagggcatagagtggacacggtctaaggttagttcctgaactgagtacccacatatgcagaactttatttaaagctgctgaaatctttgtataacagatagatcaataggactgaaaactactgatggttttacttacttgttgaacgtgactaagttccatggcaccatttagaaattgtgttgtatagttttcgtgcttaagaaacagtttagcataatggttaaaagcatggcctctggaactagattgcctctgtatgcctcagtttcctcatctgggaataataatagttctacctc

SEQ ID NO: 2657 - DNA, 3120 bp, Homo sapiens
gcaccctggctgctcgcatctgcaggaagcatggtggggctgggcggtcccaggctgccgtggcccctttgtgctgctgtaagaaggtacctgtgactgggtgactcataaggagcagaaatgtactgctcacagctctggagtctgggaagtctgaaaccagggccccggcaggtttggtgtttggcgaggactgctctctgcttccaaggtggtccccttgttactgtgtcctctcatagcagaaggcaggagggcaaaaggggcctggccagtcagacagccctttcgtaaggctctaatcctacccttgacggtggaaccctcacggcctaaccctcccgaaggcctcacctctgaacactgttgcgctggggattaagtttcaacatggatttcggaggaacacagacattgaaaccacagcagtgccatcgctcccaggctgagaccccaccttggctctctgcccctagcatctcctccctggcccctggagagacacaggagaaggagagaagggctattctgtaggaatcacaaggccgagtggactctcacctgagggagggcacctgcagcttggctggccccagggatctgtgggcacggagcatgtggctgggtgcctatcaccttcttccccactttaccctgggcatccagcccctggaccatgactgccaggcacggagcaggtgtggaggagtgtcagcatgatgaaattcacccacaccacggctgccacagatggacagcctcacggagaggtgccgcccacagcccctcgctgccctgggtccagctgatgctcagctccatggtccggccgctgctggtggcggtgttggcccaagggtgatgctctcctccctctgccgggaacacccctggcaaggacgctgcccacccatccccgcacatggaaaggaggtgaggcagctgcggcatcttcacagaacacgtccccccgacacgcaccaagacatggctcgaggcccgggcctcccacacacccatgggcttccagcacgtccttcccacgtcagacaccagacagagccggtgcaggtggcttccaggtggcatgtcccttcggatgggctctgccgtccctgtcatgtgcaccagctgctgcatccacccttagtgccagctctgggggcctaagcaggagctcagggacatggagaccgtggagaggaggcattcactgtggggtgtcccaaggctgggcaccaaggcaggacctccgtgtgccccgaatgccggcttccctggagactgcagccagcggggatctctcacatcagcctcccaagaccaccgtgaggggggcgcttaggagcagaaacacccaggccgagcaggatgagcaggtgaagctgcccaacgcaggggacgggacgcagaggcgattcacgagcctggggctccagcagcagccaggcggatcccgccacacctttcgctctcagctaccagtctgcctgccaccatcaccttcccgcgtgtgagtggggccctggttccccaagcagccgctgactcccggacgcctgctggccaggccccggtcatgagtgcatccggggaaggcttcgggcctacaggaacggaaggaaaagccatccagcctccctgaccctccacacggaagctgaggggttccccatacaccggctgccggggactgcctcgactctggttttggcagagacaggccctgctgtgtccgtcatctctgatggaagtgacagccatttcccctgcagacaggccagagcggcctatccacgctccacggtgtgaggccagtggtggcgtccccagggccacagcccagcgagggtgaggtgggggagcgtcctggctgagggctgggccgcctcccgcgtgctctggggaacaatgcttccgcaccacccccgccccttcctggcttctgtgaaactgaacatctccaagtaaatattttcactgctaagcacaggcagcacttcgaggcttcgtgacgaagacgtggaaaccgcaacccggacctcgccgtcagagccgggcctgcatttcccagtcagcacgtgtgtcccttctcctcagcaaccgccagccctgggacaagccccacaccaccctggttaccctcagctgcgagatgggaggtgccgggcacagccaggactgcatctggtccgtgctgcagggatgcagccccgcatggggccggggcttagatcagcctcttgttgggttgagcggggaggcgcacacctgccccagactgcagctcaaaagaggcagaggcgagggtcaagcgttccataccccgaggtccccgggggccccgtcagaaaaggtgggggtctcagggagctttgggttttgctctgcctcctgggcctgaccctggccagagctgaaccttcgagaagccaggaaaagtcggtaccaattcctggactagactccctgccgagcctgcccctgagtgccctgtggcctgggtgtgggaacccagagggagactgtgctggtgtcaccgggggccttctggcggtcaggatggctcacagggaggcactggggggctgtggccaacctgtgggacccgtccacccccagggctgctgtgaggcctaaacgtggcaggggctccccgatgtgagtcctacaacgctcagtgtcggatggggggcaggacccacaggcccctctcaatgcaacctacagaggcccctgcaggtgacctcgagggaggccacagagagcaggacccacgtgggggaagagagcacctgccccacaaaagacaaatcaagttgctgccaaggagccggcgagtttggggcggatgaagtcacaggatcacccacagcgaaaacagggaggcggccacatgccccccacctggggagcctcaggggcggccggggccacgggggtggcacgaggcgggtgacaccgggcagcaggcgggggcggcgctccgggaagcagggtccgactggagacgtggggatctcggggcggtttcgggttttactctgctttgcctgtggctgagcagtgctgaagggtggtgttgagctaacgggatgctgaggcggaggaggatggagg

SEQ ID NO: 2658 - DNA, 722 bp, Homo sapiens
gttctttcttccaacggttgcctggttaatcccacccacccgtcagtccttggtcgggcattctcaggaaactctcccaagggacagctcagaactcccatgtttcctcaaaaggttccctcctgctgctcacctgagctgcctgtcccagcacacagccaccatcaccagcaggttccccaagatggccatcaggataaccgtcgagagaaacgtgagcagcaccaccttctccactgacccgaaaccctcctcagaactgaaagacacacacaagcacaaagaattgaatgaaactctgggacacaagaaggaaaattcgtcttttcatcattgaccttcagaaaggtttcttgagagactaaacatacaaatggacaatggccagaccatgtgtaacaataaaactccgatggacaatctctggcagccagcccagaacgatcaggacttgttcaatgactgcgagctagcttcccccttttttaaccctcttacctgcttccaactcaagactaacaacagaatgccaaagacactgctccccaaagcaattacgtaagatgcctcactgcttgttagtgcacctcctgcttcaatgtgccaacaacctccaatcagaagatagcagaagccttcttttccccgcttataaagcttttttactcccctgcctgtctttgagactttgctaaattccaaggatggtggctgatcctctt

SEQ ID NO: 2659 - DNA, 2148 bp, Homo sapiens
atcagacataaccttgccataagcagcaaagggcttggtgaaccctcaaaaaggctgtcaaacacccagaggccttggggatcaggaaggagctatcatgtggtctttcatctaagagagaattgtcctgcctgatgggcttcaaaccaccagaacatcagttcttcctggttctgcagtagtctccaaccttcagactcaaacttcagcacctgttcttcagattttggacttgcagcctctataatcacatgagccaattccttatataaatttatttatacatgctgacagttggttctgtttctctggataaccctgactgttagagctgttacctcaaatttgttttcttatatttggtgtctgttttggagtacttacaagtgcttaaaatgttctttttcaattaggtcctgtagaacatagctgcgcctggaattgaatgatcgtgttttccgtgcagagctatctgcctttggacaggaggagaactctcagcaccattccctttccacgggagcttcttttttctcattctttttcttgcctccctcaactcccatcctctgttctgggagaaggtgaagctggcctgacaggcctgagggaagccggacggaggcacacttgccagcttttagttgagggaggcaccgcagcaaggctctccagtccctccttccctgggagcaccagctctgattctagtgggcagctgcagctaagacgaagacaaatgaatccagagacttctctcgagctatgagcctgagccaaaggcacagcccagctgtccagagagctttgtgacagaacatggggggccagctgacaggaaccgaggcacttttaaatttagcacttgtcctcgccctttcggttcacgatttcttggaagtttcatttggaaaaagaggtgagggacagaagtagaagttgggaattctagatcccttgattctagaatattctaagatcttccaaactaaccctgattcctaaaaacagaataggacaatcttgttttcggtattgagaatagcaaatatagaaatcccttaattctttgacttagcttagcaggtgcaattagttctatccctaagccttcttaccagaaaattttctagtgtaaaatgattggatgggataccaattgggatgggtgtggtaatagtaaaaccatattctttaataactttttcttatttgttttcctggaattttggttggcattttttaatgaattacatgcttatttttaaaaattattatgatggagaatttttgttaggcagaatttcaaatctgtcatctgctgttgactcttactttcactacaaatttacgaaggtagagagacccagttcttacttaagttatatctaacataaaaatacaattctgtcccaatctgttcatttaaagggtaaatttatagcatctgttcaactttatatgctatctcaaaattgtcaacattttaagcaaggtgctacctaattttaatgggtgcacaagagggaaaagtgggtcattgacttcaaaggcgaaactataagctattaatgggctacgttgtgctgaattacaatctcttttcttgtttcaagttaaaatttttaagtggccacatgtttggcattgtaattgataccacaatgctgctgttccttgactcattcattctcaaatgtatatatatatatattcttagttcacaaatttctatttcttttacacaagttgctatttcttgtagtgttcatgaactgggtatgctgtcctttgtaatgaaagactacagactgccatgaatagtaccttggcttctttttttacagtgtggaatgagagcatttattattgttgcattattgtatttttgaataaaaatccctattcccactgtaccaaatcaaatgagcttgtgttgaattttattcatcagaattgtggttaatgcagtcctcagctatggcactagttagggcctgcccaggactgctgaagagctggctttgtgatttacctggctcagtatgtgatcaagcatctccattattggaataaaataaaaactttcaagatcatggttgtgcaatagagaaaacaattttacctctgcactaacactcaaatgct

SEQ ID NO: 2660 - DNA, 18333 bp, Homo sapiens
gtgcggtggctcacacctgtaatcccagcacttttggaggccaaggtgggcggatcacttgaaggcaggagtttgagacgagcctggccaacatgttgaaaccctgtttctactaaaaatacaaaaattagcctgagatggtggcacaagactgtaatctgaactacttgggaggctggggcaggaaaatcgcttgaacccaggaggtggaggctgcagtgagctgagatcgtgccactgcactccatcctgggtgacacagtgagactccatctcaaaaaaaaaacaaaaaaaacaaaaaaaaacaaaaaaaaaaccaactattttatgtgtgttggggaggaaatagagatttaaaaggtgatagaaaaccttagtatcagaattgagaattaagaatatatattacaaaccacttatacccaaattaatatcccttcatgacgtctgtaaagtcaggtggccaataagaacaagcctatcccttgttctcaatctcattttctggtaagagagtaaaaatagaaaacaaagcagactccactgataagggttcaaatgtattattgaaataaatgtgtgattgatagaaaaagcttgtgactatttaatctaccaaagttcatcaaatttaagatgcacaattgtaaaaccatacatataaggtgctcaaccaaaacaaatattgcttgggaaaaaggaaaggctattttatactaagtattgctaaaatggaagacacaaaccatataatatacttttaatgagtttacgggtagtaactaaacaaaaagtcaagaatcaggactagggtttattcagctattcattaaaaacatcaatcaatcaatatttattgagtatcaactatattcaggcaatgatagagttggaaaagaaatgtttgaagaaggaatgggcattcctttcacagagctatgttctaaggtggagataaacaataagctagcaagcaaataaatgaacacaataactgaaggttgtaaaaagtattttatgagacaaaattgctatgttagatataaagtggaaagaatttactttatagtgagcatctctgagaagttgacttttaagctgatacctgaagaaaccagccatgataattgtcctggtgacagggtaagtttttcatatcttagatatagcacagactgagccttcaaattgagaaagactgtaatgttctagtgatggccacaggctagtgtacttggagaataatgaccaaggggcaggatgggaccagatgaagttagagagttgtgtaggggccagttatgcgggacctggtagattatggcaagaagacaggttttattttaggtacaatgaaaagaaatggaatgttttaatcagaggagtaatatatttaatttttgtttcaaagagatcactctgactccatgggggatgagcaaggaaggaagcaggagatcaggcataaatgaaggattggacagaaaagtgtgatagggagacgcagaagagccaatggattcaagatactcttggaggtaacagccaatagttgctgctgagagagatataggaatgggagattggcttgagctacagaatggacagtgagaccatttactgaggcagagaagtcaggaagagcaactgtgttggaggtagagaatggaacaggagagttctgttttggccatgttaagattgagaagtttatgaattgtctaatttgatatacaagaaataaggacctgacagaggtgggtctgaacaaaaagcaaaaattccaatatcaggccgtagaggagccatcaaaggactcttagaagcagaaagtcatgaagagtgtcactgcagaatccaaaaaaggtgactagttcaataagaaagaaatgtaagtgagagaaagccagacctctactcagtactagtgttaattatattcttctgacctgtaaacaactcgtgttgtataaaaaagggaactgaggaactttttgaatgttcagtgctatgtatgaccagcatgcagaaggagagatgattggcgatatcacttcctttaagaaaaaaaaaaaaactctctaagaggagtaagagtcaaatccttccagaaaattcttaatagattagagaaaatgtccttgttaatcactgcaacattaagactgttgagttaaactacataaatagtaatactaataatagagatcttttcacctattgattttgttaaagtattagagattcagtttttggtcagatgtctaggggtgaatctaagttacccaacaagtcatttcaaatatcacagtcttgctgacagacagggtttaagcatttctaataaaaagctgccagagctcacttctgaaactactaaaccttttgctaaacgtttacttctggcagtacttgtgcttttgtgagcctggggctaaatttctggaacatgagatgcaaaggcagcagaaagacaaacagcatcaaactatatgacacttcagaactcactgtgatgattctcaaatcacacttttggtgataattaagctgaggcacactggcaaagtgacttgcccgaggtcttatagacaatttcaagccaaggtagacccagttatttctgattcctagtcttgaactatgaacaccccatcagtttaattattaaaatacaattgctaccatatggaagaaaaacctagaggactcagagatcctctgcctaaatcattaactctgaataattatttcttttggtcaggcaaccagaaaggagggaacacctttttaaaaaaaaatgatttggttttaaaaattaacctgtctcttcacaagttgttaaaattgacatagctctttctaatagacaagacattttcttcagacaagaggtggtaaaattgttgtcagtgtacttggcaactcttcctaagactatgtaaaagttttccaaaaggcaaaaagtattgaaatcaaagagttgcttcaatccactgggtcaagatggttatttcactgcagagtatttgtggtataagagcaataaaatttacaatgaaaagctttaattttgattcaaataaaaaattttgaataggtcaattttctcccctggggtagaggacacctggttattgtaaggttattgaagacaccctcaaaaggctgagctgtgaaagaagcaatcaatttttttccctgtcaattttgggacagttgtgcatagtaatgtagatttcattacacaaccaggcttggatatacccagcaagtccaaggaattccatgattctaggtggatggacaaagtttccaggatatcactagtgagaccaaatttaagctagagccccagatgtcagctgcttctgctttccacagtcatttacaagaaaacacagaataagcttcgatttcttaagctcttggatgactactgatggggctaattaacacaattattataggaaacgagaggggaaattttaggcccagattgtgtagggctcagagtgtcttgctaagttgtcacactaagatgtctccgtaggtaatggaggaacacgggaagctttcaagcagagagtaacataatcaaattatgtataggaaagcccatctagtagtgacattccagctaagtaaaaacagggaaatgctaggtcagataactgaaccttggatgtgaaagcacatctgacctcaaagacgactagacctggggacactagtgtgttcaattcctgccacctcccttctcttcctcccttcatgtaagagctctatgtcttcctacagtagacagtaagatgcgggagaatagggcagtggaacatgtttgctgaatgttctggtctcacattttcacagcttcacaatcaaaaaggaaaaaaaccttcttcctgtactttcgttttgaaaacttgtgggaaggaatcccattgtcttggtatgtgaggttggtcaccgtcaatgtatcactctggacagagagtcagtgcttgcctgacctatctattaaagctgaagagtaaaagatgacaggcaaacaggaactttcctcagaaacagtcaatcctcttgccagaataacgaaagaagaaatcattggtatctgttgtagctaccatttgaacttgtatgtgaaagagggttgggaaagccaaaaatcatttatgcttagttcctaagtgacaaagaggctgaaagtacctctaagcaaggtgcattatgggagggaaaaaaagggaagaaaaagataaagtgagatgataaatataaaatgaaaaatgttgaatgtgactgctaaactgaatagaaaggaaatagcaatgaggatctggaattcagagaagttggtagagtgagagatttggaggaaagaaagataaagtttaagttatgaaagtagatgaaatcacttcagcagaaaatgtgagaaaagacatgggcttatattaaagtgtttatagaagaagaagttttgtgactacagcaaaacaccacaaaaggcaaatgaaaaagttaattcagtgtcagaaaacttgcttcaactgattaatgcagcagaagctgcagagaattagaaatatataaaaataatacaaatttagtatttagcctttagttactagaaaggctattgtgattcaacagagccattgtagcaggcaaggtgagttgaaagctagattgcttttgtttaagaaaaggctgagaaatgaagaagagtgagtttaatgtattctttccagatatttatcataatttacatagtcttatattttggggtgataaataacttgactttaaatctcaaatattaccaagttcttccaaaaaatgaaagaaataataagaacaggtctagtctgcaacaatagaaagttttaattctacagtaagtagttgaacaatactagggtacatatcacaagtaaataatatggacaagaaaaatctacttgcagatttaaactgacaggcttattatttatattaaagaatttatcagataattataacttttttcttttcttttttgtggacacttcatttaattttagattctgggtgcatgtgctggtttgttatttgggtatactgcataatgctaaggtttatacttctagtgaacccatcacccacatagtgaacattgtggtcaataggtagtttttcaatgctcactccctccccagattcctcccatttgagtcccgagtgtctattatttccatatttatgtccatgtgtacctattgtttagctcccacttgtaaatgagaatatgagttatttgattttctgtttctgaattatttcccttaggatagtggcctccagctccatccacattgttgtgaaggacattatttcattatttttatggctgcgtagtattccatggtgtatataccatatattcttaagctattcaatcattggtggacacttaggttgattccatgactttgccattgtaagtaatggaatagtatcacaatagtattgtgataaacatgtgagtgcaggtgtcttgatgacatgatgtcatttcctttgggtggatacctagtagcaggattgctggaccaaatggcagttctaattttagttctgtaagaactctttactgttttccatagggattgaactaatttacattcccaccaacagtgtataaacatttccttttctctgcatcttccccaacatctgctttttttttcttttcactttttaataatagccattctgactggcataagttggtctcccattatgattttaatttgcatttcactgatgattagtaatgttgagcattgttttcatatgtttgttggccacttgtatgtcttcttttgagaagggtctgtccatgttctttgcccacattttaatagggttatttttttttgttggtttgttgagttccttggagattttggatatcagtcctttctcagatgcatagtgtgcaaaaatttttttctcattctgtaagttgtctgtgtagaatgttgattttgttttcttaagtccattttgtctacttttgtttttgttgcatttgcttatgaggtcttggtaataaattattaccctaggccactgttcagaagagtttttcctaggtcttcttttaggatttttataatttcaggtcttacaattaagtctttaatctatcttgagttaatatttatatatagagtgggacagatgtccagtttcattcttctgcatgtgagtagcgagttttctcagcactattttttgaatagggtgttcttttcacattgtttatttgtgtcaattttgttgaagatcagttggttgtaggtaaatggctttgcttctgggttcctattctgttccagtgatctatgtgtttatttttatatcagtactatgctgttttggttacagtagccttgtagtatagtttgaagtcagataatgtgatgactctagctttgtttgggttattcagggtcttttttggctccacatgaatttttgaattatttattctaattctgtgaaaagtgattttggtaatttgatagaaacagcattcagtctgtagattactatgggcagtgtagtcattttaatgatattgattcttcctatccatgagcatggaatattttttcatttgtttgtgtcatctacaatttatttcatcagtgttttttagtttttcttgtagagatctttcacatccttagttgaatgtatttgtaggtattttatttttgtgtgtggctattgtaaattggattgagcttctgatttggttctcagcttgaatgttggtgtattgaaatgcaactgatttttgagcattaattttgtatcctgaaactttactgaggtcatttatcaggtctaggaatttttttggagaaatctttagagttttctaggtataagatcatgtcatcagtgaacagaggtactttgactacctcttgtccaatttggacacctttccttctttggcctgattgctgtggccaggacttccagtactatgttgaataagagtggtgagagtaaacattctcatcttgttcgagttcttaggggaaaatgctcttaattttccccattaaacatagtgctggctgtgggcttaggaactatactgcccacagtaatctacagattcaatgtaactcttatcaaattaccaaatgacttttcacagaattagaattatatgtatctttatattttgaggtatgtttgatgcctcatttgttgagaggttttatcatgaagggatcttgaattttatggaatgctttttctgcaactgttgagatgataatatagtttttgtttgtaattctgtttcacatttatagattcatatatattgaaccatccttacatccctggaataaaactaacttgattgtgatgaattctttttgatgtgctgcagaatttggtttgctagtagtttgttaaggatttttgtgtctatgttcatcaggtgattttgcctgtagttttcctttttggttgctgtgtcctggccagattttggtatgaggatgatactgatttcatagaatgtgataaggaggaataactcttcctggattttctgaataattttagtagtttggtaccagattttctttttgtgtggtagactatgggtatgaatgcatctggtcctgggctttttatggttggtagattattttttgttactcattcaatttcaatttttttctggtttaatcttgggaggttgtatgttttcagtaatgtatccatttcctataggttttctagtttatgcacatagaggtgttcatagtagtctatgactactctatagtcgtctagagactaagatgatcttttgtatttttgtggtatcggttgtatcaccttatcatttctgattgtgtttagttgaatcttctggtcttttttgttgttgtttttaattaagaaccaacattttgttttgttgatcatttgtataatttatttgctcttaattttgtttagttctgttctgatcttttaaaattcttttcttctgctagcttttagttggatttttcttgtttttgtagttccttgaagtgcaatattagctggttaatttgagatctttttattttttgatgtactaatttagcactacaaatttttctctttacactgctttggagattttggtatgttatgtctctattttcattgatttcaatttttttttatttctgcctaaatttctttgtttaccccaaagtttctcaggggcaagttgtttagtttccatgtacttgtgtggttttgagaattcctgtttgttttgatttctaattttattacactttggttcaaaaagatacttgatatgattttgatttttttgagtttattgaaactttctttatgaccaaggatatggtcaattttagagagtgctttttgcacagatgagaaaaatgtatattcttcagttggttagaatgttctgtagatatctattaggtcaatttgttcaagagttcagtttaagtccagagtttcttttttatcttaagagtatgatcacggtatatgttgtatatggtcatttggcttttgtttcattatttctgcatcaatgatctgtatagtgctatcattggagagttgaagtccccaactattactaggggctattatatggctgtctatctcttttcttaagtctagtcatactttttgttataaatgtaggtgtttcagtgatgggtgcatatatatttaatatagataaatattcttgttgaattgaactgtctatccttatatactacctgatatggtttggctctgtgtccccacccacatctaattttatagtccccataattcctgtgtgttgtgggaaggacctggtgggagatgattgaattataggggtgggtatttcccatgctgttctcatgatagtgaaggggtctcatgatatctgatggttttaaaaacaggagttgccctgcacaagctctctttgcctgccaccatccatgtaagatgtgacttacttctccttgccttccaccaagaatgtgaggcttccccacccacatggaactgtaagtccaattaaacttctttcttgtgttaaatgcccagtctcaggtatgactttatcagcagcatgaaaacagactgatacagtaaattggtaccagaagtgcagtgctactgaaaagatacatgaaaatgtggaagtgactttggaactgggtaataagcagaggttggaacagtttggaggtctcagaagaagaaagaaaaatgtgggaaggtttggaactccctagaaacttgttgaatggctttgaccaaaatgctgataatgatatggacaatgaaatctaggctgaggtggtttcagatggagatgaggaacttgttgggaactggagcaaaggtgactcttgttatgttttagcaaagggactggtggtattttgcccctgccctagagatttgtggaactttgaactagagagagatgatttagggtatctgccagaagaaatttctaagcaacaaagaattcaagaggtgactttggtgctactaaaggcattcagttttaaaagggaaacagagcataaaagttcagaaaatttgcagtctgaccatttcatagaaaagaaaatcccattttctgaggagaaattcaagccagctacagaaatttgcataagtaaagaggaaccaaatgttaatcaccaaggcaatggggaaaatgtctccagggtgtgtcagaggccttcacagcagcccctcccatcacaggcctggaggtattggaggaaaaaatagctttgtgggccaggcccagggtccctctgctgtctgcaacctagagacttgatggcctgcattccagttgctccagctgtgaataaaaggggccaaggtacaggttgggttgttgcttcagagggtgtaagccccaagccttggcagcttccacctggtattgagcctgtgggtgcacagaagtcaaggattgaggtttgggcacctctggctagatttcagaagatgtatggaaatgcctggatgcccagaaaaaagtttgctgcagaagcagggcccttatggaggacctctgttagggcagtgcagaagggaaatctggggtcagagcccccacacagactccctactgggcaccacctagtggagctgtgagaagagggccacagtcctccagaccccagaagatagacccatattcagcttgcactgtgcatctggaaaagccacagacactcaacaccagcccatgaaagcagtcagaaggggggctatgccctgcaaagccacaggggtggagctgcccaaaaccatgcaaacccacctcttactttagtatgacttggatgtgagacatggagtcaaaggagatcattttggagcttcaagatttgattgccctgctggattttggacttgcgtggggcctgtagctcctttgttttggccaatttctcccatttggaatggctgtatttacccaatacctgtacccccattgtatgtaggaagtaactaacttgcttttgattttaccagctcataggcggaaggaacttgctttgtctcagatgagactttggacttggacttttgggttaatgctgaaatgagactctgggggactgttaggaatgcatgattggttttgaaatgggaagacatgagattctggaggggccagggcagaatgatatggtttggttctgtgtcctcacccacatctcatcttttagctcccataattcccatgtgttgtgggagggacctgatgagagatgattgatttatgggagcaggtgtttcctgtgctattctcatgatagcgaatgggttgaggccaggtgtagtggctcatgcctgtaatcccagcactttgggaggccaatgtgggtggatcacaaggtcaggagttcgagaccagcctgaccaacatagtgaaaccttgtctccactaaaaatacaaaaaaaaaaaatagctgggaatggtggtgtggtcctgtaatcctggctactcaggaggctgaggcaggagaattccttgaacctgggaggcagaggttgcagtgagctgagattgtgccactgcactccagcctagatgacagagtgagactctgcctcaaaaaaataaataataataataataaaagatagtgaatgggtttctcaagtctgatggtttaaaaatgggaattgccctgcacaaggtgtctttgcctgctgccatccacataagctgtgacttgcttctccttgctttccaccatgattgtgcggcttctctagtcacgtagaactgtaagtccagttaaacctttttcttttataaattgctcagtcttaggtatgtctttattagcagtgtgaaaatggaccaatacactgcccttaattgtctttttattcactgttactggtttaaaatctgttttatctgataaaagaatagcaatccctgctctgtgttgttttccatttgcatgatgtatctttcttcacccctttacattgagcttgagggtgtcattacagattaggtgggtctcttgtagcagtagatgattgggtctctctttgttttttttttctttttatccagtttgccaatctagatattttaagtgcagcatttagactatatacattcaaaggtaatattgatatgtgaggctttgattctgtcatagtttgttaggtagttactttgaatcacccaatgtctgccttaatattcacatggaactctccctgtgtgcttgtctgtctccaaatttccccttttataaggacatgagtcatattgaattaagagcccaccttactcaagcacgacctcatctaaactattattatatataaatatgtctgcaattaccctatttccaaataaggtcacattctaaagtactcaggattaggactgcaacaaacagatgttgtggagacacaattcaacacataagactttgagactttgcttccaatatggaattgatatcccaaaacccatatgaggtgccttctctctgagacttttagcctgaatctactaatgtgaaggaggagggttagttgctacggtagatgctattttgctaatgttccatagaagtgaaggcagtgaggttgagagttgaggggctcagtggggaggatactgttgtggctgctccagggattgcatttgaattttgtctgggttcttgatgacctagattcccttggttccttccaattctcttagctttatttgcccacatgtctccaaattcttgagttgtttaataactttccagtgaaagtcctgtttggctccagttagccagagttggtttctgttgtgtataagcaataaacttgtcaagtacacatacttcatgatattttatatcttttcagttcatcctatattaaaaagtaagaaaataattcaattgcataaatcaggaaattctttaattagacctttaaagttaaacagccattacaatgaacaaattccatgttactggaaataatatggttttgtttctaattgagtttaaggtaactaacttcagtctgagcaaatgagaactatggtatgattaaattatatatatcattgaattcaactccaactgaagtcattatcagaaaagtcattattgaagaattatgctactattccttgctgagatggatgagggaaggaaaaacataatcttattaacttttaaaattatatttcatttatgaggtaaggaatttatgaaatgaaacactaagcatcatatttcaggtaaattttgtgatataaatcagttgtatttatagattcaaagctaagcttgaaaaaagtctcagaagctaaggggctgatgaccctataaactgtaaaatgtgttaacaccaataaattctggtccctcagttcaaagggcatttgattatacgctgcactgtcagtgctactcacatcggagctcatcttggaatgataaacaaggcaggcctgtaatgtataccagagaatgacaagatgcacctgtccctacaagttttgagacaaaacagtaggcacttgcagacagctgtgtcatctatgagaaagtctactcataggctcaccaacaggcaagaagaaacacccccagccagtttagactacaacatcacaatgtttgcattggtatatcttttatttctctgagattattttgaatagaaaactatgttggctaaaatctattagtaaaattcctttgtatgtaataaagggctgttgatctctggtggctttcatttctatgcacaacattttaaagtattttaataagtattacgtaaatcaatgttaataaatgttcaattggcagaagaacatgaattattatataattacctttaaataatttgccttatggtttttcatcagtatgatttttaaacattctgagggtttgatttacatctctttaagagggaaaaattttttgccttaatagaaatttttccagtcctgaatgttttactttggtcatttatgcctaatcacgcatctctcacaaagaaccaccccaacaaaacagatagttatttaaaacttattacaagatgattaattgaaatactttatggtcagttcttatgtttaacagctggtacttgtgctggcttgttatcaaaggaatatttattgagcatttggtattacttattatttggaacatatataggaaattattcctgctttcttgttatgtatattctgaagaaaatctgtgtaacctcctttgcagaatatggtgttttgtttgtttattcatatatattttattctaaaaaataatttgaaacagatttgacattcttggggcattgatttctattttttggtctgtttttttgtgattttgagaaaattacaactaagacagaaatttcttattttagtctgaaaaaatgtatcttgacaatttttttaagttagaaatttcaggttccatgaccccattatattttgatagacattattatttcattttagagcttgcaattttcattgaaattttccattttgaaatgacgatggaaaaaacccatataacttactaattcattattaggtttattacagggtcaactattcaatactttgtgtttgcatattttgtaaaacatagtattgagctggattttaaatatttttgctatgctaatttctaaaggaaggattttgagtcatgagatgaatttaataaattgcaattgtttggagaaagtctgtgaatcaatttaataacttaatagttttaaaagttttcaataaagttgaagaaaatcagtattttctttaatgcacacttgaatgtaaggcacacttaatatcaaatgttgtcttatgctcaaataaaattaaacaaacaggaaaattatgagaattagttttccttttatattggtgttgacaaatctaaataattacttactgcaatctgttctatcttgattaacactgtggtagactataattaaagtaaaatatgttacaatttctacaaatatattttattctatatcgtgtatttctcataggaatgcatctcaatggacagtgttatattcccatacctataattaaagaataagatattgatctgataaatggttactcagcaaatgcaatgttgctgagttattatgattatttcatggagtattagtctatttttattttattatactttagatacttagaatattcatagtgttcttggtatgtgggaagataatgccgacaactcatacagtttagagactggctttaccctgtactggataacaaaacttattagcagtaaccagtcatgtgttttttttcctagagaagagtaaacagatcagaacaaccaaactagaaacttaagaccctttcagttttatgaatctttttttgctttcccaacaatttttactgcaaagctcttgtttgatgttggtataaatttaatttttaaatatgtttttgttccttgtcaacatcttttcacctgtcagaccattttatgttcctttggtagattttgtaggagagcagttgtcatctatggaaaattaccaacaatattaacaatgccaggtgagagtaattacaaatgaatgtgtcaaatacatgttggacatgtggtatcagcgtgtgcatgaattacattcctgtcctctcacaaagatcgattttctctgtttcctgtaaatggtgcattcactggatattgcttctgctgcatgcaatgcttgccacatttttggcattcaatgaatattgaaataataataaaagagtaggctttttttctttttgaatatagtgacacaacggatgttttcaaacacgctttcataacatatttaaaaaatatacttgtgggtagaacttaaaatggctattttgaatatcaacaacaaatactttatattttttaatattttgaaaactaggatttctgtctgccaccaaaataaatgactccctctttctgcttggtccttgcattgttaacaatcacttcccctgccaccgaagggttcataatgcttgcaatacacacctgtggtctacacatgaatttctcatcatgttcagtcataataggtgtaaaaaacctaattttgggtaatttgtcattggagaaagtgaaaatagtttgtgttaataaaagaaactatgagatacttcccacgtgttctgcagaccatggaattgtatgaaactcttgtaaaagcaacatgagtgtatccagatatagttcaatggggcagtaagaccatagccatcaattatttgaagaaagcctgtctggagacagtcatgccaagcacctgaatccactttaatggtggaagtggacacatatgcttagggagttcaaatcctttatgagtaacactcacttatgatatatagacagaatgcaaaactatggatttttttcctttagcaatgtgattattctgaagtacatgccttaaatatccttttgaatgtagtaacattgtgattgttatctagaaatgcctagaagccaatctttgttatggtaccgaagacaataattggtcctttcaaagaatctggcaagtatatttgtttccttgttaaaaaaattaggaactttaattgattcatactaatattgaaatagtatttctcttgacaaacttggttggaagattctcatcacctttgggcagactcattcacaggagcacctgtattgtcaaaattatatctcattcccataaaaaagatgatggagtaaatgatatttgatggtagagcaatatgatttaaagcttattactagactcaggttggacatacttattcatttcaaaatgaagaacacatatacatttactaaaaatccaaacattcttaggttcagaacatcttcggacataagcatattcatactatcccgtgcatgctttcctttctttcactctgtaacaaccattttaaaatgtggtgaaatatgcagatggctaagagagccacaagatacattataatggataaagaatgtaattacatcagaaataaatgtactttttctgaaaatagagatggtaattaaataagagaaaacaccttttattctgatttttgctaaattaatcacatgtattttcacagcatatatagacatatataatatgacatgtacacacatagtatataggtaatttataattagatttttgtatatctatccttatgaattaaataattaaatctcaaaatttcaagtgttgaatatactaatcataaagcattaggaataaaattaaacatttaatctcaaatgatgttatcaaaagaaatatggaaagcacaatttttaaagtatgctcctctcatctagaaaccagtttcctaaaactcttaagtctcatataacccaccataatcttgagagtctcataatttaatttaatattctttgttatttccaaataaaatttcctaaccagataattttgatttttgttttgttttgttttccattatttcagctttggcaatgaaacaactcagtgacaacctgagaaacacagaaatcagacctgtgagaattgtggaatctaatatagtttcactgcaggagatttcaatgtgtaaatcctaaatgcaagaaaaagggccctaaaggttaacatttacatacttttttttaattttaaaaattccaggttcccatcaaaatttataaattcctgggcagcaccatagtgtacacatggggacaaataaagtaaagccaaaagagcaaaataaacatgaaatatgtacaacttgtgcaattatgaatactttaaaaaatctcctcgggttttttacaaacctgtagtcgaaagttttctctctcatcaaatccctcgaagcacctcaaagaaaacaactcttggaatttgaaattcacttctaaaccttgtggcaagtctggagcactctggcttcatgcacatgctgtgtctacttctgtgctagttaatgccttccttggggaaccactctgtcagacacctttccatgtagctggaattcagcagtatttatcttttccctcttcttttttcacttctcaagtcttaaaactgacatctgaggaaattgtgagatatgtaagaaaggaagaaaaaaagaaataaaaccatgatcatatattaactaaaaagcaggaataaaacagcatgcaagtatgtgatttttagcacaaaaaaattaaggaaacaaaaggaaattgagcattattaatatctactccaactgaatatcaggcatgaataagtgtaacatttaggaccactaaactgtaaaattattaccaacaggatatggtaggatcctatttttcaagtcattcaaaaccaaaaaagaattatagggtatatgtgggtgagaaagcaggccaaaggtttattagctccatcttctgtatctcatatgatgctgtgaacttcagttaaaaaaaatagatcagaaagattgaaaagtgttcaaattactagtctcctaaaatagaggtgtagagatatcttttgcagtgctaggtaattctttctcttcaattgctactctaagtaattacctacatagaacaaactacatttaagaaaagagattgataattttcatcgattccttaaatttcctttttttccactttgaatttgaaacaaggtaacaagatc

SEQ ID NO: 2661 - DNA, 754 bp, Homo sapiens
gatggattaaggaccattttaaatgaactaaaatttactctttggtttttatgccttcaacactcacttttaaaaataggcctttattaagacttctaaatagattgaagttctttctcccgttattgaagataacagatctatcaatctaagagaatggaccattaatattattatttatgcttgtattatttttatcttaaaagatatgtggataatttcccactttggtctagaggaaagaatacagtaactcaatatatgtctttttttttttttttttttttttttttttttgagacagggcctgactctatttcccaggctggatccagtgcagtggcacaatcttggctcaaagcagcctcaacctcttgggctcaagtaatcttcccacctcagcctcccgaatagctgggaccacaggcatgcgccaccacacctggctaatctgtttatgtctttagggacaccagtattcatctgaggagtcagtgcctctcgaaagctgccaaaataacttgtaggatcatttaaaaactaattacagaaagctttacccaggaacattaagggagttaagataaaatgttcctgatgctgtcagagttgaactataagaagacaccacgctaaaagaaatcagatagatgctgtctttaaagctcagtttactgttactaaggaagagagatttggtctggtgctgacagaactacacgattttactggagagtcactcgagccgttgtgg

SEQ ID NO: 2662 - DNA, 8748 bp, Homo sapiens
ctgagacagggtaatgagatctggcattgctgggtggctgctttccattggatggtcagggaggcttcttggaggaacaggatttaacttgaggccaaaacggcacaagggtagagccatataaaactaaggagaaaccattttaggatgagggaacaaaccctgaaggtgtgaacaagctcggtgcatctagacatgtaaggaaggttccagcatgtgaaggagcgaggacggagaagggtccggtgaggtcttacagcaacagagggtccagccacatgaggctgagcagccaagctgggaaagcggaaatctggagaactaaaatatcttgctgaagatcacaatgcagtaaagcatagggcaagtttccaactcgaacatcaccccagaacacttccttttaaacataaattatgttgctaacttttttattgttacttagcaggcagatttcaaactgatacaaatgttgaaaatgatacaaaatgttttcccaccttaaaggcattctgaaacctagcacataacatctgtcactgaagtccatagtttccaatgccatgattggataaagaccctattgagactcatgtgtttgtctctcactgcttaaaacactcatgtgttttaagcaacatgacaagcacaaaagagaacaagtactgctcctgctctccaggaagttaccataaaataaaggggataaggtgccttccaaagaaaaaacaaatactaggagaggtcagaggagaagagagattattccagaaggagagactgaggcagatttcaggagggaagaatataagagtcccaaaagaagaaacaggaacccaggttagagagcaatgggcaaggggtaggaggtgagactaaactcacaaggaagttgcttcaaaacaatagtgccccaaatgccaagctgatgggttggacccatttaggaaaaacccacaaagtccacaggagagcagactgcacttccatgagcttcaagctgtaaacagtaacctcaaataaaacttttcccggatcggtaatttccatcctgaacaatggccaagtcaaggaagctgaggatcgagccccctaccgcatgccacaaagaacctcaagggaccccatgctctggggagctcgcaggaggaccagcacagaggtgtgactgcgttggggcagggtggccacatgtacaatgttgtaccttccaatgttcctccttaggctgtgcttatgaagtcccaacatgtcttctgggctgtgttttcaaccaagagagttaataaaaagtgggatgggcaccaactatgcctccagagacatcaggcagaatatgccacagcgtgccatgtcctcctgcaaacagtcagaaagaaaagatctctaaaagcagattggaagagactatatatacagagcgagtgccggtacagaagttttgctgcaaatacaccctctaatcccttgcaacccactgcaagctcgagagaccagtgcccttggtaaaacataggagagatcattaattaaagcctaggccctttctttgatcctgagggataaggcttgggaaaatgcacagtgataaaagtgaacattttaaaagagcagagtgagtgtgaattcccaaagagaccattcatatcaagacccaagccatgagaaaatgctacaatgcccttgatcaatactttataggcattttgacctcagatctaatcccatgaggcttagaccaagaccttgcttgatgcagacctctctgactgctgaaattggtcaggagctcagtgatgaaaatttggaaagtcaatgctgatacctgaagaaagtcccatcagagatctgtgacctgaatcttcataactttcacaggccctttctaaatgccaaggaggatgtgtgtggagaagaatatgccacctatggcatcccaatatgcctgtgcccgcctgctcttcaacaagggaatgaaacctgggtattctcataggttttttaaagcacttgtccacatattttattccgcaaataacacaatttaaaattcagctagaatttgccattttctgtcagggttgtgcatttcttccagtcaccatgacttcctgagatagccaaaacacaaaatttaaattgtgtttaaattaaataaacacaatttatgctgaagctgactttacccactctgttccaacattacttatcctcagcatctctgaattcaaatatcagccaggtgtggtggctcatacctgtaagcccagcactttggcaagccaagatgggaaggttgcttgaggagttggagaccagcctgggcaacatagcaagacccccatctctacaaaaaaattaaaaaattagccaggcatggtggtatgcacctttagtcctagctacttgggaggctgaggtgagaagatcacttgagcccaggagcttgaggtggcagtgagtcatgatcataccactgcactgtagcctgagcaacagagcaagaccccatcccttaaaaaaaatacctgccctctgtacttcatagcacctggggcattttgaacagttcttccttcacctgaggtcattatttgagaatccaattttagagactacaatgctctcattacttggattgtatcatttaatcttcccaacaatccaggaaggggagtctcttaatgattgtccttgatttccagttaaaaaatctagacccagaggtaaccttgtgaaggtcacagagtttcagagttctaagatcccatgcgagattgctgaacttgaacttgtttcttctgatctcatgtcaataagtgacttagtcaacacctgggtagaaatcatcactaaagtgagaaagcacatggtgagggggatgaatcctgtgcccacatggtccctttcacctgcccaatcctcaggcctctcacctggggtacccctcacacacatggcactttcctgaactcatggacatttcagtttgtaacgatcctcctaagattatctactttcacctatccacatttgaactatacttctttagtggaaaaaaagaaataaagccagtgctgagaatgatcaaactccagaaatagtagactgctgtataatttgtcttgcgtgacaccagatctttcaaggaactgcaagctcaagtgcacagttaagcaagatcaagatctacctttgtctttcagagccttcccttggcgaggtcaaggatatctgctgtgagcctgggctggctgaaccaaagggcaatggaggcggccaagaagccccagccaactgctcccctccccaacccccttctccctggaggtcccttcagctagaatttgccattttctgtcagggttgtgcatttcttccagtcaccatgacttcctgagatagccaaaagcatttgctgtgagcagagccccatggctggctttgcacatcaaacatttcagacagccatatatttcatagaatacaaggggaagataacactggacacacagaactttccaacagcttgagaaaatgtggtgcctggtgactgactaaatatacaatcggacaacagccaggccatagcaaaagatggaactctgatccacaaggtgcagcaactttcccagaaaacaatacccttacccacaaaaagcaaccccggaagctggcctgctctaaatcagacctgctggaagccaaattgctctctagtaactatccaggaagctaaataataacttctgtaacaattgactcaaaatgttcaggactggattaataactgatggcttccctaatttttgtccccgattccaacttaggacccaccagagaaagccaaatatggtcccctgaccaagcacacaggatgttcgcttctagtgagccgcctccagcttccccgcattgataacctccaatcagggcacacctgaagccttcgcctttttccactataaagctctcccactcgtctgcccacctttgagtctctgccaaattgcaaatgatggtgtctgactcccttgctgtagcaagctctgcataatagcttgtgcttattctctttgggtaggtcttcatttcttttcacaccagataggcatcatctttgaaaacatctttactgggtctcttgtctccctcctgcagccactgatctaaatcacagacttttttagaaagagggaaaatagtaaagaaagaaagcgattgagttgatgctcccagccactgtctgtaccctgaattttgtttttctgccatatgtcaggtggcctctcctggaccatcgtcactgtttctcctgcttccctgcagctgcagacacaggagcactgtgtaggtctggccttgagcacccacccacccagtacagagccagcccctgctgttctgaatcagtgcagtgaccacttagaacacagtgcccatgcctctgtgatctgaactgctctttccagttccatacaatgttaagaacccacttaagaatgttttaatcattcagtagtttttcgtggtatataataaaaaagtgatttaaatacaatctattttattttagattatatcattaggggttattttacaaagttacctttaaatactattgtaaataaaattaataacaaataagcaaaattcttacttttccttgtttgacaattgacatggtcaatttaatttcctttaaattaattatgcaagaaaaggatatttcctcaagaaaatttaaaatgatatatatttcttggttgggtgccaaatattcattcagaagaagacggaaatttaaatccttgtttctaatttaaggaaaaaactactttcattattggatgtgtgaaattcacccattttgtgtttatctagaaaatctagtttattgtccaaatgttcttattttccccaaaagcatcagttaggagagaagatttccagctgccattaaaatacaattgtgtgcaatgaatacattttgggtatagatagtttttattctctataaatgaaatgccaaattggatagaaccatcctttttttttttttttcaaaaaaaaaaggcttttggagtatcagagacatcctcttatgttattttaaaataaataattatttgagctgtttgcttcttggaagcagataacaagggggcaggtgagataaaaaaaaaatatatccaaactgaggtgagaccaaagatggccaatctaagaaccaggcagatgtctctgcctgtcctgggaagattccctcaccaggctccctcactggccagaggagcccacttgttgggctgccaactggttcctataaattctaaggcaattagaatcatgtggtgactgtaacgggaatgacacagctgcccaggcattagaaggaaaccacacccaatggctcaagccagtggcgagagataaaaactgagagacatctcccctgactagcagactgggctccctgcttccccattgcttcctttaaacaggccattcacacatttgcctgaaaacttacagtggcccagaccctactccctatacacactgccagttgccatgtgccttgtttctctctctctgcatgatgcttcattcctatctggagtggcccagggacaaaggactgccctcccgactctctgtgccctccctgcccaggatccgtaaattacactttttgaatttgtttcctactgtggtgtatattgcctttgcaccttccatctgaagaccaggggatgccccaggccaggttttacctgggatgcccaagagagcacaaggtttggctcccagcgccagagcaatgggcaggggggcataaactgaacacaggaaaggcaagagccacaaagacatataaacaagtttcccaggcgaggagcccctggtcacaggtcagacaactaggcattgggccatctaccaggtaaaagcagcatcctatgaaaggcacgcagtaaataccatgtccatctccccttcatttccccttagggcggtttgctagctgttctgggactggaacctcagtttagctgggggctctcagaacagacagctagatgaattaaacaatgaagtctctcagccttaggcacatcttccaggacaaggggaaggccaggggagagtaacatcagtgatcctacaagatgtgcttccaggccaaggccaggttgcagttgcagctacttagccatggtacacggtgggcctggagcttctgggtgtgcaaagatgtgactcaagagtccatctgccagcagtgagcagggcaggccagctctcctctcactggtacggtggttccagccctcacaggacattaaaaccacctggaaactgtttatgaaggttcctatattcaggaaaaatccctagagattctgaccgaaggaatttggtgctgcctgggtaccagtatttttaaatttccccagatgatcctaacatgcagtctgagtgaaaaacccaagtttgacggctacaggaatttagagcttctctaaaacatacagggaataataccagggccatacattggaagtccttccattgggaatgcaaagaaaaaagaaaaagatggccaacatctaccattttaaagggattccagcaagcatattattaaatgcagggctgcctctggcatctggaagcagcttgggtgccctggatataattctcttttaaaagtttttttcacagcttttatagaccacttaaaactggccttcatcttgtgccaaaatagcagggctgtgtttgtttagcttcaagattttcaggtccaattgattaaaaaaggtgagtgagaagcctgccaacacacagtgaggctgtcacccaggcagctgctgctgctggcttccagcatccagaagctggaacatcagccagctccaatcacctgacagaggatggatcctatgagaaggaggaccggggcttaaaaccagacgtacccactgaagtcagggcaggagatgaaaatcttaacaagtgaaggaggtatgaaaacaacagattctagggatcagcaaccaatgaatgagggtccattttttgaaaaacaaatacttctactggctgtcttttgagtgccaggcattaaacaaagtggaagaaaaaaattggagggtgactcaacagatggaccagatcaataatgaggggtaatttgagcaggacaaggctggagctggaagtgcatgcaggatgccagcatcagagcagccaggcatcagagagccagccttgactactcgccgggcctcaggggctgagccttcgtcccaggacaagggagtggccagagcttggctggccccgttccagatgaggactgtgataccagtcaggtcaacgagcaccgatagaggtagggcccaatataggaccgtgtctcacaatggtgcagacccgcagtccaacacacaggaaggatgcttgttgctaagtcttagacacgggaactggaggagggttgagggcccccagcagtgggaaggcaggcatggcatgcagacggtggacgcggactcaagacaccaactctcatcactacaggtccgtggtttggaaagtcccagcaccattccagagaaggaaacaggcccaggtttctgatggggatgggtagtagccacagagcacaagtcagccgcacccaccacacacttgctgtagtgccacactctcggccctagagggcactgacgctttcccttcgctctgccccagggccagggccaaagccatcaagtcctgggcagagggcgggagcgttcagtgagagcagcacagaggttaaagagctgctcttttttgagatcttcgctctcacttcctttccaggcagccagttcagcaaggtgggtctggggctgcctcctgggagaagaggcctttcaccctcgaaccctgcaggacctcagtttgtcccagggcaaacctcctacattgggcagttaggtcagacctgcttcaggccttggaagactgtcttctccttggcttctcttactgcactggatccagccaggacactgatcagacctccagggcccaggttaacaatatgtggcccagctctgggagagaagccagcaggtctcccaggcttttgaactcggagctgaaaaccaaacaaaaaaacgaatccaccccattgacaagtggcccagcctagttggccagtcaggagactgcacaggcactgaggccaaagctgccttggattaagaggtatggatgccaccgctgcccttttactacaggtacactggccgggaacctgtagcactgagtgacacctgatcagagagtcacccactggctgggtctcccccaactcagatgcatggctaacaatcactagctaagcatgtattcactctgtggaaagccacgtcacgttcatatatttattatctcatgtattaatatactgatgtaccacattattctaatttactacctcacttaattcttacaacaacctaatgtgatgggcaatattattattagctccattttacagatgaagaaacaagacctgaaaaggttaaacaacttgcccaagatcatccagccaagtcatgataaagctgcacttgaacacacacttctcagattccaaagcccaagtttctctctactaactgtatggcccctgcactcaaaaactgagaaatctctctgccctgggtgctgcagaatttctca

SEQ ID NO: 2663 - DNA, 57200 bp, Homo sapiens
cttctctggaggaagcaaccctgcacagagggaaagaagaatctcaacatacagtcctcagcagctttagcatgggcaacaaattaagtctctgtaaaaggcccaaaggacagggtttggtgagattctggagagctggaaacatggaggttgacaggaatgtaaagaagaactcatttacatgccaggagggtggaacaccccaattccatgaggataactgctcctgtactccagacctcaccccatgtgtctcttcatctggctggttatttgtcctttaagatctccttactcaaccagtaaatgtgtctttacattgttttagtcttgaactagaagatgaaagcatcaaataaagaaatatactgtgggtatatggattacaaaaaaaggtactcttataaggaatagaggagaagagaaaagaagagaagacaagagaagagaaagagaagattgcaagaagggaagacaagagaagagaaagagaaagagaagaagacaagagaagagaaagagaaagagaagatgcgaaatagacgcatgcatttattgaattttaatttatgacagaagtagcatagtcaataactgaggagtggaaggacaatataatcagataaattgaaaaatgcttattgacatggaaatatcaaaggaaaaatataccatgtgcccactgataaaaaataaatggaatattcatgaaaggtcccaattactgttacaataattttttaaataattaggcatttggattttatgtgctttttgatttgagtagtttaaagtgttttaaataacattaaatattattataattataataattattatttttgagaccgagtcatcttgctctattgcccaggctctagttcagtggtgcgatctcaactcactgcaacctccgcctcctaggttcaagtgaatctcatgcctcagcctcctgagtaactgggactacaggcatgttccactacacctggataatttttgtgtttttgtagtagagactgggtttctccatgttggccaggctggtcttgaactcctgacctcaagtgatatgcttgcattgacctcccaaagtgctgagattccaggtgtgagccactgcacccggtccattaaatattattttaattatattaggtcaaatatttttgtttctttcctgaattttaacactatttagaatgagtacatagttgttagctaataaaatctgtagttcaaaaattattttgtgacttactgagcatttcacttgatcaatttttataaatgtttcatgatctcttaaaaagaaatgtaagtagcatgttatagtagtatcttccgtcatcataatagtatgttctatatgtatcatgtgtcatacttctgtcatttttgttttattagtgctttgcttatttcacagattctgcttttgtttatttgtttcttaataaactttctaaatctgctagtttgggaggtttcgactttcatattggtgcacatttaactttatataatatgcttgatcatctatttactgatgcatagacttcagagagtgtcttctcttaactatccactttgatcgatgaaaaaataacgaccactcctgattttagtagttttgttggttttcatatatatgaaatgctactgtatgaataaaaatcaaatgtagatctatttttctattgtttcttccccagtgatacttttcagataagaatatgggcaaataatgattgcagattccatctttggttttattctttttgctaaacattttattctgaggtatagctggtcaattcgatagctcatgatcttaaaaatgtctttgtattctatttctttttttttttaaattcaattatttagcctcattgactacatcattcctccaggcagaaggtgcaaaagacagcaaaacttgaggactttcaccaaggatgtgctaggaggggacgtgggaaatggattattccttgaacattttccctgggccattctcttccttttttatttttgttctggttacatggggctttcaagactcaagcaattgtttgtttttttttttttactttaatttttttagtatttcaaatgtttttattatgaaaaatttaaatatgtataaaatatgagaaattatataattcatccccagatatacgtcacccagcttctataattattaattctgtccaattattttatctatactaccatgctgtttctcttcctttctcctggattagtttggagaaaacaccagacattatatcacttataagtattttgaatatatctctaaaagataactcatttaaaaatataatccctattatgacacacagagtactaacacaaattccgtaatgtttttgaatatacaaaaattgtttaaattcccacaattctcagtctttttaagaaattaattattcaaatcaggtgccagacaaattctatgtatagcaattagtgaacacatttcttaaatttctattaatctttagcttctatctccaactcactgttttttttttgtaatcatttgttgaagaaagtttaaagactgtgttacagtttcccctagtctatattttgctgattgcatttttttgtttgtttgttttgtttttgtttttgttttttgagacagactctcgctctgttgcccaggctggagtgcagtggcataatctcggctcactacaacctccgtctcccaggttcaagtgattctcctgcctcagcctcccgagtagctgagattacaggcatgcagcaccacgcttggctaatttttgtattctcagcagagatggggtttcaccatgttggccaggctggtctccatctcctgacttcaagtgatacacctgccttggcctcccaaagttctgtgattataggtgtgagccactgtgccctgatcacattcttgtggtatttctgaatgggtccactgctccttttcttataaattgatcagactgaggcttgaattttttttggcaaaaagatttgacaggtactattatatttccagtaaaaagcccttaatatctgactgtttctctttttgtgaatttagtagccattgatgattactgctggatccattatttcataaagggttataaaaggatgatattgtaattaaataactttaattattatctgaactaccttgatgaataaaaaattatcttccatcaaatatttgtttctctgagttcagagcatgtaggatagaactacaatatagatgtgttggtaattttcttatttaccagtattcaaaataacgagttggctcccagtatctttgcaggttgatcaattttgttttgtaaaaatatatattattaagcgcttatggattttgaacacctaatttgtcttaactaagtaaaattgtaattcttattggtgttcaaactttcccagctttggatagtgtgagtttctctcagctggctcctgagtcctttttatgatgatcacaacagtctttgtattcttactgtctggtttgacaatatgttctagatgcaacatgtatatttgctgtcccatcttgaaatctaaaatttttttaagaaccctagctcctttatgagaaatgccatttggagacaaaaatctgggtgaaagaatacttgtttctgctgcccaagaacaatagtactgcccagttcactttttttagtgaacagaagtatcacatatttaaaaaatatatacaatatatcatatgttcatgtttatactccaagtcaaatttagcaaattcaggaattcaggatttttttcttaaccaaattcctctcacatatgtgtcgcctttctctcatgatcaaaattccaattcttaatgatatcattattatttatttgctttgtcctgtgtagcacattcaggaaaaccgtagtagcactcaaaagtctgattactgaaaacagtttgaggattttttcttttctcatttttttcttagtgtataccacattgggaataaacaaccaatttactctgttttaacactcacttgaaagaaatatttcctcccaatgtagttatttttattaattctatacaagctgtgccaattttttattaacttgttagaattttaaaatttaaaaacaacttctgtttagtagttttggaaaatatttatataattcttttgactctatttccttagatctgaaaactggttttgtttgtttgttttaggttcatttctccatttttgaataatgtaagcaaatacattatttcccctttccaaaattaatggcagtattctatgcataattttcttcacgttggaccaaattgttttttaaagatcttatgaaattacagtatcttcccttcactccatgctattaaacgacataaacatttactgaataccttctaagtgcaaggcacagtactttgttttgtggtggaggagacaatgaagtagattttgcctttaagacacttttacaaacttttttctatggtttttgatattgcagagatctaaaaatatcactttggatgttcagataatatactgattgttgaatagttattgggttaaaaaaagtcaaaggatagtattctgtgtaaaatactaacaataaggaaaaaacaaaacaggcataatgtaattattccagaaattgtagatcttttatgacattatgatcaataaactataaaacatagacgactgcatctataaagcaccttgaaagatgaatagcctctgtgtgtgtgtgtgagtgtgtgtgtgtgtgtgtgtgtgtgagagagagagagagagagcaggcaggcagagagagagagacagaaagacaacatagattaaagaatgtgtgctaaacatttgcttagcaagtaagctcatttttcccattattttgatatacagcaaagtaaaatttcttattaatatataattgagttaggtacccttatttagacatttggatttatgaaaaattcccataatgatttcaatgtgtgggtttatgattataaataggagtccacttaatttgactgttaatatgctaaggtttataatttacatgacttctctttctaacatgatctgtgaagtagtttacgtttcaaactttacttggattcaactgaatttattttaatgattatcaatatggtcttagttcacattcccaaatgtaaaggtatctttgacaaagataaggatgtttgaaaatacatttttttgaacattaaaatttaacaatgagttgaatgtgatttgataatattcacttttaactgtgaataaaataagcttatcattatatattagcactactatattgatctttcagatttaatttaacaaaattctaatttttgagcaaaaattttctattttatctattttggtaatcatcaatgatccttgcctccttgtatttaaccacttgtgttctttcctcccacattggatccaactggattcagcaaatttttttctgtaccttccacgaatgttaccactttttatagtatttgcataagttgataactgtcaaatctatgatgtgtttttaaaaaaagacattatctagtagggttctaggcaaactgctcatctcaagaattcagttagtggatgatggatgatactttccaaatggttagtcatggctggaaatgtatcaaagcttggaggaaatacaatgacaggtgagcagtgtggcggtgtggtagcactgggacaaagtggaaggaaagagagattgttaatacctttggaaataaaacataggagcataagagtttaaaaagagtttttaaagatgtctaccagtttggtggcacagctgtgtgccacactttcaagaaagcctacggtcaaactcttctgattggttaatgtgtgagaagatgaactcatattctttgtggtaaatcctgggttttatagcctgagcatgccaacctacttttacactgattgtatcttttgtttcatctcttttcttccttgaactcattgtcctctctccatccacagcccaaatctgctcttctgactctgcatcagtgcatgtcaataccatccaagttatgactcaagatggaaacaagaaagtcatccttcacatttgcctgccccttaattttcactgagtctcttaaagattattcctgaaatatctctcaaatttgtcttttctgattacaaccttactgacgctgcagtaagttagaaactcaacatctgtagtctaaaccgttaaaatagctgcttgacttttccggtctctgtgtagctctattctctccattttcattaagtttctttgcaaaacacagacatgatactgccaaagtttcgaacaaatacctttagtggcactgagttatctactgttaaatcgccagacacctcaagagagcattcaaggttcatgatcttgaaccaatttacttttgggcattctccaaaagaattcccttggtagtaaatagtatccattgctgaggctcttggcaacatttggtgggacaaaggatgggcaatgggcaacaggaagggcattctaaaccttctctcccgaccccccctccacttttttagggatggtagatttagagttgggatagagaaagaaaagagagaaaactagccattgaaatttgatctctctctgtgccttgtaaaggaagcctggtccccaggcaaaaaggggtttatttcaagaaggagcagttaccatcttagtttcaaattaaactataaactaaatttctcctaaagtgagttcagcctgtgcccaggaataaacaaggatagtctggaggttagaggcaagatggggtgggttagatcagatctctttcactcccataattttgtcactgttatagtttttgcaaaggtgttttcacaaagcctgcgaggtggttgagaaacagaaagaaggccaatgggcatctgaactgcatagaatagtcagttttattgcttaaaatgtatttgcaagagtaagtctgactatagtaatataaatgactttgcttttttagtttttcaatacttaataataaaatatatcttaattttatattcatctttttctttgttagaattattataatgaattagaaaaattatgaatgatctttagatactcattgcaagaacaagtcatatgtcctaaatgtagaatgagatattgttttcataagaaatatctttcatcacagacataaatatccagaaattttatatgaatgttacacaaagttctgtcagcaacatagggcaagaaattccagttaacgccattcaaatagtttcatctgaaaataaaaggacatgctgtctactcttcctgtcagttttcttggacggtttgaacttgctcacctaatgtggttatgttaggtagaatttatcttttttgttcaaatcatagatctttttttcctttacctagaggaattggcaagtatacagcttttgacttactgtaaaactttcaaagtcatcactttaaacagatctttactttaagatcttaagaagactatcagtaactaatggagtaccatggtgatttaatcaactggtgacttgcaggaagttattgtaagtcaatatataaagttcatcagtgcagtgtctaaagcagcagaaattgacttgcaggcataggtgtacttcagtattgtaggtattagcttcatttctcaataaggagaaatgaaagccgagaaagattattaattgggtttgccaaagttacaaaacactgaagtgataggtccagaaaaagagcctatgttgtctgacacccaaattccatctcaaagtcctacataatattgcccccagctaaacgctatgagtttggtggatagcaggctcaacgcaatgctttttattgtgacttttcgataattaatgactagggatgccttctctgttctttctaagatgttaaactgtttctcagtgagttctcagccatgaatctctgctctgtacttgactatatttcttgccccattgacttcacagcgagatggaatatgggaaagatgtaaagcctctgcccttttttccattagtgacaatatttttccagttcagttacaggtttaagcacaggctctttgttagccaattcatctaacacctcactcacactgagtcccaaacacacaaatgcctcctaaatctttatgttcttattctattaatttcagagaaaaaaatgatatttcaccctattttactttatatctttttatcatgaaatatatatgagttctgcaataacttactgataagatggattaccaagaattattgattaaattctactcatttgtgagcaactactttttaatcccatttctcatggactgggatttatttcccaaatcagatttgcctttgtgataggtagcaatattttgagaaatgtaaataatgacattgatgtcttccagtcaataaatagaataatatatttaattaattttcttacctcatcctaaaggcaattgaaaattgaagacttttcctctccaaactgtgcaaagtgtttcttaatagaaaaaaaaaaaagactgtggcaaggtgcaaaggaaagaaaatgcaataaaaggacttgttactctggaagcaaacgtacctgggtaattagttgccagtccacttagatcgtaacacagataactgagcaagatattagtaacgctgaatttgaggagaatataccccaaactgtatttctagtatgtgatctttaaaagatttgtgtggtttatttatcacactgattttttcatttaaatgcatgcattagtaacatctaatctaaaggtttttttccctcctatgattgatggacatttttttaagaatgcagtttgtcaagaagactttcccttttccttcttgaaattcctgtttcaaaccagtggaagcaatgtcctgcctgtgatggcattcaggacatgaggtatccttgtctttgacagcaaaggacatttgttttgtttgagttgcactcttatcactgacaacaacaaaattgtcaagtgtgttatttgaaacatcaaattcaataagaacctttgtgtatgtaagctacattgtatataatgttttctttcctaaccaatggaacaaacagctagaatttgtgatattcatatattgaatgatgaaatatgatacgaatgtaattgcacagtataattataaggaaccaggagtatatttttgtgttaatgatggagtataatataagctgtttgtgaaattatacattagaaatcaaagggggtagtataacaaatagttaaaacataaataaattttatttctcaacacaagttaaatgttttagttgtcactgaaaaatgcaattaaaattagatttatatatctctgtttagaaaaagtcactatcaattggaaagaatattcaattatttaatcattcattcatttcttatgtgtgttgaatccattttcttctgacccaaatctgataaacatttttgaatgaattcaatatttgtaagtgaaaggaaatgtacctaaccaccttgtgacttgctgaggcaaattagatgaaaagaaatttaaggagtaaatgtaagagtcataacttttaaagctatacaatttatactactgctggcaaaaattacaattacattgaatctcagaacaaatttcagttaaaatgtaattcatagttctacaaagttctaactatattctattaatttaaaataatagtaaatctgccacaatataagatcctagacactgtgtaataactatgagattttttaaaaagtcaccaacagtttttatttttagcatctgtgaagcaactctcatttacattaaagttacattataattagaccatatttttataagtatagaaatctgtctttaatttcttaatttcttactttgtgaaattcctaaaatataatttagaagatgtaccttgaaacataaaattaataaacatataataggaataaaggtataatattttcttattttaaacgcattacattttcttaaagcactatacctagctatatatatatagggtactgaggtccttacctctatctctatatatatggtactgaggtccttaccaacaaaattttaggtaagaattatcatataatattttcttaagtataactaaaacaattcttctgaagttttattccttctgaggtaatatatagattacatgtcttcaggaagatatgacttcttttcaagagatgagggatataatacattaaatgattttctgtgtgcgtcagcatgtgtaggtatatccagtgtagagtccattcatgcttaaaatgcacctagagttgcatttgtgttcaaaatggagaaaaaggggaagggaagtctccctattctattatcattacaattctctcacttcttcatttcattgccttttgttgtttcctctccctcacttgccaatctacgcaaagccctggttcacatatagtctgagaatgatggtcagattcatttctagattcgccactgagttgcattagttttcctgccagtgaatgacaaaagtccaagagactattcaggcatttgagaaataataacctagattttactgagaaaaagagctagctatgaattagtagattttagaagttaaaattaataggtgaatacataataaaaattacttagtctgagacctgtacagcctttaaattttttaagccatagaattttaaactagtcaaatacaccaaaataaaatcaaatcttggatgcatttactctttttaaaaaatgattatgtattcacaatatgtataattaaatacatagttattaatctaataataatgctgatgaaatatcctaggatatagtagatggtgtgtcatgtgacccttccctctaatgcagagcagatagctgaaatttcacctgactacattctatctgggcttctaccagagtatacttttgatcttctggcattctccagggaatgcatatatatctgttcgggtcactgtttgccacatccagcaaccaccttgacctagaatcctgctcactgttctgctcacagtttaccaggcccttgtaacatgtcatgtcatcctctgtcttcagtctaacttctcaaaggcagctgctactggtccgaactgcttccttccaattttgggcagtgagccacctcttcagttccccacaggaatcactgagaacaggttgtaatgtttaacaagattttactgaaggcttaaggaacaatagaagagaaatataacacgacgacctttaaaaagatgctcaatggagccgttcttagcagagccagcatcaacatagtccttcctgcacctagtgcagagtctgacaggtggaagtgctggatgagtacagtattttttgttgagttaattaatggaattagtttgtagaacccacatattcacatgtattcacagagtttttgaactaggagcctctctaccttcaacctgccaacagtcccaagttctatctcttcgaagttagcacaaactaagttttctcctccttatctgagtatgtggattatttctggagtagtgatttcaaaatacttttattattctaatatctgctctactttaaagccccccaaattaccattatttcagttggtgtgactattctcttcctggccttcgtcctcctcttttttttgtctgacttttcaccactactttctgcccaaacaaacttggcaccctcacagtaaaccctccagctgctcatttccactcagttcctgcaattcttcttctatgcattccatttctctgtgaccgcctcctgtctggcaacctcccaactcttaaggttcatctttcatctgaggaaagatagtagttacagcaaaagatcggacgtgctggaatcaactattctgcaaaattgttcttagaaaatttcctgagatctccctgagtcaattttaagtatgtcaaaaaattctgaagactaatgaggccagctcccccagagttgggagctctcattctgaggctgccttgggtgcaactggactaaagtcaaaaggaacagctgagctcagaacagctagcaatttaaattggcatgataataactgagacacagtcatataaatgcatttatattttacacaatattttgctttaaagttaaatcatttgtgccttcataatttctaacacaatatttaataaacagtaaattgctagcaattttctttattaagctatttctctaagaagcttaaaacttatgtacaagattttattcaacattttcaatttatatatatatataacataaaaggaatagataatgtcaatattcaacaataataatgtttcctgatttgcttattagtaaactcattgaaatagtatgtcacctacatgtgtgggctataacaggagtgatgtttgggtgcctagagaatagttggtacattctcaaagggaaagacaatgctaatcaaggttggaggtagaagagaatttattttagtgacagcaaggtaaaatagcttggccacaccaatagtgagtgttgaagagtaatgagaagcatgtttgtattgatgaggagaatgcttattttcaagtaagtcaaaacaattttacattgagagaagtgggaaatagtaaattcaaaaaattctagtttgctaaagaaatcacagaaattttactgcttttcgattgtgtgttgatactacagctggccatattaactaatgaaacactgttatattttattctatcataacaaaaggaataaaactgtatgctttttatgcattccagagttacagttggaatagtacattctattactcacgtaaattcagtggttctcctaaaaagataactctggaagaaaatgtccaaatctctgaagtaaaactcaagggacaattatttaggagacaaactgcaagtgcagaatttgcctgtgaaagaaaatgctctgaatcgttttcaaacatttgatagaagttgtgaatctcctttgtgaatccttgaaaaaaatctaattaaatagtgaaaggcactgaaatttagcatttacttacaaaaacaaaactatcccttcatatgtatcatgcatgtgtataccctagatcttgtattgatgttagcactaatgtaagaggcaccataaacacgagtgtttgatgcaagctagagagataacaaactggcagcatattgctatttaaactttgtgacacatgttgcaggtgccaagataggtgcaaaattttcaaattatcacctggtttgtttgcaagaaggaaaagcatcatgctacttagaggaaatagtgtggcaatgtgattctaacgaacgcctactgtccacataagacaaacccttaaactcttcaatctgtgatgttgccacatttcattgaaaaaaatatatgccaactgtacagctgtgtgataatagccaaaattaaaaagaattccaggctggaatgcagtggctattcaaaagtgcaatcatagtggactacagcctctaattcctggactcaagcaatccttctgcctcagcctcccacttaggtgggactaaggcattcgccaccatcttagtttatttaagattaagatttagttaatcttagtaactaaaaatgcttttcagtttctttaggtcatgtttttgttaaatttttaacagtaactcataattaaattagtgaatttcatgttcatagttccagtcttaaatagaacacgtatactacagtaaaaaaaagaacacaattgcacattagttttgttaaattaatgtattctacttacttgtcctaaatattcaagtgatggttaattagctgtactcttattttagggcactatctgctcgtattgaaattgttgttactgtttgcttaggtgacactgttcttgtaagctcctaatactcacaaaagataaatatagagcatttagatgttggaaaatcttatgcattgcataatattttgttgtaactattcaaatgaatattgacatgaggcctacgcatattgtttgcctgacagcatgcaggttttagaaacaaaactgcaaatttatttcacataattaaaaaaaacttgtgaattattacaataaatagtctataggttaaagtaatattatatttattatagaaagagtctgtccagatttctgggagtagtaggaatttggtatttgaaaatacttataatctgtatagtgtctgaccgctcatgagcagtctcctaagtcctataaccttgattttgctttccatctcctgactctgagtaatacttcttcacacattcttcagtaacaactagctcaaaggctcaaaggtcaatagagtttccttcttctctcatgaaaacccatcaatattcactgtggcttcagtctgtgatttgctctcatttttcttcattaaaaaaaaaaaatccttccagcattccatttcaggcaagctctatccctggttctatttggtgctttcttctctcttcaactgactatgagggacaaaacaaaaacaaaaacaaataaacaaaaaaactcccaaaaaactgacatctggatgtgtagggaccaatatttcagagtctactctgtatcttaggaatctaaatttcgaaaccaaagcactcataaattccttatcggattgacatgctatttccattatggtttgcatattaaataactataacttctgtatttcaaagatgtcactatataacatttactttggcagtaaaatactttttgcatctttattttttattttttgtcttttgacgcttttcgcttctacctccatggcatgggtgcacacacacaggcacataacccaaatcactcaatggattagacatggggaaagatcccttatgatacatacaatgtagaagagaacagaaattcttatcaccatcaaacagtagttttgagctgtaaatatattttctatgagcctattgaaataataattcagaaaaagactagattatgccagcagtttttaactattttttctttagacttgttgaacagtgttgcattttcagttgtattggttttataaattgatccctgtggaactgtatttccaaaggtagagtgccttctctttcaaacctggattaataccactgaatttgccctttgatgttaataattaaaaagaataaaacctccttgtggatttttccttcaatgcaatttaagcttattttctttgttagtaatagccatctggtaagatttacatcaatgatgaagtctagttggagcacatgtttcatttttgcattgacaggaataatgctgagtatgttccttagtctctctggaatcaccatgctctttacaaaaaaatgttgtgattttcagtaattctatatatggtggggtggtatagttggttttatttaatctagaaatgtatagtgtgcatgaatcattttgaatggtaccatgtaggcatcaaagcaaataatacaaggctattttctagtttctataatatattagggaatagaaggcaactgcaaataactgtactaaaattaaaacatagaaaatgttctaaaatggtaaaacatattataggagtacagcgaaaggagttttttcatcatttgatattttatttctacataataataggtaactaaccctaaaatatttgatgtttatgtatgcaatttatttaaaaaacatcctcttcaaattttactaatgcttattttcaaaataatctcagagcaaggttattcgtcaatttaacacttctgatttcagagaatacaactgtcaattttacttgattatagcaaatagtgaaaataatgtagacaatcctggatactgtatataacttgaaaaaatattataatatgttaggtttaatttacataatgttatgaatttgtgaaagtagaaatcacttgtgtaaataattacagcccagtgaaaattgataaactgctgggccattcatttaatttcccaatatagtcttgaaactgctacagataaccaggaaaccaagaaaacattaaaaacctgaagaagattaatagtcgtacaagaaactttatgaaacagagttttagggacagcaatccggttggaagacgggttagtagacttgtcttatggctgagtttatttgggaagcccattatttttccacagaatatagatgagaggggactgatggagatggaggagacaccatcctcaagcccacccatgcaataaccatggatgaataattaattggatgagtttagtgtgttaaataaccttatttgttataattactttcttgggacattttccattgacctgaacaaatgctgaatttacttactgtgacattaacagagaaagcatatttgttatattactgatatatagttaatatatgtttgctattcatccttaaaaggattttttgttgttgttgtttgcgtgttttgttttgttttgagatggaatgacacccaggctagagtgcagtggtgtgatcttggcttactgcaaccttcacctcccttaagcgatcctcctacctgagcctcccgagtagctggaactacagatgtgtgccaggctaatttttgtatttttttgtagagacagggttttgccatgttgcccaggctaggctcaagtgatctgcccatgtcttcctcccaaattgttaggattgcaggcatgaaccagtacacgcagccaaagggtgtatttttaatgtttattttaaacctgaactttaacaggatctctgatcaatatgattaattttcaatatgcttatggtgaatttgctatttagacgaattctgctttaggaatttgttaggaatgccataactaaatattacagacactgggtggtttggtttaaacaacaggatttgttttctcacagttctggaggctggaagtctaagatcaaggtgtccgtagggttggtttctcttgaggcctctttccttggcttgcagatgactctcctttcaacatgttcttgcatggcattttcttcatacgtatgtatccctggtgtcactaaatgtcctaatctcctcttataaagacaccagtcatattgaattagggcccacccttatcacctctttaacattaattacctctttaaaggccttgtctccaaatatagtcacatttggaggtagatacctgaattttgtaggaacatggttcagtccataacagaaaatcacaagggtttagatttctggaacaactagaaatgctaaaacataccctgagtaaccaggggaatagcatatgctgttcagactcttggtctgatatttactgactgcttgtgttgtccatcaggaatgatggcaattgcttgagtcaggaatctgggaatcattcttaactcttcattcttccaatatttcatgaattgcctgggagaatgaaatttgctccctctcctaaatatctgttcaaactattcacttttctccagtctcaatatgaataggttagcttttcacttggctagcttactacagaaacttcctaattaccatttctgccattgtcttatttttaactcctttcatttcatcccaaattcagccttctgagtgattttgcataaacatttcagtgacttcccattgaccacagaatttggtcaaattccctgcattatttgatagagctccccgctacttaggtacccttgccctctgtctacttctccacccttgccttttctcactcatctcttaccctccatcctttggccagactaagctcatattcactgagaagctatgttatctcttagctctgatacgctgcacatgctgaaattttagcccagagatctttctgccaagaatcttattcatatttaaggtctcagcttaaatataactttttataggcacctttattgaccccgaaatctggctgagatgttcttttaaggtgccacaaaaaaaaaaaattgaaaaaatatttaattaattcacacttctcccatggttacatttctctcattaccttggaattacatttttaccagtatatatgtactactaaaatctaagtttcttaagaaataggaatctgtcctgcttatcactctaatctaagcactagtataaagcctggcacaagatagatgttcaacaggactgaagtgactcgatgtataattagattagagaatctcttttaacatatatcaatttttattaggttagggattaatggcagggtaagtattctcaaattgtgttttccttcattatatttcttttgctgtcttccattattttcatctctgtgtctacacttttctatacttgagagttttctatatttttgatcctaagaatcaggtcacttgtatttttttcaccttgcatcatacaaagaaaagcttgaaagatcctggtctgttgtataaactgactactgggatgaattggaaactgaagcacagtgaccaagttaacagagaggaagagaataaaaggacagagccatgacacagtgaatgcttcagggcagccgagctgcaggcatcaagtttctcacagataacagagttggtagctatcgttactagattgttttccaaagacagttgatgctgcagcagtatgtgtatgtgagcattttaagagaaaaaaatgtccacccaaacatcaatgtggtaaattgtatgtgtcaatgaattagggctttattctccacatgatgaaactgaaatgtgattgaaaatgagtgaagcgtgaaaaagggactcatgtttaaaacactcccagaagaaataatgcctgtgtaatgactatactaaaaaaagtatcatttctaaatatgtgctatcagtttcaccaggaattagatccaagtttgaaaacatttagtcaaataataaatttcaaaataaaatcaccctttaatattgatagagactttgactatatgattactatgagaaattcttgtagtctttattcactgtttcatgtgtacacagtgaaagctttaatatagaaacttttataatatattaggattgttttcctttaaataaagtatatattgaacataccaagttctctgtggattatgagtgaacattctagaaaatcatatttacaaatcatgccgcttcagtgggtataaagaaactattttgttgccccataaaggaaatttgccttttggacaatgtgggcagaggtaatgacctgttactggaattttactcctagaaacgaaattctttggtaaataacatacagatgatgaaagaatatattttcccagttgcaagtaatagaccaacagttaaaatattttctcaaataactagaacacttccaggggtaggattaaggttgctttctgtctattgcaatttcataactgttttgaaatcagtaattatacaaacatttattaactatcatgatgtctaggcctgtgttgggtaacggaaatacaaaagtatagtttctagatattatccttgccttcaacttgctcatagctccttggaatgcttacaatatttctctctaatatgatctttaaaaatttgaaatcttagcatgttacttctttgcttaaaaccttaatgctttcccttttcagctagaataaacgaatgctagaaaccatgattcacaagattccagctgatcttgtctaagtttcttgtctctctccctattcttctcttccctcacctggaacatcactttttgagatctttgaatgattcactctttctcatgatgtcattctctgttcatacgtccttttctcagcaagcctctctctgaccaaatattaaaaaacccccttcccagtccacaaccctaagtcagtcccatcccttacactgcttaatattctttatggctcttgtcactgtctgaaatatttgtttacataaaaaatatccaaatagaattaagtaccatggagaaaagactgtttttgccaactgctgaattcatatcacattaaaaataagtttgtggcccacagtggtacttggtgagtttgtgctacatgaatgaatgaagttctggaaaggcctttgctgttcaacatatgatgtcactgtctccacgtatcagaagtttctgcacaaccagaatggcgaagaaggcttaggaagtcaatcaaaatgcttttgtaaaatgtgttttctaatttcccattcaatatatgctcataaagtataatttggaacttagatgcagaaatagaatttctcctcaaatgagacctcaataccaaaagactgatgttacatgccgattttcccatgaatttatatgttagatgtagtctttgacattttttcctgaaaatggatatatatctaaaatttgattttaaaatcaatttttacaaaaaagcattaattgtgaaaaaagttagaaagctttggtaaatatattaacattaaaaataatatatgtatattataaagctgtgtttttatgtaaggatttcttaaaatagaatgttattataataggtatatgtgttgtaaaataaaagttgcacttcaggttatcttaaaacatgactgggtttcagactttacaaatgctttactacagtataccaagaaagatattttggactaaatgtatacacatgttaggcactgcatcatacaccatttaaactgcttcaactgtatctgtcttattttaaagactgcacttgcaaatactgagggtgtattgagaatgtttatctaccaatttccttttttgcttgagagacagtactcaatattataaattacccccctggtagaaaatccattccaggaaagccctctgaagtgaatacctgttaaactaggagatctttaaaatgaatacattttatgatgagaaaatgaaattgaaaaatgaagtactgaaataaaatgcctgatgcttgtagaaaaaaaatgacatctagtaacaagtaaaatttacctattaagccacatctcattaaaaacatgtatagaacagtagaggtgatatgaaatagccagtgtcatgctcaggatatatttgtgctatatgtaattgtgctattttaattcatacaattaaactatacttttgtagatcactttaagtaaatgttaaaaatctgatattgtaaactaagtttatgagaggtcatgattcatgggtgagaatttttgagttgtaccattgagcaatgttcagattgaattatttccattttctgtctgcccttggggttcctcagcacaaatattgttgaagaacatgcctcagtggtatttccttatacatacaggcttttctgggtgaaaaaacatgttctacatataaaatacacaataaacaaattgcttcagtgtaagcttctctcattcccttcctctttccctctctacttcttcctctgccttctctccatcgctctgtctctcccctcccagggaaattttgcttttgacaagtaacttttaaagtgactcaatgactgttttctcatttgaatctcatgtcatatgcagtggagtttgtcgaagaaagctgctcctgaactgctgtaataacagaagctctactaacttgaagtttgtaacataaaagcactctaggaaggatgaaatggcagctgggaacaacactttaggcaccggaagcaatacagcagctgttgggggacagcattcctcttatagacgtccatgtgattttctcagccagggacacatctgcagggcattatgaatctgccagaagattaaaaaattcatttacacttttcgaaatatctgagggaaccatttgaagtgttagagtcttttgtagcttttacaaggaggcctttatggaagcaaaaaaagtcatgtattggaaagactagatttaaattaacattttttaaaaagttcatattttaggaccaggatagtaaattttaaaaagtgaaaagaaagtaacattctatgagctaaaaatggttattggtaaaaaattatcagtgttctaagtcatgttataatttatatattaatttctctctctgtatatctaaacacacacacatatatgtatgcacatatagtctctaaaatattacatacctaaaatattctgcacaaatgaacataattatgtaaatgatatttatagagggcttttatatttatcaacaaaacctatttaatgttaatgtggaacttcaaagctgaaaggtattatagggtaaatattttttagtagagattggaagaactgagttttagaaaatttgtctttggcgctccaaaattaccatagcaattgaatacagtacttctatttctaagttaacacaatgacaaatacagtgcctaatgcataatagttctctttttcacactaaagagagatattttaaatgttaaacattttaacatataattttaattgtcaaaattataatatgaagaatataatttagtaacattaatcatgtaaaattggtgaaatacatgaaaatacttgaaaattaattcaaatggcatgtggcttttgatatgatgtgacgggatccatcatattcttggggcaagacagataagcagtcaacaggttactgcttaatacctatgtattagaagttcaagaataaacaagaagtggagctcacctgcctcaaaggaaggtcgtgatccattgttcaatttctccacaagagccacttctcagccccagagctcacggactgagcagcagtgatctcctgagctcctctgaagaaggactgatggacatttatttaggtagctacacatttgggaaaggagaataccagggctttagaggattcttggatgcagaatctgagttggcactgatatttaagatccaaaatgtcctccctgttaaactcagaattatgtgatcaagttataaacagagctcaggtccatcttaaagtgggtccactggatttatgttggcagaaccttcaccctttttccttgatctgtggaatgagagatagaaggaaagtgagaaggaagcttctgaaactgtaccctctctttaaaatacttaatcaagaagcattggtcagtcactaacagaggcatgagttcaagtttgcaaggcaatttatgtccctaacttccctatgaaattagactgaagctactttctggaggataccacattcttgttatgcttttttcctctcctttttccacttccatttcaccccttggcctgaaaacacttcaataaatcatttgaaagttacccttgactcaggctcttccctagggaacgagatctctgacatttgaaatagcacactccactctctacctcttttgttttttatcctcttacccattttatttttacatagctcaaaagtacttcatattatagttctaagtagctatttttaaatttatctaaatggactcttcccctcattagactgtaagttattctgagtgtaggtactttgtattgttcactatgttagccctcaaagaatagaacctaaacaatacttgatattaaaaaatgacaaataaatgaatagatgagtatgtaaatgatttgaaagagcacattttcatttactttattattttgttgttctttagtattataggtagttcactaagttactcctaaggaaaattcagttgctcaatttaacaagttcttttttttttttttttttttgtaatcctattgcgtatgtagattcaagtagaatcaataaaatattttgaattaaattatataaactctaagtgagaattagggggtttatatgaacacacatttaactttagttttatacttagattatttttccatattcacaaaatgagttatttcctttttatgtttctaatctgtgtcttcagtattctagccttacatgctacaatctacctcctcttggaaacatagcatgttctgaattgctccctgttggttaatagtcattttataaatggaatagtataatctttaactatcccgagatgccatcaattttaaaaatttcaaccttttacacatttaagcttctgaaactcagtgtaaggtggtggatacattttactatactcagtaaatcataaaactccagtaatttctggaatcaaatttttgaaatcattgtaatttttatagcaatattatcttatatcaagatttccttttttcacttaaactaattgattgaattatttctctacatattttatagtaactggcctttaaaatagagtgagataactttaaaatatagtgtattaaatcaagaagatggcatatattgagagaaagcagacactttgagtttatctcaagctgtcatgcatattataaagcctaaagatttaagaaatgaaacagtattactcggtgggagagtggaggcaataagaacatgaactaaacaattcagattttttaaaggtacctctaaacaatcaaggccaatagtagaggcattggaactaatttggcatcccaactctgctattatctaactatgtaatctgggatataagtaatgccatttataaaatgattttatttggtgaatgttgcatgaatgattttatatataaattcctattgtgtttttacatcaccttattcttccctgtaactccatacaagtgcccatttgagccacaaagtcatgttagtcaagccagtgaatggaaactgtacatgcttgaattttaagtcacagtccacaggtaaaattaggagttcgggaagaatactttctgggtaagttgttcccatactataagaaattgaaactctgggctgaggtttagacatgagaatgacgggaaatcaaagtagaccacagtgaatgaagaggctttgtgctctgacttgtcaaccctgagccttagcatccaggtttgggataataaaactcagatatgtcaaccctgagccttagcatccaagtttgggataataaaatctcagataagtttgcgcatctgagagtataaaggagcccttgctctccagaagtgtcagttaaacctaaaaatggcagccttgcaaatgctctggggtgtcattgtggcatgagagcaagagaagatagatggttatcagagttggatgtaggataattatatagtttagtttgcccaggacatttatgatttacatctgcttttcagtaacatttatccatgacagcatgtcctagttttggctgataaattagataatcactcaagttctaagtggcaaataggatttgaagtagccctatcaagttccctatagccctcaagatggataaaaatgtggcttcattctattgtgcttcagtaaattaaaggagacaaaacagttgaaagaggcatacatatgtagaacatatctcaaaataataacagctgtttatgacagtcccgcagccaatatcatactgaatgggcaaaagctggaagcactccctttgaaagctagcacaagacaatctctctcaccattcctctctcaccactcctattcaacatagtattggaagttctggccaggtcaatcaggcaggagaaaaaaataaaaggtattcaaatcagaagaaagaaagtcaaattttctctgtttgcagatgacatgattgtacatttagaaaaccccactgtctgagatcagaaaccccttaagctgataagcaacttcagcaaagtctcaggatacaaaatcaaagtgcaaaaatcacaagcattcctatacaccaataatagacagagagtcaaatcatgcatgatctcctgttcacaattgctaccaagataataaaatacctaggactacaacttataagggatgtgaaggacctcttcaaagggaactacaaatcactgttcaaggaaataagagaggacacaaacaaatggaaaaacattctatgctcatggataggaagaatcaatattgtgaaaatggccatactgcccaaagtaatatatagactcaaagttattcccataaagctaccattgactttcttcacagaattagaaaaaactaccttaaatttcatatggaaccaaaaaagagcttatatagccaacaaaatcctaagcataaagaacaaagctggaggtatcatgctacttgacttcaaactatactacaaggctacagtaaccaaaacagcatgtcactggtaccaaaacagagatatagaccaatggaacataacagaagcctcagaaataacaccatacatctacagccatctgatttttgacaaacctaacaaagagaagaaatgaggaaaggattccctatttaataaatggtgttgggaaaactggctagtcatatgcagaaaactgaaactggaccccttccttacaccttgcacaaaaattaactcaagatggattaaagacttaaatttaagacctaaaacaataaaaaccccagaagacaacctgggcaataccattcaggacataggcatgggcaaagacttcatgactaaaacaccaaaagcaatggcaacaaaatccaaaattgacaaatgggatttaattaaactaaagagcttctgcacagcaaaagaaattatcatcagagtgaacaggcaacctacagaatgggagaacatttttgcaatctatccatctgacaaagggctaatatccagaatctacaaagaacttaaacaaatttatgagaagaaaacaaccccatcaaaaggtgggcaaaggatatgaacagacacttctcaaaagaagacatttatgcagccaagaaacatgaaaaaaagctcatcatcactggtcattagagaaatgccagtcaaaaccacaatgagataccatctcacaccagttagaatggcgatcattaaaaggtcagaaaacaacagatgctgaagaggatgtagagaaataggaacactttcacacggtgggtgggagtgtaaattagttcaaccattgtggaagacagtgtggcgattcctcaaggatctagaaccagaaatacctgtttgtcataaacagctcattattttgagatatgttctacatatgtatgcctctttcttttgtctcctttaatttactgaagtacaatagaatgaagtcgcatttttatccaccttgagcactatagggaacttgatagagctacttcaaatatttgacccagcaatcccattactagatatatatccaaaagattatagatctttctactataaagacacatgcacatgtatgttatctgcagcactattcagaatagcaaagacttggaaccaacccaaatgcccatcaatgatagactggataaagaaaatgtggcacatatacaccatggaatactatgcagccataaaaagaatgagttcatgtcctttgccaggacataggtgaagctggaaaccatcattctcagcaaactaacacagaaacacaaaaccaaacaccaaatgttctcactcataagtgggagttgaacaatagaacacatggacactgggaggggaatgtcacacactggggcctgtcagtggcgggaggcaaggggagggatagcattaggagaaatacctaatgtagatgacaggttgatgggtgtagcaaaccaccaggcacgtgtatacctatgtaacaaacctgcacgttttgcacatatattccggaacttaaagtataataataaaaaagataaaaaaatccctggatgcaaaaagctgtagaggggactagactaaattaaaggtactaaacctgaaatgacagtgtttatctgagatttaataagatcatagttttgatgattacttgaaataaaagtttgagacaaaaactaagttcagttacagtaaaaaataaaaattaaaaaaatatggattgagaaaagtgtacccactgcaagtgtttttcaaactattctctgaagaggtgtacaggtctaggccctcagaaagatatcaagggcaaaggggtgacttgggtgagagatctgagctcatcaccccttccttaaacagtttgattctgttcctacttattctaactattttaattaaagaaaagatttaactactaaaataaaacaattgatttcatttgttacttttctatttttctcacagcccataagtgacccaagtcctactgcttctattttcaaaaatacatccagactctgatcatttcctactagccccactgttagctaccatgttccaaaccgttatcattcctcactcacattattgcaataacctcccagctggtcctctttgatactcttgttaccgtatagtctattctcaacagaatagcctgaataatgcttttaaaaagataagtcaagacagttcacttttgtgcttatgactcttcaatgatatcttatcacttaggctctctccagcttgctccataatgatatcacaaggccctgtgtaagctgaacccttctacatactctgacccttttccaagtttcttttgctgtctctgcattacctgttctctgggcatctatgccgtttgcacaaacatgctaatcatgcttccattttgggacttttgcatttcatgtttgctatgactagcccctccttgctccagagtaggcactcaaaagtaagtttaattaccattaaaccacatgatttctaagaatacttttataacttaaggtctgtaactataagaaattgttgctttggaatacctgaaattgaaccagatgctttttttcaaacactgtaaggatgatggactctgctgtttctgttttggtgctaaagtgttaatttcaaaattgtctattttgtctcttgatagggaaatattggacgattgatgtcaataccaaacaagctacaaatagtttgcattcaactaccaatatttgtaggagaaggataccactgctaacttacattatgtagcaaagaatttaaaaattgcactgctgttaaaatttacaaactttgtaattttcaccataataaattcaaagattactgtcttatgttcatggtaccaaattcactcctatacattttacttatttaggtgttacttataacagttggctttaatatcatgccaaaatattaccattcaaaattgttcagcagctatatgttattcctagaagtagacacttaaatgttaatttgtcaagaaactcatgttctattggtcaagtcagttaactttttgaggactcaattaatttattttctttaagttgtaggcagccacaaaaatatcaccaatgatcctcacctcccagcatgaatgcccttgtataattctgtccccttgactgtgagctggacttaaatgaattcatttctgaggaatagaatacaaggagaagtgttgggtaggcaattctgacatcaggcatgaaaaactctatgacttctgtcttaagtgtttctcattttttattacatttgcttgttctgggagaagtcagttttcatgtcccgaagcagcctgtggagagtcccacatgagtgaacttggaagcagatatgaaccttgtcaacaggtatatgagtgagtttggacatagatccttgagaactaagagccatgtaagtggatttagaagtgatcttctcttcattgacccatgagatggcagcacctgtcttagtcaatttgagctgttctaacaaaataccataaaccaagtggcttataaacaacataaatttatttgtcacagttctggaggctagaagtccaagagaagggtgccagaattgtcagactctggtgagagtgctcttcagggttgcagactgccaatttcttgttgtatcctcacatacaggatagcagaaaggagacacaagctctctgtaactcttagactcttataagggcacaaatcccatttgtattagtctgttttcatatcagcattagtcctttcataagggctctatccttatgaccataccaaatcctaattacttcccaaaggccacactttctaaaaccatcacactgggaagggagtaaagtttcaacatatgaattttggaggaacacaaacttccagtctataacacacctgatgtcacatacggttgcagcctcatgagagacactgagacataaatacccagctaaactattttcgaatctctagctctcagaatctatgaaatattaaatgattgttgttatcatatgtatggatatcccatctaggaatatgttacctaaggatgacattattgattactataagattttttcttctgtctctgaaatctctctttgcttttctaactataatcagactagaacataggaattgccattttcaccagactgtaaaaatagtgaacttgagaagacatgtgattttgcattgtgataaatctgttaaatggctaatttagcatataaaatatgtttaacatatgcaaaattgtcctaaaatcgctagtctttttaaaaaagtgaatttcttaaatcattcgcccaactttagtctgaagtaaaattaagacaaccaagttagagtgactgctctagccctcttgcataagaaggtcacttaaaggagacttggttcaatttagatctaggctgcctcaaaaggacagcagtagacagactggtcagaaggcagcagccttgatcttcatgactcttgtccttacatttccagcttacaccaatgccctttgaaataacatgccttgatctgtctggtccatccacattgctacagttttaattggtcaaattcccttgatatcaatccctcactcatggccttgctatattatggctctcgtaccaggagcctctagcatcactgatcctttcatttgtataaaaggagaaatctttcaacattatttatataactagcacctccatgggtcaaagcaccagcttgcaacatcagctttcttccaatcttttaaagcctttatgagattacaggagcttcactattttcatctttaccactttctcatagctaaacctcagtatggatttatatacatggatacatgcagacaaatacatatgctgatacacacgtgcatataaatatgagaattttcttcttgtttctagctgtagtcagtgtaataattatctgacagttcataaaataagtaaatttttttactatataacagatgacaccttatattaaagtgtacataaggaataacttaactataggctaaaattaatcagttctgtttttctgtccctattgaaatcagtaataaaatgttttgtctagtcacacatacatacacacacacctacacacacatttctccttggagaacatttagcaacaactatcttctatttgttcgggcattttcataagcaaatcatctttacagttctttagtagtagtctccaaagtgcatttcttggattattgttttgttaggtgttgacatactatatactaataatcctcaggttatgtgtgtttggaaaatacacagttaaaaaagggaaatagattctgttatttcaggaataccagatgttaatagatttttattaaataactgtaagcctgttaaaattaacataagcctattaaaatttaattattaatgtgcaatggaaactatgggataccatattattaaaatgaaacgataaagaacatttaggagaactaaaaaacaattctagaagagacatttaaagcaaaagtagatcgctcatggtcagcatcatttaactattcagcaactggaagtcagttttgggtgaggcacctcagtgagcatctagctattattcatcaggagcctcaggatgggagcaaggttttacttaaacacttttaaattacatagtgacgtgcatggcttacaaaaatgagatattgttgtattagaatactttcttacataacaatattttatcatagaagtccacttgataatgtaagattccttgatgaattgattcttgtaggtgaatattaatatacacactaaggacgatcagtaaatacttgtctaataaaaatgaccagaatcctgagagggtccaacattcctttctctgttgatcttatctcttaaatatttctccagttggctgggggcggtggctcacgcctgtaataccagcactttgggaggcccaggcgggtggatcacgaggtcgggagattacgaccatcctggctaacacggcgaaaccccgcctcccctaaaaaaaaaatacaaaaaaaaattagctgggcatggtggtgggcgcttgtagtcccagctactcggaggctgaggcaggagaatggcgtgaaccaaggaggcggagcttgcagtgagcggagattgagccactgcactccagcttgggcgatggagcgagactctgcctcaaaaaaaaaaaaaatatatatatatatatatatatatatatttctccagtcttagcaccatctcctttgcccaagttcatgtctttatttcccacctttaaaattaatttttatttccaacctagactgtttttcctatgtaattttgcatgcagctttattctctacattgcattttctactttgtcaccagaattttttttaatgcaaatgtgattatattgctttcatgtttatttgcagtggctctgtgcacctacagggtgcagtccaaattcatatgttgaatgcatatgtttatagttcagctatttcatgactttatgcttttacacctactctcctgacacctcaaatgccctcttcagttcagtagttccaggttcctagaactacttttaaaaagtcaaggtttctagaaacataaagagggaaacactcttcaagacatacatggaagcttttaacatgcttgcttttaaaatgagccgatatttaaattcttaagaatatttttatgttctcttttgttctttgaaacaacttcaaacattctcaacaaatttgaattgtgaatagttctcatagttctaggaaataaaatgaaaatgttattaaccatttctccctcctgagggacatgggagaactagaggggagtaaggaccacaatagtttaatgaagacatgaaatgtgaaataccaagttaaatagttcttaataatatgactaacatagtatgtttgcaattgatattttattgtgatgtaaatccttcagacactttctcacataaatattaaaatatgcttttaaactatttcctgaaagggcttgtatttaagctatgttctaaaagggctttccagatctgaagttagacaaaactattaccctcatcaatcaggaaaaaaaaaacaaaaaacaaaaaaacaagcaaaaaacaatgttttatagtggcagcaccacctcctgatacctcattttcctacttagttaccacagcacagatccatttctcctgagcttattaaaatatttgtatgtgtagtattcttgaatgaattaatcaagaggaggggtagtggcacatacagagagggtatttggtatcataagaatgtcagtcactgagagacacttatagaaacttcaccgaattaagtggatgtgaatcctcagttacatcagtcaaagatgctaaatcagaagggacttctgatttcttgtgaagacaagatcagggagcattggtagtcatttcagacagccttgcttggcctgtcttctctaaagtggggcatccttcagggctgtatttccacgtgcttcccctcaaaattatagtaaaacactaggtgctgtttttacatgcaataacaagtttgagctctgttcagctggaacttccatcttccagtgatccaccaacatgacaaacacaaaaagaaagaagaaggacacccattgtatgctctctaggcattttagaaaacttggaatttttcctttggccatatacctatgagtctacaagaaaggaaatattgtatacatcaagggaatgagcactgatcagaaagaaatgcccgcagatgttaccgtgacaaaactagaagagtctacaatgttacccaggatgctgttgtcatcttggtaaataagcaagttaaagccaagattcttgcaaagagaactaatgtaggtattgggtgtattaagcactctaagagctaagatagttttctaaaatctgtgagggaaaatcagaaaaagaaggaagccaaatagaaaggtacctaggttcacctgaagaatcagcctgctccaccctgagaaacacactttgagaaccagtcgaaagaggcttaagctgttggaacctattctctatgaattcatgccataacagcataaataaaatgcataaaataacaagttttggattccaaagttagctcttttatttttctcttaattaaatagaagtgtggtgtttcctcccccaaaagagtatttaaagcaaacttggtgtcctaattcattgggtgatgtccttaattttaaaatttagtgccattcttgctgggaaaggaaagtttgagctcatttctggcctgcatagaacaatatgattcaaacatagaacaatatgattcaagcatagaacaatatgcttctgttttccatagaaagagcaaaacaatttgaataaaactatatcactttgctcttccgtaggttatccagagataatctccccttttttgtcagatctttgtgtatttctcttcctcattaattttgtattaacacccatttttccctactaacctctccatttctaatttttctttagatcaacttcactcctatattatttacccactcctggaggtaaggaaaagtgttaagggaacacaattggagagattaaaaagataaactgaagagttggggcaaggctaaaaagccaagaggtataatggggaccaaattgtggagacagagctaaatgtttttctccctgaaggcaataaaattcaattaaccaattggtaattttttgtcccatctgcctggtacagtcttctaggtgggtgcctgattagctctttatcatacattagagctcagctcatatactgcttcctgtgagaggtgtttcttaatctcccaaggtaaaatgctgtcctcactcccaccatttatatcacatcagcatgttataatttctgcatgtcacctatgactatgtgaatatattttatttcatcatttgtctgtttccttccaataaaaagtaaccttcatgtgaacaaggtccatgatttgtggttgttctctctatccctaatctagtacaaagacacataagaaaatagttctataaagataattatttcttttcatagaaaatcataatttaattcacagaataactagaaaatgataaagagtgaaatgcaccctgtaaaccataagtaatacactagttcagtggtaagaggaattgttatggctagaaacatttagggaagacttcatagaggatgagagctttaaaatgaccctgaagaacaggcaaagagaagaatgggcattaccacggagggagaggtcttgggcagggaataggggtaagaattagacttaaatgctattaaatgccttatttctcaccacccacttctaatttctttcatgtaagcgtggtatttgatttgaaattacccttctgacttttttatggataaacatgaagccagatattcactacgacagcttgttgaaggaatggatggtgaaggcatcacttgtctcagtgctgaggtgcagccctcaataagcctgcggttcaatgaagtgctgtctttgtgacaggatggatgaggcagctatgttgtgagcagcagttgtagattacgtgggctgtggctttcacaggaatttgtcaggctaggctaggtttcatgtgagaaacttgaagcacccctcgtgaggctgtctacatgggctggcataagtgtctacatgggctggcataagtgtttctcactattgctataggccagcatatacacattgccttctctcaccttttgatttggaagccaactgtcagttttcgatgtcttcacctgataaaaactctgcctaagaatcatttttttccactggggatttagttagtgaaagggaagccctaagtatgcaattttaatattgaggaaagggcagtacatagcattctacccattttcactacctttggcagtgtcttgttttgtgacattgtgtgtgcttgtgtatgtgtgtgtgcccgcggggttttttttttcctgctccttttcttttattgccatattgacagaaacctgtgcccttttgggctgcacagtcaaaatagagagcaatctaatttgaaatggctattttaaagaataattggcttgcagagacagaaacctctagtgggaaagaaaaaaggaatacagatgataaatgagcagaggtctgaaaattattaacaaaaaatagtgaagtatcttgatgacaagaagactttgatttactaaataataagaacatctgaattgaaggcatcattgtattgattttcagtaagtccgtaactacaaccaaacactataactgatgtacagaagttgagggcaccatttatattcagaacatataattttacctttggaagttatgaatgacactttttgtgcccattggtgacctcctaaatattctataaaatttttgaaaactataaaaattctataatgtataatgatatattaaatattgtgttaatagtttagttaaaatctttccccaatgtgtatataatcttaggtatgttttgttatgtatgattgtggcatatttctgtagacgtaccaaggaaattttgttttatttttttgtgtgagacttagtcacgctctgccacccaggttggagtacagtggtgtgatctgggctcactacaaactctgcctcccaggttcaagctattcttataccttagcctcccaagttgctgggattacaggtgccagccgccatgactggctaatttttgtatttttagtggagacagggtttcaccatgttggtcaggctggtctcaaactcctgagctcaagtgatccacctgcctcagcctcccaaagtgctgggattacaggcgtgagccaccgcacccagtcaagaaggtctatacttttttaatttaaatttttaaattagcaaataataattgtccatattcaaggggtacacagggattttgtgatacatataatgtgcagtgatctgatcaggacaattaacatagctgtcatctcagatgtttatcatttctttgtgctgggaccatttaaccatcagtgatccatatttactttgaaatgttatataattatttcaaacctacagtgcttgataaaacatagaaaatagaaatactacagaaacacaacatactttccaaatagtgacaaaagattcacaaagtatggaactatacttaattgtttatttgtttattcatttattcatccctttattcttttccaatttcattgtgcttgttaatagatcacttggttagttgattgaataaattggtttatttagtgttagaaataccctaactgttccagtttggatttaggccaacattttccatgtcctattttgtagaagaggtctatggaaggaaatgtattgcctaggtcatatgggtggttgcaagcctggactcatccaaatactaaatagctaagctacatctgtccttcatgactccagttttatttactgaatgttcggtcctcttatgtccatattttcttcatttactgaggaacttgtatcctcacatgtacctattctgctgttctttcatcaccccatataaggtgaatatttaatttatgaaatatctgtaactcagatattttgaattgcaacatctaattttgaaatgcaacatctttctctattaagaggttaggttttaagtagttagtgattgtagaatttggggagctagggtgtgacatttctggagtgcctttttcacagcagaaaacacgagaagaaaaaaagaaaaagaaaacaaatatttatttaatacttttattatgtgacaattaccctacatatacatttacacattttatcttatttaataatatcataaacttgaaatgattgtcatcataagtaattttgtttttgctaatgagacctaaaaattgcttgcctgagatgtccacaaaatatctgactacccattataatagattcatgttccagtcactcaatttctccactgtaatgcagctcactatgtatacagatgtcatatactcctcttcactttgcccagtgggaatcaccaattggaaaatcggcataagaatgctgatattctacctgctgaccaaggggcctcatgtcttctaccagcatttgtgagactatagaaagttaatttgtttggtttacttgagtggaataaaatctcagatccttcacagttcttgacaatgatgtcatcatttacttggtcatgaattttcttagtggtaaatgaaataatggttaaaataccattaaataatggtaatttttaaattaatgactttttagattcagtgacatgtagtgtctgatatatattcttgcatttatacatatagaatcaatgacatccacactttctctctaaagatcttatcaaagcttcaagttcctataccgtgaagctggccaaaacagtataatctcaatatttacacttaaagttagagatagagataagccgagtcaatttatacttttattgtcactttctattcccaccttgtaaacagtatcctagaaaatttccttggaagagatttgtttgacatggctggcttcaggaatttttggccgtaacatcatctcttttcttactttagtgaaatcagcaagccaatgtattactttagagagggaaacagctgtgaaacagccaagattttaatacttccgtattatcttcctatatttatgatcttcccatagacaagcaacagggaaggcaaattataagattttgtgttaagaacagaattagagtaaataatattaatatcattttgttgtctactggtgcctgactggaaaaaaacaaaacaaacagaacactattattcttgccctggaacatgccccagtgcatcatttgctctattgtcttaacctcttttttttttttaacaaaaagacagagtatcactttgtcaatcacactggaatgcagtggcatcatcatagctcactgcagcctcaaaccccccgggctcaagtgatctaccggcctcagcctcccaagtagctaggtctacaggcacatgccaccacacctggctagttgatttatttttagtagagatgggatcttgctctgttgcccaggttggtcttgaactcctggcctcaagtgatctctgccttagcctctcaaagtgctgagattacaggaatgagccattgcacctaacctaaattaagcttattttggtagtttcattcttcaggaaaattgctttagcattgcacttaaaaaattctattgagatggctgaggatttctgaacaaaccacattcctgtgggcgttgttttgaatgagcatttgaaggtggctggatgtgtagcagctatcttcaaatttatgtagaactagcatgcagacaaggccacaatactgagagatagcaaggtagaaagattaaatgtccccaaatcaccagactccaattctgttactctatgttcaaccaatgtgtttcctgagctcgtattttgtgtctctttgttgccttcctttcctggcaagagctgaatgtattggtgggaatggaatcaggttgagcagaagatgtatcaatacatgagctatcacttattccttattatagctcttctcataaattttcagcctagcttagttctttcctaattgagaggagagaaatcagttttttaaattctcgtttaacagctgtttttctttttttctttttgaccccagttttagagattctttaatattaaagattacaaggtgatgttctttttctcaaaggtccttatgaaggacaaagaaagagaactgtatggaaataaaagtgaatcagtctttgacataacaaatttctaactaccataaaggatactttatgtgtcatatttctacatatgtaattcaccattatactttcttattatttgtagccatttaatcacttccccaaacaaaccatgtcttcaggcatttcttactctgtcttttgtaatttctgttacttcttcacttctaacaaaattattattacatttattttacagttgttgatggagagttttaatacatcagatattgaaactcatatttttttacaacatcactcttaatggacttattatctgattgagtttttttctgttttgcactttaatatttgttcttattgatagaagcacttacatgttaaaaaaaataactttcccatttctgccatggtaggtgccatgttctcccatgctaggtgcatgctagttgcagggaataattctctttcataatcacaaaagtgcctccaaagatagttctgtactatttcctttgaaaggctcttttgaaatataatatttctatgaccacatataatttcctgaagacctttaataaaaggctaaatgctagcttttatctcacttagttggcacaattttccacatttatatcacagattttaattttatttcagcaaccttatttttaaacttcaaatagtcatagaattctatgtagcttccaaaccattgatcggctattataagtaacatctcattctccaacatgatcccctgcattactctcctgcacattcgctgcagttacaaatggaacagggtcaaagtgaaatcatttcaatcactttgagtatgaatgaagagtagcccctgaaaggtagagtcaaagctcagaatttggatatggcaacaaattgagtggtctgttaattctaaggatgcccaccagaatgtgaactagaatgtattaaatattggggacctgcatacagggcaggtaggactcctagagacctagaaaaatgttcaacttagttttagatccaagaagctgtcactgttattatttagcatgatttgtaaagtcttgccaatgtaataagattgtatacagctgaggcaggagaatcgtttgaaccagggaggtggaggttgcagtgagctgagattgcaccactgcactccagcctgggtgacagagcaagtctccatttcaaaaacaaacaaacaaacaaaaatcgtatacaatgtaggtagcaaaactatggggaaaatgaagaaaaatggtcattatttgcaaatgacatagctattacattggttgaaattgcatgtcaactgagagtcctggaaaacagtgatgtacaggaaattggagtttattattattatttctgaacataaaagggtctgaaggtaggaatttcagtactggcatgaatttctatgatataagcaggaaatgaggctccttctcgtttttgttccctcttccttaaggcatgattgttgttgatgttttcaagataactactggaccctaattgtcattacctaccctgggcaaagagggtcaagacaaaggcaataataattttaaaaaggtcaggctaaatgagtttgtcctgctgtttaagtccacctaagaactctcttagataacaaagaaagtgaacgtgaagacaggactggagcacagtcactatacaatagagtacaaattacagaaaccattaatggggaagtattttgttgatagaatagtataggcaccagaatttgcaaaaaaagacttagtttcaacctatgtagggtttataacgggcaggttttacactaccttgataggttttctcaagatgagcacacctataacatatgcacaattcatcgccatgagttatattaaatcatgacaaatcataatgtctgatagaccagtcctgatgtgacatttgtcctgatgtacacataaaacttaaggtatacaaatatactcatgtactttataacctctcaagtttggttactgtgtacttcccaacagtgtatttcaactttatacactttattgctctgctgccatccaagagatttctacagttctcatgttactatttactcttgaagtgcctattgtacatatattttacttcaacagctataaaaatgtctgctagctacttaagaatcattacattttggaaaagaaaaccacctttaaatcaaattgaatatgcatggatctttaaaaggtctgacctcacttaaacaaatgttaccttaacagaacagttgatcttatggaagatcaattatgacaaaaatcactaagtccaaaagagaagtcttgtctttggaaatgaacatgaaataatttatttgacttctaatcatatttatgccattagaaaaatgaaatgcctttaccacagaggcgatacagaaatgtatatgagaaaattgattaggtgctaattgctttcttgatccttaacttcactaatattattcacgggataaatataaatagatcttatgtcctgtagctaggtctttttctaaattatatgagcaattttaaaggaacaactgcctttattcttagggagaaatttgaataagatttttcttgattaaaacaaataattgctttattgtggttaaacataatttgacctaaattgatcactttcttggatacgttatctttgagcatcttaaaaaatgaaacacaccttttagatgagataattctttgttgatatgaattatttttatatggtttatttttctattattaaaaaatggcaaaaattctgatttccctataatctcacttgttgaaagtaaagttgagccatgtccacacaaaacaatatgtttaaatgaaaactaaaagctcatttagatctatctagccatctgtaattagtcaaatatgcagaattaaggaagcagattctcatttaactctgtttacatagtacacaaaatttaaaccacaattgaatgatttacacaaaacttaaatagcaattgaattgttaaaccttcatttccttcttccacctttccagcttaaacaaattttgcacaaatattttaaatttgataggcattttaacatgtattaaatttttttctcattttgaagataataccttatttatgagaaaatgtctttctttttctttaaaggaagattggtgtctataattactgctatgattcatagactgtcagactgtataataatgagtctgaaatggttacataggagccctttctgagtttatatagcacgaagactgagaaggtaattttaatggacttgcataggaaatgtcataatatccctatttttggccagtgtggctatgttttctgcttggaccttacatctgtttgctagggttaccataacaaagcaccacagtccgcatggcttaaacaacagaaatttattttttcacagtgctggaggccagaagtctgtgatggagttgctggcagggttgttttcttctgaagctgctccctggcttccggaagccattttctctctgtgtctccaggccatctttcctttgtgcctggctgtgccctaatctctttctctctctcttttttttttaagacagagtctccctgtgtcacccaggctggagtgcaatggcgtgatcgcggctcactgcaaccctctgctacccgagttcaagtgattctgcctcaccttcccaaatagttgggattacaggtgcccaccaccactctcagactaatttttccgtttttagtagagactgggtttcaccgtgttggccaggctgttctgcaactcctgacctcaggtgattcacccgcctcagcctcccaaagtgctgggattacaggtgtgagccacctcacctggcccctaatctcttcttatatgacaccagtcatactggattagagcccaccctaatgacttcattgtcatttagctttacctctttaaaggttttatctgccaagatagtcacattcagaggtactaggtgttagaaccttaatatatgaattttggggaggcataattctgcccataaaagacctcaacagccaatgcatctctctgccaaaggaatttaagacatctttaatattatcacagtaggcaaaactatgatgatgatgagcatgctgactagggaagaaaggatagtgcttacaattcacaaaaacacagaataaaaaagttgaggttaaagagctgcaacaatatacagccatgtttttcaattaatgaagctggaagccaccattttggataacatattaggatgaagaaaatagatatgaatagctctactaacttaaggtgtgagtgatattatatttatttgtctttgtatcagaatgccaaaatgatcttggaagaccaagaataaaatatcagtttgtaagtgctccagcattccaattgaggtgctagacatgtaaatgaagagactaaaacttcattttgcagtctttagctcaatatccaccttaagctcgaaggcttagtttgggaattagatttcttgaagaagcttgcacttgttttacacggggtaagggaaacaatattttacatcacttcaagtcaagtatgtgggtcttgatttacagtgcctgcagtttgggagcatagtggactggctggtattggatgcatatctgaataccttctccagtcactctctcctctcaaaaaagtttagaagcaaaaggctggctgaaatgttctgcagcaacagaatagagtgctgcattaacaaagtaactacactcccactcctgatacagtagatcaacgctgtatgtttcttgttcgccaaatctggcccatagacaaaacacagagccaatcttaggctgtcttagacattaatgaagagcataagacatctccagccatgagggagggaatttagagatccataacacgacagcctgagaaaaagagatgttttaattatctacctggtccagaatataccatgaccctcatgatagtaatagtcaagtaagactgtgaccaacacgatgtccaagttgagaaaggagagaaacatatttgaaatgtaattcagagttctgactattgcatattatggacattttaattgtgtgaatgaaattagattcataactaaacatgaagaaataccttttgttttctgagagttaggagataagttttaaggcctgcccaaaattttactcagggtcaggaaagaaccagacatacacgatgaatatgaatgaatatttaggatggaagaataatattggttgcagaattacattcaatgaatcccatttgtttaattgatttttaaattaaattaaattctgctcaatctctgaaattatggtaatattcttgtaaggcccccttcttgcccagttgtccaacaaacctggagggctaacatattttcaaatagtgagaagaaagcccaccttccatagtcttgtggatttatctggttctttttctgagttctattacatatttatgtggactcccatgtgttgccatggatgaacatccatagtgcatgaagtctggctgggctgtagttcccagcagaagccagcatgatccactgaaggtaaaaagtggctccccatttatgctaagttcccctgaaagaattctttagttagatcataaactgtggtcttttgcaatttccaacagcataagtagacatcatcttcaccctgccacctcttacatgctatataccagaaagtctgccaagatgcctatattactgccattcatcctaaaagatcaggcaggttttacttgtcaccattcaagagtggcagtcgatccctcccactcctttcttcagaggtggagtcatgctagccctgcctcaccactcccatttctgtcgactattagcagatattcagagagaaagttgcaggaacaatgacattctctcaatgagtcattcttccgtatcaacttttaaagaattggcacttgatttctgtcctttcaacaaataggtttgcaaatatttataaaatccctaaaataacaaatattcatactattgcaaatagtctgggacaaactaaaacctgtttgtaatgggaagtgatgcactgaaacttctgtagtgaaatccattctagatcagaagagaaagaatgattttaacaatactagttaaggattatcatgtttccttaccgataaactgaaaatagatttgagaattttctaaatctccctctctctcacacacgcacacacacagaaacacctgtacctatttgcatattattttaaatatattaatttaagcatatgcatatatttttaaattgtttttctgatggtatgattgtcattcatttaatttgagtaaaatatttcatcatcctcataaagtgatgttaaaaagcccttgctctaggtagaatttctttgactattagaatcaaaattttgcagccaaagtggaaaaataaaaggttaaaaaaaaaaagtataggttaggcgtggtggtgactcacacttataatcccagcactttaggaggctgaggcagatgggtcacctgaggtcaggagtttgagaccagcctggttaacatggagaaaccccatctctactaaaagtagaaaaattagctgtgtgtggtgacccatgcctgtaataccagctacttagtaagctgaggcaggagaattacttgaactcgggaggcggaggttgcagtgagctgagatcgtgacactgcactccaccctgggcaacagagtgagactccatcccccgcccccccaaaaaaagtattacaaaaggatatttttaagagatttaattcctcctcgagtaaacataatagatgaatacattccatggttataattgtatattttaaactagatagcttagttacaactggcagataacttttttcccggaagcaagtatgtttgtaaaaatattaaaagtgctggggtaggtagatggctatctaaatttgcatctcatttgatgaatattaaacactttttgaaagggtgagataaatcaacactcagatctaattaacctaaattgaacacataaaaatatttgccaccgataaagttgattttaggagttaagatcagtaccaatacataaaatactctagcaagtaacatctttgagcaactattagcagctttcagcccctttgatatttgctgtattataaactcaacacaaaaactacaagtaaacaggaactaattaagcaaagacagtgtaagcaatttaaacagtaactattgagttggagtacctgaactacatcttaaatactatgcataaaataggattttccttatttatgagagtttttacagactttaaaaagaaaacaaaatattaaagtttagagaaagaaaaacataggaaaacattgtataatgttctattctccacattaagaaatattttccagaaacaaaataataaccaaacaatagaatacatttcccagatccaacattcctcacagttaagatactaagttagagaaaatgatacacaggtaaagtagagacacatttgaagacagtatctaaaaaaataagtaggcaaacaaaacagtattcttgaaatactgcatggcactgacacatttttttctttattgaaaaatttttgcaccctgagaagctcttataaaacgcatcaagttatttttgcgaaggcggcagcagaacagcagtcgcgtgatcacattttgacaggcttcagtagcacacaaatagcattaacgcaagacccttggtctatggcagcgaacagcgatgtaacagacaactctaatcaatcagaatttgacttccctttattctgacaaggattcttaatataagccatcaaaagtagtttaaaacttgttagtccttctgccctgcttttaatagaacaggtacatacctcagttgccatcttttcctttattgaaaaactgacaaagcattacaaaatgcatctgccttaaatatttgaggccaactataaaacatcaagatgtgtggcaataaatgcatcaatgaagatgtgctgtgaaaggtaaaaggcataaaaccgtcaaaggcaaaaaaaaaaaggtggggggtgagctggattgaagtaagaaaaataattctgttaaaaaggcaagaaacttggtgggaacaagatagaatttaggaatcagaaaaacctgacttttcatccttcactaggagctaataactaggaaatgtgggcaaattgttaagtctccccaggctttgcttgacacatttggaaaatgaagaggcagcctggatgatttccaagattccttccaaagctacaatctgatgatatattggtgatttacaattgttagaaagaagacaagaaaattcaaattctgggtttacaatcttcagatgagaataaagttatctttctttttaatttatagaaattataaatgaaataaaaatggacatagtccattgtgtttctagtcaatggatatatctagtcaacagatatgacctctggattgtacctgttctatactattctccatttacagttaaagctgaaagttaagataatacaattgatctctagggcaaattgtagagagaaaatgtactcttgtactagataatggtaaaatttaccatcaatgtactagagtgatgaactatttaacatacatgaagacggctgatcaatatttagttaatataggttggtttgtttttttcctccaaagaactgtgttactgagatgggtgggtgttgaggtaatactttattatttagattttattaggagacatattaactggtttaagtagggaggaagagaaagaaagagagagagaaagtgggaactgagaggagagagaaagagagaggtggattgcagggaaaaacagtgaaattgttgaagtattagaaaatataatataattacatagagggaaagaactactgaatagctgccaggccactgaagagtcctagcctttgtctgtaacagttgctaaaacaaagagcagactaggctatttgtaattccctcttgtattgtctaagcaggaatgcacttttccaggctataggtcttggtaaactccacctgttctatgttagactctgcaacctggagctatacttgggaaaatgtatgctcaacagtttacagctaccttagagagtttcttaagcaggtgcagctctgggctggccactctacagtgtgcacctttagtttcaagaagaattagcattatgtaatgtcacagtggcaagataatcattacaggttagaccttggaatgaaatcccaattccaaacagttatgatactactattactactaagaatgataatcatgataataataatagctaatagtaattgggttttaggctaatgcaaatgctttacatatgttatttctattaatacttgtacaacgctatggagatattattaaccatacagagaaatgaaataatttgtttaatggtggagttatcatttcaaagtagttttttgacttaaattctcttgttctcactacatgtgacaagggcaggccatttggtttatcttagaatcatagcttcagttttctgagataaaataggataacaatatttccctctccccacgtttgaatgttattaatatattcaaacacacacatatatgtacatatatggacatatattttacacacatttatctctatgtctatcatctctatctccatctattgatctaacaagttaaccagtgataaacaggagcttatcttctcttcacttgtgcaattggcctactgtaatattcaactaaaatcagagtgcaagaggtgagaatgcatcagcgacagatacttttgctttattttacgtctgacaaattcaataaatttacttaagacaaagtcaggtctagtctttttgatttctcacacagtggctaaattataaaaatgattaccaatatacaaattcctacatattcataatactttattcataatgataacaattgtaaaaagttgttatcacttcctttttacagttaaggaaattgagagttacacaggttaaatgatttgtcctaggtcatatagataaagagagtatgggtatgtctgtgtaactgttggctcatattgtttatgtgagtcagatcatctctgtagcagacagaccctggggtggccctcatgattcctacccttgatggtcatactctttgagtggaggtaggaggatgcattgcttctagctaacagaatatggaaatggttaaggattttgaagctgcaatgaaggtcctaaatgagctgattttgaattaagcaagaaagagattaacttgagtggacctgacataatcatgcagaagcctgtaaaataggaattagggcctccatcgtgggcttgctgaagtaagcagccatgctagagaagcctacatgacttcatacagctgcaaggctataaactctgcccataacttaaaacagcttgaaagtagattcttccccagtcaagcctccagaggaaaacacagcctagttgagacgatgattgctgctgcatgagatgctgaataaaagacccagctaacctatggtcagattcctgatccacataaattgtgaggtaataagtgtgtgttgttttaaattgctaagtttgtactaacttgtcatgcaacaacaaaaaaacccaaaaacagaaaaccagtataaactcaaaaactattcatttagtaaatatttgtgaagtgttttttatatgcaaggtactgtgctaaaggccatataaagcacaaaaatagaaatcctctagaattcctgccctcaagaaaattataactgcaatagggggatcatgttggctttctggtgccctttggcttattctaggacttctgttagcttttattataaaaaaatccttagtaaatcaaaatatgatagctaggttgcaggctttatttcttgaattaggtcatggattgaagtaagaaaaatattttcaaatatggaacattaatatgtgtatgagttcttttctagaccatatgaacacatcatctccaaagataaacaaattggatatagatattttttgtggtaacttcgagtttggttgcatttgaagattagcttctagaattaaattccttttaatttaaaaaatttatcattatttattactatgacaaaataagtcctattatcccctgaatttgaacaacatattgtagttcctaaatttagggaatacaaagagattatttaaattgaagactaatttacatgaagttatattagatggaatgtcctttgaagtccaatcatggggttcttcgagggaaaaaagatttctaaattgaaacttttgtgtgtgtgtgtgtgtgtgtgtgtgtgtggagaatggggtctcactgtgttgcccaggctggccttgaaattctgggatcaacctgtcctctagcttctgcctccctaagtgctcagattacaggtgtgagccatagtgccctgccaagatttctaaattcagttaaattgcatagaatattaaataagtgtgttcttatcattatctaaacctatgcttcttaactgctacaggatttttaatactgactttcattcaaatttgtttgcatgttgtaaaactcaattaagccatataggtcgttcttatgttgtagagcatatcaatttaaattcccaaggaaaacttaagtgcttacatcgaagttatttttgatattaatctttcaagcaagaactgcagacatttccttatactttgttaacctcaaaataaaatagtctttgtaggagataccctatgtttttggtctttttttttttttttgagatggagtctcgctctgttgcccaggctggagtgcagtggtgtgatcttggctcactgcaagctctgcctccctgattcatgccattctcctgcctcagactccctagtagctgggactacagtcacctgccaccatgcccggctaatttttttttttttgtatttttagtagagatcgggtttcactattttgggtcttttctaagcaaagactacataggcaacattaaacatcaatatgttcaaattgtttgcaaattaagcatattaacaacaaatgcagataaaagataattaacatcaaatcatcataagttatcagaagtgaaaattctgaagtgaaattgtataatcagggtacattcaatataatatctcagaataattgagactgagataaattatactaaacataatgatgaatttaaatgtttgccctcctttaagtcttttctgtcagtttctacctatatattcttaaaaaaaaagacaaaaaataaacaatcaaaaagacagctttcagaaactatctctttagtgaaaaatacacttctttcagtcttaacctctcagagaacactctcttttcccctaacttcacttgacttacattacaaattcatagcaagagaaacaaaaaattttactctaggagacaaagaaactggtagaaaggtttgaaatatcagcatataattgtttgttctctatagccaatcttaaaacaaaaaataactagttttgttaatatgacctactatcttttttcctgagtctgtcactcttactagaagtacctgctgggctcgatgctttttcattaatgggatctgttgaagaagagtgtaattttcccaataacactcttggagagctttttgactcaacaacctcaaacatgtaccgagagatttcatttataatcacctctcctactagtagtgtctgtagactctgaaggcacaacacagtgtgaaataaaagtaaataataggaactgaagtgagcatcatttccttttcaattcatctgcatatggaaacccctctttatattttgaatacatgagaaacatattttggctgatacctgcattgaaatcatctttaggaatttttattcttgctttatttatctttctttatcattagggaagttccttcatggatctctggttactgtgttttgttagttaaatcaataaagccctttattgaaagaagaattgcgttacaatgctgtcaataatgaatgcttattgcaagaaggggctcagagaaaataattaagaggtggaaatctcttaagaaacttctgcacaccaattgtggatgtaatctatgtatgcaaatgacgggcatacattgtatagcagctttcatccaaatagacacttaacaaatgtgactattatactcatgaatgcagtgtattcttttctttttctgcagttgttttcatgatgaaatgttaactctgcttaataaaaactttggtatggattagttaagcaagaaacatgaaagaatgaataatcaatttgaaacaattaaattacatcagaggagttcattaaagagcacatctccaaaacattgagatctgtggaggttataattaggaccagtggaaaaaaatacctcctttcccttggcttgcatcacctctcttgtaatcattaattgtcaaatttacccaccacaactacctcatcttttcttcacctcatgcaaaattctcttgttcagccattctcaatcagaagtatgagaacttccattccgtatggttgttgtaactttcttctcaccaaactgcagttgtgtctacttacatttttgggttcttcttcctatattttataaaattcaactctttaaagatccatctttggttctccatccctacgagtagcatcctctttcttttactcatttcttttaataaaatcatgtatttctttatgtgtcaaatatagaaatttgcatagtggttgtgtattcaaaccaagatgagtttgcatttaaaaataatgtcaaagtatgctgttgctgtatgcacatggattggttgcaaaagcaattaagaaaataagctgaaaatacctgaaagatgtatgtgacttagtgaaggacaatttgttttagacaatagaagaaagcattaaggaataagatttccctatttgaaaaaaaatattaagttattgagatgtactctggaatagccagtaaatgaaatgtggaggctagctattgattctcaaaatttgaaccttaggagaattcccagttaagtagcattaggataagagtgttgaggcccagtccttgaggactgaccatgcatgatctaggccctgtgaatacaaaaggaaacagggcacagcaacatttgcttttcagtaattggtgcatttgagataaagaaaaaaaaattcatgatatttgttaaagatggtaaggcaagctttactgaggtgggaccatggagatagctttagggatgacttcaatgggatcttgcagtagaggagagagactggactcaagtctaactctgacaaggacaagtggagacttaaaaccaaaaagaagaatgagggtgagtggatggaaaattactaagaggaaacatcgaggataagggatttctggctaaactgatttgagaggaatattgctaaaggcaggtcagggtaataagatacccagggtgttcaggtaacaagagacttagcaggattcttactcaaaatgcattttacagacagagagggaaagctcaaggtcaagactagtcaaaatagaaaactcagaggtgcctcactaaaattttggccaaaagaaagagtctttgtcagagtttatatggataagtgcaataataaagaaaaaggaaaaaaaaagttattcatggtttgtggtcaaacagaataaaagcctattactgaggattagacaaggagaagtaaatagtatgtcatcatctttcagactaatttatagtttgtgactttaaatatattgtgatagtaaggcacatatacctttaattctaaccttgggaacttctatgaggcagaataataaacaaaattctctcagggcaggtacatgcctattttatatctttctgactttaaaaattaattggctcttaaagcatggcattggatgtatctccttaccagagtggttgaaaggaatgatttaaggatgactttaaattacaaaggccttcagaaattaagttaattctcccttgcaatagctttccaaggtagaaaaatattgtcctcctaaaaatggcagttaaaattgagatgtagttaaaataaattggttaacgtaggaaaaaagtcaagattattaactttatattaggcttgtggcctgatttaaaaatctcttcttccctgttaacggtaaaagccttcagagttatggctttcttagggcatgtatctttcgtagcatcaccatcatcatcatcattgttaaccgcatcattaacattttcagtgtgattacaacactagttacattagcatttcatgctgaaatattcttcttaacactctccagatagtgacaggatatgatagatgggctgcttctaaatagttgcagttaaggctttctctcttctggtctatgtgtgaaaacagatagcaaaaagagatgagtagaaagcaaaaggacagccatacctgtgagatctatttaagaactttatctggcaacgtattaaataacatagctccttgttgaactctgcactttattttcttccctttttattttttcttggctcaatcatggatttattttcctatattgttttgcataagccatgttaggatttgttctgagttgcaaacattataaaatgctttaacttatagtccttttagttaaaggtgtttttatatagaagccttatgatacagtgtgcctgtgtccccccgccaagtctcatctagaaccacagctcccataatccccacgtgttgtgggagggactcaatgggaggaaattgaatcatgggggtggttacctccatgctgttcttgtgatagtgagttctcacaagatctgatggttttgtaaggaactttccccctagctttgctctgcacttccctttgctgtcaccatgtgaagaaggatgtgtttgcttccctttctgccataattgtaagtttcctgaggcctttccagccatgctgaactgtgagtcaattaaacctctttcctttataaattacccagtctcaggtgtatctcttagcagaatgagaatggactaatacagtaaattggcgctgggtagtagggtactgctgtaaagacactcgaaaatgtggaagcggttttggaactgggtaagaggcagaggttggaacaatttggagggctcagaagaagacaggaaaatgtgggaaagtttggaacttcctagagacttgttgagtggctttcaccaaaatgctgatagtgatatggacaatgaagtccaggctgaggaggtctcagatggagatgaggaacttaatagcaactgaagtaaaggtcactcttgctatgcaaaaagaatcgtgccattttgcccctgccctagagatctgtggaactttgaacttgagagagacttgctgagtcttccggccttcatctttctcccgtgctggatgcttcctgcccttgaatatcagactccaagttcttcagctgttggactcttggacttacaccagctctgggtttgtcagggcttcctgggcctttggccacaggccgaaggctgcattgttggcttccctacttttgaggttttgggacttggactgatccacaactggcttccttgctcctctacttgcagacagtctatcttgggactttaccttgtgatagtcgtgtgtgagtcaattctgtttaataaact

SEQ ID NO: 2664 - DNA, 4478 bp, Homo sapiens
caggaagtaaatttctttccaagagaaaaaagctggaaaaataattgttcctcttgtttagaagatgacagcttttttttttcttcattaagcgcccttctcttcaaaagacaaaaaagggtgagagaaacttgaagacttcagtcctttttgtatctatgactccggaaaggaaagaaaaataaaccatgtagaacctgcttgctgtcctgtcctctgccagccgttggcctcagtaatcggattcaaggatatgtatgacctactttttgaatcactgcagcccaggctgcgcaatttcttatgttctcttgctgagaaaccaacatacaagcagagattgtgtatttttctgtaaaggtagaggtaggcgcttctggaaattctggaaacctttccaagtttacagcacaaacgaccggaatgttaagaagggcttttgttaacaggtctgttttgctaggattctgcagggggttggagccctggggaggcttcttcttgtccccattggtgttgattctgtctctgatattcactggtagcaatcagatctcacctggcataaagcactggctccatctgttttctaggagtggattttttttccattaagaatagagtcatctcagtatgaacggctgatacaaggggaaaaagaagcatttccagcagtgcttgtttaccagtcctttatgaccaaattgatgcaaagtgggccacaaacatgtttgttgacacctggagtgtccaaactccagaaatagataagagtccctcatgaaaatatatataaagcaaagagatagaagaaattgattaaacccataaagatatggacaaggaagagaaagcaaccaacatttaccgtgtctttctattaatagctacccaacactgtcctggaggctttttaaagagcttatctcattgaagccaaggctggggctagcgagaggccaatgaggtgagtcatgcttctgcaggggtggattctgtctttatttagaattttgaaattttgttccttatggattttttgcattgattttgattttttttaaaaaagattcctctattgagttgaatagtatctctccaaaattcatgtcctctccaaacctcaaaatgtgagcttatttggaaatagagtctttgcagatgtaattggttgtgatgaagtcattctagattagagtggagtctaaatccaaagactgcagtccttattaggaggttgtgtgaacacacagagacccaaggggaaggtggtcaatgtgaagacagaggcagcaattggagtgaggcagcaattggagtgatgcagctacaagccaaggagcaccaaggacagccagcagccagcagagctaggagaggcaaggaagggttctttcttgggccttcagagggagcacggtcctgctgacaccttgatttctgatgcatagcctctagaactgtggcagaataaatgtctgttgttttaagctactgagcttgtgatagaatagtcccctcttacccaaggttttgctttctgagggttcagttctgtagtcaacttggaaaattccaggaataaacacttcaaaagttttaaattgcacaccattctgaggagcatgatgaaatcttgtgctgtcctgccccggacatggaacatccctttgtcattgacgtcgtctgctcctgacattcaaccgtggacatcatcatggcttgaggatccagaatcaactgaggcagatgatcctcccttccgacatcatcagaaactcaggagtggcccgatgctatgtcacaatgcctggatcattcacctccattcacatcatgtaggcattgcatcatctcccatcatcacaagaagagggagacccaggtaattttagagtcactctggagggaagattcgtatcttgaaaaattcttccaggtgatttggacatacctttctgcctcccagccacccccccccgccatggctcatagccacgtctccgggattcctcagctctatttctggatttggtcagaaaacagcctgctctgctggattagctcatctctccatggaaatgccaccctggagttatgagagcacggcctctttctaaggctttctggtgcaatgcaaccctcctcgatggccacagctgattgactggagtgaacctgtgacctgaactgggccagtcagatttttcatactggaaatttggcgtcggagccctgagaaacaagtcaggtggtctcgggggctgaagctacccctgtggggtgactagtggaactcctggtagtgagaaaaagtgagatgagactgatgatcttcagaaggaaaagtttggactaaacacccagaggaaagctgaaatgagagaccacatggaatgaaggagaacaaagccaatcactgagacaagtattgccagggaagaaggcttttttgggtgctacagctgaggagctgggaggtcaaaacagtgtgggaaaagaaatttaaaaaaatgttattaaagaagctactgtcaacctaaaggaagaaactgaggcaaaattaatgtaagtaaagagtttatttgggccaagatgaggacagctgctcagaagattcaggcccaagtgatcttggataggagctctgtttggcctttgttaccagcaggtttttaaaggcaaaagcaaggggatacgtagggggatgatacaaagttgcttgtcaggaattctctttggtttacagaaatgtcattcattagttattgcctatacattgttgacatatagattatgacctaatgatatctatcatgtggtgtcattaggttaattttgagctacttgtgagaaaaggcctagagtccacatagcaagcaaattcaagagatgattatttagctcaggaggggaagtgggatgtgactgtagcctcattctcatgcctcactgggcctgataatttaaaggaggttcacattcctcagatagaaagtttcttttctttctcgctataagcctctgtctttcttgtctctctattgctaagtggtttggcataaaatcatgtgctctggtagaaacctaagggctttttattcagctgttgaaattcatacccactggagattctagagccatcagtggccatggttcctgccactggaggaaactgtctttagagagtgaaggtgaagctgacatttataaacagccacggtgagaggcagggctggaaagcaggcctggctctgttccagttcctgtgtccattttggagacgagtttccgtttcctatggtttgattacgtgatcccatgaatctccatctcctgcttaagctgttttgagtgtcttgtccatacatgaagtgtcagggtgtcctaagaagacagtggaaagtgatggggtccagcatctgggatgttgggcatcttagtactgggggagtgtgtcagtctatagcaaaatcttcacttctgggctgggcttcaggatggaactcaagtcttttggagggaggaggagttcctagaggaactggggtcgcaaatgagttccaagtcaaggactcaagaccatgagtcaaatatagatgcctgagtgctgtcctcagcaagcagtcaagggtgttggacccagacgcccagatggagtccagggtaggcatcacttacaggtcgtctttgatgcatagaaataaaaaaggcaatctaaagggcagaatttgggttgaagccccataataaaaatcaagcagcttgttctaagtagcagttgtcatttggaagaggctaggcagaaagggtgacatggtaacatttacagatagaaagaaggataagcagatgagagaggaaaacttcaaagaaaaatgaaggaggtagaatctgaaaaaaaaaagtcctggactgaagagaacatggtgttgctgcttttgtaagttatctgtgggctaggttgtggatatagagaaagctgctaaaggtgatagttcactgaagatggcaaaagcaccatgagcagaactgggacacaggatcagggccagatgagactacaagatgacaaattttgggggtcaggaggggaagtgagatgtgactatggcctcattggtagacttttccattcatggcccccaagggaccgtgtctctcagtattcatgctcttgtgcattgtctcccatattggactctgggcttggcaaggtgacttgctttggccaataatatgaacaaattaaatagggataaattagaggcctgataggcatttgcatattggacctatgctctttgaattctgagattgccagaggatggattgactagctgtcattaccttactacaagcctatggatgaagccagcacaggaggtaatggaaggaattgcagagctacgaagctgtgactgtaatgcagcatgcctagtccccttcctacctctagtcttcttgttatatgaact

SEQ ID NO: 2665 - DNA, 9860 bp, Homo sapiens
ggttctgcttggagtcacacggcacacaagattgctgtcaagaaagcctgtccataaatagtggctgtacaccctcctcacttacaattcagggaaaagaagagcggggaaggaaaggaggaaaaacaacaacaacaaaagccacgacagagaacgggaaaaggcagagactgaaagcgaaggaccgtcggaggaggagggcgagaggtctggagaggagggctcgccggaggaggcgggcggggcgggctgtgcggagggtgcggccagcgcggtacccgccccggcgaggcgctggggaggcccgggtggggagaagaaatggggcctgggggacggtaggagcctccgtgcggagaccactgttcaaggccacagacatttatgcagtgtgtgattctttctaaaacaactccctggaagagaggacatttaattcaacaatttattggccacctactgtgcaccaggcagtgaacttggaactggggctactgggttacagcagtgaccaagacagaggtccctgttcttaaggagcaagtgagggcaacagaaaagagcagaagtcagctgtcatgcgagggcactcaagcagccctgtggaaagctctacgtggtgagaaactgaagcctcctgccaacaccaacaaggaactgagacctacttccaacagccatctgagtgatcgatccatcctggaatcagatcctccagccccagtcaagtcttcagatgactgcagccctgaccagcatctcaactgcaacctcgtgaatgaccctgagccagaaccatgcaactaaactctgcgtggattcatgacccacagaaactgtgagatggtagctgtttgctttgttaagcctctaagtctggaaagaatgtcttaagcagtagcagacaatgaacacaagattattattcagctgttgaattggaagaggaggggaagaaaaaattttcagatcacaaaatattcattgtgtaaaacttcaaaaattctgaaatttaaggaaaaaatatcatttgttgggaatttgttgggattcattgtctcagtgccaagagacacccactctttttttttttttgagacagagtcctgctctgttgcccaggctgaagggcagtggcacgatctcagctcaccacaacctctgcctcccgggttcaagtgattctcctccctaagcctcccaagtggctgggactacaggcatgcatcaccatgcccggctaatttttgtatttttagtagagacggggtttcactatgttggccggctgatctcaaactcttgaccccgtgatccgcccgcatcagcctcccaaagtgccgggattacaggcatgagccactgcgcccggccgagacactcactcttaacattttggtatattttttctctctgcacattttttatccagctgactttattttgtctcctgaaatcttcatttttaaattatagcttcagcatttaagaaaatgtgtctaacaaagtcttcgcaagcatacatttttcccatagttagtatacttagaatttatttgtcaagcaattttgaagggctttcactatgaaaaactttagggcttattgatattctctttaagtagaagtatgttttttattattacaaaagttatatatgtatatatatggtgtttgtgtttgtgtgtgtgtgtgtgtgtgtgtgtgtgtgtgtgtggagtctcgctctgtcaccaggctggagtgcagtggcgtgatctcagctcactgcaacttcctcctcccaggttcaagcgattctcctgcctcagcctcctgagtagctggaactacaggtgcgtgccaccacgcctggctaatttttgtatttttagtagagacggagtttcgccatgttggtcaggctggcctcgaattcctgacctcaagtgatccgcccgcctcggcctcccaaagttttgggattacaggcatgagccactgcgcccggccttatactgaattatataaggcgaaaagtgaacgtctcctgtaatctagaaaaatggcattataatgagtaaattttaaattttaatgtaattttccagaattttttttttttgagacgggacggagtctcactctgttgcccaggctggagtgcagtgacgcgatcctggctcaccgcaacctctgcctcccacgttcaagcgattctcctgcctcagcctcccaagtagctgggactacagccgcccaccactgcgcccgactaatttttgtatttttaatagagacggggtttcgccatatcggccaggctggtctggaactcctgaccttgtgatctgcccgccttggcctcctaaagtgctgggattataagcgtgagccaccgtgcccggccttttttttttttcgacaaggtctctccctgtcacccaggatggggtgcagtggcgcaatcacagctcactgcagcctcaacctcttgggctcaagtgatcttcccacgtcagtgtcccaggtagctgggactacagacgcgtaccaccacacagggctaattttttgtattttttatagagactgagttttgccacgttgcccgagctggtctcaaattcctgggcttaagcggtctgcccaccttggcctcccaaagtgctgggattacaggcatgagccacttcacctggccatccagaaacttaaatgcttataatcacatgcacacatagttttttttacacaagtggaatgttactatatgtaatttctagtaacctgcttttttcacatctcttttctctttccatgtagtgcgtaggttctcgtccaggtctgccgagtatattgtaattcatttaatcagttcttttttttttagagacggagtttcactctttttgcctgggctggagtgcaatggcgtgatctcggattactgcaaactctgcctcctgggttcaaatgactctgctgcctcagccttccaagtagctggaattacaggcgtgcatcaccacgcctggctaattttgtgttcttattagagatggggtttcaccatgttggtcaggctggtctcgaactcctgacctcaggtgatctgcccacctcggcctcccaaagtgaatcagttccttcttgaaagacattttgattgttttacccctttttgctattataaacaatatggcagtgaacacctttgtatgtatgtttttggccacttatttatttagagatggagtctcgctctgtcgccaggctggagtgcagtggcgcaatcttggctcactgtaatctccacctcctgggttcaagcgattctctttcctcagcctcctgagtagctgggattacaagtgtgcgctaccacacccagctaatttttatttttttttgagacggattctcgctttgtcacccaggctggagtgcagtggcttgatgtcggctcactgcaagctctgcctcccgggttcacaccattctcctgtctcagcctcccgagtagctgggactacaggcgcccgccaccatgcccggctaatttttttttttttgtatttttagtagagctgggttttcaccgtgttagccaggatggtctcgatctcctcaccttgtgatctgcctgccttggcctcccaaagtgctgggattacaggcgtgagccaccgtgcccgacctgtatttttaatagagatggggtttcaccatgttggccaggatggtctcgatctcctgacctcatgatctgcctgcctcagcctcccgaagtgctgggatgacaggcgtgagccactgcacccggcctgtctgttatttctttaggaaaaattcatacacagagactccacaatataacagaacagacatttaaactggctgtcccccaaacacaacaggcttgggcctacctcagggccctcattcatgctgtctcctttgtctggaactcttttcacccccatccccacatgggctggagcatctactcatcctagcttcggctcaaacgggctccccagagaggactgtcctgaccactctctgccgtttcccgttcatctccctctgtctcaggtatacagaatcgcttcatctgcgacacattctcattgttgcctgtgattccctcactttatgcttgtgtgggttttttttagagacctggtcttgctctgttgcctgggctggagtacagtggtgcgatcatagctcactgcatcctggaacttctgggcccaagtgatcctcctgcctcagcctcccaagtagttaggactacagatgcatgccaccatggctggctaatttcgaaaaattttttttgtagaggcaggttctcactatgtttcctaggctggtcttgaactcctgggctcaagcgattttcccaccacagcctcccaaagtgctgggatacaggtgtgagccaccatgcctggccctgtgtgtatttatttttacataacataataaaaatctgtggagtcagcaatctgacacaagaactggaacattgataacctgttttccccaatgaattcctttaccatcccatctcctgccttccttcacctgaggtaatgtctatcctgattcttccagaacattaaaaaaaaaaaaaaacagctttgttgagatgtaattcacataccacactattcagtcatttatagtttacaattcagtggctttcagtgcattcacagagttgtgtaactgttgccacaatggattttagactattttcatcatccccaaaagaaaccattagcatcagtactcattagcagtcactctcccatctgctctgccttccctctaatccccagccctaggccaccattaatctgcttctgtatccatggatttgtctcttctggacagttcatgtaaagagaatcatacaacatgtggccttttgtgcctggcttctttcacttagcatcatgatttctaggttcatctatgttgtagcatgtatcagaacttcctttttattgccaaataatattccattataggccagatgtggtgtctcatgcctacaatcccaacactttgggaagtagaggttggaaggattgcttgagcccaggagttcgagacgagtctgggcaacatagtgagaccccgtctctaaaaatagaaaaattaactgggcctggtggtgtgtgcctatagtcctagttacttgggagactgagtcaggaggatctcttgagcctgggagttccaggctgcagtgagccatgatcacaccactgcactccagcctgggtgacagagtggaactgtctcaaagaaaaaaatatatatatggccaggtgtggtggctcacatctgtaatcccagcactttggaaggctgaggcaggaggatcatgaggtcaggagatggaaaccatcctggctaacacgatgaaacccatctctactaaaaatacaaaaaattagccgggcgtggtggcacgggcctgtagtcccagaaggctgaggcaggagaatcgcttgaacctgggaggcagaggttgcaatgagcggagattgtgccactgcactccagcctgggcgacagagtgagactcggtctcaaaataataataataataataataataataatacctattcttaatgatacctgaaggcaggatgaagccaactcaggtgtgggtgtggctgttgtaggtactgtcgtgttactccactcaccctaactgtgtctagctccaaaatacctatttgccaactggcatggtcctcaaagacattcataatgagaagagaacaatagggacaaggtaatttcttttttgattcatctaaatttcctgattttaaaaaagtcaggccaggggcagtggctcgcacctgtaatcccagcacttttggaggctgaggcaggcagatcacctgcggtcaggagtttgagaccagtctgaccaacatggagaaaccccgtctctactaaaaatacaaaattaactggaggtgttggcgcatgcctgtaatcccagctactcagaaggctgagggaggagaattacttgaacctgggaggcagaggttgcagtgagccaagatagcgccattgcactccagcctgggcaacaagagcaaaactccatatcaaaaacaaaaacaaacaaacaaacaaaaaaagccagtggctcatacctataatcccagcactttgggaggctagcttgagcctaggagtttgagaccagcctgggcaaaatattgagacccacatctctacaataaataaaaaatttaccagttgtggtggtgcacatttgtggtcccaaccactggggaggctgaggtgggaggatcacttgagcccaggaggttgaggctgcagtgagcagtgatcaccccactgcactccagcctgggcaacagagcaagacagtgtctcaaaaaaaaaaaaaaaaaaagaaaaatcagagattatgatagtgtgtgcattacaaggtctcttttcttttgtatgtgtgtgagatggcatctccctctgttgcccaggctggagtgcagtggcatcatcatagctcactgctacctcaaactctggggctcaaatgatcttcccacctcagcctcctgagtaactgagactacaggtcctttcttttcactaaataataagagatcttttaaaaaacaatatagctaggcacggtggctcacacctgtaatcccaacactttgggaggccgaggcgggcagatcacgaggtcaagagatcgagaccatcctggccaacatggtgaaaccatgtctctactaaaaatacaaaagttagctggtcttggtgatacgtacctgtagtctcagctatttgggaggctgaggcaggagaatcgcttgaacccaggtggtggaggttgcagtgagccgagattgtgccattgcactccagcctggtgacagagcaagacgcagtctcaaaaacaaaactcagaaaccaatataatagtataaactgcacagcggctattgagtacttgaaatgtggctaatatagctgggcacagtggcacacattgtagtcccagccacttttgaggttgaggcaggaggattgcttgagcccaggagttcaaggctgtagtgccctatgattgcacctgtgagtagccactgtactccagcctaggcaacagcaagacccctgtatcaaaacaaacaaaagaagtgtggctattagacatattacaaatattcccagaggtgactcagaagttaatcatagaagtcaaactttgcttattgttatgagtctctagggagtacttcaactcatttgcatctgtttcctcatcttcaaaatgggacagtgtaattctggacctgggacatagtaaggattcaatgggtggcagctgtgacaagagcaacaacaaaaatattgtgcgtctttcttttttttaataatggcacaaaaaggcaaaaccatagatacagtaaacggatgtgtggttgccagtgtttggcggggagagggttcaataagtgagcacagggggttttttagggtgaagaaatgtgggtatatgactgtgcattggttgatatccattaaacttaatagcacaaaaagtgaaccttaatgcatgcaaagttaaaaaaatcacttaggacatttagataattccaaaatgtcatgcagaatatgacaaacatcttcaccgtattacaaatgtgtgaaatgacctcatgaagaggatagaggaaaacgtgctgacctaagtaactttagaaatgagtgggccaggcgtggtggctcatgcctttaatcccaggactttgggaggctgaggcgggaggatcactggagcccaggagttggagacaagcctaggcaacatagtgagatcccatctctacaaaaattttaaaaaattagatgggtgtagtggcgcatgcctgtagtcccagctacttgggaggctgaggcaggaggatcacttaagactgggaagtcaaggctgctgtgagctgtgatggccccgctgcactccagcactccaacctgggcaacagagtgaggctctgtctcaaaaaaaaaaaaaaaagaaaaagaaaaaagaaacaagtggagtctgctggaacactaaaggcaaaagaaagtgttcagaagaatgtactctacttgataaagtttcccacaggggtatgggttaacaattttgataatcctacacatgtatactggacttgaacaattaagtaaatggatggtggatgtggatgatgggaaccaggtttcccgttattggagtgggaatttagagataagcaagcaggaagcaagccaaatgatccctggattcaagtggtaaatataaacaggaactcatgtttagcttaatatatatacagatggttacaaatggaaatatagatatgtgtgtatatatatacacattggtatatacagatatatttctttgttctgtcagttgagaaggcttaaaagaaatgataccccaaggccaggtgtggtggctcacgcctgtaatcccaacactttgggaggccaaggcaggaggatggcttgaggccgggagttgtatcagtctgggcaacatggcaagaccttatctctacaaaaaaaaaaattgaaaattaaaattagctgagtgtggtggcacacacctgtggtcctagctactcaggaggctaaggagggaggatcacttgagcccaggaggtctaggctgcagtttttattgtctttaaattctcttcagataatttacccccgcattgcctacacagcacactgcagagtgctgggcaacttggtaattaaccctctaattgtgtaaactggaagcttcgtgaggttatggcttcattaccatggctacgtggctgtagccatgagtgtgcactccagtgtgggtgatggagtgagactctgtctcaaaaaggaagggagggagggagggagggaggaaggaaataaatgacaccctagtagcaatgagtgcacctagcgcccagttcttggtttctaataaatacccttctccgaaacaatcaaagctcttgcgaaatggctgatttgaggactggggcaggaaatacgaaagatgagcctgaggcatcttgtagtgccagaaagtaaggaagtgcttgacggcaacgagaaaaccccacaaaaataggggtgtgtcaaagggagacgggagccaaccgaaagagctcccaaaagccaaagctggaacaacttgagcaacaaaatcaaatagtattggattataacctaaagtattaaataattatctgtgaatccatactgatataaataaattactgaataaatgagacaaatcttcagtgtagaaaaatcccaaataatctatgtagctattccaaccttaaggagatagagcataactcctcacttaagtgtggcccgagcatagtgacttccttccaaagagtacagtatgaaaaggggcaaaagaagactgactttccagtagagaaacctgacgcagcaccaacagtgatgtcatgttgctatgtgagaaaccgccccagccaagaggagcccagagagacacgacagctagtgcgatgaggcatgctggatggatcctggagtagaaaaagatggagtagaaaaagaacgttgggtaaaaacgaaggaaatctgaataaactgtgaactctaattaataaataatgtatcattattggtttattaattggaacaaatataccatgcgtctgcaataccatatgtgatgttaatagcagaaacaccagcctgagcaacatggcgagacttcatctctatgaaaaatgcaaaaatcagctgggcttggtggcatgccc

SEQ ID NO: 2666 - DNA, 8313 bp, Homo sapiens
gcccaggaggcgctaagtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctattttgtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggtttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaactttctgactacctttaattttgcctaggttgatttaaacaaacaaacaaacagcttccctttcctcctgtatcacctcagctgcctccactgaacctggaagaatggggcttagggaaattcaggcacgacctttgagggttggctcagcaggagtggccagcagtgaaagatgggctaactgtgcaagaggggaggaggccaacgagatggcatcagaatccaagggcttaggacgaagtcagtagacttcagcatgtggaggcatttgaaacttgatcaaacaacgcacttcgagtggtgggagatttcatctctgggttttgcgacctcacagctgcatcaccgcctcagtgttaggcctgtgtaaactttgcacgttggaaaccgcttctttcctatgactgaatcacataagtcaaatcccgctagggcagaaacaggtgcctatctggaggtcaagtggtctttgaattcacaacaaggctgcctgtgagtttgtcagctctcagaagcagtttgactacatgcagagaaggtgattctggccaaagaagtccacctttaggaaaatgccattgtttactccctctagaatatcattctcctagaatcagggcttccgatggaaaggctgtgtttttgcgggaaaatcagtgaacctttctaagctacatttttcctcatctgtaaatagttacagtacatcatgcccaaggccatgccagctcaaaggtggtgggattccttggcgatgtccctgaagctcttatttcccacttcgaaagaacgaaaagggtctgaattttatttacacatggatttagtttgctaattcttagagattccttttttactgctagatcttttttagtaaacacaattgagatagatattaaagtgtaattttaagtgtgcttgttctatacaaatatggcattgccttccagattaagtttttaaccagagtcaaacttagcctttataaaaagtcctcatttaatttcaaaatagatcttcttgtaagacattgcacatagggaagacctacctaggaatagcctggtgaaatgcagaattggaaaaaggcaaaagtccttgctcatgactcagaactacatcgagtgaggtcagtgttgaaaacgcccattccctccaggtgagccttccccattgtggattagtgttgtggcttcatggccctaataggggtgtgtctgccaggaactgcactgcatggggcccacagccctgcctcagaagcagctttggtctcgtttgctgagaccgcttgctgtgcctcatcaatttcaggaggaaacagtgagatgcctctagattttaaatctggtttcggagagcacctaagccctctgatggaatgactctcgtaggaacttgatgggggtaattctaagggggaagagcttgggaaccatgagggctgttaggctgcaagaagggaatggatatgtgagaccatgtgggtttattttttgaagggtgaactggagtaggtgaggattctgcagttgacgccccaggatggctttgctcagccctcccccgtagactggaggaaagcctaccgccaagggaggagaggatgcatctgtcctaggtgcagccggcctccctcttccaggttcagcaagggtccctggctgggcattttcctcgtaacctttggcagcattggctcaaatgccattgtttagattcccagatatttccccactgctttttgtgttaaggtagtttggtaaaatgccttattccaatggcctaagataatatcaagcaactcactggtttacttttctaaccagctgtggttaagacacacacggcaatgtgctatctttcacatgttggacgttaaacccagaccaactccccaaatctaatttgtttcagtaatttctgaatgcattgaccaagatattcctttcatctctggttgagtttcttccattagaaggaaggattaaaccttggataaaagatttgcagatgccccagtggttagtagaggtgaaaatggaggtttcagggaaactgctggggccttttgcctttgtcctcatccaaagcattttgtgcctctctttcttctcctctggctgaatatccactggagattgaattctccgaaactccctgtgtgggtgaagtgggaagctgtgcccaggaaggggagtaactgtgcaaagttttatgcagtcagtgccagaattggattacatcacctgggggaggcgccttcaggaccaggaaatggtacatggagctttgaggtgaaaactcatcttagaaacccacaaaaagtcattcccccagcctgacatcagggacagaccacacccatggggcagaaaccgggcttggttgttgcagtgggaagagaaggcacgactctggtgcaccgagcacctttcctcgtggctgtttccaggcactgggctggatgtcctcagaaccccctgtcccctgcccactcctcaaacccttactgacccacccctctcgcctggtgctgtcccaggccctgggggtgagggggaggggactccaacgtgggcttgccctccagtgtggtgggagggaaccgcgtggccacttggcttagccgtgctcatggtgcagacgtggaacgcggaggcagggagaggctccgtgacgtccccagggccccagaacgaggaaggagcggagttgggattccagcccagttggacgctgaagtccctgttttgtttactgcctcctgttcatggcgtatgaatgtatctgagatgctttgtaaggcataaagtgcaatactagcttagtggctgttcgttcagtgattccttctgttaccaaacaggtggctgagatgagagggcaacccaagcctaacgcccttcagtggccttgcatcagagtactcgtgacaggtacctctccgtggagaggggctgtcctctgcccttgcctgctcctcctattgcaacagtcctgtggactagctcaggctctacaggggctggtgtgtgtgtgtgcgtgtatggtgtatatgtgtctacctacacacaagcacatgtgcacacatgcacacacatgcatgcaagcacacgcacacacacacatgcacacacactcacatggacacacacatacacacacatacacacacatacatgcacacacatgcacatggacacacatacatgcacacacatacatgcaggtgtgcagacttggctccaggcgtgtgtttgatagtattattctatgatatttccctcatctccatagaataccagcttctgaatcctcaatcagcctttactgcaagaagaaaagaaaaacctctctcattccaggtctgtggtgcagatgggaagagtatagtcaaaacccattaaggccttagtcaaatgccagccgaattagaacgcaatgaacgttagacaaaacaacccaactggccaggcgggggaggcgcagagcgtataaatataaagttagatacttataaagaataaagactctaataaaatattttatataaaactttttacctgtgttcagcgtcagatgcttcaagtgattggctttgcattctcctaagtcgatggattcttaggctgtgtctagaatgcgtttgttgtccctctgggaagagcactgatttgtcgctcatgttctggtccaagacgtggctgtagatgagccctttctcgatgatgttcatgtattatgttgaattgtcttaaagttttgtgttttctgttctcccagaatcctcacccatgtcctcctgcctcgtgatgttggccatgacctcgaaatgtgcctggaggaggctcgaggcagggctagcaggagggcactgggccacaccttccctttggtcctctccacccttgcaggggctccctcaaccggggctctggggcggtagctctggcagggcgacgtcgcttcttccttactctgctttgctggaaacccatctcccaggctgagctctgtagaggcagctgctagtggggaaggcagcccctctagaggttttggtcccaaagttgaggtgagcagggcctagcagttgctcagtgttatgtgctgcattagcccatggttccccgagctccggccaggcagtgaccctcagagtgaagactttccgggacaccagtggcttagaactgggctttcaaatccagcttccctcccacctctgggacacagagcagagagccgggctgggtgaggtcacagaatcggcccgcagtggcccctgcactcctcctatggcgggcaggcacaatcgaaggctgccccaggcgtgcacacaagctcgcgatgcacagttttcttcccccctcggtaaccccagcctttctggacggcccggccgccctgggtcccagtaatgttaaagtcacggtcctttccaagccactgtacttgggctgtcccgtcagggaggttcctccaagataattgccccctgcaaagacaggggcttctgatgtccacttgtggggctgacctttttggggaacctccctgggaccagaagcagggaagaaataagagaccctgcacccccatggcacagtctaattttcacttacaagctcaattcaggctgtccttaaaatccacgtgtcctgggcaggaaggaaatgtggggacaggcacacacgcacatccttctgctatgctgacctaaagttcctaatagctatcctacatcctgcccgtttcttttttccatatttgaggaaacagaagggtttagccttagcctagtttttttatgttatctctgaacaggccaacctggaatcacccctcacacagacacgtgtggcctgccccagtgtgcctgaggcccacccaggaaccctgctttgcctggggtttatgtgaatgacacacatgtgagcagaggctggggttaggaccctgaggcttccctgttctcagaaatactctcctggcatcaaaaggagaaaacggtccatgccactggctaccacattccagcctggcaagggtttactgtttatagaggcaccgtttgggggcttttccatgtagaatggccgttgtaaagctgaagagaaaggaacagaagcacaaaagcaccttgattcttcgcaaacacaggcaggggctgccggctggacgagggcgctgcattttgagggcgtgctggacccgctggcagagcccgccctgagggttttctctgcagctgtgggctaagcttgcccaagcccctccccttttccagaaagccacccccatggccacttgcctttcaggtccaggttgaggacacagccacgggcatatatgtatttgtttcactggggttcatggttctggggacagtcttctagcccccgagatcttgggaaaggcatgagctcaagccacataaccaaaaagtagcaaaactcaaaattattactttactttcagctgttttctctcaatagcgcgccaccatcgtctgtgtgtctgcactgaacaaacatacgagagaatctggctgatcactttgagtgcctttggcctaaactttgcacatgactttaaacgtggccctgatactgcacacagtaagaaatgttttttattttatggtccctgaggttacgagatcagatctctggaaatgtgtaagccacctgctgtcacctctgacccatgtggtccattaccatgagggccggtgagtggggcagagatgctgaggcctggctggtgagcccccgagcagtgaggcaggaccctccctggtgacctgtgtgggggccagtcctctagtcccccagacaaatctccctttaaggaggcttctgaagctctgagtgccggcgctcagaattaatttgactcttcactgctcaccgcacctgcctatgagcctctagaaaacagcttgcccaatgagagtgctgcagctgaggcagcagcagacatgtccgtttctggggaagttactcaaacaatcgtgcctcttagggggccctaatgtgccccttctggcaggttgaaatgcatctggccttgaaggggaaggttaggaaattatgaagtacgtgggtttagggttgacaaccccatatccgtggactcctggagatccctgaacgccgtctaatctgaatggtaccacaatttggtttgtctgaaaatatagtagtaaccacggcagtgatttcatttttacacgtttgcatttttacatgtctgtcattatgcatcttggggtctcttttccatgacctaccagcttcccaagcttaataatcagtatctcactattatgtcattggccaactgaaaacagtagcaaaacatcctatcatccaaattgctaataaaatagaacaccacacccacacgctggcttcccatttttatagtcttatcctcccacctggagggtgtgaatggggatcagtttttcaatagaacatgtatgtttggtaagttaatatgtgtagctgacccctttgcctttgtttttatatatttatgtttttctattgtagacatattgatgcaatacctgttcatagttgaatctgttacaaattgttaccttttatttgatgaagaactatttaaagattttccttttttatttcttctaaagcaaaagtcaatgcaagtaactctaatcagcgtgcaaaggcgtgcatatatatctgctatgtaattatataatgtttttataatgctgtgtggataacttttcactgatttagttacttgactgtaggaaacactgttgctttgcacgctgtgagaggtttgcactgttacagatgaaggcaacatatttacatatgtacatgtatatacatatatatatattcaaaaataacatcggctctttggggtgtctgtttccttggttgtctcacgccactggaacattgaacccagacagaccctaggatgtgaggttcctgactgcaccttacggaccacagagccacgtgtctatttctgtagacctatctccttagatttgtacatgcattttttgcggacttgaactttgttttctgaaattagatgcc

SEQ ID NO: 2667 - DNA, 4137 bp, Homo sapiens
cggccactctgtgaaactaccgaacctttgcctgtcaaagggcctgccctctaagcgtctgaggacatcatttgccaagcagactctgaccttttccctcttctcctccacccaacaggtattgtgttggctgcgtgccaggccttggagaacagcacgtccccgctgagtgacccgcccgtggctgcagcagtggtgtcccattttaatgactgcccagattcccacactcagttctgcttccatggaacctgcaggtttttggtgcaggaggacaagccagcatgtgtctgccattctgggtacgttggtgcacgctgtgagcatgcggacctcctggccgtggtggctgccagccagaagaagcaggccatcaccgccttggtggtggtctccatcgtggccctggctgtccttatcatcacatgtgtgctgatacactgctgccaggtccgaaaacactgtgagtggtgccgggccctcatctgccggcacgagaagcccagcgccctcctgaagggaagaaccgcttgctgccactcagaaacagtggtctgaagagcccagaggaggagtttggccaggtggactgtggcagatcaataaagaaaggcttcttcaggacagcactgccagagatgcctgggtgtgccacagaccttcctacttggcctgtaatcacctgtgcagccttttgtgggccttcaaaactctgtcaagaactccgtctgcttggggttattcagtgtgacctagagaagaaatcagcggaccacgatttcaagacttgttaaaaaagaactgcaaagagacggactcctgttcacctaggtgaggtgtgtgcagcagttggtgtctgagtccacatgtgtgcagttgtcttctgccagccatggattccaggctatatatttctttttaatgggccacctccccacaacagaattctgcccaacacaggagatttctatagttattgttttctgtcatttgcctactggggaagaaagtgaaggaggggaaactgtttaatatcacatgaagaccctagctttaagagaagctgtatcctctaaccacgagaccctcaaccagcccaacatcttccatggacacatgacattgaagaccatcccaagctatcgccacccttggagatgatgtcttatttattagatggataatggttttatttttaatctcttaagtcaatgtaaaaagtataaaaccccttcagacttctacattaatgatgtatgtgttgctgactgaaaagctatactgattagaaatgtctggcctcttcaagacagctaaggcttgggaaaagtcttccagggtgcggagatggaaccagaggctgggttactggtaggaataaaggtaggggttcagaaatggtgccattgaagccacaaagccggtaaatgcctcaatacgttctgggagaaaacttagcaaatccatcagcagggatctgtcccctctgttggggagagaggaagagtgtgtgtgtctacacaggataaacccaatacatattgtactgctcagtgattaaatgggttcacttcctcgtgagccctcggtaagtatgtttagaaatagaacattagccacgagccataggcatttcaggccaaatccatgaaagggggaccagtcatttattttccattttgttgcttggttggtttgttgctttatttttaaaaggagaagtttaactttgctatttattttcgagcactaggaaaactattccagtaatttttttttcctcatttccattcaggatgccggctttattaacaaaaactctaacaagtcacctccactatgtgggtcttcctttcccctcaagagaaggagcaattgttcccctgagcatctgggtccatctgacccatggggcctgcctgtgagaaacagtgggtcccttcaaatacatagtggatagctcatccctaggaattttcattaaaatttggaaacagagtaatgaagaaataatatataaactccttatgtgaggaaatgctactaatatctgaaaagtgaaagatttctatgtattaactcttaagtgcacctagcttattacatcgtgaaaggtacatttaaaatatgttaaattggcttgaaattttcagagaattttgtcttcccctaattcttcttccttggtctggaagaacaatttctatgaattttctctttatttttttttataattcagacaattctatgacccgtgtcttcatttttggcactcttatttaacaatgccacacctgaagcacttggatctgttcagagctgaccccctagcaacgtagttgacacagctccaggtttttaaattactaaaataagttcaagtttacatcccttgggccagatatgtgggttgaggcttgactgtagcatcctgcttagagaccaatcaacggacactggtttttagacctctatcaatcagtagttagcatccaagagactttgcagaggcgtaggaatgaggctggacagatggcggaagcagaggttccctgcgaagacttgagatttagtgtctgtgaatgttctagttcctaggtccagcaagtcacacctgccagtgccctcatccttatgcctgtaacacacatgcagtgagaggcctcacatatacgcctccctagaagtgccttccaagtcagtcctttggaaaccagcaggtctgaaaaagaggctgcatcaatgcaagcctggttggaccattgtccatgcctcaggatagaacagcctggcttatttggggatttttcttctagaaatcaaatgactgataagcattggatccctctgccatttaatggcaatggtagtctttggttagctgcaaaaatactccatttcaagttaaaaatgcatcttctaatccatctctgcaagctccctgtgtttccttgccctttagaaaatgaattgttcactacaattagagaatcatttaacatcctgacctggtaagctgccacacacctggcagtggggagcatcgctgtttccaatggctcaggagacaatgaaaagcccccatttaaaaaaataacaaacattttttaaaaggcctccaatactcttatggagcctggatttttcccactgctctacaggctgtgactttttttaagcatcctgacaggaaatgttttcttctacatggaaagatagacagcagccaaccctgatctggaagacagggccccggctggacacacgtggaaccaagccagggatgggctggccattgtgtccccgcaggagagatgggcagaatggccctagagttcttttccctgagaaaggagaaaaagatgggattgccactcacccacccacactggtaagggaggagaatttgtgcttctggagcttctcaagggattgtgttttgcaggtacagaaaactgcctgttatcttcaagccaggttttcgagggcacatgggtcaccagttgctttttcagtcaatttggccgggatggactaatgaggctctaacactgctcaggagacccctgccctctagttggttctgggctttgatctcttccaacctgcccagtcacagaaggaggaatgactcaaatgcccaaaaccaagaacacattgcagaagtaagacaaacatgtatatttttaaatgttctaacataagacctgttctctctagccattgatttaccaggctttctgaaagatctagtggttcacacagagagagagagagtactgaaaaagcaactcctcttcttagtcttaataatttactaaaatggtcaacttttcattatctttattataataaacctgatgcttttttttagaactccttactctgatgtctgtatatgttgcactgaaaaggttaatatttaatgttttaatttattttgtgtggtaagttaattttgatttctgtaatgtgttaatgtgattagcagttattttccttaatatctgaattatacttaaagagtagtgagcaatataagacgcaattgtgtttttcagtaatgtgcattgttattgagttgtactgtaccttatttggaaggatgaaggaatgaatctttttttcctaaatcaa

SEQ ID NO: 2668 - DNA, 1775 bp, Homo sapiens
ctcaagagcacttacgggtattaagacacagagaaaaggtactttttcctgtttcccattcaaactcttggagaaagattgccttttagactgccctgtgccactctgaaacatgaccacctcaaatttggtggctccatgcaatcaggcagaagaaaaccttgatgcaacgctttcttgggctgctttagattgcacctaataaataatctggatgacaccaagaagttcccacaggtccctgggtggggctgggaaggtggatgagttgccaacgaatggacctgtcattggacctgcctcaggtaaaggtgaggtgattccacagaaggagtcaggagtgaaacgcctagcagggagctagatggagaatgaggaatggatgaggcttttttatgtgctgccctagattttcttggcctctcccatctcctttctcttttgctccttgctcacaaaagagactagctgctgtgtcttatatctcattagaaaggtgattgaatcatccttcagagtgacttaataacatttaaacaataatattatgataacatataatgaacataataaacgttatttctgagtagcccccaaagcaagatatctctttaataattaaaatttcgagataagaaaatgatgcttgcattgggaccataacataatgttttttctttgtcgtctctgcatataaaagtaatttcagtctacctgtaagagcagcatttgcattatggaagtttttgtttgtttgtttgtttttgtttgagatggagtttcacccttgttgtccagactggagtgcaatggcgcgatctcggctcccggcaacctccgtctcccaggttcaagcaattctcctgcctcagcctcccaagtagctaggattacaggcatgtgccaccacgcccggctaattttggattttgtagtagagacggggtttctccctgttggtgaagctggcctcaaactcgcgacctcaggtattcgatgagatcaggagcatgcccagctctccactgcgggcttcatgtaagaggagagccatgataatgtattgcattattcttgtacagtaatcagatcataggtcaaaaaggacacacggtttctggcctgtctgcttggaacacttgctctagacacctggctgccataggagaggccaacgtgaaaaggaaccaacgccccagacgatagccccagcagggctcttacccagcagcctgcaccgtggaagtgagccaccttggaagtgaattctccagacctgtagagctacaccagctcattccatgagaagcagaaatgagctgcccagctgagtccttcccaaattctggcacacaagattgtaaacaagactattttaaattctcaaattttgaatgcagtttgttatgcagtaatagataatcagagaaggagtagagaatagtatataaagtcaacacagaaccaaaaaagaagatcaaattttaggtgacatgttttgtttccaattattattattgaaacattaaatccttcctgagtgtaagtgatccagatgaaatgaaagtaattggaaaagtcttgactgtgttatgaggccttagagaaaataaaatccctttaacacatgattcccaaagcacaaaataaaatatattcaaaatgttatggcattgaaatccatgagtgtcctttctttcctttctcactgaaatttattagaagataataatctgtgcattacctattgatggtttttcagagctattttctcc

SEQ ID NO: 2669 - DNA, 3023 bp, Homo sapiens
ctctgtgtgtctccaggtggtcatccccatgggctccacagatgaggacaccggccctcagctctgccccctctcagaagccttcctcacctgggggttctgggtgaagggagctccccgccagagactcatgtgggatcgtgtgtggaccgtagagccacagagcgtcatctgtaagccagatagagtttcactcttgtctcccaggctggagtgcaatggcgtaatcttggctcactgcaacctctgcctgctgggttcaaatgattctcctgcctcagcctcccaagtagctggaattacaggtacgtgctacaacatctgactaatttttgtatttttagtagagatggggtttcaccatgtcagccaggctggtctcgaactcctgacctcaggtgatctgccagcctcagcctcccaaagtgttggaattacaggcgtgagccactgaatccggccaatgttatgcatttaagtgtggggagcagaagactggatatgcaagagcatacatctggataccttttacctcttggcttgtggggaaaatgacctgcaggattttacatggagcttcctgtgtgcatgctggtgactgttggcaacaaggtgtcaggaagaaagacattgctttccaaactccttttcccaaatgatcctttcttacccagtctgccttacctgcttctgtactgttcaacagaggagggggaacagggaaaagcaggggcagttgtgaaaaatagaagggaaacttgagtgtgcctttttcttctccttctctttctccaccctcagtcatcattaacagaaaaatatttttaaaagatcccttgatggcatccccaaatgttaagtctgacattttcttagctgatggcctcctttgtgaaggtactttgtgtccgcccagcatgcctgctggatccctggtttgccgcagttgctgaggtaaatactctttccattaagcaccacagcccaagagtggcctaaagctcaaataaatgaccaagaagcaacttaaacattccctggggcgattttaacctatgcaatggctttttgaaaaaattgcctattttttcatgttttggccgggggggtgtctcttattcccttcttttttattttcctttcagctgagtacaccttctctttcatttattcatgcactgcatgaaggatggaagcaggatgaataaatcacagagcattgcccctctccccactcagggtctgtgaagagagctggagcagaatacagtccaggcattatgtcaactttcaggggacctggggcaggtggccgattctcacagagaccccacttccctttcctgtgaaaaataccacagcccaacagccactggagaacagtgttcttctggaagcttcctctgggcaggaggagtcaaagatcctggtcctcagggacacttgagatgggtgtgcccaaagctgtgcaggatggtttggtttgttttgtttttctttgcctcaggaagaatgtgttcacaaacctcaggacaaatcgtttaaaaaagtgtcctgacagttgtcatgcttcatcacttgatttagaggcaataggacagccttattttcttctaatctctggtggttgaggagtctggttggcctggcagaaggctgagattggctgagggagtcatgagcgagcaggggcctctggtgcctgaagcgcccctcaggaagagcgggtctcaccggaaggccacactcatctccttcctggttacccagtgtggggatttgctactttgctgagtgtgttttgtctacattcatggtgctccagaactgtgtctgtgtttctcacattctctttcgtgtctgccagagcaacattctcagcaaaccatctgaatgcaactcctgtgatcacaaaagtcaatcactgatggaaatgaagaccacgaccctgattcctcaggttggcccttttcaaaccacgtttctcagagctccaggaacaacaggagttctagggagagtttttttttttttttttttttttttttttgaggcagagtcttgttgtgtcactcagtctggagtacagtggctcaatctcggctcatactgcaacatctgcctcccgggttcaagcaattcttatgcctcagcctcctgggtagctgggactatatgtgcacaccaccacgcccagctattttttttgtattttagtagagatggggtttcaccatattgcccagggtggtctcgaactcctgagctcaggcaatctgcctgtcttggcctcccatagtgttaggattacaggcgtgagccaccgcgcccagccccaggagagatctttttaaaaacgtgaatagatcacgttagtttgctcattgcacttggacaaagctgcaccctgagagtgtggcctgccaggcctggtgacagcgtctcttggtctttgcctgtggtggtctctggacccttcagtcttctccatggtgcctgcctcaaaagctcttcctccactgttcacctgtttaactccatgtgtccttcagtttccagcttgaatgtctgccctcagaaaggccttccttgaccccccagatgaagtcagtttcccctaaagtgcacgaggcccacatgaaattacttagttatttggttaatgtgtcttccccactaaactgtaagagccacaggagaaggggcgagtctgtttcattttcagatgtagctctagcctatggtgtatagtaggtgttcaacaaacatgtatttaatgaaagaaggaatgagagcatggcactgcctctctatgctgaaatggtgtctggactacttgttttttctttcccattcatcagatgatcagtcagctgtttaacagagcagattaaagtaatttcgagagcacactcttttttttgtttttgtttttgtttttttttgagacggagtttggctcttgttgcccagactggagtgcaatggcacaatctcggctcactgcaacctctgcctcccgg

SEQ ID NO: 2670 - DNA, 714 bp, Homo sapiens
ggcgcatttaccatgcagagggatgggaccatttaagcccacgccccggttaggcctcttcccagttccagctcccacactgtccgctcttcttcctggcacggaggtgagggcccatggcctccctgttcacctattgccatcatctcctccacaagtaagctctccagtctcgtcctccaggaagccttccttcgtcacactcaccccatctgattatgctgtttccctgtttcttcccaggctttatatcatcggtggcttgtattcatggttttctaattctgtgggcgtatcctaatcacctgtggtgggaggactttcattttaaacaaataccgcaagtggtctgagggccacccaagtttgatatcctttgcttaatcagatgttacacccacgcataaacgtgtcttgagtcatttcaacagacagtgtggaatgtgcctttgatttattttgtgtcatgacctccccaaggcacctgcactgtgagcacgggatctgctttcctggtgcaataatatgaccatgaagaaagccaatcatgaaagtgtgaaatatcacaaacacgccctcccctaccccgcatcaatcagcaaggggctggggacctgttctgaaagactggtaggtcttgggtaccagttaatacaacccatggaggccgggtgtgagccaccgttcctgggaacagctagttttatgtttatt

SEQ ID NO: 2671 - DNA, 2308 bp, Homo sapiens
ccgatgccgtatcctgccgcccgttttacccgcgggaaagccgaggcccggtgctgtattctgccgcccattttacccgcggggaagctgaggcccagtgctgtttaatatcttactcatgttcacttgatgagaaagtgacagatctgagacaaacccagatcgacagaaaagaaatgagtcaacgatggtgcaggtgatctgtgcagtgctgtgcaggggatgggtcaaagctgtgatgctggcatgcaactaactcaccattaaagggaccagcttgacgaagcttctgcttttgtgactgtctcctaatgggagaagtgaaattctacctcacttttttaaaagaagagcctggaattggcctatccgtctttttccccgttggatcacagagcagaaaggaagctaagacctctagtacagtgttcaatggaactggtgagaaaagacgtccttgctgtgttcctgatatgaagaggaaagcagtccttctccattaaatgctgacaacatgagcctcccgtggtcggaacgggcttgtgaaggcggtgctggggtgcaccagggcagcagctacagggtcaagcctgagacacctgaagccctggacttggaatctgaagctgtcatcagccagtacacctatgaacctgtggaagacctgaagtacctgtttaaaagacagccaaaagataagtaaatacttcccaaatttccttggtgtctttgttgcatagttgctgtaggctggataatagtagccattgttatatttttacaattaatttctttcctccaaacagatagaatcacttcctttctaataattaagcaaagtaaaatgttgtaatccatttttgtaacaatcattcctgacaggataggtatccatcaccacccctaccccaaagttcccattctatagaacaaaataacaaatatgtattttttgtgttccataatagtcacccatagcctgtgtatactgggaccaggcatatgggaatcaactttattttacaacagcttctctttagctctccatcagttaatggattctgggtatttattaagaactttacatttaatggaaagaatgttaaataccaccagccccactctggcagaggactgttggctttgtttatctccatcatcatcccaatactttgccatctcaatcccagcccaatcttgggcctttgagaaaataacctatcattcctaactataagggtggaactcccttcaaattaatgagcctggatgacttatatgacttcaaaattatgtaaatgacaagggttagaatgacagtatgagtagtaaacctcctccagtcccatcagaacaaactttctggggttacgtcccattagaaacccatttggtggccaatatcaatgtacacagaactaaaattccaggtgccactttatattaagagaagccacaatttttgtcaggccctggaaaccttgaaaagtcatcgacacaactgcaccctggaaattaatccctcacataatcatgtaagctatgcagttacccaatcagcattatttagaaaacctgtatggttttcatggaaatcattctgagttaaggacactttaaaggatatacagtctaagtactgtcaaggtaggcccactagctgtgttcacattttccattgggaagactgtactgatcctcagatatctggttgccttttgatttgccggtatgaaaatagctttgggtgattgttggaggacactaagtgtaactaactccattcggaaaacagaactgctggggcaactcgggatacttcccaaggtcctttccagcctttaactggggccatcttagcagggaccttaactacttggaaaaacaaaaatggcaagctaacccacatgttcatcatagaaaacaatttttgtcttgaacaacaaggagctttttttcctgcgtggaactggttcctacttatgtttaccagccaactggactggaacctgtacacttgtttatttagccctggcaattaatatagctcccaataaccaattcctcattttacctttgactgcaactgccaggcacagattaaccagtcaactcatacccttttggtagggctaggcgtaacagctggaataggaacagaggttagcgggcttgcaacttccctatcctattatcaatgcttgtccaaggattttatgaaaagcttggatggcattgcctaaagtatcgtcaccttacaaaatcagatagacttcttggcagcagtcactttataaaataggagggg

SEQ ID NO: 2672 - DNA, 2871 bp, Homo sapiens
agccagccaaatgtgtttcagatcctaaatcctccacctaaggggagttgctgagtcagcccagaccggaaggagtggcagagatcatttgccccaagaacggcagcgagcgagtaaatgttgccttggtttacccacccacgccgactgtgatcagcccctgttccaagaagaatgttggtgaaaagcacagaaaccagtgacgtttgtggctgtggaatttccatggagaaaagagagcatctgaacacctggaccatcttttgcacctggcagaccctctgcactcaccccagcgtgttctgtgaacttgagtgacaacgcgtgcttgcagggtgctttttggacgactggggaagaggtggggagggggtggtggggggaagcatggacgagaacatggagcaaatgttttacaacctgaacctcagaactgtgatcctccaaggagcgcgctacttgaagaaaagaaaaaaaaaaaaaaaaagtcgaatggcttctcagggattttgttttccgtgcacatataagccatagttacagtacaggtggcagtatttagagcactcagatttcagttctgttaaatgtgaaagagggatcgactgacgttcattgctgttccataactagtgtaaaatatgtatatgtttatctttatttttataatatgcaaatacatttaaatttatacagtttgaagcttctagcgttagttcacactgggtgcaatattctgcatgagaactgtgccaagatggggctgatttcttattttagtataagacttttttgttttttctttattctttaatcctcttcacattaaaaaaaaaatctctctgttagcccatggattaagtgttggttcatagagattgccaataatcagaaagaaccttaaatgtgcatttaagacagtgtcccttcccttcttttcaatgaaggtccctgcctatataaatcatctggcacgctggtgggaaatcctttgctcttccaacgtgttattagtgctgggcagagatggggcacactcaggggccaaagaggacaaaaagtccatgcaaaacttgagtcttttaatggcttaagataatcaggagtcagttctgaatcttacaaagtgctctgcttaataagtaccttacttagcagagcactttgcaaacatattacttattagcagagctctttgtagaccttccacatctggctgtcagatcttaaggttgtgaatttaggctccagttacattcactggagagcataatcccacacgggttatttataaatacagagcctctgattggacggtctcctgccaagaactagtaatacccttgttttaaaatcttcacaaggtaaaacttaaaaagccaaccaaacaaattgctctccattctacttttaattgggccaaacagcatatgctacagtagtaacatgtttttcggagagtgtaaaaaactctgtttacatttgcctcctccgtgggttgatcgaaaatgtataaaactgactgcttctcgccagcctcagacaagaagagtgagttgctggtactcgctactcttttacttcttttgtaaagtattgactcttggaaggctacagtatacaaagtctcaacatgttttttaaaagaaataaggagcaagcgactgccctgctagaaatcacaaaccgatttttgtagaatattttgtgccccaggcattaatttcactgactccagaacctgcagttcagagaatgatttcttatgatgataaaaatcgaatgggatcagacgatgtttgcatttttttaatacttgaataggacacctcaagtttgagatttcattttcttttagaacacagtcacaagattaatctggtgaatccttttgtcacagttctcgtgtgtgtgtgcgcgtctccgtgtgtgtgtgtgtgcatgtgtgtaaaactgaatggtcacatttaattgctttttggaccattgaatagttgggaagtaagaattttttaattggcatgagacggttcctcaactgttaaattaaccaactttgacctgtctttagaaaaaggcttatttgtatgattttgggctaactccccggggaccatattaaatgacaaaaatgctcctttgggtgacacaccctacaaagtatttgctgttacgaacataaacgcccacattcttaatatctaatatttttgaccagtgatgttttatgctgtcatctgaaccctagagaagcagtgtcagaggaaaccttggtgtcacatgtgtcttagcaaaagggttaccatgatcgagggtcatgtgaccaaaagatgctccagagaagcttgagaatttgtttcaagttgggaggagggttggagatacaaaaatcactctgctctacaggactcttcagctgtctatgcaagaaattccgttttctctttcagcacctggaaagacacagcagcccaccgaggcgataggtgattcactaagcacaagaggaatgttttctaagcaaggcgtcccttgcctctcaaacaaatgccctccaagtttgttagggtttctattcctgcaacttgtggtatcaaaaccacttcctggaattgtcaaagcactgccaaaataaatgtttttcccccttctaagaaaaaaaaaatgacagtgctcatatttgacacttgtgtattggactctcttttgaatgaataaaaaggaaaaggggtttggtgtaattcctgatggggtgcgtgttgtttttcatgccatggtttgtgaattttaattgtggtttcccatttcgttgttgtaactgggcagaaattaaaaaagaaaaatcaataaaaatacaaagaaatggttaaa

SEQ ID NO: 2673 - DNA, 310 bp, Homo sapiens
ctggacagtcagacaagaaggctcactttctccaggaatctcctagtgccaggttctgggctgtggacaccatgctggccagaggaagctgctgcacagtgtcttcctttggctttggtatcaaggtaatgctggcctcataaggtgagtaagaaagtgttctcatcttttcaatgcttctttttgaaaaattcgaaaatgatttgtgttagttcttttttaaatgttcgttggaatttacccaggacccgtcaggtcctgggctttactttgttggaagattttaaattactgactcaatatccttcta

SEQ ID NO: 2674 - DNA, 1396 bp, Homo sapiens
gttctcaattgctatgtgacaaattaccacaaacttagtggctttgaactacagccatttctcatttcctagtttctgtaggttagaagtccaggcatgacataaagtggcttttctgctcagggtctcactaggctggaatcaaggtattggcagggctgtggtcttatccaaggctctgagtcctcctccaagctcaccggtgggtggcagaattcaatttcttgcagcagatagattaaagttctgttttcttcctggttattggaccagagtgactctcagctcctagagtccacccccaggcccttgccacatggccccctcacagcatggcagctcatttcttcaaggtcagcaggagaatctctcctaatctgctatgacagagtcttatgtaaagtaactgtaatcacaagagtgaatatctgatcgcctttgttatacatcataacccaatcgcatgagtgactaacctatcatattcccaggtcccgcccactctcaaggggaggggattatacagacgtgtgtgccacgagactggaatcttggaggccatcttatatttctgccaatcacaattgctacgtcttttaaactaggatagatagatagtagtattttctctttttgctgattaggaaattgaggctcagagaggtgaagggacttggccaaggttacacagtgagtacactttggagagagggatccaactcctattccctcagacttaagaccttgagggcttcttgagattggaggttgggttctccaggaggatggtggtggaggcctgagtaccaactatggtaggtgtgaccaaaaggtaggcagtctctccccagggatgggagaggccttccttgctaacagctgcctgtggttctgagcagcaaacccagaactggaggaatccttggggagcagaaaccacaaaaagtcacaggatggaagccagccttcgatgccatccagaccgcacggggccaaagctgggtctcatgtgcactcctagactagggacaggggccatcttcccggatttcagggagtcgtcatcagatctaaacaatgtggattctgtcagcaggaagagagtgggcaatgtttgctggatgggcaaacgtggcatctatggggccatttggaaagtaaggaggctttccaagagcctagaatttgcatctctgaggcctgctcctcagattttcctacggtcaatggacagtggacagtgttaggtgactgattctccaagcacagcttgactgaacccatgactgcctttctttctgcctgtttgccagccaagaataaaaaggcttagtgtgatttcaaatcattgcaaggttccctaaggtctcttctgctggcctcacacagacctcat

SEQ ID NO: 2675 - DNA, 3177 bp, Homo sapiens
ggcatctcccgccacccccagcagacattttactcagatattaacaattcctgaattaacttcttcaatgcatattcttattttatagagatgcaaatagatccctggatatttttgatgagagatcacatccacttacacgagaaaaagttccagaggaatactttaagcatgatcctgagcacaaatttatttacagatttgttcgtactctttttagtgctgcacagctaacagctgaatgtgcaatagtaactttggtttacttagaaaggcttttaacttatgctgaaatcgacatttgtcccaccaactggaaaaggattgttctgggagccattcttcttgcctccaaggtttgggacgatcaggctgtatggaatgtggactactgccagatcctcaaggacattacagttgaggacatgaatgaaatggaaaggcattttctggagcttcttcagtttaatattaatgttcctgccagtgtttatgccaaatactactttgaccttcgctccttagcagatgacaacaacctgaattttctatttgctcctcttagcaaagaaagagcacagaacctagaggctatttctagattgtgtgaagacaaagacttgtgtagagccgctatgagaaggtctttcagtgctgataacttcattggtattcagcgctctaaagccatcctctcttaaaaggagaaatgaggggttataacgtcatgggaccttcatctacaaagactggagaaataccacctttcctgctcaaaaaccagcaaaattagtgttttcatcaaaaggaaagatctcaaattcaagagactcatggacaacaaggattatactccacaggaaagaatgggaccttgtcaatgcaacaaaacactcttctgtcctttttaatgtaaacagagttacaaaaaccactccaaagtgaaggctcccatcctacacacagatatttgcttactgtgtgggccgatagctgtgaactatgtaaggttttttaaacaatagtttaaatttttagactttaaagacactaaccatataacttttatgtttcttccagtttctctccctccccccgcattttgctgcatatgcctttaaaatcaatgcagtattaccattaaaacatgggactctaactaaagccacttaggagcagacagcagcgttgttaggtactgaagggttcttcctccctactgttaccattgaagctgctagtcattggcaatcattttaaaccaaaaagctgctggataacatttgtcattcatattctttgcaagcattactttagcattttagcatgtttggggtcataaacagaggaagtatcagttattgatatctacttctattggagtccatgttgcatttcttgtgaactataaatggtgcttctcattttctgataatttttctcttgctaaataaatgtattaaaagatattttcataatgccaaccaacatggtggttcagtgacgatgagaaaaagtgaagcagttttaagcttgaatatagtttgggccctccaaggcactgcagcatgagtataaatgctataaacctttaaaaaacatgatttgaaagttttttgttttgttttgtttgtttttaaagagatgggggtcttactgcgttgtccaggctggagtgcagtggcttttcacaggtgcaatcattgtgcactcactgcagcctagaacttcctggtctcaagccatcctctagcctcagccacacaagtagctgggactacaagtgcaactggcacctgtctcctgaatattaagcttttaattttttgtttcggtcactcttgatagcagacattgactgaaacaaaaaattaaaagctttatattcaaaatttgcaaaatgaagctgggtgtggtggtgcacgcctatagtcccagctacttgggaggctgaggctggaggattgcttgaggtcaagtattggaggctgcagtgtaccatgatggtgcctataggaatagctactacactccaacctggacaacgttatcaagaccccatctcttagaaaaatgcaaaattaaatgcaaaagaaatgggctgggcatagtgattcatgcctgtaatctcagtaccctgggaggctgaggtggaaggattgcttgagtgcaggagttcaagaccagtctaggcaacatagtgagaccctgcctgtaaaaaaaaataataaaaatagttggatatggtggcatgtgtctgtagtcccagccactctggaggctaaggtgggaggatcagtagagcccaggaggtcaaggctgcagtgggccatgatcatgtcactgctctccaacctgggcgacatccagaccctgtctcaaagaaaaaagcagaagaaaaatgttcagacaaggttttgtaaaggtttgtagcatttatatttctacaagtatcaaagcttaaaattacactgaacttttggaataccttgtatctccataaaatgccctctttttaaaagtagttacccgcagagctgtgctctatatgctttgattaccgcagtttctttaaaggaagattttgaagagcagtgttaattaacatgtaataaaaggaattggaccctaattatagaaggtgatatgaacagctgttttatcatcctacatgctaccaagctgtaggtgtcccattaagtcctgctatttaagaaatacttacataacccttaggaactcttcaggctttaaaaggcaaggagcaaataattttaggagaccgataatgtcacctaaatttgaaatactaagaagaggttagtgttctcaactatgtgaaatctgtttctcctactttctcaaatctaatcctaggaatcttgcttataaacaaagcatttctgggacaggagtacttcctctattatagcaatgcttcacatcatattgtgctgcagtttccatcatttttaaaggacagagacataaatgataaataatggtatacaaatattacaatctaccacctcaaaaaaacaaatattgtttatggaattcagagtttggagattcaagtattgattgcagttttattttgaaaagaatgctacaatttatgtggtttttatttctcatgtttatattaaaagctaataaactctattttaattaaaa

SEQ ID NO: 2676 - DNA, 2955 bp, Homo sapiens
tgaagatgctgcctcagccccgggggaggggagggaccgctgttcctggaagagggacgcttggctcggaccctgggtttgggggagcccctcaggaccccatttagccacctgggaattgggtagtggcgtgcactgtgcagaggagggtgaaggttggaggagatgacgggcgggcctgcaatgcgctgcgtagggagcctgggcggtgccccacacactcgcccgctagctgcagggcttcaggaaagaggagcacatcgggacttggattcttcccacaggagggcgggttacatccccgtcagagggttgccgcgagggcagataaaatcagacatgaggattcttgccctctggtgggaacccagaaggaggtcagggagggaaggtctcccttcctcttgttgcgggtggttggtctctgcctagatccgcagagggcagaaattagcgatgtctactacagcttcacgcccaggaaacgcgctgtatctgcaccgtccagtagggatggcatcaggcccgtggggtcactgagtcctggaggtgcagacggtgcagccagcttctcatgccattcaactttggataaatttaaatatcaatagctatgtgtgactctcatgctggacagtagatgtagaaagtttccatcatcacagaagactctgctggtcggtgctggtctagagggagcagtcagggtcctggggagtgaagggagatccccacagtggatgtgggaggactcagagccttctctgtccagctcaggactctaactcctcctccttctgattcctccctcccaggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcacatctggcagccccaggcctggtcctgggtgcataggtctctcggacccactctctgccttcacagttgttcaaagctgagtgagggaaacaggacctacgaaaacgtgtcagcgttttctttttaaaatttaattgatcaggattgtacgtattcaaggtgtaaaatgtgataatttgtcgtacacgtacattgtgcaatgacagtcacaatcaattcctcagcgcacccatcaccacgaatacgatacattagatattctgaacttgctcatcttaggacttcacattggtgtcagtgttttctgacaaatcacgtgtatcaggaatgaatgagggaggtgtggctgggtgaaggcagagagccgaccctacaggtccacatctgcacatacatgcacaggaatgcatgctctcacacacatgcatacacacacgcacacacacagacatgcacatacactcacacgccccaggaaatccaaggaatcactgagcctgctgttggttgaggcatttctgagtatccaccctacctgtagggtcagatgtactgattgacacagaaaattaccctatgtaccactaggaggcggcagaatctcatttgggttaatctgtgtttgtctttaaaaaacaaaaacaggccgggcgcggtggctcacgcctgtaatcccagcactttgggaggctgaggtgggcggatcacgaggtcaggagatcgagaccatcctggctaacacggtgaaaccccatctctactaaaaatacaaaaaaattagctgggcgtggtggcgggcacctgtagtcccagctactcgggaggctgaggcaggagaatggcgtgaacccgggaggcggagcttgcagtgagccgaggtggtgccactgcactccagcctgggcgacagagcgagactccgtcaaaaaaaaaaagaaaagaaaagaaagatttttaagaattcagcaaaaactcagccagctctttctatggggcagttgctaatttagttctaggcaaacgtggacacattaaattctcctacaaaccctccacagcgtgctctattattttcctcatttataaaaacagaaactatg

SEQ ID NO: 2677 - DNA, 2199 bp, Homo sapiens
gttttgggggggggacagggttggcaactacaagcaaatactctgagatccctctagccctgatctattgggaatacctaaatcatatgtatgcaagttttaattcttgggtgaggggctgtttcctaactctgctgatttctaactgcccctttcctgtaattgctgggtcaatgcaagttctcagctgcgcattggaaatgccactgctttccatcacagtgatgaatttacatgggaaaaacctgaggccaaagagttctggctcttactcagagccttcctaccagtcacctcccaaagtaaaagaatagtaacatacctgacctgttcttctggcttctctaaagccaaattccagccttggttaggtttctgttcatttggaaaatatctgtatgaaatgtaggtgcatgtcatggagggggcagtggggagtgagtgaagtgagtcagaagggaagaggagagctctctccccctgaccctgccgccgcctgctttcttccagtgagtctagatggatttttgggatctgatgtggctgcataaagacgtgtctctgaaaaagcaaaatgtcagtgttttgaggcctttccgttggggagggagggaacacggtggtcactggttgttctccttaggccagacaggaggaaagggaagtatgtgtgagtctctgataattctcttctttttctttccctcacttttgttcttcaataaatcactcaggacaatctgcttcttcttagtggtgtgttttcctagggttcagcctttgtttgaaattctagaacaacagagttgcagtaaatatggtcaacctacgtgtaattatgctggtatgtcaactttgccccgcagagttgggtctgctctggttaaacagaggcccccctgactcagaaacaagacctcctgcaggaccctgtggagggccgaccccaatccctgtgtctgaagggggtaagacagcccataattacgctcattgtttaggtcggagcacaggagggtttacattaaagacctcagctggcacacacagcatgcctatggaaaaaatgaaccgctctcctccgcccgcttcccggtcccagcgttgcctgtccaagggctttgggtttcacagacgccttctgtgactccacgttctgaccactcctgattagaagcttggcttcccccagttctaagagatgtctcaatccagaggtttggaaattgagcctttcaagaatcacagcgtgtaggtcttgggaaggacctagagatgatgctgtctagatttccccagccttctctttgaacttgaccttcaaccgctggatcttgaaccagaaaacagttgaaaggacatagtggagacagcgtgggatcaagcatgaagactgagctatgtgctgacgaggactttcacctgggagaagagctcattcttcctatcgtttccctgggaagaacatggctgaaacaacttactgtacagaccacagaagtgagaccaaaaacactgagatgaggaagagacttattttgcaactggcttcaaacaatttgaagaaagggtcatggctttcccttcagcagagtttgggatctgaacactgcgttgcccccaaatgtctgcctcttgagagttctccacccagtggtcctgcttgcgtctttggaggacggtagcagtgcgctcagtggaggccacgggtgcctcagagggatttctcttggacctcctgccctaccccagcttcggcgttgcacttggagaaggccctggatatctcagggtaatctaccatccctagccctacagcatactggccctgtgcactagataagaacaatagcagagggttgtggactggtacagacacacactccccagggtcttaatctgccatgccaacccactcactgctgcaattctattaaaagtttggtggggctgggtgcggtggctcatgtctataatctcagcactttgggaggccgaggcaggcagatcacctgaggccaggagtttgagaacagcctggacaacatggtgaaaccctgtctctgctaaaaatacaaaaattagctgggcatggtggcaggcacctgtaatcccagctactcgggaggctgagaaagataatcgcttgaacccggaggcagaggttgcagtgagccgagattgtgccactacactccg

SEQ ID NO: 2678 - DNA, 31432 bp, Homo sapiens
aactaaccttttccaaatttgtcagggaaatgattcaaggcaatctatcggtcttgccactttgtgaaagccactggggaaccaaatgtgctaagagtcctccctgtttccctggaggtgagtgggagcagttccctcacataagagtctcaaacactccggcttcactgtgcccaagaacagcacggtccggggtggtccagtctgatcccaaccggcccacccggggcatccggtggaagtcttcgccggaggatccgaaggcagcatcaacgcggttgtctcttgacactgcacacagcatagcatttaatcttcggatgttctagtcaccacacaaataaagagactgagcatcggagaaactaaacagcttgcctgaggtcttgtagaactgcctggaaaaggaaaagctggaaaaattgtttatccatgggggggaaaaaaaaagaaattggattcttagtcacaccatgccgaaaaattcactccagatggatgaagagctgaaatgtcaaaagcaaactctgagaatttgaaaaggaaatataagtgagtatctttctgagcttgaagtagggaagaatttacaaagatagaaaaaaggacaggcataaaagaaaagatcaataagtttggctacattaatattaaagcctttgtccatcagaagacactttaaagagaagaaagacaatctataaactggaagaagatatctgtaagacattcaactgacaggattagcactagaatatataaaaatagccacaaactagtgaggaaacaactgcagaaaagtgggcacaaggcatgagaagcacggtcaccgcacagaagggaggtgtgtgaggccagtggacatatgcagagatgctcggccacagacaaaggcaaatcatgactatgatgagacatgattctatacctactgcgttggcaaaaattataaaaaacattgataatacaactattgggaaggtgtggagcaacaggatccccagtggttgtacgaccattttggaaaacaagttagtgttctcacttaaagatgatcattctcacttcctatgaccctgcaatttcactcacgaataataagagatcaatacaatagtttccaaaaaaaaaaaactgttcataatagctaaaaagaaagagaaagagggctccaaatccttatccttgggtaaatggacaaatctgcagtatattcacaaaatggaatattgtctaagagaaaatatgagtgaactacagctacgcagaataaaatggatgaatctcagtgatgtaacggtgaatgataaatgcaatccccctcacgccccgcaacacacatacatacacacatggcgggggtgtgtatgagagggagaacaaaaaatagcaagaagatgatcagcacaaacttcagtagaatagctggtactggaagggaatcaggagaactagagaggagaagagcaataggtagatgtaatttattagtaatgttttaattctttggttgagtggtggtttcacagatgtgcattacattttaaacaaacaaaatttctagcacgcctgtaatcccagctactcgggaggctgaggcaggagaatcgcttgaacatgtgaggcagaggttgcagtgagccgagatcgtgccactgcactccagcctggcgacagagagagactcaaaaaaaaaaaaaaaaaaaaaaaaattctagcttttccattgttttaccctgtccaactactaaaggccatttccaatacaatctgcttaagtgagaaggtctctttaagattagctcaaacttactcctgtttcaatgtcttcggtcacatggaagtggagcccctgagtgggacacatgtggtgtaaatgcgtactgcaactcagatgccagacttcagccttgctcggtggctaagggcatttttgcagtctgcttcttagagggttgaaaccagtttattgtagcaactgtttgtgggtggggagagtgtactaggaaactgctgaagcagttacacaccattagtcctgcattttttgccatggccactctcagcaaacatcaagttctcaatgtctaagggaattgcctatattcgtattaacccaatggttacaacaaagagggctggacatggtggctcatgcctataatcccagcactttgggaggccaaggctggcggatcacttgagtccagcagttcaagaccagcctgggtaacatggtgaaaccctgtctctacttaaatacgaagattagccaggcatgcctgtagtcccagatacttggaggggtgaggctggaggattgtttgagcccgggatgtggaggttgcagtgaactgagatcgtgccattgcactccagccaagttgacaaagtgagaccctgtctcaaataaataaataaataaataaaaataaaacaaagaaagagaactatttattggctatttcctctgttagcacagaaaatcctgtcagcattatcctggctttatagataaggacactgagactcataaaaagggactggcccaaggtcccaaagattacatgtgtaggctgggaccccaaccaaagcctacattctttccacgacaccacatgcactggaaggcacccggtttgtgtcatgcagagttaacacaggcatacatctgtctgcaaggaagcagtgtgtccatctctccacccaacagccttgtgcaaacgctggaaggagtccctgtgtgataacctggtgtgttactccacaatcagaagtgatgtgtgccaagagtggcctctgcctacttcacaggcccaaatcctactcctctaatgccagtgtgtgccttaatgtcaaagacgccctctctgacaccctttaagatggcctctccttattcccctcagagcacccaccagcgtgaggccctaaatcaccacattgtcattcaggattgtcaccccaagcctggatgacactaaaggttgctttgtgtttgtttgcttatttaaatatgaatatattaaatacaaaagttttttcatattccataaagtttgatcaagtttaaatttacaacagatggacagcctctccaatttaccagataagagaatggagggttttatcagattttgcaaaagggcaagctttaaaaatctttaaagaaagatattaaaaatcaaggaaaacagaaacacccaaccctaatggtcattatgaacattttcctgtgttcagaaaaatgatctcagatgtatttccccttaacccatctaaggaactaggcagatactaagttggaaacaggaatcagtgatctaacagaaacatggtaaaatgaaggtatttccaacatgcccaaagaagtaaaaatggggaggcaagcccagaaaatgacagccttcctttccaccctctctagtccatccttaccctgctgacatgatccattctattctgttaaacccttcggcatccaagataaagtgcaaacttgctggtacacccaactggtgtaccagcaagtttgcctcaataataacccagctctgtccagccctctcatctcaattctgttttcccacatttagctgttgtcttctgaacaggaccaggtgctctctgagggaagggattatacattattcatttctgtagcacctagggtttatcatagtagttttccaggaattcaacatatgatcataggaagaaacaaaacttcaggccaggcatagtggctcatgcctgtaagccctgcaccttgagaggcccaggtgggaggatcgcttaagcccaggaatttgagaccagcctggacaacatagtgtgacccccatctctacaacataaaacataaaaataaattagctgggtgtggtggtgcacacctatagtcccagctactcagaaggctgaagtgggaggatcacttgagccagcaaggttgaggctgcagtaagccaagactgcaccactatattccagcctgcgcaagagagtaagaccctatctcaaaaaaaaaggaaaataaataagtaaacaaataaatgaatgaatgaataaaaaacagcttttatgtctgctggcagcctgtctccactcaagagaaaaaacaagccagaatgaggatacaaacttatacatttttcagttaaaaatcccatgttgaagcctggtatgtgaaaaaagtgcctggactggaaactggaggccctggctctggctcgaacgggtagttttgcctgggcaggaaacaggccaccgtcactgatagcagaggctaacccacctgcctgctcacacccttgggagccagagcttgggattccttgtccttcatgcttcctttcatatcgtgggtgtttctccaacaaaggctaattatgttttttaaaaagtcctgaggctgaaagagtagaaactagggcagtgaaagagatctgagccccgtaaaggggacagacaaaactagggaagatagtggaggacggcattccttcctctctgctttctcagggcctccatggcagcgcctgacccatgagatgcactcaggaaaggaaaggaaatgaatcaaggaaaggaagcaggctcagagggctatgcttacagagacacagagtgcagaggaacctgggagagccgtgaggtgtttacagacagcttccacagatcccaccgcctggaccctcaccatggtgagggcaggtgctgttatcagtgcttcactgacgaggcagagagaaagttccatcggcacccaactaggatgtagcagaacagggcagagtgtgatcttggttctgttacctagagcaagtcaggccctctactctgctacctccccatccttcccctcaattaaatatggacaggcatgcacactggccactgttcccatgtgtcacttcactttacagttctccaattgaggccacggaagcagcaaagaaaacagtctttacaaactagacatgaaaataatggtgatgtttaattatttaaaacctacccaaacggaagccacaaagtcaaatgggaaaaccacaggctctgaggccacacaggcctgggttagaatcctgcccaaaccttaagttgtgtggggtgagttacctgcctccctggacttctctttccttatccataaaacagacatctccacctaccttacaaagcttttatcacagggcctgagacacagtgggtgcttaattaacaaggttactgctgttaaatcacaaatatataattcagacaaaaagaactttgccaaagccaatataagacattccattgctctgcatattctcaaacaacaataaaaaaaaagaaaccattatttaaaagtctgaactataaatttcaaaattttccgagaccaaaattagttaattgattttctcccaactctcctgaaaccacctgttaaaacattcatctcattcattcatttattatttatttatttttgagacagggtctctcgctctgttccccaggctggagtgcagtggtgcaatcacggctcactgtagcctcgagtttctgggctcaagcaatcctcccacctcagcctcctgagtagctgggactacaggtgcatgctacaacacctggctgatttttgtattttctgtaaagacaaggttttgccatgttgtccaggctgttctcaaactcctgggcacaagcgatccacccatgttggcctctcaaagggctgaaattacaggcatgaaccactgtgcccagccatctcattcaataaacactggcactgggtactgggatgcagcagtgggaagcagagattccctgatcctaagaagcctgcaatctgaaggaagagtaaaggaggcgaaaagactggtagagcaacaccaagtaggcaggtatctaggtgggaaatgataatctcaacatgagcaggggcagcagcaaaggcgacaataaatacaagctattaacaggctgactgagaggtggaagagctactgcttaggctgtaagttcctatggcccaagccaattgcctcagcattgaatgaatgatgtcactaaggaaccctgctttgattagccagcctggtgtttttctttttcttcttcatggtttcaggctgaaaagtcagtcaaaaattattaaagccaccatttactaagtacttactataatgcttgtaaagaactatgctaactactttccaaacaaatacagttgaccctcgaacaatctgtgtttgaactgcatgggtccgcctatatgcagattatttttcaacccaacacatcttgaaaacacagtctctgagggatttgaaacctgcctacacggagggcctctcatacccacacgttctgcaggactgactgggggacctgagtacgtgagaattttggtatactcaggggtcctggaaccagtctctcatggacattaatgaacgcctgtatatttcaatctcacttgttcatttattcatctatccattcattcatgaacaaactatcttctaaaactaggcaactgaggctgagagtgaaatcagagagacaaagcccagtactcaaggagagaaagagagcacagaccatcacccacgggctgagggttagaaaaggagcttgctctggagtttcccatggggaaatgaccacacctggggctcagaaaaatttccctaaggaaaagacactcaggtctttcttgagacttgagggttgggagagcaggtagtgtagaaattctggaggtggggaactgtgatccaggcagaaggaatatgatgaggtgactcatctgagagaggaacacagtctagactaaggatgaatgaccgtaatagtgaatcctaaggaggaagcaggagaagggccggcggtgcagccggaacgatgcgcagaggagcgccacactgaggagttcagtcaggagggccttgtggtcagatctcctcctcctgacaaagattccgggagatcagcaggacgccagggtaataaatatggagagaaagggcggtggcttgttaggatggaagaggtggggacacagagaaactacacagttctccgagtcctagcctgggcagtgcagggttgtgccatctgggaccagggaacaagatagtgggaacacaggaatggggtagatggtggctttgaagtacctgggaaacatcggtggaaatgtgggatgggcagagagaatacatttgggaatcactggcatgaaggtggtgtgagccctgagaaagaatggaattgctgaggagaaggtgcagagtaaacacagaagcctccagactgaacttaggagcaccggcctttaatcctcgtatggatggggagggcagtcatgaaagcctgggaagctgtggcctgaaaaggagaagggcaaacctagggatttaagaaaacattgcttcaaggaggaagaagaggccaggcatggtggctcatgcccgtagtcgccagcactttgggaggacaaggcgagaggatcactcgagttcacgggtttgaggccagcctaggcaacacatacccctcaatgtccactaaaaaaaaaaattagctaggcatggtggtgcgcacctgtagtcccagctactcaggaggatcgtgagcccaggagtttgaggctgtagtgagctatgaccacaccactgcattccacattccagcctggaccacagaacaagactctgtctccaaaaaacagaggtcagagtactgagcactcaggcaaggtgagaagactgcctggtgggtgtggcaaaggggtcagagggtcttcagtaagaacaggctctgtggtgtggggaccacagcgagaggagagtgagcgaggaaccacggtaagggtggtgactgcagacgcctcgaattccgaaaaggaaggaaagatttgggagaagaggcgagctggggttgtgggagttcttttgaacaggtggaaggaattctgcccatgggtgggcatggataaaatgtagcacaaggcccctgagaagggacttggagcacatggtggggacacatgtctgacagaggcacagaaggagggaggtgtgtgcgcggacagctttgtgaatctgggggcaggaagtcgcacctggaagttcactgtttcctctgaagaggggtcgaggtcaggggaggggagggatcttcccaaaagcaccagggctggaacctgggaagacaggaagagcagaagaggccatggagctggtacctgataaggtccctgccagagatgtgaccttccaactagtgctaacaatctgcccaatgctcttttcctcctcaaaaccaccccacaaagtgggtaacaattctccttccatggccaggcaaacaggggccgagagaggttgagtggcctgctgaagatggcgattctgacagcagggctggggtgtgaagcccgagctccctgaccctgacgcatgcttctgatgacaactttaacctgcccctcaaagcagtcaacaaagcctctgcgctcacacccagcccaacacaaaaaagggctttcccaagtgctgacacagcagcttaaaaagtgggtagtgaagtgcagaaggtaagaaggaatttatgatggcatcaagtagaagcagatgggagtttggcaaaaagtttagaactattacttaaagaaaaaaaaagaagaaacccttctttttttaaaagatgaaacacaacttaaaatagacttgggaagcaattccatacttaacagtcttgaggaagttgacagacagctgaaagacctaagcaatttacaacattcttcacacttcatggcagaaaattaagattgatgtctcaactacacaagaataatttaaggtaaaatcaaagatctgctagatcatgtgaaatggcagatcctaaacgtcaagaactctgaataaattccactccagggaagactaaatagtacacggcttagttaatactatatctttaaggtctgcttattacatattacaaagaagtacaaacagataccaatcatggtttatagggaggttactaagcaccaggttctctactatctctaatcctaatacattattctatatcctaaaacattaatctattttcttccatctttaatcctacccctgtaaagcagtcttattttgaatacgacagaacagtgcctgagacatgttaaaataacttgcctgatgtcaccgtgctggactgccgtgcacagccagtatttaacccgttgttgacgccccttcccctgcctgagggattcccaatttaatgccagcatacagcctgcaataggttttaaattgcaacagtatcactaaacaatacctacttttactacatgaaacccactctcatacgtccttttcttcgactttctcccctcttttttttaaatgctggtatctaccagcattgatttcctgacccactaaacaagccctgcctgacctgaactctataacacaacacagctcattgacacccaccattcaaaacagcatttctatgtgacaatgtgctttgtgttctaaaaggttaatcaacaaaagaacgtttaggacacaatctcttcacagcctgcgtgtaactgaagcactggctggaggtagtggctgcatctacagattcaagttgggtcctttcacctggactagttctcaggaacttcagatgccaggtacaaatatatacctaataggcacacacaccacctgcatcaagacaacacttttggacctagctaactttggcaacttgttgggctgtttatgaagtattaaatctgccacaacattagtgatacggtgataaagcacagtgctccatgtttcttctacttcccatagccacatacgcaaacagcctgacagagcagcacatattttaaggcttacaggtttcagtggttgaaaagcttagtctgtttgtgtataagctaatataggagctgctgggctgcactatttacactttcattaagggctgcactatttacactttcattaactgtgtctctgtggatgttttgaagtggttttcatctgataaaagaatttactggccgggtgcggtggctcacacctgtaaccccagtactttgggaggccaaggcaggtggatcacaaggacatgagagcaagagaccatcctggccaacatgatgaaaccctgtttctactaaaaatacagaaatgagctgggtgtggtggcatgtgcctgtaatcccagctactcagaaggctgaggcaggagaatggcttgaaccagggagtcggaggttgcagtgagccaagatggtgccactgcactccagcctggcaatagagagagactccatctcaaaaaaaaaaaaaaaaaaaaagaatttacttatacctcatgactcagcttattcattaacccagtgaaaccccggaggagaggaggggaactggagagagaaagagaatgatgggcagccaggcagagctgagctagctcacctgcgaggtgagtcatggcccctgggagggagggtgtctgtcaccaaaagcagcctctcccaacctattagagagtcacagaaattccgtatcaatagtaaatgggacaattttgtctctggttccctttaaccgtcccttgccatgctcctagcattggaagcactcagcactttcctgatggtgccaggatgctgcgctatgaacatgagtcctcttcctaggcctgcctctcacctcttcccacctgctagccctgcaatccacctacagatgcagagcagctccaggacacatcatacacgatctgtcaccaccaagaaggtttgaaaaaatgccaacaccacctccttgaacaccaggccagctcctccgtgccttcatggagccctgtgcctgtgcttcccatcctctgtggagagagaacagtttattttaaaggaagggaatgaaatcctctctccagactatgggttgccttgggacgatgaaatttacttgttgtaactggcaatatttgacttcgaaaaagagttacacttctccaaaagggaaatggataaagaatgaggatgttatttttattttccacatcaattttacgctttgccttgatgagatgatgtgctcaatgactaatttatttcattggtgagttctgtctagaccctacacgctgaaaccctgaaggtcaccaaatgtccccaaatggtggcgcaaatctgagtaagaattgttttgattttgaagtcccatcctgcctgggcatttaacacaatgattctacacttgtattgttgtttctgcttttaaatgaccacatcacttccttgtggatttgggatcttaggaggactattccagctctttattttctttttccttaagtaagctgcttccctgttacgggggctgttgctgctgacaccagacctaaagacagcattcaggtctgaactggagcaggttaggctgctaggagaggaagcatgctgagtgacattactcttgagtctaacacaggtaatacagggggatgggagaaggagaaagtagggagagggagagagcgggacagagagaggaagtggaaggagacagtgagcctgcaggggaatcagggagagcgaacttttcccatttgctgaggaactgcttttattaatagaaggtggcaactcccaaaattcaaagaagtaacaagttcttcaccactcctggacattaaaaggatctgtgaaattctttgccagcaggagaatacgatttttaaaaaagtgatattgacattgttcagctttccagactcaagtcattaaatctctaaattgttctaaatattcattttgctttctacattctaaaagtgtagagcttttttgtctatttaaacattcattgtaaaaaccaactggttagataaaaaagtcaagccaaaagagagaaatgtaaaaaactaaaacaagccaggtgcagtggcacgtgcctgtaatcccagctactcaggaggaggaggcaggaggatcacttgagcccaggagttcaagtccagcctgggaaacaaagggaaccctgtctccaaaaaatgttttaaataaaaacaatattaatacaatggcaagtgtgatattatcacatgccaaagtatttttgaatattttataacattgtattttaaaattctcaatgacctgagagtttcctacaatgtcaaaatactcaacacaaattaggaaactgaaaaacaacttctgaaagtcaggtatacagagagaagaacacagaatgctttttttcattctttgttttttgagacagtctcactctgtcactcaggctggagtgtagtagcacaaccacggttcactgcagcctcaacttcccaggctcaagcaatcctcccacctcagcctctcaaggaactgggactacaggagcttgccaccatgtccgggtaatttaaaaattttttttgtagaggtgggatcttgctacattgccagggctggtcttgaactcctgggcttaaggaattctcctgcctcagcctcccaaagtgctgggattacaggcatgagctgctgtgcccaggctagaatggtttctgtaaactttatcttttactttttttgttttgttttgtttttttaagacagggtctcactatgttacccaggctggagtgcagtggctattcacaggtgtgaccatagctcactggagcctcaaactcctggactcaagcaaccctcccgagcagccagggctataggcacgtgccaccaagcctgcctacacttgtggattttataaagtactctctacatttctttccctagaaaaaaatattaccaccctttagattctaattctaaagtgctacatctaatacctctaacataagtaaagtctcattttaaagcatgtccaatgaataaatttgcttctactgcctttgcatatgctaagattttgatggaggaaaaaaaaagtacctgaaagcagctttcatggaacccagctataaagctccacaaaccccatttttccagtgagctcacagatagtaccctgtgccctatgtcagcttagggcagcagttagaggcctttaccaacagaaaagaaaaagcctagcttgcttctaaggctacatacatccagatctgttccaccaaaatcaaatctgtggcaaggaggtccatggctacagattcttctgctatgaggcacccagggaaatagtccagaggtctgaattgcaaacaaaataattttaactaatataaaaaagaccatctgttcagtaactaattcccttgaggacatgatatggaagtcaactatccagcttccacctttacatagtatataaatgagaagagaaaagcgagcaggttgggtgcagtggctcacgtctgtatcttaacacttttggattatttgagcctgcccaggagttagagaccagcctgggcaaaacagtaaaaccccatctttacaaaaaaaaacaaaaaacaaacaaaaaaacaataataataataataataataataataattagtctggagtggtggtgtgcgcctatagtcccagctacttgggacgctgaggtgggaggatcacttgattgcgccactgcactccagcctgggacaaagcaagactgtccaaaaaaaaaaaaaaaaaaaaaaaaacagaaagaaaaagagaatgaatgttaaaatgtaggcagaggcatgaaaaatagaaaagaaagtcagcttgcagagccaagtttatatcttaccccaccctgatgtggttggccaacagctgatagagggcttttcggtaaagtaggtagaaacaaaccccaccaaccctcaggttaccaggcaatgtgccaccatgttattaaagccatcatggtgagagttcctgggcaggcagcccgctggaatgctgagtcatctgttcccccgctcacagctggccctcctccccagcacatgctctgcccacaagcacactctttggggaatgcattaggaagcagctacctgaatgtatcctgaaaatcacagacaaggcactaaacacacacccattggagcctgttctgtcacaactcaagccagagtgcaggcataaatcactgccgtttctggaaagagcacaggcacaccttgcactcagctctctagaggccttagctaaatgctgtttagattatttttaaaaaatgtggttttgactggttcaggatttaaaagagttaacaaacatcatatgagcagaaggcacaatggaatgagtgtgtacactctggggtagacagctctactactggaaggccacatgcctctctgggcaactgttttcttatctttgaactgagatgctttccacagttggcttcagggaaagcatctaagactggagtcacaacagagtattcacgcatggggcaaggggtggggacgctaaagctgaactttgcctttagttaaaattacccttgaaacttctttcttcacactggagaacatgcgtctctcagtgaagccaacacagctggtttttcctccagggtcagaacacactactgtttctcctctaggacatcagaggaagacgatggcttgcatgtgagcaccatgttattaaacacacatgtacacacatgtgtgaacacacatggtttataaccagcaggaagcttgctacaagaagagtgtgaaagttgatattcacaaggaaggggcagaatctacatctcccatttcatctccaactcactgggataaggataaatacttttgctgagtgaagtgacaagcaaaaccagtctcacaccctaaaaaataattagccacatcaagtacatttgaattcacacaagtttcaaaatgttatgatgtaactctacttggtacctagcaaatatacgatctaagcctctgtgcctgtcctctggtcacatgtacccaagctagttctctgaagacaaggaaggtgttttagctattctatacctccagtgatatttcttcaggagagaacagctaatacagctacttctctctgcttccgaacagccctgggcttgcaattactacaagccactgaagaaccacggcttaacttcttagggcatggattttaccagagatcagggaggaaaaattaaataattaatctggcaatttaaaacaaattaatattaaagtaaaatggacatattgcagaatagcatttttttaaattgtgagaatggtttaaataaaacataagacggtagagatatttcaccttctgcccccctcaccccgctgcgcccctgagtgctcctatccacgctgctttggtgttgtttgagaagaacctccccccacagaggcactgatactagctgaatggattctcctttctggggaatgagaacaccagaaaggaaaagagacttccaccttctcttcttggcagcaaggaggtgaatgtaatgtccacatgagggtagtttatacatgtcaatttgtattctaggtgcacaaacaacactcagagagctgtaaggagttctctgtggttagaagcaattctgaaaagagctgactcatatgagaaaagcgtaatgcagtatctatttcttttagcaaaggtgatagaaacgcacgtatcatgaatatgtcatgcaaggaaagatgagggcagcctaagctgagaaggtgttcaaataaatttcctgtttgaaagggattatgatactgctcttttccctacctacctgtggacacaacagaaaggtgggaatcctgtcctataaattcaggttctggccctcatttgccctacaagtatttcttagccaaggtgaagtggtcacccgtgcatctaccaaaatggtctggaccactgactgggcaggttttgagaagcatggtcacctgcctcagggtggtagctatcatttcctgagattatatcacaggtagtacacgctgccaatgctgtaggctctgttaccctcactttatacagaaaactgaagaccctgttgaatggcttgtccatagtcttgcagctggtataaggagaactggaatacaaattcaagatgtttcaatcatacaatgctgcaaggagctgatgtcaaggaagatacaaagtaatgaccacctactctgctagcagatggtggtaaattgttcttagaagcagtgaaccaagggcatgatatcaacagtccttgtgtgtgccttcttcagcagagaggtctactgactgtcagtgagtgttctgtctaaacgagaaggggcttagagaggatcatatcctttgacctagtaattcctcttttaggaaatcatcctatgaaaacaatctgaaatgaggactaatttttaatgcacaaggatacgtaaatttttaaattaaaaatgtcttcaaaacacaaacaaatgtttaatagtaggagaatagttaaataattatgctattcatattcattaaaaattatgtgaggttgagggaggccggcacggtggctcacacctgtaatcccagcacttttggcgaccgaggtgggtgaatcacgaggtcaggagttggagatcagcctggccaacatggtgaaaccctgtctctaataaaaatacaaaaaattatccgggcatggtggcatgagcctgtaatcccagctactcgggaggctgaggcaggaaaatagcttgaacccaggaggcggaggttgcagtgagcagagattgcgccattgcactccagcctgggtgacagagcaagactccgtctcaaaaaataaataaataaaataaataaaaattacgtgagggagaaagtagggagaggggagaaaaaatacgctttcaaagcaataataaccaaacaaaatataatcaataaattctctggctagctatttgggaaaaagtaacatgaatgcctctctcataggttataccattgactcaatcaacaaatatttgctgatcacctattttaagcattgagaaaaacttagaataaaaaaatctttgccctcctaagacaattcgttaagcagtacagtttcatatgggtattttcctatatgtatgttaagcctccatttaaaagttaaaataaaaagcctgacttcatggatcttacattctagtggtgagatatagacactaaacaaaaaagtaaaatatacagtgtacgtgcagtgctatggagaaaacaaaaagcaggcagtactgagatgtgggttgtgattttaaattaagtggtcagggaaagtcttactgataaagttaccacataacaatgcaagatgccaaatttcagataaattacatatcactgtttagtatatcatacaatatttggcacacagctattttaagtgaaatctggcaatcttacttactgaaaggcaagtgaacaaacctcattcctaataaattaaatgttaatgcttctgaataggacactaaagccagaaactataaaagaataaactgacagatatactatggaaaatgtaaagctttggttcggcaacataggctagattaagaatagctgggcacagtggcgcacgcctgtagtcccagctcctccagaggctgaggtgggaggacctcgagcccaggagttaaaggctgaagctggagggtgctataatcacacctgtgaatactgggtaacaaagcaagatctcgtctcttaaaacacacacacacacacacacacatacacacacaaaactgtacaacaaattgggacaagtatttgcaaaatacaaaactcaggattaatctaagcatcattttctcctataaaatgaggggagggggaagatacctgtggttcatacaattataaggatttcagaaccatgtcttgtacctaataaccaatggttcattaaatgtaataaataataatcatgatgtaggtgtacttataaatcagcaagaaaagcacacaattcacaaaataatatcaaccaattaaacttctgaaaataattctagtgtcagctttggcaacatgtgaactaaaatttgaatgacatccttgcacaaagaggtcacaaaattttaaaagcaatccattttttaaaaaaatcatcaatggacattaatgctgctggatgaaagattactgaggaacagggtttcacagtctcaaagtattactcacagagtacttatttattacaaagcaggaaggctacaatggaaaaatctgtgaccactatttacctaaatgatgtcaaaccagacatcagcaataagggaacaaactgataccatgtgcctctcagtgtgatgcactgaaaagagcacatcaactacgtggtactcccgccagaaacatttaatctgaatcttatcatgagacaatcagaaacatacacattgaaggacactgtaaaacaactgatctgaactcctcagaaaaatgtcaatcttgtgaaaataagaaacaggctggggaactattccagattaaaggagactaaagactaaagagccatgatgactaaaagtaacacaagactttgactggagcttggatccaaaaataaaaatagaaaaactgtaagggacattattaggacatttggggaaatttgattacagcatggacattagatcatatcaaaatcatatcagtgttaaatttcctgagtgtgataaatatattagggcaatatttttaaaaagcctgtgttcttaagagaaatacactaaaatacttctaagcaaactgttatgtctctgactctcaagtagtttagcaataaaaaacaaatacatgtatacatgttcacatatgtacatattatgcttgtgtatatatgtgtgtgtctgcagagagggagacagagcaaatatgatagaatgttgccaacttgtctataggtttgaaatttttcagaatcaaaagtgaagctgaatgcagtggcacgagcctttagttccagctacttgagaggctgaggcaggaggactgcctgagcccaggagttcaagtccagcttggccaatatagtgagatctcactgcctttaaaaaaagaaaaagagtgggagaaaatattaataaaaaataaaatgcatgaggtctaactccaaaaacaaacaaaaaaggaaagaaaatgcattctctctcagtagtaatcaaagaaatgccagtaagaatggttttgaaaaagacttaatgttggagaagcgtaactaatataaccttttttagagggtgatctgacaatctataagaaattctgggccaggcgtggtggctcatgcctataatcccagcactttgggaggccgaggcaggcggatcacctaaggtcaggagttcgagaccagcctgaccaacatggagaaaccccatctctactaaaaatacaaaattagctgggcgtggtggtgcatgcctgtaatcccagctactcgggaggctgaggcaggagaatcacttgaacctgggaggtggaggttgcggtgagctgagatggtgccactgcactccagcatgggcaacaagagggaaattcggtctcaaaaaaaaaaaagaagaaattctgattctgaaactttgttgaaaccagctctctgactctatcatgtaatcaacagaggccaagtgaaggccaggcgtggtggctcacacctgtaatcccagcattttgggaggccaaggtgggtgcatagcttgggcccaggagtatgagaccgacctggccaacatggcaaaaccgtctctattaaaaatacaaaaaaggcatggtggtgtgtgtctgtagtcccagctactcgggaggctgaggcgcaagaatcacttgaacctgggaggcagagattgcagtgagccaagattgcaccactgcactccagcctgggtgacagggggaaaaaaaaaagaggccaagtgaaattctagagacttttaatttcccatttgcagctctttctttcatacgaaattcctacgcccaaagaggtttgagagtaataaaaattgtagtaaaaatacaaaataaatgaaagatcctataataagaatactattgagtaaataaattatggcatatcaacttgatggcttatctaatgcagtcagttaaaatttaaaatgatttcacagagtttaaacaacctgagaacatttctcaactgttaatgagaaaagcaaatcttcaagtccatctatagtatgattacacctacataaaataatgaaaatgatactgtaagaaaatatgccagaatgttatcataattatttctgggtgattatgtttcattattgtgtgttttccaaattttctgtcataaatatgtacctgttttatttttataaatactttttatcctaaagtggcaggtcaatagacaaataacataggcaggcaggcaggcaggcagatagatagatagatagatacatggatagatacatagataagacagacaaataggcaggctgggcatggtgcctcacatctgtaatcccagcactttgagatgccaaggtagggggattgcttgaggccaggaattgaagaccagcctgggcagtagagtgagaccccctcatctctacaccataaaaaataatagtagcaaaataaattttttaaaaaataaataaaaataaaagataaaacgtgtagcattcctggactcagaacataatataagatttttgttattatagtgacctgatttagaggatctaaaaagtgagtgtggggaaatgcaggctcacattcccatagtgagacactctgtaataaccagagagaatttataaaaacgaaactttaaaataactataggcttaaggctaacagatatatcaaaaatatagaaatccctataatttctgaatgtatgcaaatcaacattgtaggctgacaatttccaacatttgatagaattttaaaattattcaatgttgtatgtggaaacttgaaaaaaaaaaaagataatttaaaaattattctcagggggcggggcatggtggctaacgcctataatcccagcactttgagaggctgatgtgggaggatcacttgaggccaggagttcaagactagcctgggcaacacagcaagacccagtctcttaatttaaaatatatatatatatataattcaaagtaagtggttctgagaataataaaattatcctgagaatccagaaggtaaaaaaattttttaaaaggtaaaatttccaaagaagcaattaaattataaataaataaaattattctgaaataattaaaataactcaggtgacgtcacccactgagactgactcttaagaaagacgcccctttgcaatgagaaaggtatctctctcctacaaggttacagtaggtaagatgtttttggcttatggtaaacagcttgtttgagaagttgcctaagaaaagtataaaccccgtgtcagctgtttgttagacttactcatcagcccctgatgtggcatccagacaccacctacccacccatagataatctcttggcaacatcaccactaagctggccctgctggctcacagaaagaacaaacagcgcacttaggagctactgagctggaggtgaagagaagggaaagaaatggggctttatttaacaagtgtgacttactgcatgattatttagtgattttttctttggctaacagtttattttaaatttttattgaaatggtaaagcagtttaataactaatcctttttcatgtgaaaggacctttggaagatgcaaattttaagccctaaaccccatccatcacataagatagataacaaattatgaagatcaattctcatcaacattcaaagtctacccaccaatattaaactctaacagttggtcaaatccaccaatttctaagagcacttgaaagatacttttatttacatattaactgcactaaacaagtactggggcaaagtgtaaaacttgcttcatataatcagtacatcctcaacccctggaaagctttccatgtttttctattcttcaaggaatacatctttggcactgaatttcttttagtagaaaaggaagataatgggtaagtgtccttgttattgctttggatccctcagaaatgggtttcgcaactcaccagagttggaaaacaaaaatgtgagggcctggttgattctaacatactcctaacaattatctttcggtggagaggactaaatcctcacccagagcaaacaaacaaaaacaccccaacagaacaatggcaaaaacaactggtaggatgttcccgttgagaaggattcccggatcacctaaagattcctcctgtcctctactgggtgttgctgccagggcatttcaggcatctttgcagcccgagactctcctcaaaggaaagaacagcaaaggctgggggaatatgttcatttgtgaagaaaaggaaaatgtcagggtcgttttcaaagcatggggtgattagttttgccaaaaaataagtcaacaaaaactgcagaaaaactgagtaaagctacatattctcctaactgtaaactgccatcaaggtggctcttttaatcattacatataaaatatccaatgtacccagtactgttatttttctatcattttggcgaattctagtgggaaaaaaatgaagaatggggaagctataaacttaggaataattaagtgcctacactgaaccacaaattatataggactttgtaaaaatttgtttaatccacaagtatggaagaaaaattaatctttatgatttaaaaaagaaaaaaactcagagactcaaagagaaagaaaataattacttagttaaaacaacaaataaggaaacccaaacttttagctggacttagtttcttaatctacccttctgcttttttgaagtccatgccagagaagtgtgttttgagcctagatctccatgctccagtcctcggctgccaacagcatgaggcccaggacagaagtcctgccacccccatctatgtgacatggtgttttgactttgccatgcaggcaatgcttatcacctagccaaacttactcttctgttacgctaaaccaggagggggaaagacaaggcaaaggaagaaaagacatctataaaaacagcagaaaatgtttctgaggcaatttttcttttcagaaaaaaactgagccacagaggaaaaaatattcaccaatgtcaaaagttctgaatgccacccaactataggattgctcaatcaaggtagtttctggatcatttctccttttaaagagccccatgaatacacaaaatcagatcaaaagttcttattcttccactatcacatctatgaaattatttcctttaaattatacattagtcttcccttgttaaaaaaatgtaagaaataaaaattaaaaactcactgctagcttaaagccttaagcactagcttgtttacctccatgagttgacacagggtgatgagtccaaggtctcattatcttttaaaggtcaaggatgagatagcttggcttgttcgatgaacacaaggctataccctcaacaccctgctcagaaatgaatgccactgtttgttcacaaaggacagggaaagagcgtctagacagattaacacaaatccattcccactgctgagaaaccccaaaccacatcctatttgatggctcattaaaaaaaaaaaattacttgggaagtgttcaggcagcagataaattcctacactagtcagaaagaacagctaatcaacaatacatcacacataatataagcttgactcaatgagctcaaatcatgacaaaaatatgagactgagacatacggttcttctctgcctcctaaattattgggtgtagcagtttcaagcagagatccatgtatacccgaaaggttaaatgcatccactatgttatggtatgttatgttatgttatgttatattttagacacagggtctcaccatctcacccagtctggagtagagtggcacgatcttcacttactgcagcctcgaactcctggcctcaagcaatcctcctgcctcagcctcccaagtagctgggactatgggtgtgtgccaccatgctcagctaatttttaaaatttctttgtagagatgaaggtctttctgtgttacctacgctggtcttgaactgtcctcagtctcagcctcccaaagcactgggattataggtgtgagtcaccaggcctggacattaaatacatctataacctacttcacaagtaattctgaaaagtctctagggtctaaaaataaagtgatttttttccttccttctggaagacataagttaaaaaggcattgtgtacaaaagtcagtatgacaaagaatttaatcttccactgtgtagctaagaattaccatttagttgagaactccttgacttgtcatgactgtgctaagtgttgtattaataatcgtcctggccgggcgtggtagttcacgcctgtaatcccaacattttgggaggctgaggcaggcagattgcttgaggtcaggagtttgagaccagcctagtgaacatgctgaaaccctgtctctactaaaaatacaaaaaattagctgggtgtggtggtgcacgcctgtagtcccgaggctgaggcacgagaattgtttgagcctgggacgtggaggttgcagtgagccaagatcacaccactgcacttcagcctgggcaacagagtgagactctctcaaaaaaagaaaaaaatcatctcacccaacctgatccatcctgtgaggtctgctctaaagacacctgggggaatggtgtgtctatgaggaggaggctcactgtcttgctccagatgtgcatgcaaagtattacttcagcttcgttttactcaggaggacacctgggctcagaaacctttgataagaaatcaagggtgggaccccagaaatccaagtgggaccttatgggactccaaaaatggagttctttccactctgccttattgcctctgatatgtttatccatacgtttctacagaatttgaccgttcaggtaaaatcagcaataaaagcaagcactcttcttgcacatttttaagcggtttttgttgtggtttttattttttaatcttacagctcaaataaatgtttctctaccagaagcacttaagaaatattatcattatttttgagatggagtctcgctctgtcacccaaactggagtgcagtggcgtgatcttggctcactgttgcaacctttacctccaggattcaagcgattctcgtacctcagcctcctgagtagctgggattacaggtgcgtgccaccacacctgactagtttttgtatttttagtagagacggggtttcaccatgttggccaggctggtctccaactcctgacctcaagtgatctgcccgcctcggcctcccaaagtgctgggattacaggcatgagccactgcgcctggccaaaaatattttcaaaacttcagcaaataaagtataattatcaaaaacaaaatcattaacgtaatataaactgctcatatataatacaaacatgaactatttactatatatattcattttacctgagctatgctttgttctctcaaaccattttgaagccatggcccatggattctaccagtaatgattagcgtttcgtgctgggagtcctataaaatcctgtcttcattacacataatgtaccatactttatgagttctggcccaacaggttaccttatggctaagaactggagctactttttagatagttcactaagagcaaaatctgtaactgggccagaaggctctgcacatggcctacctgtcttccagcttcctgctccctcccctgcccgcacaatactgcttggcactggccttctgccactcctggaacctgtcggcccttctccctgttgtggctgagcctttagaaaaggcgcttcatcatcgtggagcattcctgccactgtcacaaagctctcactgaccattctttcacttcttggagcaaaactctctttcttagagaagcctccctgactgccgcagacgaggtccgtttaccctgttctgccctctcaaagcactttctaccctttactggactaatttctgtctctcccactagactgcaaactccatgagggcagggcatctgttttgttcaccacagtatcctcagtaccaggtcagtgcccggcacacatgcattaattcaacaaacatttgagcactagtgcacataagggattgttgtaggcacaggggacatatcatgaacctcagattctagtcaaggaaacaagacaatggtgggggtatggacaaaaggaaacaatcagtgcttcagaaaaccagatagcaaggaaggggggatataagagtcactttatttatttaatttaatgtaatgtcattaattaatttatttttttgagatggagttttgctctgtcacccaggctggagtgcagaggcacaatctcggctcactgcaacctctgcctcccaggttcacaccattctcctgcctcagcctcctgagtagctgggactacaggtgcccaccaccatgcctggctagttttttttgtatttttagtagagacagggtttcaccgtgttagccaggatgatctcgatctcctgacctcatgatccacccgcctcagcctcccaaagtgctgggattacaggcatgagccaccacgcctggccaagagtcactttaaatgcagttgaaggcacaacatcattaagaaattctgaacaatcatttgatggaggtgaggtgagggagactgaatcactaaatatctgaggaaagatatttcctcagaaatatgccatacttgtaatataaaataccatacttaaaatatgccatattttatgagttctggcccaaaaggttaccttatggctatgaactggagtaactttttagatagttcactaagagcaaaatctgtaattcggccagaaggccctgtagcacgtggccagcttgtcttccagcttcccaagggagaagggaggaagcagtgagtgaaaaggccacctgaggacctgtggagtatggtctggaataagcaagcatatagcagacactccatggcataaataaggctgcacggggaagctacgttaaatcaagctgttaattatcacagatgccaaggtgaagctaagtttccatcatgtaacttctctgtggggagtaacacagtatgtggcccaaagaacaaacatctttacgaatcaacacttgcctgttccttattgttccctcaaccaaacttgccgttgtcactgtgtcactgtgctggttactcatttcttcaccaaattccagaacatatacttgtttttgtctcttactgatcagcctttgagatgggatcttgctatattgcccaggctggacttgaactcctgggctccacaatcctcctgcctcaatctcctgagtagctgggactataagcttgtgccaccactcctggctgctaactttttttaaacagatgtcccgaatataaacatgaattccacctcaggtagcaaattctacagtatattttgttgcagttttactggtttcactggcctaacaactgaccttaaacatatgtagatggaaatattttattgtcaatttaatgtttcctcagagattttagcagtaaaaagaaaggaaaacagccactagaggtaagtgaagaggactgcatttaaatcccataaagcagtggcagaaaaaattctccctacggccaatgaatgcatgacagaaggacacgcctaaaaaagagatgaaaagctgtacctaatattttgaaatcaactaaaagatttaagataataatatatgaaagaacattaaggctaggcatggtggcttgtacccataatcctagctactcgagaggctgaggcagggggattatttgagcccagggattcaaggccagcctgggcaatacagcaagaccctgtgtcttaattttttttttttttaaattagccaggcatactggcgcacatctgtagtcctagctactcaggaggctgaagcaggaggattgcttgaggccaggagattgaggctgcagtgagctatgatagcaccaatgcactccagcctaggttaacagatagatactcgactaaaaataaataagtaaattgatagatagacagacaaacagaatgaacattaaatcagaattaggaaatctcagaaatgaggtcacagtactcaagaaaacattaacactcaaaaaaaattagatataaaaaggaaaattgttttatgagggccaaattagaaaaaatacaagaataaaaaaacacaacttgccttaagagaaacagataattaaaagataaaaaattttaaaaccaaaaaagaattaaattagataattagaaattaaataaattaaaaatgacttgaaagaaagtgacacagatgatgggcaaagatccaaatagctataatagaagttttcatagacaaaaacaaaagcaagggaacagaacaacgctgaaaattacaactcaagaaaactttgctcagataaccaaaaaaggctcaatattgcatgctgaaaggctataccgcatacatctgcgaaaacggatccaaaacaactagtcaaaatatacatttcagtaaaactaggagacttaaaaaaaaattcagcgcatctggtcaaaaagagtaagtcaagaaaaaaaagtcagattgccatcacactttgagagaagcatttcaagccaaaataaaatggaacatatttaagattctcaaagaaagaacatttgaatcaagggttctttcatatataattttacacctagctgagcctactttcaagtacaaaggcttctgacaaactaacattcaagaactcagggagcacttttcccatgactcttccaaaaaaatgtagtagatgaccaaactcatggaacaaacatcatcgtaggaactgagagtgagaattaaatgtacacttacctgtaaaacagagactaaatgatggttataagcgttagcatagagtatacaatggctatttgctctgacaatgtaaatatggtataattattttaaaaagaaaaggacagaatgaagagggcacacaagaaggtagaataagagtgctgacttccttacagctaataaagggtatttttctaaatcagacacagaagagggaaggcagggaaaataagagattatagctaatttcaatattggtcatagtagggtaccaatagacaatgactaaaaagagacaagactgaagtactgtataacgttatttgtggcagactgtaaaatggcaaaaaaaatccttcctttttatgcatgccccttgcaatgtgacttttctgctcctgccatcaagaggtgcggtgtatttactgctccccttgaatttaagattggcatgagacctgctttggctgaaggtatattaacaagcataatgcaaactgaggcttgcagggtagcttgtgctgtcttgctgctgggaaccctttggtcaccatgtggacaagctggactagccatctacaggatgaggggccacatggggagaggctcccactgtcccagtaatcccagctgagacaccagaagtgtgactgacgtcatccaatcccagccagtctggcctagaccagaactgcctaggcaacctatggaattatgggaaacaggtaagtattgttttaaaccattatgtgttcaaaaaatgaggtttagaacgaggaggacatctgaaaaatagaatatgcttgacgactgccttataagtgaagagcccatatgcttatatgctaaaaaacagaatatgcctgaagattgccttataagtcaacagaaaataaaaggttattttttctttttttgagacagagttttgctcttgttgcccaggctagagtgcagtggcaaaatcttggctcattgcaacctctacctcccaggttcaagtgactctcgtaccttggcttcctgagtagctgggattacaggtgtgcgccaccacacccagctaatttttttgtatttttcatagtgatggggttggccaggctggtctcaaactcctggcctcaagtgatccacttcggcctcccaaagtgctgagattacaggcatgagccaccatgcctggccaaaaggatatattttcaaaccagatgttgagggggtgttatctaatttcaatattcctattagaaaaataatcgataatgaaaaacatggggagtggctatggtattacataatggcatatgtagcccttagaacaaaaatttaatttgctcttttttaaaaaaccctcaaaaataataaaaataatacaaattaaaagagatagagaataaataaaacagaccacagagaaagactacttcatatacccaggaggtcgaggctgcagtgagctgagatcacaccactacactccagcctaggcaacagagtaagaccctgtctcaaaaaaaaaaaaaaaaaaaaaaaaagactactcatattaaagaattgcatacatacatatgtaatatgaaacaatgacagagccaaggccaaacatattggctataccaatacatttaaatgggcttaatttatgtgttaaaatttaaaaaaaaaaattcagattggctagcaaagcaaaatcccacactatgccatattactactgtcgtactactatgcagtaatctcctgaatggcttgtaaaataaaaaaagcaaagtagaaaaaagtaaatatagcagattacaatttacctaagaaacagaagaatataaatatgtatacttatgtttttatgttaagaaaaacaatggaaggatgaagcaaaacaaaaattacttttaaatagttactcattaaggtggggagagaacaggatggaggagacaggaattaaaatctagacttttttcaatatagtacaccttgtcttttaaatttgactttggaactacgacaatattttaaataattacagaacagttatatttttaaaagtgatctctaagaaatgaaaataaaagaaaacaaatgaacccaatgtctccaactgggggcataagctcacagacagggaatgttccagaagctatcagactgtgcacccctagagatacactaaggtggaaagaactgcaaaagacaaatcttaagccatcctcgattattaaatcggtggcgaatgcactggttttgttattctgaggctgtggggtgtgtaccatgggataaagcaactgaatgattatatgatattctatttctaccatctccagtgtcattgagaaccaggattcttgctatgagagaaagaacgtatatatttaggacaaaaaagattaagtagaaa

SEQ ID NO: 2679 - DNA, 2518 bp, Homo sapiens
gtttcaaaaaaaagtagaagacaaacttctcacctcctagaaaacccatagtaggtattattatggctcccagttcacagtcaggtattattataacctacagtaggtattattataacctagcccaacccaggttgccaaagttctatctctctctctctctctctctctctcactttccacgaggcaggcagccccaggctcacaggccagcagctgagatgagaagacatggggtttttcaatgacttcagcagactgtaccgggaggatttggctaactgggcttggatcactggccccttcctgccggcagcccttcctcagatgagaaaattcacagatgagaaagcgaaacttagagggtgcatggatagtgaatgctggaagaggattaacctcaggaccttccatcccagcacctctggagcactggcctgcgttgccagtgctcttcaggccagctggggggaagggactgaatgccaatctgctctgggatgaacatctgcctccaggagacagttgtttaatgaaatttcccacccatgtgattagcatcctctgagagtgagatgagtaaaacaggctaccaccatcaacatcatctctgactgcactgcctagacagtaataacacccaagatttttagagctttctgtttctcaaagtcatgcccactgattcactcaggaacccggcaggaagcaaggcagtccttgattgcccatgtcgttgagatggtaaaaggggtattctgagcaactgttgagttcttttacatccctgggatggcatggtcacaaaggccagacaccgggcctgacttcaaggtcactgtggctgcactactgagtgactgtggacaagtctcacattctcttgaagactcaggagcctcctctgtaaagtggagatgataattatttcccaccgcatgggtgtgttgtggggattaaatgagatcatacaagtggaatgctgagcaccagtccaggaaggcgaggggcacgccctacatgtcacctactggatcattgctgttttcagggttcctattacccaaagatccacctagaattcttcccctgagtgctgttcatcttcgtcaaggctcagcaatgttttggatgattctcctttgacatagctctggtgcttgttaatactaaatgttttccagcttacctataaggaaactgagtcttaggaagcaattgcagggcctctactttgtgcatgagaatgagtgacggctggggaaacctgggatttggcctgatgttcaagcactggcacctgcctgccttttctctgtaaacatctgaccctagaatgctccaccagggcgagaccatcatcaccaagcagcagctgcatggtatttatcaaaggaggcgtggtttcctttgctgtggctctccgcattcgtggcagttattcatttttgaagcagaggtcacttttctttcactggtgaggtactttgacaaagacgaagaagggagacaatggtgtggcaaaatggctttgttgtggtggaagatgaattgtcgtctcaagggggcagaggactgcctgtgagcttccttaacatggagcccgaaaccggtgtttgcacagtccttgaggaaagggtttgctcagcaaattaacagtgtgaacaagactgcaggagggaccatttacctacctgagaacaaactgttttctagctcttcagcagcaccacttacgcacaattttcatgtgctaatggcaagtgattattacctagttagtgaatatacgtggaagacataaaatagcctttactatcccctggttgagacaactcgctaactcagacttgccaggtgctctgaattagagaggtgctacaggaatgtcctctcggatttttggcgttgagcatgcatgcatgtgagcagggtgccatttcttcagaagaaaaataaatgacaacattctgttttggggcttgaaactgcatgactgaaaacataaaggtgacaactgtgatatgcttttttaatgagggcagagatgtcaagagaaaccagccttctaggaacaaaagaatactctgtcagacttattttgcaactggcttcaaacaatttgaagaaagggtcatggctttcccttcagcagagtttgggatctgaacactgcgttgcccccaaatgtctgcctcttgagagttctccacccagtggtcctgcttgcgtctttggaggacggtagcagtgcgctcagtggaggccacgggtgcctcagagggatttctcttggacctcctgccctaccccagcttcggcgttgcacttggagaaggccctggatatctcagggtgctggggagaggagcagtgagcaaacacaaaatccctgcctgtttagaactgatcttctagtggtggtggttggggctgggagcagctggacagtgaattactaagtaagtatgccatgtggcgattagtgatgtggggaactaataaagcagagttgggg

SEQ ID NO: 2680 - DNA, 2868 bp, Homo sapiens
gggttctgttgcagtcagtaggtagaggcaagggatgctataaacttcctacagtgtacaggacagccctcacaacaaagaattatttggcacaacatgtcaatagggctgaggttgagaaaccttggtttaatgactccttattttacaaagctgggtcctgtcttgcacaccttcctttaagctccttattctactctgtaggatttctctctgaattgtgtggacctttcatagcctttttttgttgttattatgtctatttcaatgtgatttccacacaagttttggaattatatagcatggacttatttcccagatctccctatctatgtgatctcccttttccttatctatgaaacaggacaaatagcaacccctacttcacacgttgttgggaggattaaatgagtttgtacatgtaaatccctcacaacagtgcctgatacagggcctaataaatttacttattatcataataaaaatcatttaatttctttcactttttcatatgatccttaaaggcagtgattatatcttgtagttatatcattatattccttatacctccttatagatgtagggccagatgaattagagtttcttatcagaatggtaatggtgagggataagtctttggtatatttccaatcaatgggctctaaaactttgagagtacagggtaagtccacctccctttgagaaaatgaactcttacctaggtcaatgaataaactctttcagcttaccaaatactaattcttgatctaggacaaatacatgacagcggctgcacctgagtttcagggaatagctttgctcctttttgtgttaagataaggaagatagaaaaagaaatggtcagagtagaaagtgaagcacaggctgaagctgataagaaacatggttgtgtgtggcgctgatggaggaagcggcaaagggaactaatgagcagtctgaagacagagggagagatgttcctttagaggctgcaaccctgcgtgcccatttaaaaagcaaaaacaaaacccagcagtcccctggtataatttcagtgaccagtgacctcttggtaaatatatctctttgatatattttccagcttgcaatctagagatcagagtagcaaaacaagacaagcagaggctaacatatttgtgtgagcaaatactcattactttactgtcacctaatttcttgtggaagcaaaccaagattttcatccatggaactcacttaaattgagagatccttacagagttctggacggaagcagagatctgcagtcccatctcatctgtccccaacaccagacttccaagaggtatcaggaagggcaaagcaaatgagctatgcccagtgaagaatgaacacacgactctggttacctggctttgctcgctgcctctgtttaatcgcgtgtgacttcctgagtaattggagaagacgctgggtgtgaagtgaggaatgtgcagctactgcagctctcttgatgacctccatcggctttggagaagtttggattcagagataccacggtaagagagaacagtaatgatgttgaaggacaaggggagagtgagccacaggaaaatgggcaggtggggctccccttgaatctctaggtctggcaacaatggcagtggaaaatgtgaatgccgggacagaactgctgatgctgtggcttccttctcagctctgtcaccaactcctttgaccttggcaaacttcttctcctggactcattgcttctccatctataaagagaagatggtggagggttactggggtgcagaggcttaattattgtttgcagaggatttggatattcttggatgaatggtgcaatcaaaatgctgtggaaaatattatcattttgcatgtcagttagcaaggtgacttaaacctgtcactgcatattgggtgagtcttaatcaaggaagagttgcagatatagaaaagaagaaatatgaggttagagaatggccattccatggagataacaggtttgcagcccaattgatcatacttcaagtttcttattattgatagtgttagctgctgtggcagaataaagatggccacaaattctttgattctcttcctatcaagaactgaggtcttttcctcttcccttgaatctgagcttgcctgtgattacttcaacctgtggagtataggcaagcctagccttgaaaaggactggaagctttactttggtgtctgggagccctgcaccaccatgtaaaaagtccaactacctttctagggagtccagatatatgcatcctatgactatatggagaatagccaccaagtgacaggcactggtaaagccttcttaggccttcttgagccactaaatgagtcccactaccagctgaatatccctgagtaacccagttgatgtcacatagagaataagaatctcagccaagccctgattgaattcctgagccacaaaatcatgagctgtaataaaataggggtagtttatttcacaagaatgaataactagaagagttaccttttattgcttatccagtgttatactagccactatacctcatttaatgtttacatgaatccccaaagttagatataattctttcagatttacaaatgagaaaaattagttctgagttggagcaagctacacagaatgagcttggatttgaattcacgtctgtctgaggctggagctcattcggaaggggtttccaggacagcctcacccccactggtccctctttcctaagggcttgccctggagcataatgtatgaactttaatgctttgttcttttgggctaaatattgtccaaattccattcttatgcaagcacaggagggcatgctatcatttagt

SEQ ID NO: 2681 - DNA, 24527 bp, Homo sapiens
aaagaatatatatttatatatataaatatatatataagataaaatatatatatatttttccattttgaacgtattgggttttttccatgctgtttcctactctcctcttttgcacccctcccatttccttcgtttttcttcgaaaatttcttccccctccagttcgctgtccggccctcacatgtgcgagaggggcagtgtgtcgttaatggccgtggcgggcaccgggctgctcctgtagtgctgggacatgtgaagttggctggggcggcgtgttccggcacctcggcgcgggtaaggtacgtgctgatcaggtcccggaggtccccggcctggcagggcgccctggagtgggaggaagaggtaaccacagcggggctggagtagggtgccctactgcgagtaggacgtgctgtaggtgggcgagcagttctcgcaggtctgcgaactggtcatggagttgtactgcagggcgcccacgtcatagcggtgtatgggctgcatctgcgcggcaccgttggcgtggaggcccgggtgctgtgcgtagcccagctggtcctgcatcatgctgtagctgccattgctccagccgttcaggtgcttgtaactgtccatgcgctggttcacgcccacgcccagaccggcgcccaccccgaccctgttgagccaacttttaagttgccacatgacacatcttgtccatcagacctatatcacatgatcacactgagctgaaagagaaactttaaatgtcttcattctgtatgtccagttgtataccaaaaactggaagaagggaaggacatcttgggggacaactggctctcttatgacaatccaccgctttgaataccaagttttcatgcctcatttttttttccccagtgtggaagatacccatccacaagagagtgggctcaaagtgactgcatttacttctaaatgtgccatactctctataaggtcttaaattagctccttgttatacttcataaatgaaaagagtatcttcccctacgtacccagagtgtagtaacaatttcaattcagaaagggaaagaggccgggcgtggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgggattgcgccactgcactccagcctgggcgacagcgagactccgtctcaacaaaaaaaaaaaaaaaagaaagggaaagaatgggcaacacaactctcactagttcctaccagttatcaaatccaccgccactatcccccagcagaaaagcgggataaaatacgggactcatctatttgaaggcagtagaaatctgtccaagcaggactctaaaaaggagtgaacatttctgaggtgagctgacctgtggctgcttttagtttgggggcacttgtccattctggttgcagaccggaggctggtaattttgattttgtatttttttaaagcttgcctccagaggacagcaaccaagaaagcttttggtagagatatggaacagccttaaacatgggcaatttccactcagaaaatttgcaaagttgtggtgctgtttaggagagaaaacaaaagtaggcagaaagcttcataaaacaaagattaaaaatcaggacttgccagaaggaggggatctggagaatatcctaggtgaccattagaaaactctgaggctaggggcacgtcaaatgtagaatgagccttatgccaagatttgtaactctgccttgatttatcatgattcttggttggattaagttctagcagaagacaggttgcctcactgaagaaagacatcacccaaagccagtaacattaaaacatctggaaaccaatggaaaattacaagaaatgccaaaaccacatggaccacgtgaccaaaaactaagagaaaaaaaagtgacatgagaaaccaagccacagacaattcacatattggagttcactggcaagaactctaagataactatgactaatgtgtttgagacaattatggataagataataggcaaagactttgatcagaaaagtaatctataaaaatcaaatggatattctagaactgaatacagtgtctggagttgagaacacagtaggtggatgtaatagtggatttgtgtaacaaaagacaagattagtgaactacaagacaggtcagtagaaaaaaatacatactgaagcatgtattggaggcatgtaaacacaatgaaaagcctttagaaagataattggagtcttggaatagaatggggccaaagtaacatttgaccaagctcagaaaactaaagcaggacaaagaaaaatagaatcacacttaggcacatcaaagtaaaccaactaaaaagtaaagacagaaaacatcttaaagacagccatctcccacagaaacaatggaaaccaaaaagactagaataatacttttaaagtgcttacagaaagtagctgctgatctagaaattcataccctgcaaaaaatatccttcaaaaatgaaggtgaaatggggctgggtgcagtggctcacgcctgtaatcccagcaccatgcccggctaattcttttgatttttagtagaaatgaggtctcactgtgttgcccaggttggtcttgaattcctgagcaaaaaagattctcctgcctcagcgtcccaaattgctgagatgacagctgtgagccactgtgcccattttgtttttggtttgtttgttttttaatttggctcttttagttgattttcatgggagcattgatctagagcaagttagtacatcagtagtttccaacctcgagatgattgtgtcccctccccaggggacctttggcaatatctggagacatttttgactgtcatagattggggtcagtgaggatactactggcatctagtgagtcaagactagggatgctggttaacatctgtaacaggatagccctctgtaacaaagaattatctttccccaaatgtcattagtatcaagattgagacatcctgcattataaagttttgattttagtatttttttaaaaagctctctgatttcagatatttttctgattttacatttaaaagaccttaaatggcacacaaacggtataaattcaagttgatgaacattgagttcaatgtgagttaactgaagagaatagccattggattcttatgtcacccctatttatctctctagagatatatggaggataacttggtggacaaaatacagttagaagctgagaatattggtctcaatttcagctgagaatttgagatgaaacatgtatgcttggaagtcatttatacacagctgttagttgaagctattgtaatgtataagtcttctcatttgtaaagcacaagagagcagggccaaggacagaactcttaagggcaggggaaggagggaagaccattggtgtttaaggactccattcctccatatgatcaactcaatagatgcaaaaaataaattgacaaaatgtaacacaataatcaaacatccatacatgatagaaacttccagcaaactagaactagaaacgaacgttcacatcctaataaagtgcatctgtgaaaacttacagcaagcatcatacttaaagtgaaagactgaaatgctttctctctaagatcagaaacaaggtgagggtgtatgctcttaccacttctagccagtgtaataaggctaaataaataaatgagtaatatccagattagaaaggaagagatgtcttaatttgcagatgacacaattatctatgtagaaaatcctaattaatctaccaaaaagctaccagtaccaatacatgtttctcaaggtggcagaatataagatcaatttgccaaaatcagttgtatttttatatagaagcagtgagcaatcagaaattgcaatttaaaaataatgtaaaaaataataaatatttaaggataacctgccaaaagacatgtgagacctgttcgctgaaaactagtaaacactgctgggataaataaaatctaaataaatagacatattgtatttatatattagaagattcaacattgttaagatataatttattctcaaattcaactatatatattcaatacgatttcaatagaaatcctagcaggcttttaaaagaaattaccaaatttatatgaaaatgtaaagaacctagaatagccaaaacaatactgaaaaaagagctaaatggaggatttacactatctgatttcaagatctattaaaaagctacagtaatcacagtataaagaaaggtaaacagagacaaatggaacaaaatttgtccagaaatagacctacagaattgattttcaacaaaggtgccagggcaattcaatgggaaaatgataatattaacaataaatggtgatggagcaaatggatatccatataaacaaatagtgaaaacaaagaacaataacaaaaaacaaatgaacttcaatccttatttcacaccagcattcaaaaagtacttcaagataaatcatagtcctaaatataagaggtaacgtataaaacttcttgaagaaaacgtaggagaaaatctcagtgaccttggcttggcacgtgtttcttaaactggacacaaaaagcaagaattattaaagaaaaataaaatggatatcatcaaaataaaaaatgtttgcctttccaaagataccgttatgaaaatgaaaatataaactacaaaatgggaaaaatagttggaaaacatatatccaagaagggacttctacctagaatacataaaactccaataataacaacaaataattataataataaatgtaataatataaaaagtatacagatgatttgaaaagtcacttaaataagatatatgaatggcaaattagtatatgaaaatatgctcaacataaatagtaatgaaaatatgaattaaaaccatacccactagaatggctaaaactgaatagctaaaattgaaaaaaccgataccaagaattgacaaagatttgggacaactggaacgtatactgatggtaggggatgtaaaatggtacaaccactttggaaaacaggttaccagtttcataaaaagttaaacatacacttatgactgagccattccacttcaaggtatttatgcaaggtatatttcataataccttgaaatgaaaagaatgtatatgtccacacgaagacttgtgcactaaagttcatagcaactttattgccccctaatagactacaaaacctaaatgtccatcaacaggaatatggataaacaaatcatggtctatctatacaacataatacaagttagcagtagaaataaactgttgatacacacacaacttggatggatctaaaactaattctgctgacagaaaccagacaaaaagagtacacattgtatggttccatgtatataaaattctagaaaatgcaaactagtctatagtgatagaaaacatatctggttgtctcaggatggtgaaagggcaaggagggcataaaggcagggattataaaggggccataaggaaagtcttgggggtgaggaatgcatttattatctttttttttttttttttttgagatggagtcttgctctgttgcccaggctggagtacagtggtctgatctcggctcactgcaacctccacctcctgggttctagcaattctcctgcctcagcctcctgagtagctgggactacaggcgtgcaccaccatgcctggctaattttttgtattttagtagagacagggtttcactgtgttgcccaggctgatctcgaactcctgagctcagccaatccacctgccttggcctcccaaactgctaggattacaggcatgagccactgtgtctggcctccccgcatttattatcttgattgtgataacaggttcacaggtgtttacctatgccagaacttgccaaattttagcagtttaaatttttgcaattaaaccatataaaaaatacccctaaaaaagaaaaaaatgggaaaacattaaaaatcgttactgctataagatcaccacgcatcctctgggtaggaaataatttctaactcttctttatccccaaatcactttttactttcattatagtacttatcagatgtctcagttatccattatcccaaaacttagtggctgaaaacagtaatttgctatttctcacatttttggggtcagctgggcaatttctctgctggtctagcctgagctcactcagggggctgcagccagctggtgagttcgcagaagctggagggtttaacatggctttggcatagatggcttgaaggcggcgactctcactacatggtctttcatcattttgtagtctaactgaatattttttttcagtgtccataaatcaagttttattggaatacagccacatccatttatttacttttttagtgagatatgattgtcagacaaataaagctatatatattcaacgtatacatcttgatgcattggaggataagtatacacctgtgaaaccatcaccatattcagtgccctaaacttaaccatcacctcttaggggactcctgtattagggtcctctgtaggggcaaaacttacaggatatatgtatatatgaaaggaagtttattaaggagaattgactcacatgatcacaaggtgaagtcccacgataggccattttgcaaattgaggacgaaggaagccagcagtggcagtctgagtcccaaaacctcaaaagtagggaagctgacagtgcagcctccagtctgtggctgaaggcccgagaggccctggcaaaccactgttgtaagtccaagaatccaaaggctgaggaacttggagtctgatgttcaggggcaggaagcatccagcatgggagagagatgaagactggaagactcagcaagtcagcttgctccaccttcttctgcctgctttttctagctgcactggcagccaattggatggtgcccactcacattgtgggtgggtcttcctgagggtgggtcttcccctcccagtccactaactcaaatgttagtctgttctggcaacacccagcaacaaccagatacacccagaaacaatactttgcatccttcaacccaatcaagatgacaatgttaaccatcacaccttgtacactattggtgggaatgtaaattggtacagtcactatggaaaacagtatggtagttcctcaaaagattaaaaatagaactaccaaatcatccaacaaacctgctactgggtatatacccaaaaaaaattgaaatcaggatttcaaagagatgtctgcattctcgtgttcattgtcccattattcacaatagcaaagacatagaaagaacctaaatgtccagatgaatggataaagaaaatgtacatacaatgaaatactatttagctttaaacgagatgagaatcctgccatttgctacgtcatggatgaatgtggaagacatgctaaatgaaataagccaggccaagtgcggtggctcatgcctgtaatcccagcacttcgggaggccgaggcaggatcacttgaggtcaggagttcgagaccagcctggccaacatggtgaagccccgcctttactaaaaatacaaaaaagtagctgggcatggtggcgggtgcctgaaatcccagttacttgggaggctgaggcaggagaattgcttgaacccgggaggcagaggttgcagtgagccgagattgcaccactgcactccagcctgggcaacagagtgagactctgtctccaaagtgggggaaataaaagtcaaacacggaagaactactcaattattccatttaggaatctaaaataatcaaactcgtagaagcagaagcagagacttgaatggtgattaccaaggtttgggggagggtgaatcagagagatgttgatccaagggtacatagtttcacttatgcaaggtgaataaatcctagagatctactgtacaacatcgtgcatatagttaacaacactgtattgtgtacttaactgaatcttcatgtggcagtcgggtacctaatgaataaatgcagaagccatgaggtctcatgggttgcccgggtcctagatattgcactgtcactcctgccacctttgaccctttatcaaaacaagttttaaaaaacagcccaaattcaaggggatggagaaattgatgccacctttctgatgtgagaaatgactatgccatattgtaaagggacatggacacggagatcattaatataatgatttgcccttccaggttatgccttataggcatttttggtacctgtatcccttctattaaatcataagttccttgaaggcagaaattagatcttatttacctttgtatttccctttgcaacgatcacagatgttgcacgctatgcaataagtgttgaatttttccggatgacaagacaagtaaaaggtaagggcaaaaaaaaaaaaaaaaacaaaacaaaacagggttgaagacgaagacgcatcgttgtagaggtaggggagaaaagatatattccaaataatttaaaatcatgatctccaaagcaggcaaaagcaaagggcaaatattgatgagccatcagagtatcttttttttttttttgagatgtagtctcactctgttgcccaggctggagtgcagtggcgtgctcttggctcactgcaacctccgcctcccgggttcaagcgattctcctgcctcagcctcccaggtatctgggactacaggcacacaccaccgtgcccagctaattttgtatttttagtagagatggggtttcaacatgttggccaggctggtctcaaactcctgacctcaagtgatttgcccgcctctgcctcccaaagtgctgggattacaggcgtgagccactgcgcccagcccagaatatcttaataataacatttttatagccaaataggtaaaggcaacagataagaagagttgagtagctgcttaagtagctagagctttatttaaatacagctcttttgattccaaattttaggctttttttccccttcttcaaattttgcaactctggggtggtattatgttaggcaattgaagggaggggtggataatttaggggttttaaattcacagagtaaacattctggtggttggtaccatgcttttagtatttatatttcccagtgtatgaaataaaagattttagagggacaatgctgaagatgcctaaaataaactttccttatttatttctaggcctttctaagcagttagattccaagagacaaagtatgttgtagagctgttctgtttagtcttttcctgaaattgcagccagtgttttgcctatctgctattaacacattaccctttgcctgccatctcatatttggcatattttataaacaggctgaaagctctaagctgaatcctggctatatcaggttttgtaattatatcttcctgcaatattcttcccactcagacagctaataaatagtttaactgactgagattcagcctttctctttgtctctgcaaaatttagaaattcaaaatgcaattcaaaataagtattttcttcatgtactttccccatgatgtatttggtgtccaacaatgaaccaaattatgaggaaggtgagtcaacagaatcatgagatccaattctttctcttgagactcttatggtatcggagagatttgcagtctatttattttttattttatttatttatttattttttggaataagatctcgctcttgtcaccaaggctggagtgtagtgacacgatcactgccacctccgcttcctgggttcaagcgattctcctgaatcagcctccccggtagctgggattacaggcgactgccaccacgcctgctaattttttgtatttttagtagaaacagggtttcaccatgttggccaggctggttttgaactcctcacctcaagtggtccgtctgcctcagcctcccaaagtgctgggattgcaggcatgagccaccgcccggccagatttgcagtcttttgggtattctgcaagctccaggattctgggattctgagtgacccacaaagttcacagtgttgctgccaagttctagtaaagcattatgttatacttttttgtttttacataattcaacgtattgggcaataagtcactttgctagtattcatattagttaatctttactctgcagtaagacttaatgtaaatgcaaccttttaaaataaaaacgttgaattattccagttgaggaaaagtgcaagtagcaatcttagagggcaagacatcagttcggtttaaattagtgaattaaattctccatgatttcgtggctccctgtggataccatgaacactctgttttacctcagttgtgccatgcctcaacattgagctcctagaatgcaaaggctatttctaattcatttgttgtgtctttggtatttgtcataatacaatactatagattattcctctttctatgtggttttaaaaattaggatcattatcaattttgaacttctgaagtcttgatgagagagttgtaaactcattaaagataaatgagtagatttaaactattcacgattcttcagggttctttttgtgccttgagtctctgaggggaatggttgctgctgataagcctagccaccagtcacgtaagaagatattaatatacagcaatttcacagctgaaggcttttgcttttccacagctatgttaatagtatttgtcatttggaatcaaacaagtccaggttattcaattcccgggggtgggaacttacacaagagaattaacttctctgagctcaagtgcccctgtttataaaatggggacaataaaatttataaaatggtgacctctgttgtagggttataaggattgaaattctatgtgtttagtgcctggtaaaatccttgacatgtagaaggtgctcagtaaattattgtagtaaaaatacaagttttttttttgggccaggcacggtggctcacacctgtaatcccagcactttgggagtccgaggcaggtggatcacttgaggtcaggagttcaagaccagcctggccaacatggtgaaacatggtcactactaaaaatacaaaaattagctgggtgtggtggtgcgtgcctgtaataccagctactctggaggctgaggcaggagaatcacttgaacccaggatgcagaagttgcagtgagctgaaatcacgccactgtagtctagcttggggtcactgagtgagactccatctcagaaaaaaaaaaaaaagacaccagtttttaacagtctttctcctcccttcaatttggttgtaaaatattcgaaaaaaaaattggaacctgtacatgttttgacctgaaaaatagtgggaaagtgaaaacattccactttccctttcggcatttattgtgtcacttaattattttaagtattgaattttcagtctgtcagacacatttctgatgaaagttaagtgtgatcagggctcactgcaacctcaaattcctgggctcaagctatcatcctgcctcagcctctccagtagttgggactatagggatgtaccactgtgcctagctttttttttttttttttttttgtagtgatgaagtctcactatgtcgcccaggctggcctcaaactcttgtcctcaagcaatccttccacctcaacctcccaaggtgttgggattacaagtgtaagccaccacgcccagctaaaaaacaaattttaaagttatttgtgccactgctactcctaaaatgaatatactgaaatgcaatgatttggatcctcccaatattttcttgtgttatgagaagctgataaagtcttatgaaactcctgtgggattattgaaataatatttaaatctaagtcttaggtcttgtgagatcctaggcaagtcatttagctcatatgaaaaatgagtactacacattattatgatctcagatttgctttaagattgaatgaaactttgcatgggaagtggctttgtcattggaacagctgttatcttataataacactgaacaggccgggcgcatggctcacacctgtaattccagaactttgagaggttgaggcaggagaatcacttaagtccaggagttcgagaccagcctggccaacatggcaaaaaccggtctctactgaaaatacaaaaaactagtcaggcacacacgtgtggtccctgctacttgggaggctgaatcaggagaatcgtttgaacccaggaggtggaggttgcagtgagctgagatcgcgccactgcactccagcccgggtgacagagtgagactctacctcaaaataaataaataaatacatacatatattcatacattacaataacactaaacatccatagggtaaaaaatgggggctttcatttgatggaaaacttcagacacagctcttttctcatgtgaaacaggactgactaatatccgctggcttcctcagaattggttaagaggagatacttgatatcccggcacctttttctgataggctgttgactgtagccttagcctttctcagcccctggcctgactcctccccttccctgggttgtctatatctaccacctctatatctaccacattttatttatgatggttgtgttgtggggtgaggtgggaaacttggcactggctaggtctcctttgcaatcagcctccctacagagaaattggccattaataattgtattaggaaacattttattcttgcagagggagacccatgctttacaaaagattcctgacatttggtagcttggcctagttctggggtgcaaaattaggaagcccatcgttgcggcatacctcagccatatttccacccctacctttatcagctgtaaggctgttatttttatcttcaactacctggcttatttattttctcaaaaagttcagaactcaaatgggaaaaagtagtattctttattaccccactgaaaagtaagggctaatttatccaagtctggttcctcacaggctggcccctgaaacactccacagaaaccagctactgctgtgagtttaagacaatcaacccaacttatggtagaattctgaagtggcggtttggttggattgatgctcacccaacctaaaatactgagttagtagaccatagacctgggctgcatatggaggttctacgttgttatgcagctgcagcccccaaagcttgaccccagccttttgattttgccaactgctaagtgctgaggtgatgacccaaaaatggaggccaaggttctgccacatcatattgctgggaccatgggtttggaccccagcccttgatcacaccatgggagcagcttatactctctcaatcatgcaaatttttttttttaaagccctacagccaaaagactgaggtttctcttccaatgcttgacgtttggccctgctagattcttctgtgctgtttgaatgcaatgggcaacagggctcacatacctgcgatgggtcttttctctgaatttctcccctccctgtcaatgttccagaagggcctgctgtgtgtgtgccctgcttgacccttcacctctggtactgtcacccgtaaccctcagcatctgttcagaaacagtgatcataattcatccagaggtctctgatgattcatccagaggtttcctaggcagggagcttgaattctgagaacttcaagatcacaatgaatgacagagatggttctttaacaccgaggtctttggtctctaaattttatgttatttgcctgggagttggtacttccataaacaactattgggtcacagagaaaggcctgattcccttgttgctgtgggaatagttaaatgccttgtcttccagaagtctttttattaaccccagacagcagttccagtgatggatttcactgtaaataagaatagctcatttttctctgccctctagagttctttttttttagtagatttttcaaaattttactgaagctgaagaaaaaaaaatatatatcaaaattgatagcacccagatgctgcagaagtagtgctgcaggtgaaagataccaggctgagacgaatctggaaaaacgggactcttgtagtcggagctccaaggaaagactggataatagaaaaggaaagatggaaaagccagaaagaaggagatgttataagaaagaaaagtatacaccacacacatatgcgcgtgcacacacacacacacacacagagagagagagagagagagagagagaaaacttataaaattttgagtctgtccattggtaaattactctgttacaagccggcaatgaaatttgaatggtagtttccattgctcaatcccatgggaagttctgagtgtgtagagcagtcaggccactttcagtactcttgggacctccgcagaccaggagggactgtgatcttgagatcttgatgatgctcaacatgtatcttggttcgcaaagcatcttcatgcaaaggatctcgttttagtttcacaacccacccgctgaagtagctgagtggaaactctccccttctacagataagggtagaaaacagtgacacctaggtccaggagtaaagatattcaccccttccgaaaataatttatgaatgatttaaaatagttttgttgggacgcagacacaggtacgggatacaaaatgtaaatgtggagccttaaacattatagtattttatttgattttgtgtttttttattattattattattattattattattattattattattattttgagatggagtcttgcttggtcacccaggctggagtgcagtggcatgatctctgctcactgcagcctctgcctcccaggttcaggcaattctcctgcctcagcctccagagtagctgggatttcaggcacccaccaccatgccaggctaatttttgtatttttagtagagactgggtttcatcatgttgcccaggttggtctcgaactcctgacctcaggtgatccgcccgactcggcctcacaaagtgctgggattacaggcgtgagccaccgcacctggcccattttggtagtttaataaccacacacgcaggaccatctagggcaagttctgagtttgggggctcccttgtgtagttccttctttttgaatctgtgctgaggatgattttctttagatcgtggcagaagtggtactatgctcattgcaggcctcagtcttaagaagtcctaatgacctcttcttttgtactcttgggaatcttaagctgccatgtaagaagtttggttgccactgaagagatcacatggcaaatccacatgaggagaagccctgagattacatggaatgagagagagagagagatagaggagaggagagaggagagagaggagggtaggggaggagggagagatcaaattggctgaaaacaatagctgaccccaggcccagctttcctgtagctaaatgcagccacaaaagtgaccactgtaaagaccagcagaagaactgctcagttgagccccaaaccagattccagaactgtgagaaaatggaatgattgtcattttaagccactaaatttgggggcggtttgttatgcagcaatagctaaccaaatagaagttagctctcagatgtggtttcttctgtaacaagaacacaaagctagtggccatggcttttggcctgggtggtgagtagaagctggaggaggctccaggagacttagtgaaggctggaagggcagtgagcagttggtattagagtctggagaaaaaacaatctgtgtcatgtagtggttgaaagtttggcaacatgttgactataaaagatagcaaatgtgtctaaagaacttggggatctgactaagagactatttccagacagaacgttgaaagtgctaactgtcttcttttagctgtgcctgataaggcacaaatagagagagaaggataaaaaataaaagtgtcaacacaggaaaactttccaacccaggacttactgagttggaaaataaaactctctccccttgcagcttttccagtctgcaaaaggttcccaaatggccttgggggaagaaagatcaaatctaagatgctaccagtaaaatggaacatgtgagtcaagatcaagtcacaggccgggcgtggtggctcacaccaaaatgctggtaatcccagcattttgggaggccgaggtgggtggatcacgaggtcaggagttcaagaccaacctgaccaagatggtgaaaccccgtctccactaaaaataccaaaaaattagccgggcgtgctggtgggtgcctgtagtcacagctactcaggaggctgaggcagagaattgcttgaacctgggaggcagaggttgcagtgagccgatatcacaccactgcactccagcctaggtgacagagtgagactccatctcaaaaaaaaataaaaaataaaaaaataaaaaaaataaaagatcaagtcacaagtgtggctataagaccctttgttaagaccccagaaagattagcagtagaacctcctagaacctcagcactagataaaagtgtttccaagaatctaaaggacatcttctcatagtactctgacccaaagtataaagaggtctgtcacaaagagatttgtgagtatagctcttatctaatggcatgaaacctaataagacttataggaatcctacatagtcttgaagagaactatattagcagaaacacagagttgtactaaaagaaacagctctgcggccataaaaaagaatgagttcatgtcctttgcagggacatggatgaagctggaagccatcattctcagcaaactaacacaggaacagaaaaccaaacaccgcatgttctcactcataaatgggagctgaacgatgagaacacatggacacagggaggggaacatgacatactggggcctatcagggggtggggggcaaggggagggagagcattaggacaaatagctaatgcatgcatggcttaaaacctagatgacaggttgataggtgcagcaaaccaccatggcacatgtatacctgtgtaaaaaatctgcacgttctgcacaagtatcccagaacttaaagtaaaataaattaaaaaaaaaaggaaagaaaagaaacagctcaacttgaaaagaggcctctggactctttctaaaggcaggaaacaggatgagaaagctattcacctacagacactggccatcccttatgggaaaagaagaaatagtcagaaagcagagtaaggaaccatgaagaaccactccctaggaacataactgtccctggagcaggggtaattggtgatatatgcctgtctggacttcagaattgctgtggactggcaagtcctgcattccttccattctccttcatttagatgagagtctgctgtgattattgtatgctggtctcactggtatatggggcgaaacaatttgtcttcagatctagaagaaatatacccaaggagtcttatctacacctggacttggtttagatgacaagatcttgaaccttgagccagactgctgctgtaatatggtaagactcttaggggtcttgggagagagttgagagtattttgcacgtgggagggctgtgagccactggaaaccagagagcaaactgttgcagtttgttttattggtggccccaataagctatgcctcttagtattcataaccttgtgtaatccccttcccatgaatctggtctgggtttatgacttgctttaactcatcaaatgcagcagaagtgacactgtgccagttctgagccttaagaagtactgtcagcttctgctttggtgcttccggatgctgtgatctgccatataaaaagtctaattaccttgctagaggggctatataaaaaggccttagaaaaaccctgccatctcagcatctcagcggagcccagcccccatccaactcacactgaattcagccaattagtgatcatcatcaagatcagcagaaaccttatccaactaagcccagtctgaatatcagagagtgagcaaatacaaaggttgttgttttaagccattaaatgttgggatggtttgttacacagtaatagataagtgaaatagacccaattaaaatagttgatccataagcatataacaaaactcattataacaatatctcaaaagcataagaagaaaattctttatggaaaataaacctttggtttcactgaagttaattgactaaattaactcaaccacaatttgagcataaatcacaattgaaaagactgactcggcagagtaaatggaaaaggctcaaagagccgactatatttagcatctacttgggtttggtgtgggatgcaagtgagttttaaaatcaggaaaaggaaaaaaccatcaagtcagagtagagcctagagatttgtttatgctttctcatgccagaaacttgagatcgctttccttctttgaggaagaaaagtatgatttgtaattttgcacagctgagaagaaatgtttccgctatccctccaaacctcactccctgccttccagccacatacagaaccaatgcagctcctcaaatgagcctctctgctttgttcatgttattcttcctgcttgtgttctgtttccccatccatccattaactgctaaacttcacccacttcacccacttggaaaatgaggtgaagcttccacttggggaaaatctttctgacaactgtccctctgtgccctcaagtaggctaatcacccctgccttgggacaccactgtactttgttttcacctgtattctttggctgtacaattattaggatggtttgtttgcttgtcctttactcctccttgaccataaatttctactagagacaggaagaaatcctactgagataagtatacgtggcatttattacatgcttataatgtggcctaacatcagtggttttcaaagttttggttgtatcaagggtgcctattaaaaatgcgtatttttagctgggtgtggggactcacgcctgtcatcccagcactttgggaggccaaggggggcggatcacctgaggtcaggagttcgagatcatcctggccaaccaggtgaaaccctatctccaccaaaaatacaaaaattagccaggcgtggtggtgggcacctgtaatcccagctacttgggagactgaggcaggagaatggcttgaacctgggaggtggaggttgcagtgagctgagattgcgccattgcagtccagcctgggcgacagagtgagtctccgtctcaaaaaaaaaaaaaaaaaaaaaaagcatattttcaacaaccagccccagatagcctcattcatttggggctgggagatctgcatttttaacaggcacctagatacaataattggtcaggcaactctatcttacaaaatatgggcctcaggacctcctgtcttctcttgcctctctctggctgcctaacctgggctatttccctacagtaaaggaaaaaccaaggaagataactgggtgaaactcaaatcaggtaaacacacttttaaagttctgacctggaagttgaaggtgcaggctaaaataataattattcatcaatggtatttatttccatttttcctgacttccttttccaccactagtcaagaaccggccatatttaaaattatgctggttgacattttctcaaggcaccctttgaataacccttcaaagccagaaaaatttatgtatttggaaattaaattgtgatgagcttgtctgtcagctgcatgatgtttccccactcattctgttctgggtgataaatccataatcactgaagtcaagagctgttcattacatatattcatataacctggtccgaggcccagactatctgaattggcagtagcaataccagctactatttatttacctcttgctttgtgctgtggctgggatcagtgttttacatcattttgttctttaatccgtatcaacacctttgagataggttttagaggtaagaaaggtggggctcagagaaatttaaaacaactcatccaaagggcaagatgaggtaggatgaaaagatatgtctgtttccctcagcaccggaattccgtactacaccgtgggccagctccttagagcctgcctgggcccgtggctaggtggtatcagggcagaacttaagacccacgattcctggcccccagcataatttttttttatgacctcacacatggggcaaaaggaaagccgaaaacattaataattaattctggtaaaaagagagggtggtgatatggtttggctgtgtcccctcccaaatctcatcttgaattgtagtttccataatccccacatgtcctgggagggaccaggaggagaaaactgaatcatggggcagtttcccccattttgccgtcctgttctcgtgatagtgagcgagttctcacaagagctgatggtttttataaggggcattccctgcccagtgcccccgccccaccaccttcgctctgcgttattttcctgccatcatgtgaagaaggacatatttacttccccttctgccatgactgtaagtttcctgaggcttgcccagacatgcggaactgtgaatcaattaaacatctttcctttataaattacccagtctcgagcagttctttattgcattgtgagaatggactaatacaggtgggttgggattttcctttacttgttcggatcattgggaaatttttgattaccaaaaggctaaattatgatgtcatatgtggccttggaacagattatctgggccttgccctgtttccactaactgctgtttctctaactttgtggaaaatgctaagacagttaccaattcttcttggtccattttgaagatttgctaaacctctaaaagccttgtgagaccccttcagccactgcggagctttttaatggagaacaggaaaggatcgtaactaggccacaggggggtattttagtccgagagcaggctggttttatgaaagtccaggctcccagcagcttttgtgaatattaacgtataaaccagggcagaaagtggcgtcagcagtgccctgagcaggaaagactgtggctttatgtagcagaggcatgtccaggtcagcagcagggacctgaattccaggactctcagctctgcctggaacttgtgagatcttgggtcaagctctcaatccgtgtgggcctggttttttgttttaaattcttctaatactacctctcctgttggtgaacgagggaaatggacatgaatgtctgtgaaagaacttatcataggtaagctgttctgagtggcgctccatcagccatctttactggctgtttgtggttttccaacaaaacatcatagcttatgtggttaagcagtgtcgtgttcacagcaggaatgcaaccagcatttggtggaattgtactgctgaatatttataactgaaaacctcaaagaagagtccacctcacagatgtcacccttattgcttgcattccaactatttaagagctaacccgttgtgctagtttgagatgactgttgcttaaagtgtggggtgcatttcactgtgataagcaggatgctttgaaatgtcatgtagacaaacatttttattaataattaggtatttttcactgtgcatttaaacaaggttcatttggaaaagtaaataaaaatggactcaactaaagtgtatgaagcaagtattaatacaggtgttagaaggatatgacaaaatcatgcaggtgatacatcaatgagtatagattaggatatactcctagaatataagtccataacttgttaagcaaaactcatggggccagatgagtttcataattcagaatatctcatgcagtatttgacacccccagaggtaactgagacaacattctcaagtcaaacacgttattatttctgcagtaaaactgatgaatattcatcataagtgggataaagtctataaatggactcatcaattcagtacaagttttgcagccaaatgaattacaaaaaaatattgtttctcagatgcttttgcattttggaattgtagataagagagattttgttgtcgttgttttggtttttgagacaaggtctggctctatcacccaggctggagtacagtggtgccatcttggctcacagcaacctccgcctcctgggctcaagcgatcctcccacctcagcctcccaagcagctgggactacaggtgtgccccaccacacccggctaatttttgtattttttgtagaacaggttttcaccatgttgcctaggctgatctcaaacttgagatctcaagtgatccacccaccttgacttcccaaggtgctaggattacaggtgtgagccactgcacctggccagataacagatttttaacctgtagtaaaataggccaagaggaaaaacaagcaaattcaagaaccttaggcctgagccatactgtatagtatggctatacccccaaacattctccctctcatcatctgatttgtgaggtaggtcctccatattacagatgaggaatttgaggcttacagagggtaggtgacttagccaagatcacacagctggtaaccaacagggccagaattaggatccaagattagaatccaagtcctgtgcctccagatatttgatctttttatactgtaatccatacatcatataaggcctgaagaggcagaggctgaattcttgaacatgttccctgagtgcagatatgctttcccccaggaaggtgtcttacctgactctgtcatttccaccgaggggggctctggaggggaaggatgggagtggaagatataaccttggccttttaatgttgagctacggatgtatccaaggtgcttggatcaatctcttcagacagtgcatgaaacccaactgaaatgcttgtgacagtccagtggtatttcagggaaccattgcctgtttcttccagaaattctaataagaatggacatttattgagcacctgctatatgccagacattccttcctctaacagtttaggggtgttcttaccatttccctcccccagatagagaaatgggagttcagagacacagccaagattacattgctggtaagtgacaagtaagagttaggccaggtttgattctgttcaaggaccacactcttacccactaccctcaaagagcagcggcagagcccttgatttctgatccacccatgggagggacgccttttcccctgtcaccagggtacagccagtttctgcattttgcatgcttgtgttccagaaattcaagtgcaagttgatccaacctcctaagtttgatggcatggaccttagcattagggaagtatgcaggagctggctgtattcaggaagccaccatagatgcatatggctggaatattaaatgagggcggggtttggggaagaactgggggcaattgttaaatcagaaagagccttgttgttcttgcttaggagacatcaattttgttctctaggcaatggagaatcaccagataattttgcatggggcaatgacatggttatatttccatgtgatgtcttatttggcttggaaatcaggtgctgcttcccagaggaggtatcagttaacctaggactgaaaggatggattggatgtcacccagggacgaagcgactgtgacaagatacaagcacagggatcccatgagcttggcaggagtgtgtgatctcactgcataggtacagacacagcactaatggaggctgagcacagatggcagaactggagacaagctcccgggaacccaggtccctgggaggtggccctggcctgtggggtgaaaacaccaagtctgaggccaagagcagagctggcatttcccaggctacatgatgaagatgaagctgcctatcttttctgcttcccatttttttttctttttcttatttatttattttatttatttattttttgagacagagtctcactctattacccaggctggagtgcagtgatgtgatcttagctcactgcaacctgtgcccccgcgttcaagtcattttcatgcctctgcttcccaggtggctgggactacaggcacatgacaccacggctaatttttttttttttaatggagtcttgctctgtcgcccaggctggagtgcaatggtgcggtcttggctcactgtaacctccacctcccggattcaagtgattctccagcctcagcctcccaagtggcgggattaaaggtgtgtgccaccatgcctggctaatttttatatttttagtagagacgtggtttcaccatgttgaccaggtgttctgaaactcctggtttcaagggattcacctgcctcagtcccccaaagtgctgg

SEQ ID NO: 2682 - DNA, 3922 bp, Homo sapiens
ggttagggtttcaccgtggttgggcggggggaagagggcaagaggagggcctggaaactctaacccccgctccccagactaactggccgtcttgggccgagagaaggtcacctctgcacctccccccagcctgtccgattgtgaggcccctagcccaggcctggccctgactgcctgggaagccggctggctgggtggggcgcctgggttagtcatcactgggctgcctctctccccacctctcggccaactcttggcccctccccatggcctccggcgaggctgtcacccccacctccctccggccctggttccagcctccaactcctttggcctgtcatcctggctgtcagattgggctaggagctgtcagagtgccagagggttgatggagcagctggtcagagggtcagtgccctgggcccaccccgccctgcagccaagggcacctgcttggcacagactctcagcagctgctgagtcctctgggttgaacagagctatctcagacagaggaaggtcggacggagttggactggtcacccaggggaaggaagatacacaaagttcatgcctcccaagagggtttcggaatttgaaccgcaccccgtatcccccaatctttcttaccctctgagtatagaaattccaaggcaagaccgccttggcccctcagcctggcgtgggccatgcccttggactgagtgtcagcacggacccgccctccccagctcacatcccccgagcctgccacgcccccagccccctccctgggccatgctgcagggcccggcttttcctgctgattcatgcgttggaactgtgggggcggggcttggaacttggaacaaagttcagacatggaggggccggcagacagcctggaattcataccagatgtacccggaatgcgcaagcggaatgcctggcatctgagagtcctggggaagctgcccagccaccctgcccatacctccctcccctccagcctgtggtcccctgcccgcccctcacagccccggccaccctgccgatacctccctcctctccagcctgtggtcccctgtccgcccctcacagccccgggggcctctgctgaccttctttcaaacgctaggcctcctcccttcctcactcttccccaatccaggcccccagaactctccttccagctgaactccctgggaacaagtcagttgggctgatcactgaactcacatttctggacctgaggtaccacacttctagtacctgcgtgctggtggggtgtgtccagggtcccgggccccaccctgtctgaatgctgaggaggctgggcccccaggggccgctagggcaggggagggtgagagcaggactgggtttctctagactccagttctggaaagaagagcaagggaagtctgtttacagccacctcttgctgctcagcgaggttaacagcttccgcgggcccagatcagagctgcagccctgcattagaatctcagaggtctactggggcaggaccctgatggccagcgagtgggtcagcgttgcagcaacatgccctgctcagatctttcccattttccctccctttcccttaggagcctgttcctctcacgccctcacctggctgagccgcagtagttcttcagtggcaagctttatgtcctgacccagctaaagctgccagttgaagaactgttgccctctgcccctggcttcgaggaggaggaggagctgctttccccatcatctggaaggtgacagaaatgggctgggaaggtccgaacagcagggtggatgatacgttttgggcaagttggagagcctttgcccagattggcccagcaaggagcggttttagattagagacactggctggattgaggagtagaaggctcaaacaacccaaggtggtatgtgatccccagctcaggcctgtgcagacaggaaattctcccctgcagcaagtaggggaggtgggttgtgggatgtgacctccttccagatatcaggcagtgagtgtaaacctgccacctccagccctgatccattctcacctagcggctacaggaagctgtgtctgttcgatttggtgggaggagatgtgcagggagctgtatcttgtcctccgcttgtgaaaaactcaaggatgtggagaagagtagaccgtggaaccctgctcttctgcagccaagctgaggggcaggatgcgtgtgggacagtggtagagaagcaggggatagactcataggctgcaacaaaggtgactctgtccctggacactgcctccgtactttctccttgcttcactggccacagcatctccctccagccctcgctatgtgcctctgccatcttcacccatcatggagcagaggtgaggagaggcagcctgggaatatggagaccagtgaaggaccaggcctggagagcacagggtcctacctgggcatccagcagaggagcccctaaaggccaggagcaccccaagaggagggagggcagccagcctccattgacggcgagcctccagccctctcctactttgatcaccatttctctccaggctttctgcctccgagatgtggcaccatagtgcggtgccctgtggcttcaccgccctacttccacctccgcccagcctgtaatgtttatataagcagcctcaaggaccaagaaccatctgcgaaaggacacacacaggaaattcataaaagaaatctgaatggataaaaccatgaaaaaaagtatgcttcattagtaattaaagaaaggcaaatagagctggaagcatttttcccttagcaaaccataacagaaaaaaataagacccaatattggcaaagagactactgaaaaaacattcccatacattgcgtgtgggagtatacatcggtgcaggcttcctggatgacagttgggtgatatgtgtcatgtggcctaaaagcctccatgtcatttgacctacgaattctatctttgggaatttatcctaagaaaatacttaaggatttagttagtgataagatgttcatcccagcattgcaatggagaaaaatgggaagcaatggtttggttgggaatttattccttttctgctgtaacgaaagtttgcaataggggattgcttaagtaaattattgtatctccatccagatggtggagtaccgcgcagacattaaaagtcatgtaaaagaacatctgactgaaagaaaaatgctccttgaatattaaaaggttgtaaaaatagtgcatgttatgtgatttcaattttgttttttaaaatatgggtgtatgcttgtatacgtagagcagataaaaaagacggaaggcatactaaaaaatgttgagtggttatctttgtatggtggaacaaagtcactgtaattttcatctttggtttttctgtaatttccaaattttccacattttgtatttcatataatataatttaagagatcagtgttattatttaaacctttggagaggtgggggtagaagaatgaagggaagacctcagctttttggtgagaaggtttggttggggcacctcttggtttatgaacttaattctttgaagtagctggaatcctccctctcagcctgcaggaaacagctctgacttgctgactgtctgccagctgaagaggtggagtggagtaaggtggaaggaaagcagtgcaacctggggctcttcaggtggtgaggggctgggggaggctcttcctcttaaggctggagggttctggaatcctaaccgccctgctactaagagcaggacaggtctgtttttctcttctgactctgtcccagccttgaagggaccctgtgttacctttccttgccctcggattgaagatattctacccacccaacgggtaccaagcccttggggaaggaagtgcttttcaagactgggggccagcgattc

SEQ ID NO: 2683 - DNA, 18224 bp, Homo sapiens
cggagtcttgctctgtcacccaggctggagtgcagtggccaatcacggctcactgcaatctctgcctcccagattcacgccattctcctgcctcagcttcccgagtagctgggactacaggcacctgccaccatgcccggctaattttttttgtgtttttttttagtagagatggggtttcaccgtgttagccaggatggtctcgatctcctgacctcgtgatccacccgccttagcttcccaaagtgctgggattacaggcgtgagccactgcgcccggccatatctcttactctgatccataaaacttttgatcaagtcacacacagaaaagatattaatgtatatcatacttttctcttttatctaggtcatttcacatagattatcttggtaatcttcacaattgcctgacaaaggtaccaatattatcttcatatgggtaaggttctttgagagttatgtacttagctcaaagtcactcaagtataaatagcacatgaggaatttgtacttaggaaaatctggccctaaaaactatatttgcaaccatgacttctaattcacggagtttcataagaataaaatcatcatatgattgcctaaaatgatttatgaactataaattctttaattattgaaaataaatcaagttctcaaaaagtagaaagaaacttaaaatattatggagatgggctttttaattaaaattctagggtttaaagattatttgctaagattctatacttattgtatgaaaatagaaatatatttagagggaaatttgtagcactacatgcccacagaggaaagcaggaaagatctaaagtcgacaccctaacatcacaattaaaaagaactacagaagcaagggtaaacaaactcaaaagctagcagaagacaagaaatgactaagatcagagcagaactgaaggagatagagacaagaaaaacccttcaaaaaaatcagtgaagccaggaactgttttttttgaaaaagatcaacataatagatagaccgctagccagactaataaagaagaaaagagagaagaaataaatgacacaataaaaaatgacaatggggacatcaccactgatctcacagaaatgcaaactaccatcagagaatactagaaacacctctacacaaataaactagaaaatgtagaagaaatggacaaattgctggacacatataccttcccaaaattaaccaggaagaagttgtgtccctgaataggccaataacaagttctgaaattcaggcagtaattaatagcctgccaaccaaaaaaagcccaggaccagatggattcacagctgaattctaccagaggtacaaagaggagctggtaatattccttctgaaactattccaaacaatagaaaaagaaggacttctctctaactaattttatgaggacagcatcatcctgatagcaaaacctggcagagacacaacaacaaaaaacgaaaatttcaggccaatatccctgatgaacttcaatgcaaaaatcctcaataaactatgggcaaactgaatccagcagcacataaaaaagcttatccaccaagatcaagttggcttcatccctgggatgcaaggctggttcaacataagcaaatcaataaatgtagtccatcacataaacagaaccaatgacaaaaaccacatgattatctcaatagatgcagaaaaggccttcgataaaattcaacagtccttcatgctaaaaactctcaatgaactaggtattgatggattgtatctcaaaataatagctatgtatgacagacccatagccaatatcatactgaatgggcaaaaactggaagcattcctttgaaatccggcacaagacaaggaatgcccactctcaccactcctattcaacatagtattggaagttctggccagggcaatcaggcaagagacagaaataaaaggtattcaaataggaagagaggaagtaaattgtctctgtttgcagatgacatgattatatatttagaaaaccccgtcacctcagtctaaaatctctttaagccaataagcaacttctgcaaagtctaaggatagaaaatcaatgagcaaaaatcacaagcattcctatacaccaataatagacaaacagagagccaaatcatgagtgaactcccattcagaattgctacaaagagaattaaatacctaggaatccaacttacaagggatgtgaaggagctcttcaaggagaactacataccactgctcaaggaaataagagaggacacaaacaaatggaaacacattccatgctcatggataggaagaatcagtattgtgaaaatggccatactgcccaaagtaatttatagatttgatgctatccccatcaagctatcaccgactttcttcacagaattagaaaaagctactttaaatttcataaggaaccaaacaacagcctgtatagccaaaacaatcctaagcaaaaagaacaaagctgcagtcatcacgctatttgacttcaaactatactacaaggctacagtaaccaaaacagcatgttattggtaccaaaatagatatatagaccaatggaacagaacagaggcctcagaaataacaccacacatctacaaccatctgatcttagacaaacctgacaaaaaacaagcaatggggaaaggattccctatttaataaatggtgttgggaaaactagctagccatatgcagagaactgcaactggacctctccctttcaccttatacaaaaattagctcaagatggatcaaagacttaaacctaagacctaaaaccataaaaaccctagaagaaaaccttggcaataccattcaggacataggcatgggcaaagatttcatgactgaagcaccacaagcaatggcaataaaagccaaaatggacaaataggatctaattaaactaaagagcttctgcatagcaaaataattaaaaaaaactattatcagagtgaacaggcagtctacagaatgggagaaaagttttgcaatctatcgatctgacaaagggctaatatccagaatctacaaataatataaacaaatttacaagaaaaaatcaaccgcatcaaaacgtaggcaaaggacatgaacagacacttctcagaagaatacactgatgtggccaacaaacatacgaaaaaaagcccatcatcactggccattagagaaatgcaaatcaaaaccacaatgagacaccatctcacaccagctagaatggcgatcattaaaaagtcaggaaacaacagatgctggagaggacgtggagaaataggaatgcttttatgctgttggtgggagtgtaaattagttcaaccgttgtggaaggcagtttggcgattcttcaaagatggagaaccagaaataccatttgcctcagcaatcccattactgggtatatacccaaaggattataaatcattctattataaagacacgtgcacatgtatgtttattgcccagtgttcgtaatagcaaagacttggaaccaacccaaatgcccatcaatgatagactggataaagaaaatgtggcacatatagaccatggaatagtatgcagccataaaaaaggatgagttcatgtcctttgcagggacatggatgaagctggaaaccatcattttcagcaaactaacacaggaacagaaaaccaaataccgcatgttctcactcataagtgggagttgaacaatgagaacacatggacacagtaaggagaacatcacacatcagagcctgtcaggggtgagtcctagagggagggatagcattaagagaaaaaccaaatgtagatgacaggttgatgggtgcagcaaaccaccatgacacatatatacctatgtaacaaacctgcatgttctgcatatgtatcccagaacttaaagtataatgaaaaaaatagacattctaaatatactaattatccatctatctataggactagaagttatcaatggcaaaaatcatctgttgaacaaaagaaggtctcatttttttctcaagctgaagtaatatacccttaacaaagaaaaataattctcctagaactcctacatttaaattaaattatttttgtattatttacgtatgcataagattaaatgacttaagttccatatgctaatagttcctatacaaatattaaaccaaaagagatttacaacttacatataataaaaactgcaatcaaatacaatcgaaataaaaaatcattattttagtatatccaacggtttattgtaattatgtcaccttcttgcaatttccatgtggtattaactacttctgaatattttttttgaaatgcatgggatgtcatcggtgtgtgccatataacaattcaattctcccagaaattttttgtgttatttacgttgtattcaaacaagtggttcttgacactttcatacacttggcttgaatggatcattacatattaagccttcccctgttcttttttattagctcagaacaattaaaatatacttgacccttgaaaaatgtggagattaaggatgccaatcccccatgccatgtaaaatttgtgtataactcttgattccttaaaaacttaagcagcctgttagtatttgactggaagccttctcaataatataaatactatattaacaatattttgtaagttatacatatcatataccatattcttacaataaattaagctggagaatagaaaatgttattattgagactataataagaaagagaaaatatatcataaaggtcttcatccctgtcatattcacattgttttgagctgaggagaagaaaaggaaggtcggtcttgctatctcagaggtggccaagcagaagagatagaggaggtgaaaggggaggcaggagaagcggcacactcagtgtaacttttattaaaacaaaatccccatgtaagtggacctctgcaggtcaaatccatgttgttcaagggtcgactgtagtactatttggcacccatctggttgtaaacacaaataccaatgtggacactaaaatctcaaggccacattcacttaaaagttggtcatccaggtaaaccagcacatggttctaccagtacttttagatgatgataaaaaaggaaaaggccaaattaaagatcaattatcatggagagattgtagacctccacagacttctgatagtccaagggccctactttgagaaacactagactagcatatcatctttaaagcattatcattgtttccattttctctttcaactggctaagcttggttcctcatttcttctaaataggagactgttgtagccattgacatttttgtaatacctttctttttaaggcaatcccaagtttctttcccacagactagcaactagccaaatcagggcattatttttatgatgtgatatttttagaggtaggaaattatagcttctcaaaaggagactgcatgtatttgggggtttgagaaaaaaaaatcacacctgtgtatcccaggatgaagcaagtagatataattaaaacaaagattgatcaagctcagtagttttcaacactgactatctattggaatcaccttaataaagcactgttgcttgggcaacacccagggcttatgattacttggtctcaggtggggcaaaggatatcagcattttttaagagaatttattttttagggaagttgtttttagaggagatttgggtttatagccaaattgagcagaaaatagatttcccatataccccatattgagcagaagatatagagatttcccatatactccttgtccccacacatgcatgattaacatccctcacctgagtggtacatttgttgtagttaatgaacctatattgacacatcgttatcacccaaagtcaatagtttacattagggtttactcttggtattatacatttgatgagtttatacaaatttgtagtagcatgtgtccatcattatagtttcataagcagtactttcactgccttaaaaaatcctctgtgctcttcccatttatcagtaatttttaaaagctcttcagttaaagctaattgtcaatcaggcttaagaatcactgataactgaaagaaaaccatccatgtcactcatatttttacatactctctgatgacatccagcatctgagagttgtatctaagctccatagcatggtctgtaaagacttctaagacctaacaattgcttacctcattctcatcatgtctcaacatttctttgctgggttacctctctaagataatatatctgttaatgtggtttattcaagctcttaaaagttctttgaacagaagttcaaaaccagtgtgggcaacatagtgagaccctgtctctacaacaaataataataataataagctgggcatggtagtgtgcacctgtggtcccagttactcaagaggctgaggtaggaggataacttgaacgtgggagatcgaggctgcaggaagcggtaatcatgccactgccctctagtctcggtgccagagtgagatactgtctcaaaaaaaaagttctttctataactgagggggtattatgggtggggcaaaagggttcttcttgctgtcttgtattaagggtaattattgctaaaaatgcatggggttcttttctattaaaccagattggccttggaactattctcaatacagtgttccagacagctaatagtagcagagaggagttgggttatgaaatgcatctacttatattacataacttaatatagtctttgtaacaatgatgaggctgtgttctcagatgagattaaaattgcacgtgtaatttattcttcaaaatatttaatccttctcagagccatattggtgaagcaatgcccttgctccccacagaggagagcagagctaggatataaatatggttaatgatgaaatacgtaaaagaaagttaaaaatcttcaaattaacctgaagctaattctgaagcagacaattctcaagcaacactttgatgtaagttcagttattccacaaatacatattaagcatgtagtataggccagatcctaaaaaatggtattcacattccctaattcaccaaatccatacaagaaacatgtaaatcaagtattattgttttgtgtgtatagatgaggaaacagagattcagaaatattaactgactttcccaatattgtccaaactaccaaattggaaggctaggatttaaaaaaataaggccttaaaactccaactcagtattcctactgcttcattcattcggcaaatatgtttttggagaattacgttagtggattaaataccagaaagacctctaagcttttctggacctagttataaaatttaactcttacagtgctgtcttgaagatcgaatgagcaatgtagcaaacatattttggaaaaaaatactgtacaaatatgagttattggcaggcttataatgagcacacactctttacctgacatacattgctgacttgtttctaacagtatagtccttgaagtgcactagaaaggaaggtaaacggacaaaatccacttggtaattttaaaggaatgcacgggtatgttagagataagagacataatgctcagttaacaggaataagagctgaagggaagatctgaaatatatttaagatcttttgtaaagactctttacaaaaaacttgccaatgtgaataaattcttgaattttctttggaataggatgcagatctgccatgtttcttaaggcattttgtttatctctacatgtatgcaaggtttatttcccccttacctaagcttaggcaaacactaattttcagccccaggcaagagttttctttttatagacatgagagtatccaattgtgtgaaccctggaatgctaaattgaaaccctattcctgccagtaatcaatttgatgatgcgaacatttcataatataaaggctccacctctttcattaaccaatcactcaggctgctttgaagcttttaaaaaccacaaaaacagacaacaacaactgaaaccacaacccacagtgaaccttattaacggaaatattttatatattgttattttcatattttcacttatcatttggtaggaataagagcctattgctcatttttattccatggatgtctacagaaaacccaaatcatacgtcaagtgatgattatttccttcatttttgtgaaggatatctaaaatttatataaggccagatatatctctctttgaacatgatggttttaaacaagtcaactttaaaacatgtaataagcagaaaatttgccatcttgattttttagatgaggaaatctaagcagagaataaaaaatgagtaaaaatatttcttaggatttctatggtaaatatttataggagtatctgcctagcaaccttgtaatgtaggatgccctttcacacacataggtggcccctaacagacatgtttctattacataatgttgcaccactataattgattcatccaagagtggtcagatataatctgagccaatcattctcccctcctgatatttggaattgggaccaaggtatagtgaatccaagattctgatctaaatggtagactaagctgatgcaagaactctgcactctcactccaaacacttagaaataaaatatatatatatatataattgtaataataagttaaaagggacaaaaatgaaatccttaaatgttgaaaacagagagaatcctcactgtaagtagaaggcgaagcagggctacttttaggaatagcatgtctggtatatacccaagaactggggctttatgcctcataggcatgatacttgaggccaaaagttccatacatggtgggcagttggaattggaccctatgcacaagacaaaaaaaaatccgcttatggtcttgggaggcaacatgaaaattataataatttcaggctaataattccaggtcttggaaggtataaaaggacatactttacgtacctgctcagattttcttggtgccaaattactgtgtaccatcaacaaccatgataccaccacttagaaatgcagaaccttagaacatatttctttctaaagatacattcagagataaaaattatatatgtgtattagtccattctcacactgctatgaagaaatacccaagatggtaatttataaaggagagaagtttaattgactcacagttctgcatgtcttggaggcctcaggaaacttagaatcatggtggaaggtacttcttcacagagcagcaggagagagaatgaatgcaaatgggaaatgtcggatgcttataagatcatcagatcttgtaagactatcatgaggacaggatgggggaaattgccaccataatccgattacctccacctggtcctgcccttgacacctggggattatggggattacaattcaaggtgagatttgggtgaggaaacagagccaaaccctattaatacatatgtcaatctattaggttggtgcaaaaacaattacttttgcaccaacctaatatgataggaagaaattagactaagcagcaaatatgaggtaccatatgcgaagaaaaagaaataataaaattatctaaaaacaattttaaaataattatctttaatattttaaagtgtgcttgcactcttcactgtaccaacccacaggtgtctttaaactcatgactggtagagcagcaactggatttggacttctgcctgattgcctgttttctgataagtttaatgtactttgtgaaacctctctatcatgctgaccatgtctcacagaactcggtgaatgatgcctgctgcatcacgtagcgtaatattgggcacacagaaggtgctctctacaatgtccctgccatgctaaagaggctggtgattattgtgaaagagcctatgtcaagacctgcttgctcatggtcttcacagggacaaacacaagagaacaacatagatgacattgaagtgaaaggaaagtatatggggttggctatatgggacacagttgggcaggaaggtcaagatcacctgaggactctttcctacccagacaccaatgttatattgaggtgttccttcatcaatagctttggagtttagaaaacctcccaggacaaagaaccttagagagtaagcgtttctgccccaatgtgtacagcattctagttgggaacaagatgcatcttctgaaggatgggcacataagacaggatctcaccaagacgaagcaagagttggtaaaacttgatgggtgcctagagatataacaatccaggttggcacttttgtgtgcctggaggattcagcaaaactgaaaatggagagaattttttgaaatgtctgcaagagtggctttgcaagccagatgtaaaaagaaaaatacaggtaacttgttttgtgaaacctcactgcaaacagagccctcgtgtaatttttgatgtgcagtttattaatcttagtgtactattactggccttttcaatttatactttacctaagattacaaatcagaagtcatattgctactgtatttagaagcaaaccatgattattaatgacgtttacatccaacccctctgccccaccagggttgttttactactctcactaccccttctcagcactactgcatgaccagacaccaattcaaggcatttcttaacttcttgctcctttttagaaagaagaaaggctggtaactttaatgaataaggctggaactactttataaataacatgtcctatctgtcacatatcagctgcaagacgctctgatgtagtattattttaaagctttcttcctaattagatttcactggtaatctcattttttggaaatgtgctcatcctgaaaggtacaaccaagtccatgttgctgtaaatcagatagtggtgtgatttcatgttacctcatatttactgtgtaattagtgccatttaatgtattttgccaaaaaaactaccccacattagattagtatttttctaaaattggattttgtaatgatatttgtcactgctataggacattataaaaagataagtaggccaccttggcctagcaaaaaaatacagtctctgaaacaaataaacaagtaaacatagcctctacaggtgacttaaatagtagacagatcttaattactgaattaccactggtgacttaagtagtacacagatctgaattgaaagatagatttgaatcatttgaaatatactacgagagattaagataaataaaatataagggagaagttaagagacatagatgacaggaaaaagagtggcctgagtttaaataagggagagaggaaaaaagaggaaaaatcagtggaattttggaggagatagtggctgagaactttctggaagaaatatatgatttaatctttggattaaaaagtacaaattccaagataaataaataaaaacaaactcacacttaggtacatcataatataaataagatcttaaaggctaccagaaagaaaaaaaaaattgtccacaaaggaacagcaagcagacctcctgacagaaatagaagatgcgaagagatgatcagtcagctgagctggtcaatagaaaggagattaaatgttagagtaaaaataaacttattttcttcctgtcatgtgcaagccactaagcagagagaatgaatgaagcaggtatctctgtggaaaagaaaagggacagatgggcagggagaatagtctgtattgctaacgatttcccaggacctggcttcagccccttgagagacccacctgtcctaggcttccataataatttataatattccaataaaatccattcctctttttttttaaaaaaaaattgcttaagttactttaagttgggctctattatttctaaccataatatgaataagacaatctctcaaatgttccaagaattaaaaattcaaattcattcagtatttattgaatgcttatttatatgtaagtgtatatatttcaaagtgttgctagttgtgattgtgatggagttgaagtggcaacaagaagacatgcaaggccacggcatgtgtttaagtagtttataatcctgtggagagagacaaatatgtacataactgactttaatgcttaacaagattataagagctatgatgagcactgttaattgatttactaatcctcagagcaacagctgaggggtagagagctgaagtgacttctccaagatcatgtatcttagtaagtggtggagctgggattctaacatacaactccagagcccacagaggtatcctccctaatactaataaaaatatcaacaaattattgccaggtactcagtagttttacaaatgtcatcatgtttcatctttaccgtaagatactggccttacttactctatttataaaagaagaaaataaagtttatcatccttaaataaattgactaggattatccagctagtaaatggtgaaagcactattcaaactggaataagtgaaggttgcactcctcttctcaaatacatggtaccacaggtctttcagcatttcttagcatgggtctcctaggagatttcttgcattcagaagtctccagatgagaagaatctatctgtgtgcttacacacaccccaagactccagaggacacatattaagttccttaagaattttttcatcaatgatgtctccagtgatatcatgagagaggccctatgttctgaatttcaacaagcttgtttccaggaaacacaaggctggttgtttcttcaataacccccattatctgtaaattattctatggatgcctccctttttggctttggggagatgaaaatgctctcctctctcccctagagtgagaattggcaataacttctctaaacacaacactctgtgataatctccccccaaaacacaacactgtgataatctcccccaaagctccctgtgctctgtttgtttttactttttcatttattttaaatgacaaaaattgtatacatttgtggtatacagtgtgatgttttcatatactggtacataagagtggtggtgacggtggtagtccatgtctagaggaacagtgtaagtcatcagcacagagaagtaaccaccttaacttcagtggctagttggctgctctccaaattttagatgcagtgtatttagatgtggtgtatgtagcaccattttcccttacatttaatatatagccataattctggtgttacaggaatgatcccacttgaagtaccaattctgttttgatgaaatgacaaactttgcttcagaaaatttaaaatagtggctacatgaggaaacagtagagatgagtagagctggagagagagactgaggctcacgtttgtattagggctaagagtagctaaacctggactacatattgtttggtcccaaaccaatcccaaatgttgacagaaagagccacagtttttaccatcagattttactacaatagatgggactccaaagtgtcacttttttaaattatttttttaatttctttttctaattttactttaagttctgggatacaagtgcagaacatgcaggtttgttacctaggtttacatgtgccacggtggtttgctgcacctgtctgagggagcgctcctttcatgggggcactagctgctggtgcggggtctgttcctgcagacccctgatttggagatggatgaataaacgtacactgatagatattctgctctgccagtccagctgacagtccaagctgcttataggcttcctgctgagtcctgtaaacagttgggacttggccctgattagctagtgaggctcgcatttattctgtaagactaattaacaaaagttgtgagtaaacaccattagaggtaaagattaaaggccaggttcctaggcctaaagcaaacaccatttacaggtaataaacttctgctgaccctcctccccgacagtaggaggcagtggcgaggcagtaaagtacccacggtaggacaaaggacagtcttaagcccatataagtaaacaggttagtaagataaacttcccacattcctttacacttgcaccctaatctttcttgctcctgcaaagacactctggctgcattcagccaagaaatctgaagctatgcaaactctcaggccttccaagatagtttttggctattactatacctatctttaatatttttcccaccagcctgattgaaccccagcacctatcaacctgtcatctcggttttaaggcctgcatgcattaggtagtgttctaacactctccctctccttgccccccaccctccgacaggccccagtgtgtgatgttcccctccctgtctccatgtgttctcattgttcagctcccacttatgagtgagaatgtgtggtatttggttttctgttcctctgttagttagcttccagcttcatccatgtccctgcaaaggacgtgaactcattcttttttatggttgcatagtattccatggtatatatgtgccacatttgctttatccagtctatcattgatgggcatttgggttggttccaagtctttgctattgtatgtagtgctgcaataaatatatgtgtgcaggtgtctgtacagtggaatgatttataatcctttaggtatatacctagtaatgggattgctgagtcaaatggtatttctggttctagatccttgaggatttgcaacactgtcttccacaatgacagacaacctacagaatgggagaaaatttttgcaagctacccatctgacaaaggtctaacatccagaatctacaaggaacttaaatctacaaaaagaaaaaaacaaccccatcaaaaagtgggcaaatgatatgaacagacacttctcaaaagaagacatttatgtggccaacaaacatatgaaaaaaagctcatcatcactggtcattagataaatgcaaatcaaaaccgcagtgagataccatctcacaccagttagaatggctattattaaaaagtcaggaaacaacagatgctgatgaagtgccacttttcaaataaactgtgttccatggagccctatggtttaaataaggtgcctcaggagatgctaaagagaaggatggaaggaattaagtatcttctttaagcataacaacttcttattttactgatatatttacttaaaaatattttttaaacagttacaggatatcagtctaggatctgggaacatatttgtcaataagggttggttcatggagcttatggtctaatggaggagacaaacataaataaccacacaatccaatgcatattacttacctagataagccctttggaggaaggcatacaattctttaaaaaatattgaagtaatttaactagacctgtggttcagagaagacttccccaagaaaaagacgcatgagtaagttcagaaaacatgagaacttaactacatgaagtgatggttaggagggatgaatgaaggagagaaagaaacactccagagagagagagagcagcatgtggaaaggccattggtagaaagaaaaatggatttaaaacttagatgccttcatgattggaatacaaaagaataagggaaagaaaggtatgatattaggctggagagataaatttagaccaaaaagaatttgcatatcaagttagttattttgtctttattctaagaataatgtaaagctattgaaagattccaaacataagaagagatgatacatataacagctttaattaaaaattattttgaaataattgtagattcacatgcaattgtaagaagtaatatgggacgatctgccataccctccacccagtttttcgcaatagtaacatcatgtaaaactgtagtacaatatcagcaccaggatactgacagtgatacagtaaagatacagaacattttcatcacctaaatgatctcagtcatgttgtccttttatagcaatacccactttcctctgttccctcttcttgtttttctcctcctcctcctccttttctttatttttctttcttcctttctttctttcttttttttttttttttttgagaaggtgtctcactctgttgcccaggctgaaatgtagtggtgtgatcatggctcactgcaacctcctccttctggggtaaatcgatcctcccacttcagccttctgagtagctgggacaagaggcgagtgccaccctgctcagctcatttttatattgtttgtagagacggggttttgcaattttgcccaggccatctcaaactcctgggctcaagcgatcctcccgcctcagtcccccaaattgctgggattacaggcactggccactatgcccaacatccccactttcttcttttcttcatcttatacttaatctctggcaaccaccgatcgaatccccatttctgtaattttgtttttcaaatttgcaatataaattaaatcatgcatgtaaccttttggtatatattttttcattctgtgtatttatctggtaatttgttgattgtactgatagtccattcttttttattgctgagtagcatcccatggtgtggatatactgtagtttaacattcacccattgaaaaacatctgggttgtttctagttctggctattcagaataaatctactatcagtagtcatatacaggtttctgtgtgaatataggttttcatttacctgggataaataaccaggagtgcaatttctgggttgtatggtcattgcatgtttagttgtcaaagaaacagcagcgaaactaaaactttagttcttcatggaactttccagttttctttttagattctcattagcaatgttaagtgatctagtttctctgcattctttccagcatttagtgctgtcgctacttcttattttatgaattttaataggtatgtggtggtatctcatcatggttttaatttgcatttctctaagggctgatgtcttagtccattcctgctgctataacaaaatgctttaggctggataatgtctatataatacacatttatttctcgtagttttgaagctgggaattccaagagcatggtatcagcagatttggtgtccgatgaaggctcattttctgttttatggtgatttgctgcattcttgcatggcagaaaagcaaaaaggggccaaacagactcccttaagcccttttataggggcactaatctcattcatgagggctttgcctttgtgatgtaatcacctctaaaggccctacctcttaatgcattgcactggggattaagtttcaaaatgaatttaagagggctacaaacattcaaagcatagcagatgatgaacgtctttatgtgctgatatttcatcattacattctctttttgataaaatacctgttgaagtcactggcctatttttaaattgggctttttcattgctgttgagttgtggagttcttcacatatcgtggatacaagtcctttgttggatatataattcgtactcttgtcctgtagctttcatcttcttaatcgggtctttcaaggagcaaaattttctagtttttaagaagtctaatttgttaatttttctttttatggattgtaattttggttttaagtctaagaattttttgcctaatgctaggtttagatgtccaattgctccagcaccatttgtagaaaagtcttatctttcttctttgaattgcttccttcactggatcgttttttacctttgtcaaaaatcaattatacttattcatgtaagtctatttctataaggggtttccattctgttcaattaatctatgtatctgtccctgtaccaacatcacacagtcttgattactctagctatgtagtaaatcttgaatgaactcagggtagaatgagtcttcctacattcttttttcaatttgttttagatattctagctcctttgcctttccatataatttaaaaaataaccttgtctgtatccacaaagccaaaaagtcttgctgagattttgatagtaattgtattaaatctttatcagtttggggagatgtgctatgttgagttttccaatccatggaatggtatacctttccatttatttagaacttatggccagtcatggtggctcatgcctgtaatcccggcactttgggaggccaaggtgggtggatcgcctgaggtcaagagtttgagaccaccccggccaacatggtgaaacc

SEQ ID NO: 2684 - DNA, 2876 bp, Homo sapiens
agcggcgcgcgccgaccgcggcgccaattggcgagcggctggagcgcggggtttcatgggaaggagttggcccggcttgtctctctgtcagtggcggctgctgcctgctctggaggcaggctgggcggtggcggccgagactggcgggggtggacgcccgggccgggctgcgcccgcttcttgcagctgtgaattcctttggacaattgatgatatttatcattgtgcccagtttctacaaataaaagatgggtggattattttctcgatggaggcatctggagcataagaacagtaattattttcttcttttccaagagaacagaaagaaataatgaagcattggatgatttaaaatcccagaggaaaaaaatacttgaagaagtcatggaaaaagaaacttacaagacggctaaattaattcttgaaaggtttgatccggactcaaagaaagcaaaggagtgtgagccgccatctgctggagcagctgtaactgcaagacctggacaagagattcgtcagcgaactgcagctcaaagaaacctttctccaacaccagcaagccctaaccagggccctcctccacaagttccagtatctcctggaccaccaaaggacagttctgcccctggtggacccccagaaaggactgttactccagccctatcatcaaatgtgttaccaagacatcttggatcccctgctacttcagtgcctggaatgggtaaacagagcacttaatgttatttacagtttatattgttttctctggttaccaataaaacgggccattttcaggtggtatggaaatggcatttcatttggaaatagcagagcagttatctgattaagcaggagttccatattcaattagccataactctttacagctggcaccttgtgatactgaaacctatttcttgagctcatttaactgttatggcttctttgtttaaatagcaataaaactttgtattattctgtagccaacagtacagcatatctttttatattcaactttagaatgcctccagatttatataaaacagggatagaagaaaacacttttggaatgtattgatgttttttgctcaactccatacatatatttttaaacatgacaacatatttcaggaataatactcctgtattgtatacttttgttaatgtgggctagtagattttttttttttaaggcatagaaccttagtattttctgatagatattttataaagctctattaaatgaacatattctctttatttcatagattatctcttttcactgtggtggatctctaggggaagatcccattctgaagtgtaatagactatagtaccctccagtttcttttggagtgtgactggggcatggaagtccactgctttagcacagatcacattgttttatgtagatttccatgtcatattgttgcatatgttagtaaattatttattttgttttagattattctaatgtagattactttgttatttcatgactaattactaatatataattaataatgattttgaggctaggcagtagctgatatcaggtaatcagagtatttgtgtagtaaaatcaataaaaaatggaaatgtcacttagtacagtagatgtttttcctgttttccttcaaaaatgcagcataagattttagaagactaaaaaaactcttcatttattaacaaattaagaatactgactataaatgaaatgtatacaaatcttaaaacttttaaaatagttacataaaacaatacttttaaatttgacatataatgacaatacttaaggcagccatatattttatgaaattgagaaaagttaaattgattgaaaattactaatgtttctgttgttatctggttgatttgagatacccatgatttgtaaattaaaattcctggttgtttaatgaaagaacttttttgggtgcgaatgtatggattatatacatttgtatatctaacttattttaagcaaaaagtttagcaacatataaagtaataaaaattgtattgcacatgtaagaatagggctatagaaggaataatagcctagattttatgatcatgtaaatataacatgttttactgaagtttttaattagtttctgtgtgaaagactgtgtttaaattgtacattgtcaaaaatgtgaatgagttaaataatttattataaagaagattaatacttagttttttctttatgccatatttgtggaagagaatcaatttaatgtgtattaccacagagctcccatatgtttgaaaattaataaccagcaggtacttgataatttgccaagctgtgtaaaaatgaccagtattcctacaatgattgcttttgatgtttgtgttaattaccattgtctataacagcatgcatataaaggtgcatgtgcaagaggtttaagatatttttatgaaatctattatttcatgtatccagattcttttgtggatatgttcactttaaatatgtagaagtaaaatactcttgcaagttaagttggcttaaatgctttccaaatctaatttggcttgcttattcaagttgaaaatttgataatgagggatgaccatgtctggattcaagtttattttttgatgataataattgaatgttgttagcacaagtaaaccagtaacttagctgatggaatcttttttttttttttttttttcttttgagacacagtcttgttctgttgcccaggctggagtgcagtgtcatggatcttggctcactgcaacctctgccttacgggttcaagcaattctcctgcctcagcctgccgagtagctgggattacaggtgggcaccaccaggcctggctaatttttgtatttttagtaggagtttcgcc

SEQ ID NO: 2685 - DNA, 1676 bp, Homo sapiens
agcctgtcctcggggaccctgcttctgctgctgggtgtggcggctctgaccactggctatgcagtgccccccaagctggagggcatcggtgagggtgagttcctggtgttggatcagcgggcagccgactacaaccaggccctgggcacctgtcgcctggcaggcacagcgctctgtgtggcagctggagttctgctcgccatctgcctcttctgggccatgataggctggctgagccaggacaccaaggcagagcccttggaccccgaagccgacagccacgtggaggtcttcggggatgagccagagcagcagttgtcacccattttccgcaatgccagtggccagtcatggttctcgccacccgccagcccctttgggcaatcttctgtgcagactatccagcccaagagggactcctgagctgcccacatggcctaagatgtgggtcctggatccttccccccttctcaccataaccccctctcagtgtttccccaacttctcccttttagcagggtccctttagagcccaactccaggtcaaatctggagctcaaatcccagtgctccctccccaggagtggggccccaactcttccaagataccagcattcctcaagtcctcccaaaacttcctacccacaccctcttcccaaggccctcaggggcagaaaacatctccttcaacccgtccccactccttcctctgcatgaccttgggcaaacccttgccctttcaagccatcagctcctgcctctctgccatgagggctttggatcagattcctcttctcgccaggatgaggacacgcactgccctccatagacacagatgaaggggtgggggtcattcagctcgaatgggtcccagatgctcacttggcctttccctgcaggatgagtgaagacgtttgcctctcacagtgtgtcttctacctgcattttggcatcagagccccccagcccacccaccacaggcaattactagccctagttgataggtgaggtgggtgaagaaggctggaggtgacatgtccgaggtcacacaacaaagcagcatgcaggaactagaaacacatcttcagcctcctcctgggccagctcttgtgctacaggtggggcggagccagcccctcaccttcctggttccctgagggtcctcagggtggaggacaggtttggcccagaaagactagccagaggcctgatggtcccaggtggctctggatatactttggatatggatttaaatggtctctaagagccgggggtagggggcaggaaaagtgggttgtctttgcccctcaaagtccacctacctagaaaccaagcccacggtcttggccgtgaccctgataataaatgggctctctcagaggcgccagcccctccctccccagccggaggcgtcatctctcttctgtaccactagagggagctctgatgcagctggagagcagcgctcaaggctctcgcccctcccctccctaacccttaccttcagtctccaccagcctgaagggcctcctaggggatcctcaggcggcccccaccagggcacaccctactgtccttgtgcctcacgccccctcctcatcctgcaccccttccatcccaccttccctttcaataaacagctgggatggatactgactttgtttcctttctccctg

SEQ ID NO: 2686 - DNA, 1242 bp, Homo sapiens
cagtctgcgcggggcttacaatgttcttgtttctcccgccgtagctgtttgccgttttgctgtttgcctccttgtcacgacctcagcgacggcagatggagccagtggagggagagagacagacggcaatgcttgggtagccagggctccctgccggccccactcctcctgcagacacgagcacgcacacacacacgcgcgcaaaacacacacgctgcccttcgccacacgtagccaagtaaaatacacaaaaagcaactgagataccattcgcacatgaccacatggaaacacacaaatgaacaaacgcattcaggcatagccacatgccagtcacacagatggatagacaagagcctggggtacaaagccacatggcacaaagccacctggatgtatatgcccctacacacgcacacagaaaaaaacatgcaaacttaagtacacacctatccagacaagtgtgagtgcacacacacacacactcacacactctacctgacacgttagtgcatccccattgggccccagtttctctcagcaaattcagatcacccagcctgacttcaaaacctgcccccttccattccccttcatgctggttcctgaatccagctcgttgctccaggctagcaaagctgtccacagcctcatttgtggtttgctcacctgcctcagcaccatcagccagagggggcgaggaacgcggctctgcggaggagcggaatcttctcagcagcgatctgcgaagggctcagcggccacaggagggcggcagagaacagcgctccctacagatccagacgtcggccctggatgctgtctggaatccaggcaaggccaggctgggctgccctaggccggggacgtctttagctcgagcaaaaacccatgaatttcagaattcaggaatccttgcatcccttctcaagctctctagtccctgaaatgccatcgccctcctcagcctcccttccatttctcgttctcctagcactggggctgctggcacagaaggaccctgtggcttttccttcatggtatagcagatgacacccacgctcctccgtgacattccctagggtcccagctgataactggagctagaactagaacccacgacttcttggttctctgcgcaggggtcttcccattgtgtcagctgcagctcctgaaataaaaccataccctacaggccacaaccagacagcatctcaaatccctggcttaaacaatcaatgc

SEQ ID NO: 2687 - DNA, 1521 bp, Homo sapiens
gcaatatattgtttgctctccctgtcctcagtttttttatttgaaaaatgaggtctaatcccactttcatctggttcattcattttagaaaagttttgtttattaattgagagattggttgatatactcaacaagtgtttatacatgcaacaaacacctgtgctaggtagatatggagaagcatgataatattcacctggaactcaaaaagcttgcagcccaggtggtaaaggagcttttaaaaaggaagggcaggccaggcatgagtcactgtgcccggcccatgttgaaatttgaacagcagaggacagaatgaaagtgtgcgtgcctgaagcacatggcatatgccctagaaggtagaaaagggtcaagggtccaaccagatctagcccaatggttgttgcttggttgaaatgaccttttaggatgggtttcattaccaatcggaatttcattaccattctcagaaggtgcctcacggctgagagctcaggacagggaataacagactggcgagatgagtaggcagtgctgtatttttagagtcttgaacattcactttcagcagctacaaatcatggccttcctggatctgcctccaaattccagccatatcctgagtgaaggttggcaaatggtcattcacctctttgacaatagaggcatctcttttaggccctgtaaggattatataatccaggtttacctataaagttaaaaaaaaaattaacagcatagaaaaagtgccgtggatgctttccaaaagctggtcttgtacccatgatataagcaggtgtctcacagcatgtagcctttcccaacagacagtcaacccacactttgtacattcaaactcaaaaaattaatatggaattattttagtgaagttgacatatgatgtgccttaatcaaataatcaaatgagttgtagtgggtgttcttagcaatcaataaattcatttaattgatcaatgaatttacacatatgtttaatgaatatttattaaacattttctttgtgacacaaatgtggaaatatattaataccccttctgttttattctaaaaaccatcttacattaattagcttcattctattttttgatgataaattatcactgcctattgtgtaaaaaaaatgagatctttcaatcaagggctgtacgtctagtggggcatgcacaggacaactctaaaaaataggcgatcccagggagtgacctggccaaggcccagatggagtgacgggggagtactggtgagggattcctccttctaagggagagaatcaggtcagggtgtgtagagtggaatcttgaagaatgtggggattctggtgagtagcaaaatggaagaagattcctggtgggaggtcagcaggagcaaaacccccgagattggaaaacaggtataggatgaggggaacagtgagttgttcaatattcttgccatagcacgtagagagaagattcataggaaataagattgaaaacatccaatgcagaaaagccacggagccct

SEQ ID NO: 2688 - DNA, 6282 bp, Homo sapiens
gcgtgagccaccgcgcccggcctaaacaggggtttttaagcatcagaatgcaaatgcctgcttatttctgtttcttaaaaacttaacatgtccacaaacacaattagcatttaagcaatattttcatgttagcttcaataacacattgtgggacttcaaagtgcttaaatggcattctacctatcattaaggtgtttacaataaatagaagaaatattacagataattttgaaaataaagcaaaactattcccaatccgatttttgctattttctcagcaactcagaaaaattcctaggtagggagaaatggctttaatttgcatatctaatttcaaattgtggccattgtattttcattatctatctcttttgacatgtctgtcagtaacctacttgttacgcatacagacacgtactcgtacacatgcacgcagtgtggcatctcattattctcgaagctctcaagggcctgttttatattgttagactgtaagattgtgagctgctgaaaggcaggaacaatgcctcttctttcatttcacttactcatttccttatttctgctagggttgtgttgtctatgctgcacagccgaaagagcagggggtttggtttatgcatgggtcagacaagtttcttactttttttgtgtctccatttcctcatctgtaaaatggggataaaagcataaacctaggtgatagggttgttgggaacactaaatgagagaattgtggcatatagtcactgttcaacaaagacagacatatacgtttaatattttatataagcatacttttatatccccccacattaatttacacttggtacttacataggtaactcctgaacagcctcattcctcctcatgctgcccctaacactcaagcactgactaaattttttttcacatgaatgaagcaatgacttaataacggtgaaagtgttatactgaagctttcaattgatggctttcccttacaccacaggtctagatagtacttgggggaagggagtgtgtactgtttttgagagaggctgaggatttgacaaaggacctcagagagcaccaaaataaagataacccaaatggagaaaccaggactaaaaagctattgaatttcacatgattatgtcaatgttctcttttcctctgaatcatttgaagctttggaaggaaattttagacataaataactttaatttgtactcttcttatgctcaattatagcatggcatcatttttgatgaatacttcatccagactgattcatttatttctagtagaaagaaggaatgggtgcgactcttgctcattcattattttttcccttatgaggaaaacaaaatagtctcataattaggggattttattgttgatattatgatttattacatttctcatatgtatgttcttaacttttttgaggtataatttaggtacaatacattgtcccagtttgtgcattttgatgaagttggcagttgtgtacagttgtgtaaccaatatcacaatcaggggcagtgactgctgtctctgtgtacttcggaacatttctttctgagcctataaagtgtttggctggcatgcaggggcctgaggaagcttaaggagaaacctcgtcccatgacacataatcctaccacaccctgaaatggatagatggttgggtcatgccagtgtgcacacacagactggtaagtggaagattagccagaattgtgaaagatgctaccatacagccacccagttctgccaaaggagaaggtcacttgccaacggcaaatgtaaatggccatgaatatcctgttctctttctgtcaaagttggttctgagcactgaggggagagacagaattaaaagtagacacagcagcgagtaaagctatctctgtctaatggagtgtctgtatttttgggtacatgatttttctatacctgagatgaataattcattctcaaggaaccccaaagcaaaagtttaaagatgattaaaaaataactttggcttctgatcttctgataactgggaactctgtgatagagacatagaaaactattaggaattaaaaccaaaacaagaccgggctttagggattcccctcacactattatactgtcatggaaggctcaggataaccaggctagccgtacataaagtaattaataaagtaggtcaattacaaagctagaagagttttatttagcgtgatattgatcacatcttgaatcatctccctgaatctccgtatttttcttttttattaaaaacagaatagcgttcttgaagaattgttttatctacacttctgtaattgttctctaaacagagaattgtttagaaggaccagttccctagcaatatatgacctttctaactatacttcatgtcatctcatgcaggccctatcttctgtaaaattaggcctccattgtgtttctcactcaagattcttctttattatttcccagattctctggatggagcattttctttataaacaacatatttgtgctcatctgttgtggatgctcttggtgccccatccagacctcctttaccaggctgatgcacgaacactctagcttctaagaatgttcactgttagcttatagattctccttttctacagagtcacccttggctaagtaggagccactatatcctttagtatacattaccagcttatagccattgattaagggaagacaaaagtcagcccttgtctcaaggtagggccaattctgaagtgaaattcatgctccagagctccctgtggggccaggctacagttagtttctagctgggccacatgcatgcttagcttgttttgccttatcctgctgccctcacttctcttcccctgagaacactaacacaagagtccctgtccaggccctgcttcaagggaacctgccaatcatcatgactgtgaacatttagggcaggtgggtaggagtctgagagtggtaatgggattggagggggtttagcacataatttaccctaataagtgtttgctaaatgagtggattttccaggcttgatgcttggattaaaagtagcacagctgtcttcaaaagatctatttctcaagcagggctgggctccctgattcactcctggattggaaacaaaataagtgggaaaatttcataaggcttattgtcgaatagaaagacattgatgattgttaatgatgttaattaatcaacagggattattaagtgccagcttttcccagcatgtgactaaacacccaggtctgtggtaactgtgatgaagaaaataacctcttttatcttataaaaaaaaaatcttatcttcatgtggagataaaacttactcaaatgaaacaatgaaaatataagactgtgttcacatgacaaaatgtacttcataggtaataagttccaaaggaaattcagagaagtaagaaatcaatgtgggcgtttgtgagttaggcaagtcttggaggaataggtgtgtgtgggagggacaggagagaagacattccaagtgggagaagaggtaagaagaaaggtgtggagacagtaatgaggatactactatttgccaggagatataacatgagaaaataagttccccctgagttcacttcctttttatatttccatcccattatcctatttccatttattcttcattcatttattaattcagtaatcaaatattctttgagacctacactgttccaagaactgcattatgtcttagggatatgggaatgaaaagaatacccatcattgttctcaaggaactgacagtctccagagagataaaattagcaaacagacaattacaatacagggttgtcatggtactttaagagtaagcatagggtgctaggagagaacaaaggagaggcatggaagccagacttgggggaaggtccaaaaaggcttcctgaagaagtgacatcttattggagacataaagagtgggtagaatttagccaggtgaaggagagtgcaagaaaataattgtggggatgcatggtgctttgaggaaagtgaggggtgcagtatcactgatgtgtgtggaggacagaaagaccaagggtggacaataaacgggccagatcagggaccaccctgtaattaaaggagtatggactgcatctttagggccatgataaccattagttgactaaagtattaaaattacttgatcggattatttctgaaacattactttagttggagtagtttgaataggttggtctcgaccaaactggatgctgatagacatgctaagaagctttgttatgcacatggcaaatgatggtgggaatggagagaagtgaaggtaaagtgacataaattggagtttcattggttttgggagaagagaataaaaaagtcgagaataatactgaagaatttacattaagcaactagggtggggagtaatggtatcttcatcaagttagggagcatgagaggaagagtgagattggggaacagatgattactcagtttttgacgtgatagttttgagaatcctggggataatcaagcagagatgttgaataggtgggtctggaagttagaagacacttttggggtggcaatatagatttggggtttctactaataaaccactcactttacttccatcctattttgtttagtggtaccaacaccctcttatttgctcaggttagaaactcatatttccctaaggggtccatggatgggcttcataggattcttgaacctccttgaaattgcatgcacaattttgggtataagtgaataagtgcctttttctagtaccatgagatgtagaattttatggaatttgcaaaaggttacttgacttccctcttgtccccccaaaacaaagagaatccaaagtgacttggggtctttgtctcttttcctctcttctttatatttactcatgcgtcgtgttcttcagtcttatctttgaagtcatatttatatcccttatctttcctcattgctagcctcctagttcagatccttactgcttgtaactttaagaacttacattggaatccctcaactttctaatacatgtaactgcatattttttttctccaaactgctaccaactatattagttgagttcccacctttatgggcagcaagaaaatttaactttgtcagcccctcctggtaatcatcagcttagtttactgattttttgcaatccagttattaaaatctcagactctattcaaaacatcttatctttaattaaattagatatgactaggctgctagaagctgattgaggaggagtagagtgtaattggttctttacctcttttcttctgatctcaggcaactgttctgctgatgggggtatcagagaggtcagggtgactgaaaagaattcactcatgtgattgccagcatgttgaagatggcaagctggcaatcttttctttaaagtcagccaatacctggtctaatttctgggtggtggtaaccagcctccagttacacagcattacatcttaggtggtctttgatgcccagccagcagtcttatggaggtagaacagcttccttctctccctcctggtgggtggctctcagtatcctcctcacatcaacccatcattcatcaatatggcccacccatagtggtgcccaccccttatttggtgacctgggctaggtccacagaaaacttgggatcattggtacacctgcctcaatttgtatgagactgtgagggggtagcaaccttaatgtactaggacttactcatttactctctcttaggattcaacacccaaaatattctatgcattttcttgggactgttaactttcaggtgcagcaaaggttcataacaatcttcacttcctaatgatgctttcagatttcatgagtgattctccagggaacatctggcttggttgggcacagataaatagccaaactgcttccctctcagccccgttccacatggagagaagtaaatactgattcacaaactcacctcttcccaaaagatgactcctcttcccctctctgtttccttcaggggggctgctctactgattcttctgaaaggtcaccttgttagcaggtccccagtcagggatgtatggccttgttgtttttcagctttgaggtgcctctacttggtaactccctaggaaggagtctcagtatgtatcacaacttcatgttaccatcttttaactggtaaccatgatacaatttcttgtctctctcacatatttttcctaaatgttttaacttcgatgactcccc

SEQ ID NO: 2689 - DNA, 1904 bp, Homo sapiens
gtcacctcatagacagggctgcactgggcctcctgcctaggcctgttcgatgaagcaccaacaagccccacagctttgttgcttttgctatgcccactgggaccagtgagagaagtgcggtcttatccctgggaggagagaaagagccagcatctgcaggcgcccacaggatgtcaagaaactgtgcaagagaggaaagaacatacatttgagagcccaaaagaccagggtttaagtcctggttccaccaattccttgctgttttggtcttcgaacagccattgaacttcaagcctcagtttcctcgtgtgttaagtcacatggaatgatggtgatcgatatagacgtgatctcagagttcactccctcatcatacagtggaggaaacgaggcccagggaggggcggaacatttttccaagtcatacagcaagaactcagaggcctcttggttcctgctcttgccttgaggtggttctgcggggcgctccagagcccccaagaaattcttctgaaattcagttctccacaggacacctgggctcctcctctgtcctcccagcccctcacagaggagtagtttcccttctggcctgcctaagtctgtcttgtcttctggacttcagtggccaccatggacctcccaagctttctcttgggctcttccagtgccgacctcagcttggctgcctcacactctgtctggtgggcacttacaggagccatgtccacagaccacctcgcctgggctgtggaggccccgttctgagaccacgtgcagtccaaaaaaggaagctaaaaggggtcagaggaaaacatccccgtgtagggtgagggtgaatctcagtctccctgtcaactctctttatcctgacatccagaattccagacctttgtgggcactgatccctgagactgggctctttaagctctttcactgatccctggggtccgaaactttcagcttgcactttggtttggtaaaccactgactgtcctaccaaacgcccccgcaccccacaaactcaacctgtgctcttcatgtgctatctcctgttcgatccccacactgaccttctgggttagggacttgcatgtccccattttatagatgaggagcctgaggcccagagaggtaagtcacctgcccagtatcacacagcctgagattggcagagccagatctcatggaatgagagccctgtctcacctccctagagacagagcttaattgataactttgagttgatactgaaaggtcacaggaattgcagcagataaggtgttctgaggaactggctctctagcacctgtggtaattaattcagtatccctttttgtgtcccagagaagcacagtggctaaagcgcacagcacaagcttggagatcagatggacatggcttcaaatctcgtctctgctgtttacaaaaagtatgaccccaggagagggatttataccctctgagctgtagtttcctcatccacaatgtgggagcaggattttagaggataccgagagattaaatgagatctttcttatagagtccttagcaaggggcttggcaccatggatggtaatatcatcatgatgatgccaggtattttcattgctattccttattattcatcagtatttttattcattgctattgctggttgtattcatcattaataaataatagcattgtttattaatgttattactaagttctctgctatgttctggggctcacagatgaattacacactgtctttgctctctgagagtcccagcctggaggtggggagaagccccttggctagtgggctgatgataatggctatgatggcacagcattcttttctcagtaagagcaactgactgtccgagggaggttatacagaaaaggtgacatttgagtgg

SEQ ID NO: 2690 - DNA, 2179 bp, Homo sapiens
agagtgggcgtccaggcggctgggcagggccagaatccggcggtggaccctctgggtctggctccctcggggcttacgatgaaaaaaagcgcgtgtgtgtgtatgtatgagaattctgaaacatttagcagaagcagtatattactccccatagtgcagttagctaccttttacctgtttcattggctccaccatacatttctataagggaaaccgtttcattcataaataccctaagtgtatatatttaatatctaagagacaacttttaaaggcataacgatgtaatctcatctaatgaaattaacaattccttaatctaattcccagtccatatttaggtttttcagatgatctcatgtccttttacaattggtttgtggcatccgggtccaaaccaaggtccacatgttgcatctggaccacgtgtttaagcctcttacttgatagctttaaaattagctaacaccagaggtttagatggtgtaaggcaagtctggccaccaggtgacttgatttacattcgttttagtttcgctcagaaagtatgctgtgcatctaccaagtgctatgatgtacagcctgccttcaacccatttacagacagaaaagtaaggttttctgatcccttggaacctgaactgatagcaaagacttcagcataagcatctcactcaggataatgtttcttccttggcgttccctttgacctagttgtggagggcctgaattccatgacaaggactctgaaatttagcttgaaaaccctaagagtaatctcattaatagtccttaaacccttttcctcccatctgaaatcctgctccctctgtgaagtcttcctttactgggcactggtgaacactgctatctcattcgagttcccacacggctgtaaaatccaattctctacttttcacattttgagatgttcgtaagagacggtgtaaagttatggcgaggttagactgtgtaggttggtagtctgactctgccatttaggaacaatgtgaccttcagcaagttattttctgaggtttcctcaggtgtaagatggggcttgttattttttatatcattggttttgttcttggcccatatgcttacgttgtctttgctcatttaaatttctggcttttctactgggattccctgacttcttccattacctatggggaatgcccctccgtcccttttcatgacctcacttgcttgtcagttatcattttctctcgtctcatttctctgttagttcctgctccacgtaagaatatgaactctttgttgcaaccttttttatcttatttctgcccatgaacagtttaaaagggctggagtttcctatttgtttcagttttactcagtttttttttttgcaagaggaaaaaattctctcttgatgccattttagcttctgatattgtaatgaagagtagctgggtaaattccctcttttgttcttgttattttattttagttttttacctgactagaccagtaaccacagtaactatttttgaatttatttctttgcaatattttctccatttctgggtattaattgtagtcagcataatttgctaattttatagctcgagttatttcagaagaactttgtgtgcttaaactgacacagggtctcctcccaaggatcacagactgagataaacctgtgtcagtgtgagcactgtaatgttccagccactaactgttttgaggtagcatatttattttggcttcatgtttagccaatgctgtgaagggaaaaggacctttatctcatttcatgtctcaggcactgtaaaatgctgagtcacagtacacctgagcgctgcagtgatctaaagtttgaggcggcagtgatttcagatttctgccaggcttatattggtgttcaattcctttgctttgatttagtatgcttgtgtaactgtgaagggttgggatggagaggaggtggatatggactgggacggggggtataggaactgtagtatttttgaagaccattgatactgttcacaagtaattgggaactgtgtaatccattacttagacaactccagatatatcattgaggcagtcagaaaatagttttgctttctgctttaactaggtttgaatgtatagagtaagtgatgcaggttaaaatattttggggggatacagaagaaggtac

SEQ ID NO: 2691 - DNA, 1731 bp, Homo sapiens
gggctcgggtttttgtgcgttgagtattcgtgcttgtctggagctcccatggttgccccacggagcgcacgctctgcagcgcctgagggtctgcggcgctcactgcgaaggaggaggggagacccgtgaggctgtcttggaactttcgctctgcgcacctggagcctgagcgctcggcttgggaacaagaaaggagacctcaggcagctccggggcagggcctcgtggggcaccaggcgtgccccaggcgccttgtcccagcgtcggggtgaatatgggaccccattagtcttggctgtaaacaccgtagcaggggccgagaggccacgcgggcctttccggacgcgaaggagttaataaaaggtgttttatgggcgctaggaaacagtgggggaggtgtgagcttctctctctactctcgcccccctacttttttcttttttccctctcgccacccgccgccagatcaaacaggcccgcgatttaactagggcaacacttggcggtaatgagcctgtccgacgcaccccttcctcggcctcagtacccggcccgaggccccagggcccttggggaggagcagagagaaaaatcaaagtttctttcttgttgttttgtttttcttttctttaccttctttctttccgtttctttctgggagtccgtttagaaattccggcgcgcatggagaaacagactcagggagggaggtgatctaagccccacagcacggagggaagcttatctagattcgaacccaggactccaacttcgctcacacacaaacctctggctatacacaggtcccagctcccaggactatttttagcaccgtgaagtatcctaggcacgggaagaatgcgcaccctggtctagctttcttatagccggggaaagaagagggggtgctgagggagacccgccagcggccgccaaagccaagtctggcataaccaggcctcttcagaaaacccaatcctgctggccccaaaccctctttgggaagagagccttggagccctaaactcggtctcagaaacgtgcagtccctgaacccgggagccgagacggagccggcgcccattgagagggtcactggatagtcccccactctccccacgcctgactccagcggcctcccacgcccacgccacatccccagctcccaccgcacagctggaaaagccgagcacagagaacggctcggagctgccccaggtttcacaaaccattctgtgctgagggtctgcagactaggggtccagcccttctcgctgccaccctggctctccaggctcccacccctccttagccctcccttctttgaaaacatctttagagtctaacgtttagtttcttcttctctgcccaggtttcaacgaggtttgtcagacacctcaaatcagctgtggcagaagcagggtcattatttattatttttgaattaaatacatcttttttaaaaaatgggaaaaatggaatggttaccaacttaaaagtaaattccaggagtttactgcaaggaaatattgatgttacaaaacgttaactataggactattctattaaagagtgaaacacgagaaagaacctgatgtcctataattacagaactggctcaataaagccatcagtacaagtgggttactattcagccattagaaaaaatgtgggaattgacatggaaattgttcacgatatattaagtgagaaaacctcctcccatattac

SEQ ID NO: 2692 - DNA, 2458 bp, Homo sapiens
tgaaaaggttggtaatctatacttctggaatttttcttgtaggattttaaaacttatgtagatcaggcatgtagagctgctgaggagtttgtcaatatttactatgagacaatggataaaagaagacgggcactaaccaggctgtatctggacaaggccaccttaatatggaatggaaatgctgtttcagggctggatgccctaaataatttttttgacacattgccttctagtgagttccaggtcaatatgttagattgccaaccagttcatgagcaagcaactcagtcccaaactacagttcttgttgtgaccagtggaactgtgaagtttgatggaaacaaacaacatttcttcaaccagaacttcctgctgactgctcagtccactcccaacaatactgtgtggaagattgcaagtgattgcttccgttttcaagattggtctagtagttaaaggggcaaaagtccattctcatttggtccattagttccagcaattgaaatttatgtgaattattttgattgtagaagcactataatatgtgctgaaactaaatttctttaatattttctattcctgtcagcaccttttctagcagctgccagtttggagcattgccctctaagagctttaaaactatttttttacatgccttatatacattccactaatgacattcttataataatattaaacacatgatcttggtactaacatactcactgtgaacccagcctattgcaaaaataaaatctttttataatattatctatgggatgtcagcacaatataacactctgggaagaagtggagttttttggttattaggttaattttctagtaaaacacgttgcctgttttcagttaacactggtaatgccattttaatatatggctttttcaaatcagttcagtgaaaatagtacagatttaggtttacataactactctgacatactggaattgcatatagagatgttcagtggtcgtttttcattttaagtaatttttgttttggcatttttttgtgtgaagtaaattaatcaactagagaggtgcaaaacgttctcagttgatatctgagtattgggtgcatttggtggcttaaaagcaaagcttcctaaaaagatttttcttggcagctccaggtctatacatttaggtaatgaatggtagtagaactaatagctttaacaggagaatagggaatgagaaatagaaatccaaggctgaagccaaaagtaaggagggtggccaaatggtaaactattggtacttgttttctacctcctaaaaatgtagcttatttttaggatttaaatcactaagtaaataagtatccttgccaagtgatcatgagtgtcatttttgttctaagactaatatttttagatctttttacttcacctcatacttatcaccaatgtatatctccatttattcaataacttactggggtaaaataacagcaataaacctaaccttttaacagggtctaacatgagagttggagtcaaagccattgttatcttttggtgacacccttaaattttaagtcttccagtcttccatgtgaactttaggcccaaagtttcttatgtatcacacatcccccaaataagtgattttttcccagtgctttgtactgtcaactgcattatctttaattatttaaaggtagaattatttaattttgtgatttgttcttccatatgacattgagcaaatagatctgtttcaaaatatgttcccgctatgtggataactcttctttttaaaaagaaaatagagaatagcaaatcttcatgataatcctcaaaagaacaaaatgcttaactttatctcttaatttctaaaggtaaataacctaggttcagcttttgcttaaacattaaatatcttttccattttttaatgtttgtaagctagatatgccagctttgtttctacattgcaaccaaaaactgtttcttttcacttaattataaaaccagtaattcatttactcttgcccaaaactatacactgtatttctgttatagtaacaaaatagagttatgtagaattgtatggaactcaaatttaaaccatgctttcttgtagtactgattgaaacttacacgttttattctactcatagtgagcttattcttattttggattgattttccaaaaccacagcttcagcagcaacaatcagaatgtccaaatgctgtcctttcccttacagagaagaacaatggtaactaaaagctgcatataactagcaataactacattgaacggtgtgcattgttcatgattgttgtgttttaagacttgtatataaactgctttttccaaactctgtataacttttaaatggctggaactactcgtataaggactagactgtatttttgacatgctcctatttttgtaacttgaaaaaataaaattttgccttgtgacagat

SEQ ID NO: 2693 - DNA, 1098 bp, Homo sapiens
ctggagtatagtggcatgatctcagctcactgcatcctctgcctctcgggttcaaggaattctcctgcctcatcctccacgtagctgggattacagataaactcagatccctctactttccaagtgtgagaagattttgttctacagtcgcttctgtgagatcaccacagccctggcaaaccaagagggaggaaccttgtgcctttgaagtgtgattcacagtgcttgataaagtgccagtattctctaaattttaggttcacagcaaattggatggaagttacagaaattcttctatttttaattttaaactaacatacgacaaaaggatttcctgatttatccaccatttcaaaaaaaggtccgaagaaaatgaaggagcctcttcctgtactcatggtacataagcaaagtaaatcattgcttgaccctcagcccacatgggaaaaccacccctaacattacaacagcagtaacaacaacaaacatctacgtgagctttctacagcctctgatgacttatgccttcaggagcttccggattaacaccttgtattcccagaacttgttgacaatgggttcatggaggagaaacctgatgtcttcgataaggtaacagaaaccacagaaatcaaaaccgtggataagaggagactacagaaagatttctccttctggagtacatgaatcaaattgcattgaatcaaaagttttgtgaagatttgagatgagaatgagagccaaataagccatatcataagaagctgtgatcagaaataaaatgaggacaatgcttactgtggctttcaaggcaggagaaagcacacccgagggggtcgtgtcccacactaggcagatctaatggtgccacaaaagacaggtgttttgtcagatttcagccacacactttcacacctgcaacgcattaactaccgcagcaatgttaatgaagaccaggtgcctgttctccagcataaatgaggaactggcaggagatttgctgtttgctacctgacgtctacccctgagtctctgaaccccgtccttctggttgaaggggaagatcaaagagtattttgaagaaaaagatgtacaggg

SEQ ID NO: 2694 - DNA, 1839 bp, Homo sapiens
ggttgcagtgagctgagatcataccactgctctccagcctggctatcagagtgagactctgtctcacaaaaaaaaaaaaaaaaaaaaaaaagtgaaaagatgaatataggcaaaggagttggcatgttctttgagaaagtcaggactttcccagtaggaccacagggatgtttgactggagccattcagccagcaccctgaccctccttcactcatggtctgtgtgtttctccttgcagaggggggatgatccagacggcagagcagtaccagttcctgcaccacactttggccctgtatgcaggccagctgcctgaggaacccagcccctgacccctgccaccctccggtggcccaggtgcctacctccctcaagcctgggaagtcacaggaagcagcagcagtaaggacaaggggccggattccaggtcttcaacactggccactcctctgcttcctctgttggccccagatggacagtaaggggaacctccaatgtctctctgaacttaaagacaggagctggcatttatgacagacaaagaaagaagcccaggtgtcctggtgttctctgagacactctttgtgagcttcagtttcctgttctataacatgaacataagtgcttagctgccatgagggaaaagtaatgagagaagtttctagaagccactccagccactccttcctggggctgacaaaagggtgattccaagatcatccttcacccgaggtcctgcccaagcacaggccagatgcaagaatggggaaaagtctggtcctgatctccaagtctcaacatcctatcagtgactctgctccctgaccacacatcggaagggctggatgaccccaatcaaaagaaagaacaaggactctggttacccttgcctccacccatgtgtcataagagtaggctacagaggtgaccaggcctggcagttgaaatctctggaagagggaacatgtggggactactcagaggcaaagaggagctgctcctgcctccatggttgctggccactcccaccaactactcttagggaggctaagcagtctctgttttgcttccatggctcaaataataccctgggtatgcaggacccactataccttgcatttgctgagtacacctagagagcttggctgtttccaaaaacaatcagggtcataaccatccatgcagacatggaggctcggctgaaccaggactcctcactgtctacctgagagaatgagcacccctcatccatctcagcatcaacacaatttccaggggacctcaggtctacctcaggactgaacgccacacctcaggattcctcctccttgaatctgagactggctgcccattctgagatggggatgaaggtaagatgccgcatcaccaggcacgccgcccctgacagctgccttgataccagctctctgtggaaacccccgaggagttggatctggagaacagctgggcctcctcactcaggacttctctcctgaagaacacgcagtgctaaaactgaggatgatttccctaatgcttctgcttggccttatggaggagctgctccttccttacagccttggggatggacttgcccacacctccacctcccctgagccctgtgagaggcacgactgtctatgccaatgaggctcggtggggggctctcaagtgcctgatcctgccctgggctcagagccagcccagagggaagcaactgcacagccccacaggccctccctggcactgtccccccaaccccatctcagagctcagagggtacaagctccagaacagtaaccaagtgggaaaataaagacttcttggatgactgactc

SEQ ID NO: 2695 - DNA, 6377 bp, Homo sapiens
gtgtgtgtgtgtgtgtgtgctgtataaatctgacttacctaaattctgacatttgtagctgccttttcaaatgctggaagcacagatacatcttgaatgatgtaaaagcacattcgtatttttagcaataaatctttgactgtagaatatcattaaataaattgaaaagcagaccaatattaacatcgtgatttatatgctacttgctgctagagacttgacatagaatactaattatgaaaatggtatagtgctagatttcttcctgaattattacacacattatactttgcagggagcaggtttgacttaaatgtaaattaccaggcctttttttttttttgctctttcaaagggctatttgttgtattacccagtgcttttctgtccctcatagttgaaataattaagatcatttgcagggcctggtttgctcattttgcttagttacattgctgctatggtccattatgtctacaggggagcaccattatttaatctgaacatctggaatccatcatgtgtagtgaaggacaagatgtatcctcatttttaagccaactccatgataaaattgatggatgggaccaatgtgtacaggtgaagaagattgatacttaagatctgtatgttgtgataggaagatcataagaggacttttattctgcttcatttttttttactttatttcattatattgtattttattttatttatggcacagcaatcagaatctgattgaagataaactcatcctatttggatcagagcattagaagaaagaaagaactgacacttctcaaccttctctagttgaagacttctctttgctataactacttgaagagttcagcagaaaaattttactgaagaatccctgatcctcctttaagtagctgtagagaatattcactaagtgtaatgggacacgtctctctcatgcccacttcttttctcttatccctgcaagaaaatgaagttttgttggagtcagaggtttattttagtttattttaatcagaaacgtgtatgaaatccaaagcacatgatcttcatttttaataacgtaaaccatccccatgtttatgtgctttctctggtcctcaacctttttttttctttttaattttaagaacatctgtccccactgcaacttcactttcatcaggaaatctaattacagagatagaaaagagtatagtaggtgaagcaaaagacagcagctccacctcttaatactgaatacttagatgactgccagatgaatagctggatccttttgtggctaactaactcacctggtgtagagaaagacagttgatagatcaaaaaagtatacagataacagagagcaagtgatatggatatgaaagacattagggagcatacaaatgcagtttggccaggatttatttctagttatggactgatgaggagacatggggaaaaattgtcaaattaaaaaaaatctttttggcaaatttaaactttgcctctatcctttttctcttaatctgctacccagatatgcacttcaaataggaatgtgggcctactggggcatgaaatagttgagagctattcaacaatgaggagaatgagagaaatctatttagaaggacattttagaatttaagccagttgaaccttaatagtcacagataatttaacatgacccctaaaccattaggggggtttttactacaaggacttggctctgtattaacaatgtcatccttcttagaaattgataactatagaagttatcctatgtggagtaagataagaatgactgctcttcatgtttacaagagattagagtggataagaaccaggtgaaacaggaatcccaagggatctccttccttctcagagtcatagccattccagggaatctgcacattttctggctttcccatttctatcagatggttacttaggaacaaatgaaaatcagcaaaagtgccatgataattatcacaaattcgtatgaaataatgaggcagttgaatgcattttttctgtcttatctctgtttgtcaatgagctaaacagtgtgttcaggtccctctgaatacttggaggagcaagattctttagccttgtctcactgattcccaaagtttatctaagtctttccagaggaggacctctattgtcaacacttgatagccaaacccttcctttgtttttttccttctatacactacttgttaatcaacttgcacaaaaccaatttctggttcaactttgtcctgagctgctaactggctatgactttattttacaggtgcagtaactttgttagctgttattttgaggagctccagccatgggctcatttgatagatttaattgccaacatcttgaacaaaccccttgattttaaaattttaatttagcatgtttaacatgaaagaggattgccgaataagtgtcccatttgatttactctataagtaatacagctgtttgtctttatttgaaaaataaaggtagacacttagaaatgaaagatgaaagcttggaatgtgacctgtaagtccagaaatcacagaccagaaagcaagaaaggaacatgaacagcacatgtcaagtatccaggaatttctaagtataatgcagaacttggggcatgagaaataatctctctctctctgtgcgtgtgtgtgtgtgtgttttctttatctgagcatgtttttttatatactgccttttctggtaacttcattaggtctgtataattatagtttgcttcaaccttagtctgcatcagtattcattattatctatttggtgcattgtagcagcataaatataactaaattactagggtcaaaccataatgggagctgttgtgatggtaattagagcagaaatatagtccttttttggtaaaacttgcagaattgtagcatgaggtgtgttcttatagggtacaattaaagccaggttgtgggttcaaggtggtaaaatgatggataatgaaggtacaccattaatcacagttccaaaagatgctctgtatcaattcttttctctctgaaaggtagctcagaggttgatgctaagacaaaaaccaacagagggcttagaggtaagatgccaacttccgtgccttcactaattgtcactagaaagctgaaactgtatcgaactctttaaaaggaaaaaaagaaactagtagaaagcatctcagtgtggttattgaaatcattaaatttgaacttagtggagcaatgctttaattctatgtgtctttgccatgttggactgagtctctcacataacatctttagaatttagaatgtgctataacttggagcggaatcacccttattgtctttacacacagcccataatcctgaaaagcagaaacagaattccactcttaaccccctcagtttgcagaatgtctaagtgtagtgactctagactcaatgtgagatgaaaagggaaaaaagaaactgcgtataaatagtactagagtaagttaaaaagaactatcttataatgtgcttaaaattatggaaagtttctgaattctagcctgaaatttaagaacagttctaagtaattccttaaatttgttaagtcttttcaatctttgggttttcagataagacaaccaaaggactgactgcagtaaatagagcttttgaaggcattatcattctattaacaataaagctgagaggatagatttgttttatgattttcacatgatattacttgtcggtgacctgagctgaatttgaactggcattcttgaaaagaaagattccctttacaaatcctttaacctctaatgcagtcattttaattcacaacaggctagaaccttgcataattgttctcagctcaatacaatctttaacagcttttgatttacatattgggcagctgttttgaataagaagttgtccatcatggatccttttgtcatctgtccaaggaatgtatttataaatggttccaattagagtaatgaaggtttcatgtgaaaacaatgatcaatagccaaccttaaaaacaatataagtcaaagacagatgtaaactgtgaccaggcataacaaagtcaagttatctatggggaatgtataccatcgctcctggaaaacaaatagaaattttcaagtctttgactattggacagatgttgattccatgacacagaagcatttagattctgtgttaaataaatcattgacccacatatgactgagactatgcagattaatgagaacaaccgtggccagggaaaaggcagctcagtgaagccagctagatcagatcctcactgtgattatggactgcaccccatcagccttcaggaacagatgtctgttgctataagaaggagccacgttgatagtgaagtttctgtacaaacacgtttcagactatgtcagacacatctggtcaagggctttgtaatagctttatttatttcttgcctgaactggaacgtcagaagcatgcactccacattaagccaagagttccctttgttccacacggctgccacagctggaaccttttgttggatgacacagccagatcttctgtagagaccattatattctttggcgtatttcagtgagtttgcatcttttaatccacctcagcaagcagtggggagttcataagggccatgcacagagccttctcttaaaactgtacaggaacaccagctgggattgcaaaattgatagcatcaaggtggcctgctaccaagttggccttagtgagatgtgctctctgccatagccctgtttgcttagatcatttaggaaaaaaacatcaaaacagaagtaacttctcattcttgtgtgttgaggttgctcataggttactctctccagccaaaaagaaaaaaagccaaagaaattttgtcatagactataagatctgtgtatgatgaacagtttcatgagggttactatagaaacatctagcctacaaaagtagaagggaccagttaaaatgaagttctgcctagatttctaatataactaaagctgtttttttccctctccccctctcttctgtctctctctttttttctctctttaaccacatcaattgacagcccaatttccacatataaaataggagtcataagttaaaagaaggtgggggctgaaaaacaaaagtagatattcagaaatgtgcacctagaaaagtctttcagacacattgagttgattttgtttggcctgattatcagaagttcagtgccgtttttagttttcgggaacacagtctcaaacatgagagtagctctactccagccccggggcacccgccctcactttgcctttgccacatccttcctaccaactggcccccaactcagaataaaagctggtctagcctttccaattggcaagccaatgacattcacctgcatttctcttgctagtgatcctcttaactaatgcttaagctccaatttcttgccatagtgcttatcacagattgtactcctaagactgacctccagatttatctcctgaagcatccccatcaagagtgtctgatgggggccagacgcagtggctcatgcctgtaatcccagcactttgagaggccaaggcaggcagatcacgaggtcaggagatctagaccaccatcctggccaacatgatgaaactccatctctactaaaaatacaaaaattagctgggcatcatggtgcatgcctgtaattccagctactcgggaggctgaggcaggagaatcgcttgaaccaggaggttggaggttgcagtgacctgagatcacgccactgcactccagcctggcaacacaatgagacttcatctcaacaacaacaacaaaaaaaatagtgtctgatgggaagaaattctcctccagggtctactccatcccgaagacatttctgaaatgattgagaaagccctcaagcataacttgtcattgatgttgctagggcattctattaggaagcagatgcagaaagagctgtatgtagttaggggcatgcacatgtgtctttgctcaatatagggggttgtatacagttgttctccccacacagcatacaggaagtttaaaattaagctatactttacttacatggataaaagtcttgatttttagttttaactaagtatttgctgttttctgttcaaaaagaatgctgggggttcatgtcagtgacagagtgaaaagctagagcagtagcatcaagatataaaccaaggctcattgtctctcttttcatatatattactttttaataaatctatgtttttctaattacagaagtagtataagctctttaaaaatttagcaaaataatagatgagcacagaacagagaaagttaaagaaatgaattttatgcaag

SEQ ID NO: 2696 - DNA, 41152 bp, Homo sapiens
ctgatttattcactgattgtatacaagtgcttcttacattttaacctcacaattattgtttaaatttttggctaattttaaaggtgtgaaatggtactatattctgtatatatctttgcttaataattgacaaagttgagcttttttttcccagtattgtgttggataattgaacttcttttctgatcttgatacttttgcctaaattactttcaatagcctgactggccttcctcttccgtcacattttatctcctcctgtcagagtaatagttacaaaatgtatataatcaacccactgcaaaaatgaaacaaagagaagttttaatacctgttaactgtcaagtaagggcaaactcttcagttggtatctcagactttccatagtcaaggtttaactagccttctagccttttctcacactatcttccgggtagtgtaagtgttagccacaatgtcatactcttattcctgaggccccttattttcctcttccatgcattagtcactctcatctcttcatctgaagcccctctgttccaaccctactaattaggaaaccatcaaatactacacctttctgaaacttacatggtcattccattagaattaatctagtttgtattttcattatgcctttttaaaacccaggttttagtgcttattctccccttaaataacttttgatgtccaaatctgaattttccattccattttaagttcgttgaagtaaggggctgtccttaagcaatctttgattctctacagtgcccaatacagtggataagacataacaaaatttagtaaatatttgttgaatggtttgagttcaataaacttaagactattgtgaaacttatagaggggataaattgttagactctgtaagtgaacagagatgaatcctacatagcttaacttacaattgagataagttacaatatccctgctgccatccattcataagagaagataataaaagctcagaagggacatattattaagaatggttatgaatataaagaagcccttgtgctcttaataatataatttaacatgaggctgtatatttgagcgcttgtcaaccccttgcttcccctcccacataatagttctttacttatttgcttcatttgttaggatgatattttaaagattggcttagattgaggtggctcacccatttaatttcattaagctatgattataaaaaatactataattctgtccattcattgattttgacaacatgttttttattgtaaggcgatttgggactgtgctgcaagagaaggtgaccttggtagaatctaaactactgtacttcttgacacagtgagggaaagcagttgatattggtattaacacaattatgttgttaaatgcatcacaggtgaggtatttaaagcaaattaaacaagtgacgttcttatttcataaatgcatttaatctcatgcttggctgtttttatggtagaattacagcaatggagaaaattaggcaagaacggaagaggaacagatttgttcataaacggacgcttagaatttgaacttaaagtgagtaaggagcatcaaaagtcaaataggacaaacagggtagatggtattcatggagacaaaggattaactgaggttattttaagactatttatatggaagggatgacattacatagggagacctccaggagtcctgactttgagccccagctatatcaatgactcacactgtgtaacctggaacaaattactcaacctctttgtactccatatttcttatttataaagtgtacataattttatatacgataaagttcttgcaagaatcaattagaaaagaggcaagaaaccaggtacggtggctcatgcctgtaatcctagcactttgggaggccgaggcagggggatcacctgaggtcgggagtttgtgaccagcttgaccaatgtggagaaaccctgtctctactaaaaacacaaaattagcctggcgtggtggcacatgcctgtaatcccagctacttgggagggtgaggcaggagaagcgcttggacccggaaggcagaggttgtggtgagccaagataacgccattacactccagcctgggcaacagagcgagactacgtctcaaaacaaaataataataaaataaaattaaaaaaagaaaagtggcaagaatggtttcaaatgtgaagtaacccatatttatgaggtagtattgatatcctgttgtaaaaaccttatcatcctaccatatttgaacttgattcattaattaactcagaaaatatttagtaagtgcaggcactgtattcattagatatgtaatagtgaatggaacagaagatctaattcctgctctcaagatacttatgatctaataagggtcactagttaacaaactgatactgaaaatcagagtttgtcttaatagtttccctttaacccacttgccagattagctagtgttttccatttcatctgcaaaacacattgactggcgtctcttatacactgaatgcctgggtagtaataatatctaatatttatacacaacacttaacaccttccatgaactgttttaagtgcgttgctcaaattaactcctttaatcttcacaacaaaaccttaattaatgtcattctcattttgcatatgaggaaactgaggcacagagaggttaagtggcttgtccacggttaaaaaggctagtaggtaatggatcaggattcacacccaggcattctggctccagagcccacagacttaatcactaggtaacaacactagcaggtctgtctattactgctctcaccagttgaattgaaaccttatttaaaggtcatctgtatttgttcccaaacatgtttataacagttgtactagattttttatgtaatttaatcaaatatcatgtaacatactagaaatgcaaaatacaaatgtggttttggacatttataaccaatttgaatatgctgataagacttaaggggtgttgcctttaaaaagttgggtgaagaaaatcaggaatcaggaatcaaatcagaaatgggtgaaagcgaagagtaaactacctcataaaacatagacatttgctgtagttggcctcatatgcctttatgctctcattttaagtaaaaataaatgaaagtggaaaatacagaaaagtacatatttatagtgagtgaatcactaccaaaatacaaagtcttggccctactgtaaacacttgaaaagtgaattaacatttatatattttaagttaaaatatatgtttaatatatatccacaggccaggcatggtggctcacacctgtaatcccagcacattgggaggccaaggtgggcagatcacttgaggtcaggagtttgagaccagccttgccaacatggtgaaaccccatctcaacttaaaaaatacaaaaattagctgggcgtggtggcacacccctgtagtcccggctacttgggaggctgaggcaggagaatcgcttgaaccctggaggcggaggttgcagtgagccgagattgggccactatattccagcctgggtgacagagtgagactccatctcaaaataaaattgtacacataaaattgtacgcgcgcacacacacacacacacacacacacacagatgatttttgtgacatcacattttgtcaacttttttgattaacctactaactgtcctgtaagaaagaaatattttcaaatacctccacttccaaacattagaactatggctggtgttgtaggtagagccatatgagtttctgttactgcaagagggtgaatcacagtatatttcttaaaggccgaaccatagaggatggattgtggttcccagtgtggtacacaaaagatagattgtggatgccagcatggtatgtggaggactaatcgtggctcacagagtagatttctttttattccacataatcaactctgttcttctttccagagcaacaggatgtggtagaaagaatcctagattctaatcagaaacagcctttctctatgtcagtgtgttcttggtaactaacctaacctcactgtgttcttgggaactaacctaaccttggcctagtttatttgaagttggcaatttcagtaatgtttttagatctaacatagccctcaatgaatattagttaaatggacctgaaaacactttggaaatcacaaaatattaaatcccatattttcatactatgaatatattgtttgctcagttattgttacatctattttattatacaatgattagctataaatctgtgagctccatgagattccagatcttggctcattaatttttgtacagacacctgcacctagccaagtgtctaggttcttctcatatatagaaggtattcagtagatacaatttatgtgaactaattagaaatcccctattttgaaccagacattttgatggtaaaacttattttgataggatataaaatattcgtatcattccagttttagatattgttatagaggtgtttttcttactttctcaaagtctactaaaattatcaaagaagtcaaaaaagagggaaaatattgtcatctccaagaaagcaaggaagcctcacaactgcaatgatacaaattacgaagtccatatattaaatattgaaatagataatcaaacccactaagagatgttgactcagacattatcaataggtgcctttcccccaaaaatatttggtagtttttgattaaagagagcttagtttctgcgtgatacataagaaaagtagagaataaccacgtagaaatcccgcctgagactctagaatggtagggaagggaagcctcagagggactttctgccaacaacctcgttctattctctaccactttgtctttcagcccaggcagtctgtcaaagaaggtggaagaagtaggtggtacactgctgtagggaaacttgctgtgatccatgcaaactccttaaataaaacaaacaaacaaaaagaaacgagggaagaactactttcaatgttaagaaaataaaatatttggaaagaagatgtttgagttcgtaagctgaaatagtggctgccaacttcctcagtacatttccagctatccccttcctcttcccctccccattgtactacttggtcagttgctatctcattcaaagaggagtagcgatcagaaagggaacagtggataaactcatgcataaaactaccattttctgtttcacacatggagaggaaaacaagcaaataaatgacacaagtgtatatcacaacaaatacgtattctaaaaatagggttcagaaaggagacagatgaattcaaagaagagagtatacagcaataaaagcagtgaaaacagaacaagagttcagtaaaaaatgaaaatggaaatgaaaaaaatgacagaaataaaatagacactggaagcaacacaaatagaataaacttgattgaaaacaaagtcacaagcatagatactaggttggaaaaaaatctgacaaaatgaaatgtgtatgaacagtgtgaagtttttataatgaagaaagatacggaagacagggaaaagagagacaacatgtacgtaattggtgatcctaagaatagggaacagaaaaaaatgaatcaataaaaataaaaaataaaaagaagaaaattgttacaaagatttgaatcttcaaattgaagttcatactctgttctaggacaattttagatagaacaatgaatactgagagatactttaaactgtttcctgaactccaaggataaatattcaaccagatgaacatttatggaaaagataccagctacatgtaaggagaataaaggttggctttcaatttccacgtaatatgagaacccagagaagcaattactacacaattctgaaggaggggaagtatgactcaagttttattttcagtcaaatatagtatcaagagaaagacattctgaaacaaaacttagacaatatagaaccctggagctcttctttaaactcatgtgcatgcacatacatgatgagtcaacatcagtagctcaagaatggaggaactctgatttaagatggttagcatcaaatctatctatggataaaaaataacagctttagaaattagagaatagcatataaatggtataaactatgataatgaaagcatgttaatgaaaatgattaatatgtgacaaggtaatattggaagaggtatcagttaatttccctaactacatagcatggggttaatagctactacctaatgttgaaatagacagatgattctaacctcctaaagtttttccattttttacctcaactttggagtgcccttgtagaaaagaaaacatgttttgggtttaagaaacgtttacctgaatttcagtttttagttcaaattttctttagtcaaattaaaggaaaagaaaatataacatttaaatattaaaatgcatatataatttgatttcatttttttcaaaattaaggcttatgtatgtatacatctctctgaccatttttctaccttggtaaacatttagctatgtttggaatgatgtttacttggtggtagagatggctgttttttttctgataaatggaatttggatgacttaaagtgaaactttctgaaacttctctttattacttgaagtttttatataggacatatatcatctcaatgaaagaatagtcattcttttaaaaaattacagccttaccaccatctcttctttagaatttttttccattagctactaaagaaagtctttggcaaatacattataaattttggaattgaagtacaaaataaaagagatcataggaacagtatcttctccaatattttaatctaaaaactaattttgtctagaagaatatatttcaagaatgcatatgttacaaacaggcaccacctgggattcccagataaagatatttcttaagttatatagtccataatctcacaggttatacaattaggaagtatacagtagttaattaaagctgtaaatagaagccaagattcccttcaacaaaacagaatgacataaattacaatttttgtgtaaacctattaccactgctgcatcaattttataagggatctatgtaagtctactgtggttataaatttaagaaaatcacttgtacacctgtgaagcactaaagcatgcatggtgaagaatggtaggaaaagaaatactttttctagtgaaatgattagtgcacaatagtgatcgacttctacaatgaaccaaaatacaaactaatgttgattctttgctttaaggggaaaaaaggttattttttacactcccccttttgtctctgtccttcatcacttgtttttagagacaaattctctggagtgtttataaaacagcagtcctgggaaaccctgatttagtgggtttttagaccttggggctctggggtaccttttcacaccccaaatggcacactgggaaggctagatatcagagatcaatctacatccttgtgagagtgggcctgtatcttttctgtattcaccagtaatgactttaaaattcatgcaaatcagaagtgcacatttggaaaaaaacttccaggatattacatcagagtaactgtcaacctctttaaaggaaaattttgattatactgagctgctttacctgcctattaccttccttcaaattaattattcctcagatttaactgtatggtattaatacttttaatacttttgtatcaagaaaaggaagtaatctgtactcatagccatcaacaagtataactgtgcttttaggagtactgtgtttgccgaggtcatggtatagttcagtataaagtgttttaatgtgactttttgcacagcacgtgaatggactttgaaatagcattgcatgtctgagaattctgtctctttaaattgtctgctttgcttattggaaatgataacaatgattgtttgaagttattattaatttttttagttttaacaaatcctaataaaggaaaacatatctattaaaaactgaaataactactcactgaaataaacagcaaacattatagatatacaactttaattttgaatggtagagaattttattaaatgaagagaggcaacttaatagagtattaaggacagacaccagatgcatttgacagatctgaatttgagtcaggttcttacacccattagcatttttgactttagtcttttcacctaacttctctgagccttaatttctccatgtagaaaatgaaagatgatgtctttcctatctcgtttaggattgctgtaatataataatatgtataacagtattgcttaaagaatattacctagtggccattgcagtgcataagaactggtaagatgccttacctggaaaatataagggaaaagtgttggtttttttaaaatcatgaaaagataagattgaaaatggcgtgtctttgctgctaattaatgattgctttatgttcatggagctgtaacatttttcccacctgcagaacatattatagtaagctctagttatattttctaggatcgcttttaataaaactttaacaaacactcgtgaattccaacaaaaatcttgatcattttacagaagtgtatatccaaaaccaccgtgaagctggaaatacatcaaagacgtgattacatttgtccaagttaagaggacaaccaatgagggcacaatggacagggttctttaggtatgttgggtataaattgtgataatttttatcttcgtagggttcctgaagacaagcaagtaggttttatgttttctaagatgaaaaagaacaatgatgctttttgaaataaagctttggagaaagtctgcagaataacaaaggttttcatcattctaaaatcataaaggcaaatatttataatttcctcacaattgtgagctataacaatttatattatatcaaataatttttaaatgaaaaatcaacctaaagggaaaaggggagaagatactatagagaggactgacctgtaggtgggcatctaggagatctggcaccgaggtggtggcatttctattttctctgggtttcagttctctacccatgaaatgaatgggttggactagatgatccctttcagctctgaaattccgtgaccttgtgacattcttcatactctgtgacataggaagtgcatcacacactgtagggttttccccttctgtcagtacagtgcactgcacagtggataagaatgtagactccagagccagagagagttgtgtttgacttgtatctacggagcttgtgatttttggcaagttaccataatttctttaagtttctgtttcctcatatattaaacctaaagataatgcctatagagttcttgaaatgacagaggaggtaatgttggtcaaaaccatggatgggtactcctggggctccatagtgggtttcaagggcaggtgtttatgaagccaggttctggggcctgatgatctgggactgaattccacctctgccacatgcaacctgtaggtccttgggcaaattacttcctcaagttctgcttccattttctcttctgtatgtatggttgatgataatacctacctcctagggttattatgaggattaaattagttcatacatataaagtgcttagaaaagtacctggtacatgtaagcactctatatatttgctatcgtcatcattatcatcatcattattaaagttacacatagcctagggtgaaattctactaaaaattttagggaaaaaatactcatttatattatcaccaacatgtacatgttatggaatagaatgaaagtttccataaatattgacagtaaagttttaagtttaactccagaaagacaatgcagcactgtaaagcactttctggcttcctaattgcactctatgggtaaatttctgttttttcactagcaattgtgtattctactgaatttgtaaccttctgaatagtttattattaaaaacagaacaggctagcttttttttttttttttttgagacagacttttgctctgccccaggctggagtgcagtggcatgatcttggctcactgcaacctccgtctgctgggttcaagcaattctcctgcctcagcctcccgagtagctgggactacagtcacataccaccacacccggctaatttatttatttattttttgtatttttagtagagacggggtttcaccgtgttagccaggatggtcttgaccccttgacttcgtgatccgtctgccttggcctcccaaagtgctgggattacaggcgtgagccaccgcgcctggcctatattgacatagttgacaaataatcttaatttcagtttaataatatgagattttatagatttatattgtagattctctattatattatagttgtctaagattcatggtaaatgtgtttttgaaaatgtcaattcaattgttaggtttagaagaaataatgttaaccataaaggagtataatttgacaaatatttaattagtatctacaaatatgtcaaactctgctgagaactgggcatacaaatatggatatgctcaaatcctttctgtggaggagttcagcatttggggtatggcaaacattgttggttggctgagtcgaaagctcttgctaacactcttctttcttgcatggctatacaaaagcattggaaaattcctagcagctactgatatgtgagcagaaacttgctggaagtgatagtggtggtggcggtggtaaagatgcttctgttttcttattaaaagaggatgattgtagctagtgctccccccactcttcttcttgccttgagcacagatctaatacctacaggatagcagccatctggggactatgaggtgataagccaaaaataattggagagatattaggcatcattaagtcagcaatccaacattaggtgacactacttcctgactttttattttcaaaggtaaatgataaacccttttatattttaaaacatattttaaaacaattttaaaacattgttggattttctgttactgtatccaaagattattctaactaatgtgggaaggaggtatatttgcctacatacaattatgagacatgttagttgctataactataataataacttttctaaagaacaatatgtatttataaatgatatgtgtaatcttctgctttagtgcatatgcgtgtgtgtttatttttcttgtaatgccatagtactagttagagtatgataaataattctccaaaagcaagagtcacaatcttgaaggttctaaagagccctgactcagaaggaagagatatatagtaatggaaggacaagtttgaatccctaaagcctccaggacaggtagctgaagaagaatctatactagaatgacagggttcttgcttagatccaagtttcagaaccagagaatgccagagatgaagaggagtgaagaaggaagaagagacagtacgtacaaaccataacatagaaagtctctgatgcaaaaggatatgtttttagccactcactccagatggagaggtgtgacctgggaaaaggaaataagagatttggtgacagaggaatggagtaaaaaagtctagcaagagaaacaagagactgcaaactgctcctgttttttctctcaatctacaaccatcaaatagaaaggagactaaagagataataacacaacaaagagctgtataaaaaaatcacaagagaaatttcccaaaaaacattggaagattaggataaaaattacccattcgctcagggaaattatactagatatgatacggacaagcaaacaaacaaacaaacaaaaagcctgaaaaaatatctatgagaatcaaagtagaggttcaatgaaaaacagatgaaagaggttatgtatatcaggagagaaatgggagagaaacacgaaagctttcatagacaaaaatattagaagcaataacaacaagtggaataaatgtgactgaaaaccaagttagaaatatggagaaaagctttgaaaaaaatcccataaaatttagttcaaatgcacaaaaacacaacatttattatgggaagatgaaagatgtggaaaagaaaaaaaagggatccaatataaatataatttgtattcttgaatattaaaatagtagaagataaattcctgaaataaagacttacatatgattttaatggcattctgtatcacggtaaggttaataaatattaaaaataatgaatacatgtatgtgtttattcagcatgaatatcaagtcacatggaagagagaaaaatgaggttagttttcccacaggtttattaaataccaaaatcctatagaattatgtgtaaaaattctgagtacaagaaagtatataccaaggttttatacccacccaagttatcttttaaatataaattcaaatgcacaaacattttcaagcccataagaagttacacaagatagtataaaccctcattaaggaaaattaaaacaagaaaacactgaaaaacaataaggtaaacaaagacttaaaaagattcttatgcactggggccttctgtcttattttgctgttttgaatcctgaggctaccacttgtgaatatgcctgagctagcctactggaggatgaaagactacatggagcagagatgtgctatcctagctggggcttctaaatccaacaagcttgtaagagccagacaaatgaatggggctatcctagaccatcaatccccttcaaaactggcagatgacttcagagatgagccaggccagccccgatgagaattgccttgctaactcacacaattatgaacaaatacattattgttcttataagtaaaaaaaaattgaatagccaccctgtaaaaacaaaacaaaacaaacaaaaaagctgtagtgaatttcagcctactaagaggtgaatcaagacaaacaattcaggtatggagggattccaactaaaaaactgaatataaatctttaatcaatgtaaattcagaacgaaaattaaaaaccatgagcactatggttattgaataaaatagaaactatgaatgaacaatgaaaaatataatatcaaattgatggaagttaggataaaacattaatatgttcatttcttcagcttttatagcaagtaatggtcccaactttttaaagcataagtttttcctgaactcatcaatattttattacacaatacattttggagtgttaagaaacatttatctctactgcaggataaagatgggcattaaaaaaaaacaagaaaaaagaaacatctcattttttagtaaattcattaatttcatttaaagttcttatactgtgattaattcaagtatagctatatttaatatggtacatatatttaatatagtgtgggtagcttgagtccattttaacaaaactgatcttcagttcctatccacattacctgttggcctttcttcctctgtagcttcctttgtatatatttttatcaaaatatctgaaataatggctattttgaggtgaatggtttttatgttatgtgtaacttttgagttacttgacaattttttgaactttttttttaaaaatactatttttattaatatattcagtatggaatagaacctttctactatacttatttgtaataaattatggattttaaaatggtgggaaatgttgagtggtctttgaaggctgtaacatttacagggaaacactggcaagggtttcagaaaaaagcctttaccttatgttttcaggttttcccttttactggatatcattttaagattttagattccaagtttgacctaattaaagtttcagtggcagttgaactgcctacagtgtgaaagtcctgcttgtcaaatattttatctcttattttagaaatgaaaaaaatcatgataagtatacatttaagggctattttatgttaaaaaaaaaaagtcagattgaagccaataaaaagttggtcaagggtaatttaaaaatcaagaaattattttaaagttagctactttaatttcaatatccaaatagtgggagaggaaaaagagccaatttgttaattccttggaaatacatggtgagtcacagtctaatttcagttcaatgtgttgatgctaaacaggaactgacacccaagaatttgaaggtaaaatctggtttaggagtcacagaggcataattgacaatgctcttgaacctacagtgaagaaccaataagcaatacataatttttaagactgtaagctgggtgtggtggctcacgcctgtaatcccagcactttgggaggctgagcagggtggatcatttgaggtcaggagttcaagaacagcctggccaacatggtgaaaccccatctgtactaaaaacacaaaaaaattagctggacgtggtggcacatgactgtaatcccagctacttgggaggcagaggtaggaggatgccttgaacccgggaagtagaggtgtcagtgagctgagattttgccactgcactccagcctgggcaacagagtgagactccatctcaaaagaaaaaaaaatttaagactgtaattttgaggaaataaagagaacaaatgtatcaaacagaatttgaacattcaaagatatttattttaaatatttcaccattaaaatgtttacatcttatagtgtgctgatggcatcataattactcaagttttaaatgaatttaaatttttattacataatttgtaaactttataatacataattctgaatctcttaaataattgagacttctactttagcaggtagaggttgaagttataagagaatagaaaacatctgggggatttgtcccaggaaaaagctaagtttttggaaatagaagttgaataaactacaaagcaaatgaagataaaattactcttttcaagatgtagagtagtatatacatagcacagaaagagggagaaagagaaggggtggagggggatagattctagcttcgacttttgcaaagtttattagcaatttggtaagacagatactttaagaggcttaagcatacctctttatcacaccacttaatagttaagtggtgtgatgtagagaagagagtacagctttggaatcaggcagaagtaaacttaaatcctgactctgccacttcctgtctctgtgactttgtggcttcactttatgcaactcagcttccctgcaagaaacaggcacaggagttcttaccttgcaagatagttgcaaagttgtttgtaaagtacctggcactgtactgttcaacaggtggtagataattactgtaataatggaataatgagataagatgctgaataatttcaaaataaataatcaaaaaaatcatggagtaggttgggtgcgatggctcacgcttgtaatcccagcattttgggaggccaaggcaggcaggtcacctgagaacaggagtttgagaccagcctagccaacatggtgataccctgcctctactaaaaatagaaaaattagccaggcatagtggcatgcacctgtaatcccagttactcgggaggctgaggcaggagaatcacttgaacctgggaggcggaggttgcagtgagtcaagatcataccattgcactccagcttgggcaacagctcaagactccgtctcaaaaaaaaaaaaaaaaaaaaagatggagtaaaataaacaaaagcattacttttgcttttgcttgttacatttagagattaattgcgatttgagaccacatacctttttttccgattcatcagatatattcacctttgcctcctcttcccttatctattcctttcttcagcaataacactgggaagtcactagtctacaaagctccctcccatataaaacctatggcctatgtgatcacaggcacaatgaacaggtgaagaaagaaataattttgaattaggaaatacaatgaaggaaatgaactaggaactgagatagagaatgtctgcttgggggaagtgatttagataaagtgtatttagatcaggtgttttctcccttcaattatgcctcttccacattgatgaggaggttggtaaagatgtgaaaattagtaaggggcagagttttaattaaaggtcatcattttctattgaacagcaccattgtctggctttggaaatcattttctttaaatggaataaataaaagcagtaaaatgtcaagaaaccactttttaatttattatccaggtaaaaaagcatttctctccattggaaaaaaaataatccataggaaaaggagcttgtaggaaaaacaccaatcccacattgtgtactatttcctgtttttgtgattatctctatgaaactaccttgagggtttggcgagtaaatagtaacaaattcagtcttactaattttgtccttttctttgggggtaatacagcctaacaacaaaatctgttcttaaaatactgcgttctactagagttatttcccttttggctggaggaagtggtggctttgtcagactgaacatacatagttgtatatgtttaaacaaagcatcagaaacaagaaacttgcagagttccccaaaccaggaaatattttataaagataatgaatagcaaataattgacatgatataagttaaaaaggcatttatcagtgagtatactagtcttttgaaagcagtatttgttagactaaggatttcaactacttgccaatgccatcagttatcttgacttattgtaggattagttctgtagtcctctattagaacggatcaaggttacaggcaataatgatggtttccactgaaaaaaaaagccacaaatatcttgtgtttcaaaatttctgtgatcagcattttttgagggaagaagcattatgggaagaaaaagctaacagagatgaagtatcagacaccatgccatggggctgtccttacatgtgtcatcattttaacagggaagcaagatacatttctctccttttctcatcctcatcattaccatttaattttttgattcacatgaatattgataggtggcttgtggcttttgtccatgttttgactttctttaaagacaggaagaaattttataaagagtcagacttttaaagcaaaaatctttctctgaaacttttttgtagaaatcaaaattcaggccttcttctcaattcaatgaccctgttaattaagtatttgtcactactcaaatacatggctgatacacagccatggctccacagccagatcttggcaggtggctttttttttttaacatcaaaatgcaggtaagttatttatgttaggtgagaaaactggtttgattcaatgtccacaaatattacctccactcaatatttgtaattgttgcttcagaatataagtcctttgagtacagaaattccagacctgatatagaacttactcatgcaataaaaaacatgtgcaaggtatagtctcacagtttattctcttccgttttatgctgcactttggctgatgcattgcaaatgtatgttaaaatcaaccaccctctgctagagacaacacatgaatctattaacaaaattaacctctcaatttgtattgatttctccagttaactggccagaatctaactagtctctagaggaataggacctgggcagtcaaattctgcatgaagacagggacacccaaatatttgccactagttttatgttaataagactcacttgaaaaagtaatatgaaataggtttcatggttaagtaagttttgcaattgcgtgagttaaatgtagataaaatatttctttacttcaggacttataagagccttcagtatatgaatagattaggagaatcctaaggattgggaatatagtatgcaaagtttcccaaaagtattcgatcttggaacctctccgcactctgatttttttgagcaatatcccctaagactgaaatacttggaacatactatgggaaatattggtgtagggcttgaagactttgtacagtatgtgaagctctttttatgccaggaatagttcaagattactcagtattagggttaaagcagaagacaccaaagaaaggagattggccaaaatggtcaggaagtcatggacattaatttcgtttattccccaatattattagtcataagcataggcactgtgcctgaataattggggcagtctgattcagcaggcatcctggtaaggaatgaagtcactgtggcgggatgcatagattatttcaatggaaaggggcattgtaattatgtttgagtgttgtagctaaaagactgcatatgtttgttagtggcctatgaacataaccatggcattataaatagtatcataattaccgtgaaagcaatactgcatctgatgaatgtattttattcggcagccacaagtcttacgaagagtatattttaggtaatgaaaacttgagccttggtatgtttagaataataatgatactaagtttttatcctttcctagtctagtttattaaaaaattgttttttatttatatgaagacattcataatcaaatacatgctaaataaaacctaattgtgtttatttaacccagcaattatatatgaaatatggccagtgactctggaattaaaaaaaaaattctgcttggtaacttagtactatattagcctgatttttggaaacaagttttataaacaagtaggcatcctgaaatacatggcccagtacccagctagccattagagccattaaacacagctctgagataatttacctgtgttcattgtgtcaaaggagtaatttagactgtcataaataaacattttcaaaggaattttttttctttttgttttctgctcctcaaccataaataccagttaaattaaagtagctcttatctatggcttggatttagattcaaccttgtagaaagcattacttttcctatcattaaaaattaaaacatttctcacttttacagaaagcctttcaatatgtatagaatgtaaacaatgatcctagatgacttgcactgctctgagaattagtagttatttgaagttatttgtccactgagggctttggcaaaggcgagggcagtttgatatataagtagaatattatagataagaaataattacttattgttttgaaaaagcttcccattcgactctgtttaagagaatatgaggaaaattcaaaaaggggaaattagtgaattgaatccatttcaagtcagagagcttagagatcattgaatccaacgatctcatttttttaggtgaagaaactgagctcctaaaagttaataaagcttgagtatggtcagtcaaccagacggtgacctcctcggaacctaggtcttcggactctaagactcatacccatttctgcactctctgcttcctcaatgtctatttcccagccatggtgaagccctgactgaaagagaaatgcctggttgtagcaaatgtgttttaggaatgagcaagctccttggtaatgatgacaaggctaaacagaaagaaaaggaagagatacagtcagtagaaactggtgggtttcttttcctatagcacccttttttattacatgctttgagatagtgtgagtgtgccttttgtgtccttgatgtgtgcctgacaagatgtatgtaaatcacagttttgtaaattgcattatgaatacaattaggatccactaaagttgtcttgtggtaactttctttataaaattattctttttgagtattaaagactaaatttatctgttggtaattctacatagtaatgatatattataaggttttttaaaataattagaaagttttacttcaagctggtgaaaaattctatattcctctaaattttccacctgtctgtgccccccattcccatttccccatccttctgtcccccacccctgtcttcagctcctacttcacctttttggttttaggtaaatttccatgagtacctagcattctagaagtgaactcacagcccagattttatgattttattattagtttatttaatttttttctctttttttttcttttttttttttttagacagagtctcactctgtcgtcaggctggagtgcagtggctccatctcggctcactgcaacctccgagtccctggttcaagcgattctcctgcctcaccctcccgagtagctgggattacaggcacacaccaccacccctagctaatttttgtatttttagtagagacagggtttcatcatgttggccaggatggtctcgatctcctgacctcatgatccacccacctcggcctcccaaagtgctgggattacaggcatgagccactgcacctggcctatttaatttttatcgtcctttcttggactattccttcctattttctctctctactttcgcattttattttttaaactcaacagaagagtttgaaagctgctgagtcagcccttggtcactttccagcctgttgttcatgagtaattgactttggctagacataccaaaattaaattctcagattgccttagcttttacagaattgcactggcattcttctctactcttcataatgcgctccccatagaattttattgtaattgtcaggtgtggggtgagggaggacttgtatttatactaattgactttacatcaagatttcttctattgaattcatatatctaattcagtttaattgaatgtaaagactcctgtaataggaggcagcagatctgactcctgtttcctgggtaaattatataagttcatggtttctttatagatacagaggttggaggaggtgattggtgtaatttttagcttgttgtaattttgtgattactgaactggccttaagcccaattaagtggaagaccttgtgtaagtaggtgttgtctctcatagaactaactaggtagcagtcaacatcatcacaataagtagatcggtttcatttctcctgcatttaaccttcttgtgccaattcgccatcaactttcgtcatcagctgtcttgtctattgggtcagcaagagtaagggcagccttttcttacctcaatcactcaccaattatttatgtaagaggagtttagaaatctattccaaatggttttacttctgcagcacttagtaatttatctaaagattcttgtaaatgtttctcttgagctcatatagcaatcttaaaagctgtcttcaggaaaccagatctagtcatctggaaggccctatatttttacaatagagccttccagagttgttagaaatatggagaaaatgctatcatgatcatttccatgtatactaaagcttcagtagttttaattgtgaaaaacagctatcccataaattgaagtgttagtaagacaaatggatgcattgtattaaagctgacagagcagtgactgggaaaatctagtcactgatctaaagccaacacaacaaatcagatgaccttcaatgacttttaattacaatttctgaatacattgctgttattaggaaaacattttaggaaaataagactagaattagtatacaaatcagaaaaattgatggtcaagtaatctgtcagtgatataaaattcaactaagataaattgataaaatacagtaaaattgccaattgttttttgcttaaagacttatgaaatgtacattattcatttctactttctatctaagttaaggcctatttcatcccaaactaaccctgatctagtttatgtttccggaagcaccatttataggttggcatttaataggatttcttttgtgacctaaaagggatgcatgctgtctgatcacctctatagttagaaaagagagacaatagtgattgaagctagaagaatggattttatggcataatcatgttctgatccatacaagatgacaacagcccagttttctgtgtaatacaaattgatgatcttaatttaattattagatgcttacctatccttgattatatatttttttcaggaatcccaagttttttcttgaaaatgttaggcagaaggcccatgataatttcagattccagtgtcgatttagcaatgcctatttttaattaattgatttacatttttattcagtcacaggtcttttaactgataccttttaatgcataaaatcatgtttaaattcttgaaataactgaagtcttaatgaaatatttgagtgcaaaccatcaattgaaaatgataaataaaagtagtacaaatatctttaattttgaaatatgagggttttctgtgtttctatagtgttccaattttattaacttttgccctgtcttccgttttctttataactaaaatagtaataaatacatttctaatttaattgtcttatatgcacagaagttctgagtgatactgaatttttggtgttgattgagatttgctttatgtatatgttcagttttaaagcttattatgtatttaagtgaatgtgtgttctctaattgtagggtccatggttttacatatagccattggaacaaacttcttagttgcattatttgtatctcccacaatccactaatgccttctgctgcctgatgtatcagttataagaaaagtgcattgaaatctcccattattgttgatctgtgacaattgctctttctaatctcaattttactttgtatattctggacaatgttatttctcacatatgagtttggaattactatattttttgctgattccttctttattgttccatagaaacttctttatttccaatgtgccttttttgcctctctacaagtgtctcactttcttctgttcattgtcattcttcatctttttattttcaacttttctgtgtcattgtattttatttgtgtgtcttgcaaaaagcataaaaatataatttgcaatatctgtcctttacttgcaaatttagtccctttgtatttattgggttattgatatattttgatttatgtctacattttattttgtgctatgcttttacattaactatgcttcttgtgctttaaaaaatattgttctatcttctattttgaattttattcctgcaactagtactaaaacaacagtgtatgctaagtaaacatagagtaaggaggcacttatttctgcttatagaaaaagaattgtagcactggagtatatgggaaggtagatgagacataaatctggtgagatatgcaaaggctgtgctaaaatgccgtgttaggaatttggtttgcatcttatttatgtaggggaatggcatcagccatctcattttagaaatataattacaattgttgtagaagaatgagctggaatgggggagaaatgaggggatgaaactgagcctggtgggcagggaggccagttagaaaaatcactgcaataatccaagtgatgaatgatgaagcagtggtagtgaacttgaagaggaacaaatagatttgcaatatattcaggaggaagagtcaataggtcttaatcaccaattaggagtgtggggatggagtggaatggatgactgtaggcttctggcttgggtgattttgtggatagttgagccactaattaagaagagaataggaaatagcaacaaatttgaggacttcctctgcctggggaacaattctcttatagattgttatgacggaataaggtataagattatttaatgaggtatttagatgacaaacttgcttgggaagaaatgtgatagaacagagagatggtgtcctaataatgaggggaagaacatccagaaccctgaatttaggaaaacagtgtataggagtatttagttacatgaatacatattaagagatttactaaatagcagggatctaaaagttttaccagagcttatgaacagacaagaatttggtttaaactgttctagatatgcctttgaaatgttattgttttatcagttgttagattaaatcatgcttaaagtgctagttttaaaatgaaatctgattaaaacaatttaacacaggtaaattaatttttacaaacaagaaagaatttgtggtcatttggtaataagtatttcctgctcagattgtatcagtcacattcatttttataagagattgtatcagtcacattcatttttataagacctctgcctatgaataggatatgtgagtcacaactatggaaaattaggcctctgaaatgctgaaataatacaaagggttgttttgccaaatgcttgacactaagcaaagacgaaaaagctgtttgatgtgcagatcatcttctgctcttattcttgccatcacatctaaaagttttgggaactgtttgactctctgttagtattaatataaacagatctataactgctatccaggcagctaaatgtctgtcttattcttgattatcttttgcatttaatccaagataaaatattaaacctcttgatttaatgtcacaaaccagtagtactcacaaagctgaattacagactgtcaacaggtggataattgctgaacatttacagatgttagttcacatggaattgtttagaattactgtgtttaacagtgtaattgtagagcaaaatttcaaatgctactttagataatatttttgcacatacccttagaaattttttttccaataagttgagcaagcagaaaactgcataggcgctaattaactcaaataaacacataagtgattgacacaaacatgcttttttttttttttttttttttgtagagacggagtctcactctctcacccaggctgaatgcagtggtgcgatcttgacccactgcaacctctacctgctgggttcaagcaattctcctgcctcagcctcctgagtagctgggactacaggcacgcgccaccacgcccggctagtttcttgtgtattttagtagaaacagggtttcaccatattgcccagcctggtctcaaactcctgagcccaggcaatctgcccgtctcggcctcccaaagtgctaggattacaggcgtgagccattgcacccagcccaaacatgcattattaaacaagcttatctttgagatatattaatggcactcttgctctttttactttgttgcacagctactaagttagatagataattgctttgattcaagatgcgttaaaatttttaatgcatttgttaacatctctaattatataatatcagtctccttgaaaccattaaacttcatttatcaacagagctttgagacctacttgtgcaatgaagtagcttaggcaatagagagtaagatgaaccacagttcagtcctaagtagttttcagtttagtaggataatattacaaaatatgtaaataagtaggtaaaataaagcgtactaaaataatttacaagtgattgtgtaggatataatagtaaggtaatgtgaaaataatttatgtttataggatacaataatgtaataaaccactgaatacaatgtctaatgcaatatcagtactccataaatattagttcttattagatttatgaaacaaagatggaagtgtataatttcctctgtggatttcaggaaggtttgtagaggcagtaatgcttgtattagaccttaagaatgagtagaaattcatcaggttaaaggcaagtaggggagaagatttgaagatcttttaagcagaaggagcagtgtaagcaaagctacaaattagtgagactgagtctgagtcttagttgtctggcatggataggtagcagatgaggaaagaacctgaacttaataaaaaaatatagagatgtagacaagagccagggaataatgttaaggatttgtaatttatcctgcaagaatattggtaacctttgaaaggtattaaacaggtaggtatgggtaactttatctgcttcgtgttttaaaaagatcacttggtgaatgtttggagaatggattaaaagaggtacatctagaagcagggggtcctgctagctgactgctaccatgggccatgtaagagatgatgaggacttgaaccaaggctatggcagtgggtatgaagaaaaggaaaaagatgagatcctgtgtaattcccaggacttggtaaccaatttgatatgagaagtaacagagaggaaaaagtgtcttcagtgacacccaaggttctgtcatagaggcctgggtggatggtggttctattcacggagagagaaatacaaaaggaggagagtatggaaatcatgggttatgtttgagattatggaatgtgcattatttctgtgacattcaagcaatgacacctcagaggaattggaaacatgggtctgttgctcaactgacacatcttgggctagagatctagatttaggagtatttagcatatacttggaatgagaaggcatgaactctgggaaataccaggacagaagtagcaggaagatagaccttgtggagagttccatcttggcagtgtgttgtggtattagctgagcccatgttttccacttgttgcatttgggtttcctagttttacatttcatattgtaacatttggcagattttaaataacttgtacaatgtatagaaattctcaaaggactgatgttttgtaaaacttcttcacaataattattagatatacaaagccctgcagctgtattctataaatagtattgaatgtagtgaaatagtcatcaagctattccttatcttaatcataacttgaaatgttgaaaattctgtttggtggtaagtcatgattttgtcagcaattttcacagtgtcagatctgcccttgttgagagtaaagaattgaaataatgaactttaggtatccttggtacttaatgctatttttgtatcatttgctattgtaatattacttcaactgcttttttcctactttagaagttcagcatgatgcaaaactaggaattgcagatatttggtaattgagggatgaaataggaatgttcttgtgcttttaaagagactcacactgagcttcattccatttattaagtgagctaatttgttccacactgtacctaatgtagaagcaaatttcgaagttattagctaaaggtgtgattagcaaaggccaggcaaacccatttttaactacgttaaatgtccgtataaagcttggagagcattttcctttcttccttctttcttttcatcttttccttttaaccactggagtacctgggtagttgctcctttacattacttactggtttttatacgagggaccttctataagaatatagtgatggcaactcacttactacatgaatgctacttatttctaggagcttaacttggttaagatagtttgacctggcatgattaatatttacaaatggaaaattaaatcttttacttcagtttttattcagtctgttcaccaagttacattgtcctgctatatctggcagtgtacttggtgctatcagaagacaaaaagttaaaacatttgcccaaagagcttagtctaaatgttgggagaaacaagacaaaaatttgtctaagaataaatcggataagaagaaattataaagcttagacgaaggacataaaagaagacctaaccaaatttgcaaaacaaaatatatttattagaataacaaaggtcataaatattttaattttctccacataatccgaaatacaggctcaatgaaagatggaggttttatctgtttttttttttttttcatttatgtatcattagtgcaagagcatagtaggtactcaataaacatttgttgaagaatgttatctgaaagttcactcaaaaatcacattataaaatttggatggaaccagacaagttaattctaaaatttatagattcatagttggaaggaaaagggtccaaaatggtgttgaagaagcctaatgaaatgataaggcttgtcctgccagaatgcaatagattgttatttccaaagatgatcacaacactattttccttcccaggtactttttagcaaagtgacattgccactcccccatcaagaggtgcagtctactttaccttcttttaatcaacttgtaggaatagaataaggcagaggtggctttgagtgatgtctgaggctagactttaagacatctgcaatttctgcctttgctttttgtaatatttcttcttggatcccacctatcatgctttccaaagctcaaatagccacatagagatacccacatggagaaaaacaaaggctttagttgaaaaccccagctgagctcccatttgtcagctagcactgtggtagtcaaccatgcgaatgaggctattttggacctcatgatcgtccagtgcctgggctgataccatgggaaacggaattttgtggctgcccacaaaatcatggaaaataatgattttttagaaaacctccactgttttgttttgcagcaataaataactgaaacaccaatccaaaaaacttataaagctataacaattaaaacagtataataatagtaccgggatacaaaaatggtcaaattgaagaggatacaaagcctcaaagcagtcctcactcataaaagccttgttgtatcactaaaaaggcattaaaattgagaagaaggaagaactagtggattaattaataaatgagaagtatccataaggaaaaattaaaattagattcttgcttcacattatgaaaaaatacaaacaacagattgattaaagacttaaatgtgatcaacaaaatgttaaaactgtgataagaacatttaagaaaatagttctataaccctgggataaaacattttcatccaaggcattaagtgttaaatgaaaagactgatacatttattcattagaatttaaatttctgttgccattaaaaaaaaagtaaaggacaagccacaaactggaagaacatatttgtaatgcataaaactagaactgacaaagaattttttattcagataatactaagaactcctaggaacaagaagaaggagaaagaggagtggaggaggaggaggaggaagaataataggaaaaggagaaggagggagaagctcaaagaaacaacaaataggcaaaggatataaacagttgatttacagaagtgcaaaaccaaaggacaaataaacatgtaaaaagatgtttagcttcaccagtgattagggaaataaaaattaaatcaataataaaattgcatctcacagccattagatgataaaaattaaagcatgacaatacatatgtctgggaggtagagaaactggaactttcattcactgctggctggaatgtaaattgatattagttctttggagagcaatttggcaacatctgataaggctgaggaagtccatatcctaattgttgacgttcacaaagagacatacaaggatgtttgctgcagagtgactggatcaaatcaaccctgggatttatacggtgaaagaagacccaagacagaacactgaaaggggaggtatgaaggttaatggccaacaggagtggtgaatagatggccttcttttctagaatgagatttctttggtataaaataatcataactgattaaatgaaagtatttgatattattctggcatatatacagaagagactagaaaactagaaaatatcctacatgtgatatactttatgaagtttaaacagcacagagttctggcaaatgttactaatgatgaataaaatattttgttttctggtgcatgcctctaatcccagctactcaggaggctgaggcgggagaatcacttgaacccaggaggcgaaggttgcagtgagccaagatcacgccattgcactccagcctgggcaacaagagcgaaactccatctcaaaaactaaataaataaataaatttgttttcactgagtctacaaaatgttttatttgttagtgtactttataatgtttaaatatacccttttaaattacttcaaaaatcaaaataaatagagataaaacatgatggtgttacctgtgatttagtgttgatataattttctgagtaggctatttatgttgataaaatatcctttaattttaaaaaggattatcttaaatattatttcagaaaagcaaactaattcctggacattggcacttagaaatatatgtcttgataagtaatgtgcagatcatttaaataacttccctcaaattatactaatttgaaatatgaaaatttagaaaacctggcatagtgacatttttacttccctgaatgtttgaaaagttggaaaaactccaaagtgctgctcatttacaaaacccctatgttgtgtgcttttagaacatctgttcttcaaggtcagaggttattttctgaaggttcttctgcagcgtgtcttgtaagacttgtaccactagcaaatacatttccatcattagcagatatttgtttcaccaaaatgttcaatacatgccatcatgattactcaaaaactgttaaatgttcataggaataatgatgctttgtttgcctcaccattcaaaacaaattaactagagttctacttggtctactgaaattgacatgctaaagatgcccatgatactagtgaaattttacttccttgaataggatatctgtattggtaaaggacagattttggttacataattcaatttatgaacattatcaagtagtgagacataaaattccagattatctacatgaatctcaacaggttcaatgttaactttgctataaacatccattatccacatggtgtagagaaaaggacacttatctggtccacactggctcctaacttgctgagtcatcttgagcaacatttgacctctttatttctcagttaccttgaatgctaaatgtgggtattagactagaactagatgatttctagttttttccataattctctaggcatccatgtacaaaaaaatctaaataggttccgtctgcaaacatccctggaataatatggtgattagaaattccatatgcaaaatatgttcaataatgggtgggttgaacctctgtgcatctttcttatttaaatggaaacaaggatgtggttaattcagcatagaggagaagaactgtggtagcttcaaaggatagtactacagtttcagagtcccttcacctggccacagcactacagtgttgagtggctgctgtggatattgggagacaatgggacacattggccccacctcattacttttgccatggaagagaacctgacttggttcatgaagcagattcaactgagcaagagaaggaatctcataacagcttaatgatgtctactgacaagcttgagtataaactcttaaagaaaatgaagacttctccaacccatctcatagtgagatgagcttctcatctgttttatgcaaggattattattgcatttctcttcgtataatatatatgtgcctgaaaatgtgtgtataaactaagatattgaggtggctatcttaattttttaatgaagttcaacaaatatttcttgaacactaaatgccaggaactgtggtaagtcctattgccgctaaataatcatagagtaacttctgttctttgagatctactctagtggataataaaagcactcaagtctgtttcctggatgagctcagaccagcagccaagtatgataatcctctgtgccatgaaaatgaattttctgaggaaattcactcaaaaacccatctagaggtaaattcttttaaaatttaaataagtagtcttattatgtaaagactgttacgttaggtaagctattcactcatatatagaaaaagttctttcagtatgtatatatatacacatctctttacccactccttttgtttgttagctaacatggatatttgagttcatacatgtatcaggctaatcccacatgaccaaacatatataacaatcaaaccatagtgtggcatctgcagcactcattttattccacaatgaaataaaaatgaattcagctattaaagtagtctaattctgttatacctacaaatataatcaagaagcaagattttggaacaatatttttcaataaattttcctctgccacaatgcttgtttctgtggacttttagggaataagttgacatatattaaatatgtgagaactttatgctgtattctaaaataacagttgattaattaaagagttaaatattgacccctaggagggccctctgctacagtcaattggagaaagaagaggaataagggcttggcattaccttcaaaaagattttactccaagtcggattcttcatttcttgctgctagacaagagccatcaaagtaaaacagatacaatttccaggaaatacaggaaataaaaaaacactttttcttgctatgagaggtaacgagactgataaaagagaggtagaaaagggattttttttttttaagtgagaggaaacatcgaggaccaaagcccaggaagcacccggatgtgtaaggaaatgaagaggaagatgatccttcagtgagtagtggagcaaataggggaacccggtgtatttaagtgtgtgtgtgtagggtggagagaaacagggaggagggcagagtttcaggaaagaggtttataatgatctattgattatattattattaggaaatgagaataagtaggaaaaaaattgcacctgtctcctttcttcttagctgtggtctcattttagttcctagtattcagaggtgacctaatcagactgcagaatgttctgaaaggttttaaacatgaactgttggttttggcaatcagaagcactgacataacatagtgtatcaaacaaaaatatcagcttcttcacaatactatataaaataatgcatgcaggtctaaaaatagatttaaattcagaataaaattgtcaaagtgactgccaaataaaaacacacaatacacagaagttggagcttttccactcagtaagaatgactgagtttgtggaatgtcagtaaaagatgtatactttaactttagatgagtatttgtgtaatagctagaaaatcattgtattggcttaaatgttgctttgatgaatttctaccaaaatcataatctctgttaaattagtaaattccaaatgagctaaattcaaacaaacagaaaacttgaatataatcctgtgaatataatcctacctcaatgatcctgtgaggtagtattattttggggatcatttttaaatcaatgaagatacttgagtttgaagattaggaaacctgatccaagtttatgatgccagcaagttacaaaggaattggaaatttgagcttagtttctgtcttcaaagcctgtgttccttcatgatactatacagtctctgccatcctaaagaataataaattattgacaaaaagactaaattatattaaataaagttttgatactaaagcatatgattatattctaattccttataatttggtaacccacatttgttatgatagaaatgtttttaaaagatcatttgaaaaattgaaaacctgattttttaaaaccctctgcataaaaaggagttcctttaattcattgtaaactaacttaaattgtaaagccactgattaaatcttaaatctggatcaaaatccatctttgcaaaatttatccaaatttagttatcatgagctaaattcacagaaatgaagtagttcataatttttattttgccagcatcttaccttatgtttatattctatgtttaaagtgtaatggtaagtctttgaatggaaaaatggtgttccaaagttaactatacaaagcttaaggacaagacatttcctcaatgattcttgggaatgagacagtagtaactggatgaattttcatggcaatgaggtaaataacaactggatgagcctctctttttcagagttaactggaaaataaattaaacaaacaaataacaaagtctttctgggcatctcggattgctaagaccccaagcctcagcattttttgactcctttctgattcttcagccctacattctatcatcaagaaatcatttcacctctaccttcaaatataagtccacagactatgatcacttcttccatctctcatctgaatcaatgtgatactcttataactgtctctctaattctgccttgctcccctgttacaatgtcaatcaggtcatgtcatgtgccactttgtggccacccgtttcattcagagaaaaagttaagtccttacaacatattctgcttccctctcccttagtcctgccctgtgtccgtgtttcaaaacctacgcacgtggctctagacaactttgcctgcttgctgtcctctaaaatgctaaaaggacttcacgtcgggacttttgcacttgctattctttctctccagaaaatcttgtatatctgcttggtttcttcttcttgcttctttcagatcttggctcatgtatcagcttattagtgaggcccattctgacgatgtgaccttgactccttattcaaatataaacttcatgaagacagtgatttttggctatttggtgcacttctgtattcacagtgtctagtgtaatcccatagtaggtgttcaataaacatctgttaaattaatagattaattgatggagaaatgattgactatcatatgtgttatttaactgccatgttaactgcagataggtagtatgatctctgttttgctagatatgataaatcaacctgattagcctgatagccatggagttgtaaaagttgacttacaaggtatagttgactatagttgattcattctaaaattcttgtcaggtaaaatgaggtatcattttgtatcattctcctataaactacagagtatttcctcatgaatgattagttttttcaatgtattgtttttaatcacagaggtcttgctactttattttattttagtttagtttagcaagatggagtcttgctctgtcgctgaggctggagtgcagtggtgaaatcttggcttattgcaacctctgcctactgggttcaagcgattctcctgtctcagcctccagagtagctgggactataggcatgtgccaccatgcctggctaatttttgtatttttagtagagatggggtttcaccatgttgcccaggctgtctggaactcgtggcctcaagtgaactgcctgcctcggcctctcaaagccttgggattacaggtacgagccaccatgcccagcagtcttgctattttaattaatctggcaagtaattatatctaaagtatacaggcactggtttaatctctgggacatactgattaaccagacaggcaaatctggaatttatagttagttaaacagatgcacaaactaaaaagaaaatatcaaaattgtaagtacaatgcaaataattaaaagaaggaatgtgaggccaggcatggtggctcacgcctgtaatcccagcacttttggaggccaaggccagaggatcatgaggtcaggagatcgagaccatcctggccaacatggtgaaaccctgtctctactaaaaatacaaaaattagctgggtgtggtggcgagcacctgtaatcccagttacttgggaggctgaggcatgagaatcgcttgaacccaggaggtgaagattgcagtgacctgagatcatggtactgcactccagcatggtgatagagtgagactctgtctcaaaaaacaaacaaacaaacaaataaacaaacagaaagaatgtggtaggaagtgactaggggcaatgggattgggttcttgatgatcatttccacctgcccttcctggtctctttgcccttctccattctgctttccactccagaagaccaaactttatggactctgtcgttggtctgccttacttctggcctctggttgtgtttgaccaatgggaaccatctgcagaagatttgagaactaggggaggaggagggctgggtatactttcccctggatcctccctgccagctccccactgattggcagtgtttttctttacctaaggccaggttcctgttgggcacccttcccctatattttcatgttctgagctgtaggaactgtttcttcctttattctctcacccttggtaaccactcctccctggctcttgtagtacagaattctgcattatatgtgctatcatattgttaaactttataacaataaataatcactatattactataaatcacccctttactaaataaactatatgagtacctgatttgttttttactcacccatgactgataaaggtggtaggaaatacctttgtggtgaagtattagataatgttagtcttgcagaaggcagccataaggaaaatatctaggaaggaacattctagacaacggaaaaatctgagacaaagaaacaaaggcagggatgagctctgtatgtttgtagaactgaaatattttggctcaacagtagtgaagaagagagaggattgtaggaaatgagggtgggatctaggcaggtgcctaccttgaattaatgttcttattgtacttaaacaaaaaaaaagcaccaaaacagagcaaaaaatgtgtgtcagtaaaaggcagtattttgtggggcatgtctttacctaattctgtttatttgtgagttttgtgaaagtgaaaggaaaattaccaaaaataaattatttaaattttcgttttcctttctttgtagcacattttcttaagtcatttaagtgtgactttagtcatcaagtacatacaagaaaaaaagcataaaggaatgaaaattaagagggtaaaacttctgcaggctatatttactatttactctaataatattaaaaggaatcatgaacgcattgagaagtattttgaagatcaagtttatgtagcagtttattttttaatctatcctcatggctttgttgtgtttgtgagacaaaatgacttcctaagaaacacagattttatttccttagtgttacttctagtaattactctttctctcatatttacatttggtcaattttatctgcttcctctatgcaagaaaaaattaacttcttagacttttaaccttccttcttgttcccccatcactctaatttgttgtattcacatactaagaataatgtttggtattctcttagtttccctttagccagtttatcaactatcttctggatttctggttctcaatcctgacaataaatgaaatcatattctgaaagaacgtcatcattcgttgaaatattttcatttctggtaaatacattgtcttgacttaaaaagtgttttttttggtagcggatgactcctagaatagtacctggcatgtgttaggtgctcaataactatttactgatggaatgaacacaggctctagtgtaaacagatgagacttcataatgtcacttaccacatggcactcaggagatatttagcctacctaagcctcgattatcatcaactataaaattgagataataatagtatctaccatttaccgttgttctaagaattaaatgacatagtgcatgcaaaggacttagcatagagcctatcacctagcaagtgctaaaacattagctattatttttaacattaattatttttcaaccctagaatggtacatttttaacaggtagtacattttaacagcaaaattttagcagaatgtatttatcccccactttgcattttttcctaaaaactgtatcatgggataatttattttgctgtggagaaagactaaactatctatgcctccctccacctgaggtcatttctgaagctgttggcattgggccaggggttgagtggcagaataatctccttatcaattttgttatgtttgatgttgtacaaaataaatagctcaataaaaactccagtttagatgttaccatggttgggaagaaaatggcagtggctacctattaagaaccacaatcacaaatgcagtccttctgtattttatatccttggttaggtgggtttcttgttcttttccttgtttgctccatctggggatgcctgggcacccgtacaaaactcactagtgcctaaacacagacacattagttggggctgcccctgcttcagataccagggagagatttgttggcataatgcaccagggtcttatgccagctcctgattctttgctgatgctgagatgaggaacatggctgggagggggctaggatggaatgaaatctgtggcagccaaagcctccatttgtctttctgccgagtgtgctgagctgtagacactgcagtgttttcaaaaataataataaaaaaatttgctcattagtttttaagtcctgctgactttgtgaaatcaatatagcacattgtaattgatttatgaaatcaaaaaacccctgcttgaccaggaagttcggcagtcgctgctctcagcaacctgcccttctgctcattagtgcatttcctttagtgctgcctgagccgagggcgccttcagagctggaaggctcaagccctctgcagacagtctgcttaagatgtagcttgcattgtgtccctggggtcttatgcttctccccttcttcctaccaggtcagctgaaggacttcagcttctctcttagggtccctaatgttctcataatatcttactggaaaggcaagactccattcatacctgtattttgacattttaatctatttgctacttttcttttctctcaccttttattcttccttgtcttattacttagcttatcttttgccatctgaccttatctattcattgatctcttttattctattttatataacctcacaaggttaacaatttttttctatttcaattgtctttgtctaatttcagtacctactgttttattcttaagataatattttatacctcttcctgccaaagcctgctataattatgtttgtatgccacctttcaaaaattgaagtaactgctatacaccaaacattgtcctgggtgctttacatcaaattatcttctcaagaagtgtgtaaggaatgcattatccttggttagaggtgaaaaaactgagatttagagaagttagtaacttgcctgagtcaccccactactgaggggcaaggctggtatttgaaactaattctgtttgactccaaagcctgtgtttcttttttccagtacaaaatgattattccaattggcctctgttttacattaaatgcttaactagcaaaatctagctcttggctgcccttaaaggggctcattctctttagtgccattcttccaaataactctgctgttcaaactgccagaatgcaaatgtatttattttaagatcttggtctatgctagcatattggatggcttatcctttttcgtggaattctcatctatctaatgttatgtgtatggagccccttgcctcatcattaaaggtgagggaagtgttctcatattgtcaaaagtcaccaagagcaatctcataacctagaaaaatcgacagacagctgagccaaataggcagcctttgggagcttcctgtggatttcattttctctttgttcttttgatgcaactttgggagcaagtaagtgggaaaattatagaacactgcagcagcaggaagatgatgcaatgtgctcgatgtcctcacttcttaagtcgttgaaggaacctgtagtttctccatacaggtactgtatgtttcagaattgcgggcttgcaagaatctcattaactgtagggccatctgccacgttgctactcatttggctcatttaatcacaggtgggtaggaaggtctcaatagttttggttcctgttcaattctgatttttgcttgggaaacagaaggaaggtctcaatagttttggttcctgttcaattctgatttttgcttgggaaacagaaaaggccagtgacagctgtggcagtgccagggttctcttttctctgtgtgagccagaagatggcttccctatatagtttgctgctaacagagcaagcagacagtaagcatttcctcgccctagtgtttggctgctgaaagaattatctttgttgacttgtggtatacttggcttaggagaagagacaaggaacacagtggtctctaaattagtaattgacttcatcaggggaggaaagactggttattgactgccgtaggtcagttaaagcacctgacatttacctataacttgtgtctgccttcctggctcagaaatgaaatagaaacaaatttgattagtaaccaggaaatacagttggtgctttacaagttattaggtacattctaggcctctaaacattttagggaaaaaagtgtctccagtgccaatgcataaccttgttttccttcctcttcttttgaacacaaaagaataaaaacttgatggaaccccctggtgttccaacagtacttgaggaaagtaaagcaaagcagaacacaacaaaatacaaaaacaggctttttctattttgttttactttgtttttcagtctagtgtttcaaatccaggaaatgtcagttctttcaaaggaccttttctccatagaataaaattttgggaaattttgaaaaagctgtagttctattatgatagtgataaagtagattatagctaacatttattgggcactcaatgtgtgcacaacagtactctgtatctcacctatataatcctattcatccccacaaacatctatgttctaagttctgtttatactccccattttactgatgtggcaattgagggatagaatggttaacaaattcttccaggtcgcatggccagaagtatggcagagtcattatcaaagcccccaagttagtgcctgagtctgcaccctgggccgaaattttccagcttctgtgatacagaattttatgccagaaactcttacattactaaatttttcattctttcttttaatataaatatacataaaaatgaggaaaacttccataggtgtgttctaatactgtgagcaaattaaaactcaattgaatactattttcacaaatacatgtatgcttatctcactttaggatgaaccaattctaaaagtcctacttaagaaatagttatgaccaggcatggtggctcatgcctgtaatcccagcactttgggaggccgaggcaggcagatcgctagaggtcaggagtctgagaccagcctggccaacatggtgaaacactgtctctactaaaaacaaaaattaaattagccaggtgtggtggtgggtgc

SEQ ID NO: 2697 - DNA, 4498 bp, Homo sapiens
ggaatttctcatgaagaagcagtagttgaaacgattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagctgccaacgatacctgaggggggttgttttgatgaaagtgaaagtgaggactcttgtgaagatatgagttgtggagaggagagtctcagcagctctcctcccagtgatcaagagtgcaccttctttttcaacttcaaagtggcacaaacactgtgctttccatcttagaaatctgattgttctgtcagaatttatatttacaggtttcaaagcaataaatgggggaataggtagtttcctggtttagcccccatctagtcaggaattaatatactggaatacctaccttctatttgttattcagatcagatctggcctattttcatatttatcctaagccatcaaatggggtagtgcctcttaaaccattaacagtactttagacattggcactttatttttctcgtagatctttagctactttggggaggagggaaggtgctgataccttcaatttgttacttttcaagatttttaaaaataactagtgtagcttatcttaaacattttataaaaccttcagatgtctttaagcagattggaagtatgcaagtgcttccttagcagggacagtggataatccttaatggtttatcatagatttcaccctccccccttctcagaagagtgagtatgctcttaaatgtcaaacacatttttgttgttttgttttttaaatgatcagtgtctatttgatgtgatgcagatcttataaatttgggaattataatattgacatttctgtgatttttatatatgtaatgtcttaattgagatttctgttaaggcagaaataattaggctagggctcttagttttcattcctattgcccaagtattgtcaaactatggtattattttaatgttactttaaaaatccataatctgctagttttgcatgtacttatatgaaaacagtgcagtaagttgaaaactcagtatctatggaattgataaatgttgatctggtgtagtatattttatcgcattttcttatattaaaaaatgtctgcatgattacattttatttcctttgtaatttacatttcagaatagtgtattgctatatgggtgccaagattgaatatgaagaacccgagtgtttgtagtattatagttttaagcaaatctgtgtggtgatacagccataagaatggggcttatataaactctgtacatgtaagattttgtacagagaatttttaactttataaattgtatatgaacatgtaaatcttttaaaatgtacataaaatactgtatttttttaccttgtgtgtgatagtctagtcattgcatgtaaatataatttattatgtattctgtagtataaatcatacattgatgacttacatttttactggtaagtcaacatccgttggatgttttctgaagtggctctttttgaagtgataatagattgtaattcaaaataaaattattaatgaattctccttgtttgggatcacatcttaatttttaatctgttaaaagttcttgatgtattttaatgagaagactttaggtgaggctacagtgattccagagtgagccttctaactggctagcagaagttctctaggtttggcatctgtgccttggagatactgaaagagaatctgtcatttgacaattgacctctttgtgggatggactcattaagtatgctctcagagactggtatattaccagaatgcctattaattttcagtgagaggcaacaggtattaagtagaacagaatgctcaggttggcagattagaacgatctttcaggagacaaagcaagttttaatcagttgtttggttaataagtatggggtgttcgctgtgatagggccccgccagcttctggctcttgtggacctcaaaagtatcaggtggttttgcaagtggtggtcctttcccctgccccaccccaataggttccccatctgtctagtttgatttttgtagacctttgttttctctagttagaaaatcaggtacactgaatatggttttcatgtaacacctcttctctggagataggggtatgttttcctacccttctagtggagaatcctacttgaggatgacctttcctctcttactaaataatattagtaaatagtgggcaatatattctgctttcagattttgatttgttgagatgtaaaagttgtttggggcttaccaaatctcaagactctctttagctcctgcaggattgtattgcttttcttactggatatttttcctgggtaagcatctttgtggcttcatctcttccccctgtggttttcagtgtatttagtcgagacctctctgctgagcttgcaacctgtttattcacatggcctgccatgccacttggaggtttctgattactcccaaacctgctggttctttatgtctttctcagcgaataattccatctattcatgttggaaacttaggtgatatgctcatctccttttgcctgtttatggaggtcaccagcctctatcatttgtatgatttcgtttacactgtttatatctctctgtcccccctttttctgccattggcatggtttagacctgtactctttatcagcagaggtactgtaatatatttgtgatccctcagcttccaggcttactcctggtctctgccttcctatctacatatccttttaaaataaaattttaactatctcctgaaaaattgttgagtaggtcacgcacaatcaggagaaaaatctattcatgacatacaagtctctgtctaatctgaacactgcacctgtctctggcctttttttcttgtcatttcctagaccttaaaaaatgtgtattgagaaagaactctgttagctatacagaagatgaactgggcaatatagagtagcagcatggagaccagtctgactgaactaaggcagtggaagtgtggatgaggaagagaggtgaaaattgagaagcgctatcctttctctttgggcattattaggaggctcacagacaagtccaggagcctggttataccctcctgtgccattcaaccaggtggctttcccatgactgtgatgaataaaattgagaagcccctgcccttttcagagcagagggtgaggagaaagctaccattttgtcctcatccttacccccgttgacttggcgagagatttgacctttcaggttttgatcctgtcattttctaggatgtggtgcacgcactttgctgttgcgcatggtgaagtattgtgcctaggtcctgggtcttcatctgtttggctctgctactgtttcctcctcccaggaagtgtggttagacaaataatgtgttttaattacctgtcacactcaggattaatacatactcaggttaactgtagagaggcattggcttcagaacactcctcgtgacaattttaaccattttctttgtctagagtctgcctttttcttttttacaatttcttttatttcaacactaggtttcaatatggtgttcctgctacctcccacctccctcctccctcatcacacatgcaaattgtcagcttattgagacaacccacttagattcatatatggacaaggacaaggtattttgcatttgttactggaattcagttttcctaactatttactaccagaaatggtcaataacttactttgtgtttagcaaatcaaattgtgtgatagatagtttcccagtatgatggccagtcagtctttccatccctgtgcctacatgctgctcttcccgtccacaagtggagtctgtttctcttgagttttggctggccttatgaatggctttgcttactgaagtgcagcagaagaaatttagtatatgtccaagcctaggctttaagagactggcagctttccttttatcctttttggaagctagccaccatgctgcaaagaagctcagctggattactgaaagatgagaggccatgtggagagagactcttgaggatgagagattatcttggatgttccagccttaagctcccagctgaatgtgggtgtatcctcagctacaccacagaaaacagaggaactactcagtcgatcccaatcaacccacagactcactagaaataacaaattattgttttaagccacgaggttttgggggagggttgttaaacagtaatagataagtgagacagattgcttgttatttatggtcaaatggtgattatctctggtgagattacaggtgatgttttttttaagttatgcctatctgtagtttcctttttttcctaaaattgatttgaattattagtgtattaacagaataaagaatgaactttaaaacac

SEQ ID NO: 2698 - DNA, 1051 bp, Homo sapiens
gtggtgtgatctcagttcagtgcaaccttcacctcccaggttcaagcaattctcctacctcagcctcccgagtagctgggactacaggcgcctgccaccacgactggctaatttttgtatttttagtagaggcaggtttttgccatgttggccaggctggtcttaaactcctgacctcaggtgatctgcctgtctcagcctcccaaagtgctggaagtacaggcgtgagccaccacaccgggttcaaaatatttgccttccatgcaccctttttccaaaagttactagaggttgtgctccaccaaaatgaagaagtaagtcaagaaagagaaaggctgaggacctaaggaacagatccaacacaaacataaggtgatgggagcccgcagaataatagtaaaggtagattctgggatcacagctggtgagtaggccagaagagacaccagtccagacagaaacaggaaggcagagacctaggagggaggcaagaaaggaacaaaacccaaagaaatagagattattggctctatgaacaggaacccacaaaggcttaattgcaaaccatctgaatgaccaattgtaacacctcgtggtagagacaagacccacaggaatccttctgagtcttaaatccttactataaaacaaatgagatgatatatgtgaaagtactttgtaaactagtgtgagtcacagtggaagttccttagcaacctctgccaacctaactcactacaacaccaccaatctcccagtaaaacacagagactaatgcccagccatgctagcccattgctactagtacagtatcgtttccttccctacattaaatgtggccctttggaccaacagcagagcatcacctaggagtttgttagaaataaagcatctgggccaggcacggtggcccacacctgtaatcccaacaccttgggaggctgaggcaggcggatcatgaggtcaggagttcgagaccagcctggccaatatggtgaaacccatctctactgaaaatacaaaaattagcctggtgtggtggcacgcacct

SEQ ID NO: 2699 - DNA, 1283 bp, Homo sapiens
agctgcagaacggttgtgccactgaacagatcttacagggaggctgtgagggttctcagagttcaggcacacaagatcttagcactcagcgtgttgccaatgcccagaatgttctcattaacatgttagtcactggagtccaatctttgcatgccatagtgagctctcaaaccagactcctgatgggtcctccgccactgtgtcagtgacaaggtcacagttattggagctggaattactgtgtatgaagccttagcagctgctgatgagctttcgaaacaaggtcagttggttgagtatgagcattgaagttcaagctgggaagagatatttttatccgtgtcatcgacctgtttaccattaaacctctggatgtcgccaccatcgtctccagtgcaaaagccacagagggccggatcattacagtggaggatcactacccgcaaggtggcatcggggaagctgtctgcgcagccgtctccatggatcctgacattcaggttcattcgctggcagtgtcgggagtgccccagagtgggaagtccgaggaattgctggatatgtatggaattagtgccagacatatcatagtggccgtgaaatgcatgttgctgaactaaaatagctgttagctttggtcttttggcctctttaccctgtgtttatgtttgttccaaaaccatcatttaaatctctactgtcacattttgtttcttaaaagcaaagccagctaacaccttcattcatccctagttcggaaattcaagctaactacttaccctttaaactgtcactgcatatgcaagtaccgctctaatttttggatcattaaagggagttacacaacttttaagtgaaaaaaataggtaacaaaacaaccacctgatagtaagttttctgataagactatagataagtggtagaggtaatcaattcttccgaagtgtttccttcgtgaataactggtagaggtaatagttttttcaatgtatttccttcatgagtaaagaaaatgtggattgaagtatagattccagtagcctagtttccacagcacgataacaccatgacgcctactgctgttcccaccttgggattctgtgtgctgccatcccacctgcagctgccctggaattcccttcgctgtttgccttcatctccctccacgtttgagaggctgtcaggcagcagcgaaagcttgttaggatgtcctgtgctgcttgtgatgagagcctccacactgtactgttcaagtcaatgttaataaagcatttcaaaaccag

SEQ ID NO: 2700 - DNA, 2416 bp, Homo sapiens
tcaggttaatccaactattgctatctaaagattaacctatttactttatgaagaagtatatgaagttcatgcatcccatagttcttccatataaatgatgacacaagaagtcacccagcacatgataagcagaattgcattgagaatttatacatccttagcttcttctgtgacgttgatctgtggtatagtagacatttagtcttactcgtgtttaatcctgataaaagagccctggaaccaaaacaaatttgaacctcacttggtaagttgagtttgctttgggcttgttccattcaatcctaataagtttaaccttaataaaatcttgaagtgtatcctgtacaagtctagcaaattgacagctaaacatgtgttcccaattcctctttcagtgtattctgattctcagcgctgcttttccttcttttctagatgcctccttaactctatgttattctcagctacccaattcttgtattaaattaattaattgtatttaatttagatcaattgtatagccaaagagaaaagctgaaatctcccagtcattatatttcttggccacaggagttgccatgttctctactaaatgtattattcatacatagcaggaataagtgaaaccataaagagcaaagtagcaatgaatagaaatttggaagatcagagaagattgcaataatccagaaccaccttcacaataactttcgaagaagatccacaaatttttcgcatcaggactgtggatcagtacatctttggatctccatgtcaggaactaaaccgacctgtctacaagactaacatccaatgacaaaaagtccaaatgccctaatcttctccatgctcccaatataaagatttctgattctcagataacatctctacttctctttacttctgatattgatctaatagctactggtattttgccttccatttcagcctaataaaagtaaatgcagttctctaggtattcaccgaggattgtttctagcccttccccataccaaaatccagagatattcaagtctattatataagatggtgtagtatttgcatataacctacctacatcctctcacgtactttaaatcatctctagagttcttaaagtacctaatgcaatgtaaatactgtgtaaattgttgttgtactaatactatgttgtttagggaatgatggcaagaaaaaaggcctgtacttgttcagtgcagacaaacaattcatttttcttgtctgaatattttcaatctgtagtttcttgaatccacagatgtggaactcatggatacagagggctcattctactttgcttcaattaaaatagaatttcacattcgtttaaaagtagtggcattcttgttctttttcttcctttttagtatttttactggtaaactaactcctgcatcctctccctattaaccaggagagactgtccataggctccagatccatttggcccacaatttatacctgactattgtaaaccccttccccataggtacagtaattatttcatgagtggacatgtaataaaagttgatgagattaaattcaatcctgaaatttgtaggttttaaatggcaaacagagcttttcactcaccattattttttcacagttttattgagtgataacttataggtcataaattctgtctggaagtatacaattccacaatttttagtatatctattcaccttgtgcaactttcactcaaaattcactgttagaacatttctactaacccaaatagtcgcctcatacctgtgtgcagttaattcctcctctaactacatccttagagagccacttatctgctgtctgtctataaatttttcttttctagacatcttatgtaattagaatcaagcaacttgaggccgtttgcatctgatttatttcattaagaagaacgttgcgggctttttgcttgtttttttagatgaaagcatgttgtggtatgtatcgataaaaggaaaaagtgtgtctttcctattactgattagttactctattgtgtggctaaggcaccttagtttatgcatgcaactattgatagacatttggattagacccttccagtcttcagcttctatgaataatgctgctatgaacatttactgacaaaagcttgtgtggacataaattttcaattctggtaattagatttttaggagtggcattactgggtcatatggaaagcttatgcttaactttttaagaaactgaggaattattttctaaagtggctgtaccgttttatattaccctcagcaatacacaaagattccagtttctccaaacccctgccaacacttggtgtcgcttatggtttttaatataggcattctcatattaagtggtacttcattgtggtgttaagatttctctaataactaaggat

SEQ ID NO: 2701 - DNA, 2628 bp, Homo sapiens
cttgcaagtgcgagtgtccgcgagctgcaggggaggcaggacgcgtcacactcgcgggggcgttccgagtccctggggcgcgccggcggggagggagagaaggagtctgagcacccgctgggcgcggcactgggcagaggcgcgcgtgttgccggtgtactgaagctgcccgcgaccggcgggagcggcgtttctcgcttcctcggggtccggtactcgaagcgcacggcagtctgacctcggctgggaagcgttaagccccagcagagggctgggagggagtgcaggagcacttgcggggtctgcgcagaatacacagaagatcggggcaacgagcaaagcaaagcaactcaccaaacaatgaagttaggagaacccaatcccgtgaaatgagcggaacaagggaataacagtgcaaaggcagcttgaagtaagaccagaatgttttgctttgtttttactattcccaggaagatacactaagaggttgggacaaaaattgggatgaagcgtaaagcaagtgtgtccatccaaggaaccaaaccacacaatgcgcaccaccgagcggcctgttgcactgccgctttgattcggttactagcatttcaccgtttcctatgtcaacagcataacggataaccacttgtttaagcaaccattaaaaaaagaggagtgtgtcttatacagaattgtgtttgtggatacaacatgaaaaccattgcacatcactgttctgtccttaagctgagccttgtaagaaaatgttgatattttgtttagccgtttatctttacatgttgttaaccacgtagtatccatccagaaagacttgttcctggcaaagtgtattggtaagtggccagtttcagactggagctgacagtaatggtttcctaccacatattgtcataattgcagagtcgtgaaaatgggctgatatttaacacaaaacaaaacaaaacaaaatccagtttggcagacaacataggtaattgtgttctgtaagaagtcacattcacttggggaagggaggccaactgggaagtgaagggtctgatctgcctagggaactggcaagaaagacagtcataacgtgggaggaagcaaagattgcctgctgaagagcctatcttgctacagcctgcttactctccatgaatattttttgccaactttgatgattctggcctggggattggaatgcggagttggggggggtggttcccactagaacaagcataatttactggatcgcttgcaaagtttacaggccggttttcacatgtcagcaggcactacttcaatccctaaacttctcatggcatggattcctaggaaagaggatcttaactcctacagtttttctttcaagctgtaaactctgcaggtcagtaacaacttattaccaatctttgccatccatctctgactattcccctactccaacattcccccatctcaccccaagcaatggggaaacatcaaacttaaatcagaagtatttcttaataggaaaacactatgatttatagcataattctgcactgcagttttactattaaataagggattttagattcactgaatttgcacagtgcttattttccgaatatttttatacctttttaattttcataaggcccctcacaacaaaaacctactatttaacctttcctatatatttgtctctagcttttctttggatgggtacctggtggcaggccggcccctggtttttgtgaatacgagagcaagagtgcagttgaagatcctcccccaggcccctgcccccttgtcttcctaacccctgactcagtcttgcaccacaaggagtcttgcacagaaatatgtggagagtatagttcaatatgtggacagtatagttcaatatgtggacactatagttgttgataaccaagctctctccccaaagccaccttggtcctgggaatatgcatctcaaacatgcaaatgacccttgattggatggacctagggaagatgcctgatcaagccctggaagcgagttatgggaccaacatttgagcaggaaatttcatgatctcaggccttcagaccaggactggaatctacaccactggctcttcagctcccagactttcaaactttgtcaccagctttactgggtctccagcttgtacatgacagattgtgggacttctcagcctccacaattgcatgagttgatactttataataaatatctttatgtatatccatcctactggctgtttctctggcaaaccctgactaatatacacttcttaaagtctaaagttcatagtgttcatttatgtatccatgaattcaaaggactgtggaaggtgggttacttcctttaggtcattcttcaagagaaagcaaagataaacatgaaggaaaggagaattgcttgggcaaaaagctaacattaattcttgttcatagttttattgatgttactttcctcgttcaaaagacgagtttaaatttatattttatgattcctatgcatgcataaatacatttttttttcaaattgagtcctaagaacaccatctgtgtcctgtggtatttgagacaaggtctacacttcacggcaggaagcagaagccaccaagaaaagag

SEQ ID NO: 2702 - DNA, 2726 bp, Homo sapiens
atcagctgactgatgtacccggaccttaagtgttcttcagtgctctggaatttgttttcctgcttagtacctaaaatagtaacatgacataaagaaccttttattaacacaacaatgatattttaaaaaggaagaataataatttccaagaaaaagtacaggaatttattttatgtctttttgaatttagacagagaattatttcatagacatcatttagacaaagttagactggcctgaatttaactgcaggtcctgagacttattattaaggtcatatttgccaatgtctggtgagaaatagactgggaagatgaaaagcatcaaaagatttctaagggctaccaagattattgaggggatactgaagaacatgttttttatttaaatatttcctaggactgaccttcactcttttttcagtgaatctaccattaaaaagggttgatgttctttcactgcgaaggatgcatggaaactgaaaaaaagacatacagaaaaaaagagctatgtcagctaaatgaattgacttacgttcagttaatagacagctgttcatgttaatgccctctcacgccgtctttcactaggctacattcagagaagaggtatatttgcacgttttctttcccacagttccttgggcatgtgttatctcttttgcatcatcagtttatatttgagctaacagaggcttccatattaggcaatttatatgacagttggtttggcccagttgtttttcaagtatctttaatatcatctttattctattatttgtgcttctgataattttaaccaggaagatataaacaacttttgaaaaaaaatggcacagctcttttctattttaatgccctttgttgtcattcctgtactcagttttcttttgtaattaaaaaatatttagtacaatcagtgatttatttccacatttaaacttggaaatcctcttcaccaatatccttatcaatttctttcttattgataacatgttcatgctgtaaattgctttagtattattaatttcttgcctcctttcttctaggaactgttgagcaactgatttttgattatttcctgagttgttctgcaggcttgaaaggatagtttcttgttggtcaaatcacagaaaagtcttatacaagaattatcatcgggtcaagttctcagacttacattgtaattaattgcttagcctcattacttccacactatataatagttttactctttgttctttctattaaactggttttactttagaattttgtttcactgtaatgaatgccataagaatattctttaattcgatcattattattattattattttgagacggagtctcacactatcgtcggggccggagtgcagtggtgtgcaatctcggctcactgcaacctctgcctcctaggtacaagggattctcctgcctcagcctcccgagtagctgggattacaggcgcctgccaccatgcttggctaattttttgtatttttgaagagacggggtttcaccatgttggccgggctagtccccaactcgtgacctcgtgatctgcccacctcggcctcccaaagtgctgggattacaggcatgagccaccgcgcccagcctcggtgtttatttttacaaacaagatagctcacatttccctccaacaccattttaaaataaagcttgtcatttctatttgaccttttgttatctcttcctgattttctgagaatgatttatactaaatattatatcttttatattgtgtacatatatatgttatttataatcccatatctgaatatctgaattccaaaatactccaaaatctgactttttgagcacagcactgacatgacactcaaaggaaatgctctttggagcactttggattttggattttcagattagggatactttacggtttcaaaatctgaaaatctctgaaatctgtaacatttctggtctccagtgttttggattgggaatagtcaatctgtaacatacatgcatattacactgtgttttctttaattaaagtaattgcattaatttgtctaagctagggatgtatcaaaagtacatatttcattttgatccttaaatcaattttgacatatttcttcttatgattaaatacacatgattcatagaagaaataaggtcctccactgggatctttttgttttgtaaaagactttcattatacagctctgttggctatttatccagacccagctcctgtcataaacctttatgctttatgttacagtaataatgaattatttgcaattcctaaaatatcacaattgcattatataattccaattgttggcattgaagccaaggactgtgatttttccatagttattgtctcagcaactagcagtatggtggcataaatatctgttgaaacaacaaacagcttttctttcacagtagttactacataaatatttgctgaaagaaattaataaacagcttgtctttccaacatttcttgtatttgaaatacttccatctaatctttctttattatctgcatgctttctcctaagtatgagccatttactcaccaatttgagttttatttagctccacaatcttgaagcattttagcatggcgagatgatttgaattgccttaatgacagtcaggcatatgaaacaggtttgctaaatcctacttttctagactttttcggggaccctagaacagtattttgaa

SEQ ID NO: 2703 - DNA, 28496 bp, Homo sapiens
tgtaaggacacctgggaggggagcgaggggctggcctgggacttcaagggactgaggctgggtggccccagctgctggctccaggcagcagcttccgcagcgggagggctgcaggtgtgtgactcacctgggtgggggaggccctgagtcacggctcctggtgtgacagccccaggaagcaggccaagagccctgctcatctggatcccgcactgaggctggctagaactcccgggcagtgggccgggctgttgggcctttagctgtgtgacagcacagatgccaacaaatccacctttgccccgctaccctgcatttacccagcgtttcccggctccctccgtgcatcggaatcatctcagggctcccgcggcacatgttggctgtctgcaaagcggagaaacatccctcgtgttgctttatgaagctcctttcatgcaggccaggcatctagccttcaggcctttgctctctccgtccccaactgcctggaaagccggtgcctccttgtccttcaatacccagctcagctcagtcatggctccactaagccatgccaggtagcagcgatggctactccctgccctccaatgcctgcagcgtgtcatctgctgtctcctgacaccagcactttctgctttgccccttctctcctcagctaggcggggctccgcctccgtgtccctccgcatgcctgctgcatgattcctgggtgtaggtctccactggatgaacggcacaacttcccccactgccctgtatcagttgcttttgtttcaggtgttaccactgtccccccagaatgactgtgagcttctgggcatggggaccagcacactcctccacggtgcctggtgcatgctcagtgtagaggcatgcttggtgaacatcccctgattaaggtgtgggcgtgcgctgtcttacaaagcacacctgggaggcagcaggaacccgtgggagcgtgccagccccacactgagggcagtagtttcatctttttctggtacttccgagagtaccatagaacaattaccttagttaaatttataccagtgcttctcaacctggctggatttggccctcaggggacatttggcaatgtctggagacttttgctgttgtcattagctggggaaggagtattaccagtgggtagagaccagggatgctgctgagcgccctacagcgcatggggcagtcccctgcggcaaagaatcatcaggccccaaatgtcggtagcgccgaggttgagaaaccctgggccacacattgacagctgacgctgggacttgatttgtttatgtgcccctatacactacgggaggcacaaatggaagatccgaggagccaggaacggaacacggacagaagcatgcacggccttgtgcgctgtgcctgcctgggagggcagctctgtggcaggaggctgctcacctggacacaggaaggatcagggaagcccgtactgctccagctcacatcctcacgggacctggaggctggagagggaattccaggagtccaggtacatcctgtctggtcccaagatctctgaagggttccctggggacagtctgtttcctgaagcagctgtggagtcctccagcttccttcgtgagctagggaggggggtgctgccgtgattctgtaagagcttgactccaggaagcacgaagaaggctccagagacagcttttgccttgattaagtttgatttgatgtgtttttgaattattaaacaaaagtcagtaagaaattctcaggtgccctgtaatctggaggagttctatttccacacggttagtatcactggaccccatgctgtcctgcttctcccagctcaccagaccaaggagggtccatgctgcaccagcagagccccgcattctcttcagcgtccccacccccccccccagaattgctggccagtggcttaggaggcaacaccccaactcagggtgtgctggtcttgcttctcaagcctagtaggagaagagcagaggggcacgcagtgttttcagggcgggagcagcagaaagcatcccttttctttctccaaaagaaaaaaaaagcacccttccttggcagagtcagcaccttgctcatgtgagcagcccaggagcaccaagcagagcccggcacacggtggtgctccatgacagtgacagccaacatgtatgagtgctcccaggtgccggcccccttgcaaacactttgcgtgtctctcccatccaccctcagagatgagtactagcattactcatcacattgccacgtgggcacgagcatcagcctcgttttctagatgagcacacgtgcgtggagaagctaagtagcttgcctgaggtcacacagcaaatacgtggctgggtgaggcatggaacccaggaattctggctgcagagcctgtgctcggacctgctacgtgctactttccccactgaacaacggatgcgcggatggatggatgagcactgggctcatttagcggggattcagcacgttagggctggtgtggttcaggtggacacaggggtgttaggtgctcccccaagggacagggtgtcaggaggggtgaggggtgagagggtgaagatggagaaaaaaaagggaagcccagggaagctttccccaggcacacgagcatccctcactgccctgcgctcagcctcttgccaactgtccagggcaccagccttctgtggtccccttgcataggacacaacctttagggccatccatggtggccctgtgggctgagcttctgtatcctcgccagcagatggggtaagtcagtgatgctccaggcagtacccccttgggcaggctgccctgctccttgccagcagtggtggagcatctcctgcctgctcctccacccccgtggcttgtcctgggttcagggccacgggctgtaatgtgggtctctgccccctccacccttcccattactcagcccagcctactctgatctcagaagctagtcactgtctctacagcctgtgaagcattccctgtgtgtacacagatcctcacacagcaaagcttccagcctccctgcctttgctctctggctgttcctcctgcctggaattccctgccctggccccatctgtgttccgtttattggctgctcagccaccaatattcagctcaggcatggcctccataaagccttgggccagaagcttctgacccgtgagctcactgctggcatcgttgtttccgagcctccttctggctccaggcctctctgcttgtcttgctccctgggctgtgtacacttggatccctgcttgccctcctggctctcacctgtgccttgttgtgccttcgtggaccctgtgcaccagggtgtgaactgaacctacccaatgaactccagtctgacccccagctccactctggtttttgtgaccggtctgccccctgcagactcagggctgcaccatccttctagaagcaaccatctaatggcctggtctgatggaaacgggtaatgagaatcccaaagaaagctcctctagcatctgccttccataagaacgactcaatttcaggctcaaaacatagagggaaccagtgttttaggcacagaatgggacccaaacgttaattcccaccccttcctcataccatagtggggttttttccattaactctttaacagggcagcttaaactagaagcagagttggatactttctaaaactatagatccaaagtgaagctggaacagcatagcattttctgaatcaaaccaatactttctttaatgagacgctttgcaggaaatatgcagaaatatttctcattgtgacattgagacgagtaactagaaatggaatctttggagggacttataccacatgggggcaaactgagccccagataagagtttctggggcagatgcactggtgcataagagacagggcaactgagcttcagctggtgccatccttgaggtaagtttgaagaactttgtaaaactggaatttcagaatttctccattggactgattctgccacaaagagggagcttcgtggaagcattcattttcctcttttgtctctccaaccatcctgtatgattagagagacacagggtttgcaaaatttcctgcaagtgatagcctgatggtggaggctcggtgtccaggcaggtcacgacaaggtggagggactagcctattcccagaacagcctcgcatcagcacaacacaaggatcaagacgtcgccaagttaagctggagggagaagagcccagcctgaggctcccagccggctgtgtttgagaggatcacagaagcaggtggagggagggccagggagcccagaacgaccggccaaacaggaaaagacgaagccagctgtttaaacggcaatgacctcagggcgaattattttctggcaattaaccatggactggaggcagctcagaggtgcagctgcctggcctgtttgtgcaaaccagaggatgtgaatttggaagcctcaagccattcctgtaacaagatgtcattgtcggaaggctgaaggtgacctctacccctcctggccccagcccagggctcacaccctgggctatccagccgcagctatggtggaggttgggactcagccattccactgggagcagctctacagtgaggacaagaggatgagctctggccagtttctgatactaacatacattcctgacccggggggctgggagcagagaagaggaccagggctggggtaaggagagctgtagatgcgatggagtgagggttaagttggaagaggcagggagggagcaaactggatgctggggaagcaggaggtattctacaagcacatcaaggaaatgcagctgagcagttgcacttgctcacacctgtaagcccagcaacttggagctgaggcaggagaactgcttgagtccaggagtttgagaccagcctggacaatatagcaagacctgtttctcaaaaaataaaataggaaaaaaagagaaaatgtggctgaggccatccaaagcgccagcccaaatgttggggtctaagaggaacgtgtgtgtgtgtgtgtgtgtgtgtgtgtgtgtgtggtggggggtgggcctggaaggagaacagaattccagaactacacgcccaagacaggcgtccactgagcttcaagctgggactattaagaacttagttggaatgggctgagtcagggcagcacccagagagggcagcagggcctggccagcaggctggggggatgggggccaggtgccccatggggagacacagagcaggggactcagaggatgctcagtggattcaggtatagggaggtgaccaattgccacttcttcccagccccccctggaaagcactagacattcccgtggctgtcttcttacaggctttggacagagatggtgcagcctgcagatacctgtgcacacaggtggacagaagggactgtgcaggtggtgaaggtgggataagagcagtggcaagggccccagggcaggactagtggtgtgtccctcgcagtgataattcatcctaggacaaaagtggctatggggggtagggaaggctaccaagaacaagagtgaggagataccaagaacagggcagcctaaaggttaggaaaagtcctgaggcccagagaggtcagagcctctgaccaaatccaaacacaaattcaaaccacctgcacggtcctttaccttttaatgcaggcacctggtgttcctcgctagactccaagcctagaactgggccacagtcccgttcttcctctccccttctcaccctgtgttttgcccagcagagcaggaaagctgagaatgtgctggaaatgcttgttgaggccgacgtgtcaggcagcccatcagtgcaggatggagcctcggttgcagagaactgcagggaggtggtgtggaagctcattggctgtaagaactgctccgctgcgacagtgctgctggaggtggtggtgaacaggtacacccactgcagcctggagaggtggatgttgacgcaaagtctatgagtctcttgtgcagccagctcaaggctggctcttcaggatgtttgtgtcctgcttcccaaagagccttcaggcttcagaggtcatcttctccattcccctggctctaccacacaagccaccctggatgaggagaggttcatgccagagaggggtcgggattctccaagccctggctgcaggagaatttttggagcatgggggctgtcatctgaccaaagatgaaaataccacctaacagacgaggcaaggcccaccgtggggctgggtggctggtggagcaacagaaaggaacatgtgggtgagaaatgaggggaggatgcagtccagttcccgggtccagggacccaggttcccccgaacttcccaccagtcccagcttctttagaggatgtggcccagccaaggctgtgggggtctgggggcagtgggcccaagaataactcttacttatgtaggtctcttctcaaaggagcttggccatggtgacggtgatgagaatgttcaccagagccacatttttacaatctttatataatgtggtgactcgtttcctaagacctgaaaatacttcctccttatcctcacacctcgtcccagataaaatggcaatgccaaagtggcaaagcagaaagcagtgacttacctgaggccccagagcaagctgggcaagctccatgaaaaccagcttttcagcctgagcccagatattatctttgatcctggaccccattgccctggctgaccaagcctcggcatatttgatggaagtgttgcaattctggctcccctcattttcagaaattagtttctaggacttcttactttttaatccatcccctgataaagacccagttaagtctgaaccatccatcatgatgttcatttggcttaagatataaaagttttcagagcccacattcaaaactctaaaaatatcttcctcttttgatctaggtggcatctgtcctggtcatcggcctcgggtccagatggcctgaattatctgtctctctcatgcagtctttgctaaaagagaaggtctggtgtaaataatttaaaccccattcccttcccctctctgcagatttctgatgccaagctgatcatcgtctcagcaccagcaaagacatgctattcccgtccctgacgagcatttccttcttgagaaagtgattttgaggggctgcagatgtacttggaggaaggtttgggccgggacagatgacgtgcccatgtgggagctggacggcccctctctgggtagctccctgggaactcccatgtccgcctcccgctgcctcctgatccaaggtggatgcacttcatttgaggcctggtctttcgtccttccctctcctcttcggggaccactttgtctagtgctagactcattgtgcttcccccttggggcttccttcagccctcagccgattcaagacttcaaaaggaagttggacatggagaggaaaaaagaaatgaaaccaggaaggaaccgccaagaagcacacaacgcgtttatgctgccttaaccacacgcttgactctaaatgggtttaaaaattcttacttgtgttagcccaagaaagtttctgcagccgtctttttggtttaaacaatcaaatactcaataattctggggctggtgggccaggatatgggttactcagatcttctgcttcaccccatgctcggtccctgagccagttctgtcattggttctttcagaccagggcaggaaaagtcaagaaagcaaaagcggattctaggctgtggggtttgctgtttgctagccccctggcagagatgcctgtccttgcagtcctgaactggtggccaagtgtgcatgcatgcacgtgcaggtgtgtgcatgtgcaggtgtgcatgcgtgtatgtgcgcacacacattcatgcttgtacatgtttgtgtacacgcacacttttttctgctttcaatttcaagctgttgcctccctgatgtgtctgtttagtgacttgagccagaaagattcccggttctatgtgggatgagaatgaacgcaggcaggtctccacagaagtgagtaaagtagagctgagaagaaggacattgtctcatgccagcctgtccaatagccactttgccccagccctgcctcaagccccagagagatgacaaggctctctctgtttgtcgactccttgaagctcagaaaggtagcccatactctcacccagccggtgcccttcagcctggaacctttggatggaggattggaccttgtgaccttcaagttcccttccgaaccaaatatgctctaacccaggtatgctgttattttcttatataatgggagcaaggaggcactgggatgcccaaggcgtctagggtctcaccatgacacccctggtctcctgccctagtggtctggctgggtcctgcacagagccctctcttgtaatcagccagatctccaagagccacggctccacacagacctacccatagatggacggcagggtgtgccctgcacacattcatccctgccccgctcagcttcctgcccctctgccttcgttcagccttggtccccaggagaagcagactcttggaggcaattccaacaggctgcaattcccagtccagctccggcccttacttcctgcacgtctcagcctggcctcctcatctgtaaagcaggggagatggtgctgttgcccaggaagccggtcaccatgacgagagtacccgctcagatgaggatgcaggcggaggcggtgaaggtgctggaggccaggatgctgaggtagctgctcctctccaccagggtccagatgcccatggccaggacagctgcccccctgacctgcaggagaccaccaggttggagcagggggtggcgggggcctcaggagctgccattccttgagtgcccgctgggtaccaggcacttctcgtgcattgtcttattcaatttaggcctcctaagagcctgtgagaacagtgtggtggcctagctttacagatgaggaaacggaggctgagagaggtttgcaggcttgtccaaggtcacacatgtaagcgagctgcagattttgaatctgggtctgacttctgattctgtgcatcttactatggttcctactgcatatgaggcggggagaaatgacttcagttttggggatgactaatatacctgagtcccttcgcctcccctcccctcagagcgctccctccctctgtccacgtttccctgatggatgtggaggtgccattttgagcacctccccttgttcaatccttatatttgcccattggggaagcacggctgggccccttatccctccctgttctacagaggaaggaactgaggcccatggaggagaggtaaatggcccgagttaggggcagggccaggaccaggactcagagcccagggcctgcttgctcagtctcgctgcctccatgatggaagggccactgtgctggacaagttggagctccctgggaccacaggaggagggaggagagccttctttgctgtctgactccctttcagtcctgagagggggcagggacgggacactgctgatttgcaggtctgggggatgccttcttggaaatagagtacctgggaaatgtagctggggtggtggggcttgactgttctttcctgccatgaagctgaggagccttttagtgactgttatcctcagcagagcatagtgggtgggtgcaagtgtcctcaaggtgccagatgggggctgtttggagtgttttcccaggatttgggtcctctgggacctctgaccatctctgtcatttgctcctgggaaggtggacttctgtctcccagtctctctgcccgccatttagggacgggtccatttcctctgatggtcagtagatgcttcctcaaggggtcttgggtgtagccaaagctagagaagccctcccgggctctgttcacatcccctgatgcttttccctgcaagttgtctcccgtctgccccaggaagactctctgtataacctaacctgtcacttcccagttctctgttccggggagtcgcagaccttggctgagtaaatggaaggtggttcttagcaatgaacaggcacctacattactcaactcgcaagtattttaccattttgccattttctcttctgagctttgcaacagctctgtgaggatggggccgggcaggaggggccaggctatccctgtcttgcagataagaaaattgaggcttggagagaataagaatgtgcccaagatgacaccatcagagggtcagaattgaggtgcaaacccagttatttgagggcaaatccaggcctctgtccttggatcccccagagtaggctgggcctgcttctctcttacttctacgtttttaatagacatgatttcttcaaagtgccattttatctccataggtacctccagacaccacccaggctgcagcaaatggaatgggagaggctaacacaccataatttttcaattccatgatgcccattttttctcacattttaacgtctctaaaattggggcacatcttatgattgatggcatcttacaattacacttggcagtactttttcttggtgatacaaaaaaacaacagtgtatcttacaactgatagcttagattcagtgaaatcctagaatacaacaggtttgaaaattctctgtgggtgagtgttatctgtggcccatacaacctccatgaccagtgagggatttcctgagtctgggttccagcaaaatatcctggacagaattctttttgaccctctacagcatgcctggaaggcttgggcacgggtcccaactgtgtataactagctccgtgacctaaagagagtccctgaacctctccagacctcagtttcttcacctctcgaagaagggagtgagttatattagaccagtagttcccagcctgtaactaccaaggaccgtttgattattttttcccatgggttttatgttttgagggcttttgcctatcaacgtgcattaattaagtaataattcacttctcattttttattaatcaaaggcacatatagtgccaggaagagattctgaacagcatgagacagtcaacttgaccacactgagttgatctaactccagcaaaaggccaagaatcttggcttttcatgagaatagcctctttatagaaatatgcacattatctgtgatctgttaggcttcttaagcctgtccctcaaaccagagtgggggctgagcatatggctctggggccaccaaaagacatatgtttggactggtctggggaccatctgttgggagacacagaacctcactgaaagcctgatgaaaagctttgcatcctttgcccagagaaatggtcattcacacaaaacaatacccttggggccaggggctgaagtctattttgcactacctaatgacctgtggcctttatggtctgtaggcctcctgcacccctatggtgccctaagacctggctgtacaatcacctggggagctttgaaaaacccaggcccccctgcaggcccatccgtgtctgtgggagtgggacccagccatgaattttttatgaagttcctgggtgatcccagctgagaaccattgcccagaattaacgaatggggtccaggtgtcctgccctcctcttcccagttggtgacgctgtgctgagcctcgcagaacacagcggcttcccggtcgctcagtcccaggaggggccccttgaagctccaggttccctcccctgggaggagttgcctggagggctactgagatttgttcaggacctgaaccccatcctttccttccgtgtgtttgttagggtgtttgctttggcagaagctttaaggtagaaagtggggtaatcctgaggaacagaattttcatctaaaggggcaaaaatcagattatgcaagaaaggaaaaaaccatggctcccaggggagtcggaggctatgagaaatgcagccccggagaggagcagtgtggatctggccgacggaggcctgctctctgccagggcacctgcaggccacacaaatggggctgggatcttgcaaagcttgcaaagtgacgccggatcctgggccacggggcagggtctggaaggggtctggagggacacatttccctgattcaggtctagagaacaacaaatccacatgcattgctgtccagaagaaatcaggagatgagtctgggtcaacggggcctggttatacttagccaggggtctgcaggagccagagtgctgcaagtcctccgggaagctcctgccggggacgtggtcagctctttagaaagcaagctttcctctgagcaagggaaggaaaactgctcactgttggaatgggtcaccagagggtgccacgggagggcggaagtcagcaggtctgcatgccagtcctggccgtgcccttgactgggtatgtgactgtggacagacagttggcctctcaaagccttagtttcttcatctgcaaattgggggcactggatgggaatatctctgaggtcccttccacatggttaaactgtccctgttagtattgggcaacagtgttctgccaagacaccaccagcaagatgcttctggaccagcggctcatggctgtcactcaaaccacttggaaactgcccagttcaacagaaagcagtggaagactggtggggcagggagagcgctgaccccagtgagcggttttaacaaccattggcgtagagttgattcaacagtatttggctctttgtagaaactgggttggttttctgtggagtattaactgcatttctcaaaaccatagcctgtggccgattagccagcaaaccctgcatagggtgaagtcaggcaatgaggacgtgagcagaccagtaagggcagagcaggtcacccatgccgtgtaattttaggaacttctcatttataggagagaaacattgccaaagtgtggcccacgtcatcatggggagaagcgttagcttgaactgccacacatgcctggggctggatagaaataaggcagcaggcttgaaggaaagcaggcagtggcgtaacagtaaatgtaggatttttctttgtcctgctagctagggcttctgtgttgacagctggggggaggatggggtggggcaggagccaggaccatgggacgcccagtaaagaaggatcccccgggcaggggagttctctaccttcggtgctggggttgggtgggggagcccatggcatgggaggcagaaatgcactggctgacagtatagttcatttgtttgatgtttgctactaggaaccaagcatcacgctggactgaaaaggtttttggcctggacaggagttcccccactgggaaccacacacatcatccgtgtctctccttccaggtcggtctggtcaatggcaccatcacccacccaccctagaccagactagacacctcagggtcattattgactccttcctctccgctcaatgacagccagttctcctctgctctcaaacctgtctccatctccccaccgtcagctcccagctcctgctctacctgcaggctggcaggctgtgccccaaggcactccctgctgagcaatccccacaggctccaacagccagagccccaagcccagactcttttgcatggcctcagggctcttacgtgtctggccttaacctatttttggctttatcttctgctactttccttcctccgtacctgggctttaatcaccatgaacaaagtagttgcttttcttgtaaacattgtagatacccattaactatggcagcaatagtagagtggtaaagagggtgaactctggggtgaagtaccggtgtccgagtccaagcccctctgtttacggctgtgtggatttggataggttaccaaactctgggcctctgagaggctctctcctgtcccttcccaacctgctcacattgttctctttgccgttccttttccactgaattcctactcacccatgaagccccatctccagtgcggcacctgctctgactctgctgggcaggtgagcttgtccctctcgtgcacacctgtggcactgctcccctcacagcagccctcggcccgggggtgggagactcccccgactcccctcagaaccccgggcccagcaaaccacctggcacctggcagccgcccacatgagcatgggactccacgaacggggctttgtagggggctttggaaatagcggcatctgctcccctcacccgtctgtctgctgagctcctgaggcaacaacgagtatcccccttccctgttttatggccgtttttatttttggaggggcagtctgcaaagtgccagcagtccccgagggcaatggactttcctccaggtcattaggaagaagcccctggaaaggatcttcatgccagaccaatgcttggctattctcgttctttctttcaacccacacccactgtgcacttgctatgaggacgccaggctctcaggccatagtggggtccacacctgtcacttcacctgccctcatgtcgcaggccagtgactagatgggaaggcccagcaatcaccagggtgatttccattagaaagagaggagaatgggtctaatttcagggaggggggctggcaaacacagcctgggggctcaggagaggactgggaggccatgtctgagcaaggctcggttgcttgtaaagaatggtaccccgttcccacatcagaagagtcagctgaaccccgggctgcagtcccaatagtgcactgctgagcctggcgctcacctgcagggtagatggcacctcagtgccacacctgagcctctgagctctccaggagggcataggcaggcatgtatcaggcaccactgctcaccctgctcgtgagtgacgtttttctgagcaccaggcaagcacttctccccggctctgtccatgctgccattgccttggtttgactgaatcttcaaggacaggcttgtcatgctaagggccattttccactttgaggcattcttttcttggttctctggttttaaagagcacttgataaaataaatcagagcactgcttccccctctgtcttccccatcccatctacccttataacaagagcagaatctcatggggcataccgaggggtggagctggaaaggaacataaaatcaccttccaaacccagctcagtatccaagggaaaccttccttggagctgtctctccccactcctcagcaaaccattctgtcctctgtaccagctccatgtcttgcccatgtttttgtaattatactcatcactgcctatttgttttatttgctaccttgtgtgtcctcttttagcctcttgataaaaccttattcatcttggtgtctccaatggagtcctacatgtgggagggaagaaagaaggaagaaaggaagggagggaggaaggaagggaggagggaatcgagttcaaccccttttatattctggagggagaaactaaggcccagagaaaagtgacttttccacagtcacacaactagccaggggaagcatggagctagaactcaagaatcctaatgctcagtttagtgtccattttaccaattgggctgctgacccacacgaagctgcttggcccaggaagcaagttgtgcggtgcctgggctacagtagatctagagtccctgagctgcagatgggcagctaggaggggtgaccacagcttcatcctgacttgtctcactcaccatggccccgagcagaccaaatgcacatccctcttgatatggtttggctgtgtccccacccaaatctcatcttgaattgtagttcccataatccccacatgtcgtgggtgggacctggtgggaggtaattgaatcatgggggcgggtcccccatgctgttctcatgagtgagttctcatgagatctgatggttttgtaaggggctttcccccctttgcttggcacttctctctctcctgccaccttgtttgcttccccttccaccatgattgtaagtttcctgaggcctcaccagccatgctgaaccatgagtcagttaaacctctctcctttataaataacccagtcttgtgtatttcttcatagcagcatgagaatggactaatacacccctcagccatggccctgtcccccagcagatcctgacagccaagaggggtagaggtgccccgaaagccgtggggagtcccatgccattcagcatctcaagaagcggtgcagcagagaaaccagctacgaggtccctcacctgtttttcctcaaatggcaagcccaggaagggggcagaggccacgttcagtggggtgatgctgtccgaggtgaagggctttctagctctggcaaagaggtgagcagaaggccccaccagggcctccctagatcctgaagtgatgctcccaagccacctcattcccctgccaggctcggtcctccatcttctctgccacctgtcttggtcccatgcctcctttaagggctcccaagcttccctgtaggctgagccctcctggcggcctgggaaggagcaaggtctccgcttcaggagcagaggcagcctctccagtcacggagtgcttcccattgcctggcagagctcctgggaggctggaaaagttttgattatgaacacagccaagcagctaattaaaataataaattagagaaaaacattgcaggggtaatggtagctgcagggagccgtggaggaaaagggaggggaaagaaacacatcttctaggtggccgcctaggaaagcctgggccacattttctttttagggccatgaaagaggcatgaaagtgtggcattttggttcctcctctgctcagcaggatcatcccataatgattatggcttaactgaaaccctaggtggggtggggcggtgggagtcagagatagggtgacggggaagaattgccacctgaatcctgcttcgtgttttgcaaactttggaatgtgacccatttgggtgataaaataaatttagtgggttgtaacctgcactaaaaaaagtgagctaaaatagtagagaaaatatcagcatgcatctgtattaggattttctagatgggtagaactaatagaatctacgtatatatgaaagggtgtttattaaggagaatcgactcacaggatcacaaggtaaagtcccacaataggtcgtctgcaagttgaggagcaaggaagccagtggtggatcagtccgagtcccgaaacctcaaaagtagggaagccgacattgcagacttcaggctgtgtccaaaggcccaaaagcccctggcaaactactggtgtaagtccaagtgtccaaaagctgaagaacttggagtctcatgttcgagggcaggaagcatccagcatggaagaaagatgaaggccagaagactcagcaagtcaagtccttccatgttcttctgcctgttttattctagccatgttggctgctgattagacggtgcccacccacattgagggtgggtctgcctgccccagtccactgactcaaatgttaatctcctttggcaacaccctcacagacgcacccaggaaaaatacttcacatccttcaatccaatcaagttgacactcagtgttaaccatcacagcatcatataccgtaagggtaagtttagttttctgaatgtttcgtgtgagcatttcttatgcttccatgcatatcatgagtcaccatcagaaaagtctcaaagtcagcactatggacagagaaagtcattaaagagaccaggcatgcccatcagtctaatcataatagttatgcataatagctaagcactgagtatgtggcacaaattgtgctatttttctaaatagtaacctctaattcttacaggtattggtattctcatgtagcatatgaaaaaactgaggctcagtgagattaagtgatttgcctaatgtcttagttcaagctgctgtaacaaaatgccacagtctgggtggcttaaacaccagaaattaattgtctcacagttctgcaggctgggaagtccaagatcaaggtgatctgttctgggtggggctctcttcctggctggccaatggccgccttcttgcggtgttctcacctggtgcttgtctatggagaaaaagagagctctccctctcttcctgttcttagaagaccatcaatcctagcagaacagagccatgcccctatggactcatttagccttacttacctccctgtctccaaatacaggcacattgctggttagggcttcaacatataacttttgggggacacaattcaatctgtagcacccaatgtcccagggcaaataaataatggagtctgaatttgaatccaaacttgagtctgagccttcccagcatgctgtgctgcctcgttaattcatgaatgccccgaggacactaggaaagtgtgcaatttagagctggggctgcaaagcgtggtgaccaagcacacaggcctggggccaggcagcactgggctacagctccgggacaaggcacagtgcttcccattcctaaagcagggctctaagagagccattcacagcttcaggcagggctgggaggattaatgggatgatgcacctgcaaggacaagcacagaggcccaccatagtgagttccaggaacgctgggaactttgtttactgatagaccctatgggcctagacccatgcctggcacttactaggtgcttcatacaaattgtggactgagtttttaattgtcattttcatcactgacctggtattagaatacctgggtgccagtgttagctttagcaacactatcagaccttgggtgagattcagaaccgggtggcctgttccctgtctgtaaagtgaggataataatgacagtgaccatccaacagctcctgtcaaatgctgggctcagaactgcattggggccaacccaggtttcccctctctgtgctgggtttcgataaagagtgcagggtgatagactagagaggacctcgttctgggggagaaaggaagcttgtgtttcccctgtgctgtgcctcatacctcggcaggctcaggcaggaggaccgcgattggacgctgggggtgtctgtgtgggagggaaccttctcttgttggaagggatcctcactggccaacgccccctcctggggaattctggtgagttcctagggacttggtgctctgtccctagggactgggcctgcaggctgcccagtgtctaccccggaggagattgcagcaggtcttggggaccggacgccaggaacccctgtgttggagactgaggtctgaaccttcaaaatccaaccatcccccaccagggaaagaagtctgagctgagctggtccctgggaagctggtccacggccagccaggccctcggcaggggtatttttaactggaagcagggagcgctgcatgaaggaagctccccttgctggcaactgcaccagtaacacacttgctgcgcagctgtgtgcactgccacccacaggcccttctccttccctccccaaaaggatgcacacacccaacaggccctgggtcctccccaaccgtggtcaccatgtctgctgcccactcccacctacgggaccttggcacaggcaggagcgcagggtccgaggccttccacaaatatttgggcagagcacctcaagacagccctagggactaaagagccgatgaccctctggccccatctgctactgcccagccctctcctggtgcccggccggtggtgtctacacggagtccacctcctctaccctcccgtctctgcactttcctgaaagtgctttccccacagctgcccctctgttgctaagcccagtggcctctcaccgctgaccttctcaggcccctggcttccctcccacctcgctgactgttccgcctcaggctcccctgatcaaactgtaagcactgatcagcttgtctggggctctcttggttttagactaaaagtctcacatcctgggaactccctcagttcagggcaaactgggactgtgggtcaccccagactcaccctgaccttggggacaccccagatcaccctgaccttggggacaccctagactcaccctgacctgtggggacgcccatgtctccttcttgcctctcgtttcctcttgatctccatgctctccctaagggatctcctgtatttctgtggctgcagctgccattggggtggggatgatccccaagtctggggtgccagcctaactttctcctgagatccagacctgtaagctaactgcctacagggcatctctgctcagaggtctcctggcacctcgaaaagtcaccatgtctacatctgacctcaccatctgaccccaaacttctctctccagtctctggtttcaatgaagagctctaccatccatcaggagattcatatcccaggcacctcttccagccaaaggaatctcttcttgtcaatttcacctcctaagtcccttgactccaagtatttctgtccccgctgtcatccccacagtgcaggtcatgaccatctctcactttgatcggtgcgaagtctagaggaagtgtcaacagtggccattcctgggatggccagtggtatgggttggactgtgtccccccaaatatatgttgaaatcctaaccaccggaactgtgaacatggccttatttggaaataagatctttgcagatgtagtcaagttacaatgaggtcagaagggtgggccctaatccaacatgactggcgtccttggaagaggaagacgtcacgcgaagacagagacacacaggagagcagcatgtgacagcagaggccttagagattggagggaggcagctgcaagtcaaggagtgctgagaattgccagccactctcagaagctggaagaggtgataaagggtccctcccctagaagctccagaggaagcacagccctgctgatgccctgattttggacttgtagcctccagaactgtgagagagtgaatttctgttgcttaaagctatccagtctatggcactttgctacagcagccctgggaagctaacatagggagataaggacaattttcattttcttagcatacttttcagtattttagaggtgatctgtagtggatacacaagacttttatgattaggaaaaacatagtcattcttaaaaagaagtgctcatcagtaggaatcctaagcgtcctattggatttgtccctgagaattgaagccatctatgccacacagtttactgtcctcatcaacacagcttttttattccacaggagactcttgcccaggaagataaaagctgaacataattttattgttcatttcggggactttgcaaataacatttacacaaacagcagattgtacaactttttaatagcatctaatgactgtcttttcaccaagactcttcaaaaactcttgccttgccatgtcttcccatcccaaactcctaggtcatggctcttcccaatcttaatcaagtccctgcaggaaagatgctcaaaactcagacatatcccatttgcatttggttttctgagatgattctaagactctgtaaagggtcttctcccttaccatggtagcaggaaacctggctgccttatctgagggttgatttggtggtattttcaggcatttgacatctgatattcaaaatattgcatttatggaatgcaaccccaatcatccctgaattgtagccagggaaacaggctcctcgaacttcagttgctcaaggccacaccattagtagctggcagagcctaggtccagctgcctgcaaagcctgcactcttacccttctcctactttcccaaatttagtgagactgtaatacaaaatacttatattctggtgtctggctatttttgggtggtattcggctcccaattgtccagataatggccccaagcggacaggctatggtcctcaggaagacatcacccaggcaggtttcctgcggggagtcaccatagagaccatttccatcacaggcagcagcagcctgagcttccgggacttctgtttccctgccctgggcctggagaatgttaaccatgaaaggcaaatgggcttcggttggaaacaagccattattagccactatttcaggcagtcacatttcccacaaggcacttgtgcaacaagttagcagggaagaaagaagccgagcctttgtacggcggggccagaacacaaagctcattgtgatgtttgtgcttctattcagacgccacgtggtacggactccacgccaacctgcagactggattcttttcttccccctcagtaacaaacatacacatttgctttaaagtaggcagaatttgcccatgggtggtctttgatttggaagaaatcaacttcaaagtggtgactcacaaaaaacaaaggtggcttgactcattcagtgctcgggaaaggggatgtgtgtgcagaattcactcatccagaagcagaagttgaagacaaggagtaaatacttcaggtagacaatcagccagtcatcctgcttggtcttgtaatgggccatggctgctgagtctagagaaggcacacaggctgggctggggaattaccgagagccacctcacccctccaggagccagggcgcctcagccaggttccctttgaagggcttatttgcctgtcttgccagggatctttgaggctgtgggtgtgcagcatagagtaaagatcagggaatcgcaaaggctactggatgccttagtggaggtgaatttgggcagaattttccagaccttcaggtgccggttttgttctcttgacaaaggtctaacccacaaatcttccacagatttccctggccttgttgtgttcttattctctttccctgtctcatcagggttgcaggacacaagtttatctgtcatagacacacactctttctctctctctctctctctctctcacacacacacacacgttcagcatggctgctttgcagtggaaacctgtactgcacatccacaggtgtggcaggagtcccatatcagagcatctgtgccggaaagacctcaatgatgacccattctaccttacctggcctctacaccccttgacttcccagatgaggaagcaggtccagacaggcccagactgtttggcagaagaagtctaagagcctctggagtcttaactccttgggttcaaaccctgatctgtcacaaggtgtgtgacactttgggcaagtgacatgacttcccatctctcagtgttctcatctgtaaatggggataatgatacctacatcacagggttgttttgaagattgaatgggataatctatgtgacgtgtttagcatagtccttggcacatagtaagtatttaatgttagcttttattattacatgccatagagctggtactagaacctacgaccccaatcctaaaactccactctttgccccagcaccatgctctgtctcttgtccggacacccgtcaatggactttctagggaaagtcaacattggtgataaaggcagagaaggcccactgtactcagtaatcgcatttgcttcttagtcagtctgaacctcagtaagtctgaagcctctatggtttcctcttcacctggacctacttgtacccctgggcacctgcacactcacagagtagttgctctttaagaaattgtccccattttgggaagctcttttatttcagaaccatacgcaatgaggcattggttttgcccatgaccttctcttcctctatcattcccaaccccccatcaggccctcctccccgcttgctcttgcctctttggctggtgctgggccaaagcccaaattacttccctgagccactgctctgccttttatttcaagcttatgggctcatggagacagggagagaagaggagagaaaagaaaaggtggctgtcttatttgggatttctatttgcagaccttgaagaaggtaatttaagactgttagtcttctcattaaaaaaagacaaaacccatttttcttcaatttagtttgagagatagggtggtggaagagatataggagaaaaaaaggaagcctgtcaagaatggcgatggatgggggtggccaggcaatcgagcagaaggtgtttggaggtcattctgcagtcggccctgacaagagactgggtgcagcgtcctctgggtgccatgggtttttagtaagctgagggatttgtgggggcctgggcgctactgtctgcagtttccctccctctgcacgtccctcccctcccagccagggcccactagactcctaacacagaaccttctctcgatctgcagcagaggggcacgattcactcactcaaaccaaggggtcagggcccctgaaaggaaaattgtattttttaaaaaggacttcaggcagaagataggacttaacaaagaaaaacgtaattctaatggtaaaattttagccattattggtagagaagatagaaccacagaatgtcagggttaaggggaaaccttggggctcacttaattcaatcttttgcagacagaatgaggaaatttacccatcggagctaaaacgcacatcttaaaatgacttctctagaagtctgtaatcgatggttgcagttttctatcccccactattcaaggctccatctcctgtaatatcccaccacacttgggtccctgtgctgggagtggcaaaggccccaaagaaacttggagccggatgcctggatctcaaagctagccttgccattttactggctgtgtgaccttgggcaagttacttaacctctctgtgcaggtcacatttatggaacactttcgcgtgccagatgcagacctaagtgctttacgtgcattattctggtgcctctttccaatacccctatgaagtagggctagtcccattttgcaatataaccgaggttcacacaggttaaataacttgtccaaagtcacacagcaagtaaatggcaaagccagagttgaatgaggaatccctggctctggcctcaagctcttacccactgtgcagtactctcaggaccagggaacccagggcaaggcaggaaggggtggggggcagagactgatggtttccctcatacccactgtgcagtactctcaggaccagagaacccagggcaaggcaggaaggggtggggggcagagactgatggtttccctaatatttgttctcccctttttcattgggaatagagcatctccattttaattgggtacttggtcacctggagcaaaagacatttcccagcctctcttccggctaggcatagccaggattccctgtttgccggagagcggtatgtaagcagaaatggtatatgcggctttttagaaggatcgttttttggtatctgtttcatgttcatttacaaagaatgtacatcctgtcattgtagagtacagaattctgtatgtgtcgattaggtcaaatttgttaattgcgcttttcacatcttctgtatccttactgatctggtgtctgattggtctattggctattgaaagatgcctgttacaggctctccctacaagtgtgaatttgtctataccttatttaagtctcttaaattttgcttcgtatgttttgcagatattttatggagtacaaacagatttggagttaagatattattctggcggattaatccctttatcgctaataatgtcattatctgtcttttaacagttagaagtatatatatatatattttttctgagacagagtttcatttcgctcttgttgcccaggctggagtgcaatggcgcaatcttggctcaccgcaatctctgcctcccaggttcaatcgattctcttgtctcagcttcccgagtagctgggattacaggcatgcaccaacacacccggctaattttttgtatttttagtagaaacggggtttctctatgttggtcaggctggtctcaaagtcctaacctcaggtgatccacccgcctcggcctcccaaagtgctgggattacaggcatgagccaccgcacccagccagaagtatctttagagtggtgggggcatgtctctcttcaccctttccttcttcctgttggttggaatgctgatgttgtggctggagctgaagcagctctattgaaccgtgagctgaaaactatgggttgaaaaggagtaacaattagttcaaagattctgggtctcagatggtttcagagctgccgttcatccctgagctgcttacctccagacttagtttacattagagaacaacaaacttgtagcttctttaagctacatgtttgtgccaggggcactgcagtgggggcaataagaccagaggcccatggcaggcagtggtcgccgagctcttctgactgtacaccccctcaaatttcttatttataatttttattcatgtactattgtccatttatatagcaggtattcatcaaaacttcattttgcagttttgaaagttaaaaaataatgagggatagggatttcagtaagttttccctgtatcccagtatattgtctgttgccaccttggagaccactggtgcagagtgtgcatggagtgggtgagagctgaaggttaggtggggtcaggtcaagagtgaccttacatgtgaagctcggggacttgaattaatgtcctgaaagtgatgctgaccccaggaaggtggtgcttaagttcgagaaagagatggtggaggaatggagataggggacagacacctgactggcgcagagggaggccccatcaggcaggcagtgtgctccaggaagaggcaggagaggaaagaccccaggagtgggcagaggaagaagcagccaggtgggaagttgaaacagaggcgggggtagaaggagaaccaggggagtgggggtccaggtagccaaggaggacagggtgggctgcagtactgcatgcttgctaagaggtccaagcaagggctcacctttgtccatgaaggatacatggggatcatagggatgcaccatgaagggaggggaaacggagacctggaggtgaatattttcaaatgagaaggctgggagggaagcagctagaaggtcagggaaaggaagtgcttttgtgtgatgagggagggcggctcgggcatgcctagtgcactgggaaaggctccaaagcctgcttaactctgctgcctccggggaaggggacagggctgaaggaaggtgagtggaagagctccagccaccacttccagccctcctcctgactgtcccagtggattcccctctctgggacctcattgtaccccaatttccttttccctggagagtgatatatcaggggaggtaggtgggggaacatggcaatggctgcagctgcccctggagaggagaaaagcaaacataagccacttgatgtgagcttatctgccagcgaatggaggggccagggctttggataatcccccaaatcatttttcattgagctttgagtgtcttatgattgctgggaagccgactggccttcctaagtgggtgttatttctgttcatagcagttgggagctgggcttgggaaccaattgaaggaagtgttcctgaggggcaccagctagacagcagggggcaggcaaggcagagactcccactacgggtgtaaccaatgctggatgcagaatcacggacaagcctctgaagacaaaggagagggaccgtacctcccagatccctggcctcgcgacgctgatctcttccttggcctctaaaaggcacatctgtgtcctccctttggccctttgttcaggctgtggcctgaatctgaaacccctgctactctgtcccaatgctccagggctcagggggactctacccctccctgaaggtggctatttccaccttcccagacccccagggcaaagcccagcatccacggactgcagcagttggcctgggtgcttctcagcatcttatttaacagactgactgatttggttaccttcccgagcttgtggactgagatggggacagcggtgccacacagtggggtccagaccctctttctggctctgccctttacttgctgcctgtgcttggcgaggcaagctacttccctccctgagtgtttggtttcccacctgcagggaaaagcagcggctctcctgcttaggtcttagaattacctgggggactcgttaaagtgaagatctcagggcccacccccagagtttctgattcattaggtttagtgtgagaccctgaaggatttgctcccaggcagggtgactgataatccccatttgcccgggacagagggatttcttgggatacaggagtgctgttcagggttaaacctgggcaatcctgggaaaccaggatggctagtcactgctcccaggtgctgctggtcttgggaccacactttgcatcaatgttctctaaggtcccttccaactctgaaagtccctgtgcctgcagtataagtacccttcacctctgaaacaggc

SEQ ID NO: 2704 - DNA, 4958 bp, Homo sapiens
gcagactagacgctgagcgctcccgtgcgcagcgccccacgcagccgggacgcggcgccgctctgcgggtggaaccgccgcgcgctcccggcctcgggagctgagcccgagagaacttcgctgccttcgggtcgccgctcccgctttccactgtggaatgtgcagcttgggatagagagaaaccagggtttggggagcggtcctcctggagactttctctctgcaagtctccaaggttaagcaattctgacccactggaattcccagagcctgggagttaagcctaaaacgctctgttgctttaagcggcgcggtggggagtcgctggacactccttattttggttttacattaaaaagaaggcggacgagaagatgttgtaggtgacttcctagctgtgttaagttgctcctgggctgtgaatggtgttaatttctgaagtgggcggctccaaaaacttaacaaggaaaggtaaggtggtttttggtagtccttctaactattgtcccttaatcttacatttgggtcccaatttttgaagtgtatatttttttcttattcttctctctttagctcttatccctcatgctatcactcatcttctgtctcttggtatatttagtgggaaataaagggtttataaaacggttttaaaagggtcaacctctgggaaggcagataatcatatacagtcagtcccatcgtgtttcctgtagtgatgaatcttttcccataaaagaaactgatttttttttttcactcttgaaaatacatgattggaccgcccagaagcacaggtgactttagactcagattattacagtgagactgaggaagcgtcctggacaggaggcatctcatttaagtgttaaccaaggcagaggggggtcttcctgcagtaatttacgtctgaaagtaacactcggtagaggtgtagttgtttcaaattaaaaattcagcctgtagaaaagggtaggactgacgaattatgacatctgacaaattagcagttgaccggatatttaagaaatcagataaaataaatggaagtggaatttttcaaataaatgactcattttttaattaggtaaaagttcagccactcttgggtactgtcccaaggcataagtgataggaagataccatcttcaaggtacttacaggccattaccgacctgaactaaaaatcaaaccttttttttttatctggtggtattttaatgactcactgttttctttagcaggaatatagattttaaaatgtattctttaaaagttttaaggcaaggtcatacgaatttctcaggggagggaaagcaaagggttgacaacccaacatgaaggagttgccgaagttttgagctcaaaaggttggcaattagatccagagcatttgagaattgcaggtgccgattctaaaaggtgaaaggtggtcagcggcgtaacacacaacctctagataaaccaaagtactcaacctagagcataagaagagatcactttgtgggagtttgtgttgctattaatttaaacaatgatctttgttagatcaatgacttgaagtcttggagggaactaaaatcaacccagtctgaaaggaaaacagaaggaaaaaaagaaaggaggagatggtttggtttttaatatttttttctggtctgctttacccttcaccttgttctgatatacacactgttggcctctttgacttaattattgcatgctggaaggatggggtctcagaaatttcccaagcacctagcttcattattaactttcagtatgtgtcaaatgaagaaataagcctagctgtgccgtcctttacctggctaggtaggccatgctttaaattaattagatcaagatattctgaatatcaatcaattattaaagatttattatcttcctcttggtttttgcgtttacagaagtttgtaggattgagaattcatcatcatcattttttttaccaatctctatatttttaatagtcaacatatttatttttgattcccccactgtgctgctttaaattaaattttgaaagaattctgcccaaagcagtagtgatactgaggatgaaataaagacagaaagcaagggaactacatgcttctggacacgtgttctatagacttgctctaactagtgttaaagactactcatttttttcctcacatgataagaacattcatattagactatttggtttactgttctaggtaatgattttttaaaagattgggttaagatgaaattattttcttacaaaaggatttaatttgcttttcaaattctgctctgaagctcaagattaaatcatgtcccaaatgactgagctttcattgctatagaaaagcatttggctatttcagtaagtttccgcctccacatcttaagtctcttgatttttcagaaaaggtcaggggagtggatataagcgtgaagggagggagattttcttaaaattggacccaggctcaagtgaaactgtgattaggtaatcccagaagatacataattctggggaaaaaaaactctgaagagggtttaagtttgggattcatgagacttagaaaaagggtatgcttagaataaaggtagaatttgtgtgccaaactttgatgaagttacaatgaagacattaaatgcagctttaagtgcttgtcaccgtgattccaagctacaggttatattgcagtgtttcagctactggcctgattaggagatatattttctttccctcttgggaacagtctctgtgtcttaatgatgatgctgattttctggtttaatatcataaaaggtgtgtgttggtcccaacattactgctccaagtagtggcttcaaagagcaactggataaagattttcaataatagcaatgcagagatgacctgggtttcaagataggaggcctttggagccttcagagaattgtcatagaaatgatcagtaactaattgctcagttgccacctcaagttgttgtttccatcttatgcgggagagattcgggggaaatggcaccctgccattttttgtgtgtggtcctgaatcatcctgttggtaaaactcctgaggtcgtctgagctggagttctgattgcttctgtttctctcatagttgcttccccgtctattctgtgagcgtctgtatggggagaggcagtggggagggcgatctcgtccccttgaagtcaatgaccacctgcttttaaggttctcgtatcttttgctctgaaaaaggtgtgggggaggaaaactttcattttccagcgaaagtagaaagggagagagtgtctagaggaataaacggccaagaaacaggtaagttctgaatgtggtcctagtgtggaatttaccagaaagctcacatggagattaccactgccctcaaaggattgcaggtaaactagcaactgtgggaagtggaggctcctcctctccttttgtaattcaaatgttcctagtgtactgcaatagacactagtttgaatgaattcaagatatcatctcttggtaaaaccaaaagtaaactgattacaaaaggcacaaacccttcaaccatactcccactgtctgcctttcctctactttctgtgtggtttaagtacacctgaaaaaacaaaacaaaacaattacagctcagtttatgtaacttgcatatttaacaggagcatcttttttggttgttatgaatcttccatttttgtcatcataggaacttagtttatgtaaacaacgatttgtgggtgtgtctagatgcatatggtttatgtgtttgtaaagtaaaatacataaataagctgatcacgtaaaagtgattgtgactatagtagctcttttggtgcaccctatcaaagcttttagagtggagtcattttagaaatcaaaagcacaatctctgcttttctgaaggccatttcagggagatgacatcgggagaagacagagtgctagtgtaaccctgaaaaccctttgtgttttaggaaaatatcaatcttttggtctcaggagatttctggttctgcaaaatgtatgctttatttatagattacactcagccacattaatcaagaaaacaacatccagtctccccaaatcacgatatttgtctttggggatgctatatatttgtggttctcatgaacatggtggccctgcacgaagaccacagtgggttcctggtgggtgtacgctgaatgagcctcctgattgtgccttgcttcaatgaattgtcagttttgctcatattccctgagtatccaccagctggggtggaagacaacccgttcccagacgctatggataatccacatgtgggtgagcaagagttaagtatatgtaccaatgggcagtgggtgagtgtacaatgaatgcagggcattgtgcagctgaaacaggaacaggacgcctgtacctgaccaaggaaatgtcagcatattaatattataataaaaagtatctacctttcagagcactgagacctggctcaatcatgtttgtaaagcatttcacgtgccccaagaaaaacaaaaagtacagaagtacaaaatggacagggttttttcaggtgttgtttctcttagatcaatttaattcctattctgaaaatgtgtatttgagccttgtaagctcaggtaaaccatttgtgtttcaaaaacgagggttccaagttggtgatgataataccaccgtgcctggctgcattttttttttttttaatttaagatagagtctcgctctgttgcccaggctggagtgcagtggcatgatcttggctcactgtagcctccgcctcccaggttcaagtgattcttctgcctcagcctcctgagtagctgggagtacaagtgcacgccaccatgtctggctaattttttgttattttagtggagatggggtttcaccatattgcccaggctggtcttgaactcctgacctcaagtgatctgccc

SEQ ID NO: 2705 - DNA, 5683 bp, Homo sapiens
cctggcctcagcttcccagcagagggctcttctgcagaaagtgatcccaggatagggggctgccatgggagtcagggatttgcaccccaaatttcaggtggtatctgagctctgtgtgtccttcctacccacctctcagggcccagcagctcacctggaccacggaaagcacagaaagaactggctgaatgaatcaagagatcaagtgttctccctgaggccctgtaacagctctgcagctgactgcccagaaggaagcagaagtgagtgacaagttgggggaaccagagcttgcacaccataggcctgaacactagcctctggggaaaggcaagtccagctgaccttggtgaagttaggacccgggccgaggccacctcttctggttcaccctctgctggcctcccagcttctttggctcagcaacacccaggattccaggcatgtttgcctctggccttctaaaaatacccaggccacccagcacctcccagatgtctgagcgctgagtctgtgatttccctgccggtaatgggacagccccggggtgggcaggcgggggtggctcgagcagctcaagccacttcctctgcctcccatcccctagcctaccagaagctggacccagccctgcctcccaatccttgcaaggcaaaggagggtagaggctagcagacctcagagattgttgactccagtctcttcttgggacagatgggagatctgaagtctaaggattgctcatggcacttgtgccattaaggtcctcctcaccccactccccagcactgtgttcatgcctgctgctgtctcacttcccacatgctacttggagtctaggtcttggagcccaacctgacttcctccatgcagctgaaagctcctgacagcagtgaaggggaggatccctgtggtctccatggtgcctggaagagtgtccaatccagagcacaccatcagtaaacgtagattggattgaacaatgtagtggcagctggggcaatgggtggagcactgggctggaggacaaagcctctgaattctatctagcccagggtcagccactgtgatactatgcatcctcatcaattgccctggacaaacctgtttctcctgggctggataggatggtgtctaaggactgagccagctctgctgatatgaagctgcaagctgatgccctgctggatattcctgtcccttctctgctctactgtatgtctgggagagatggcacaacctgtaggttccatcagctccaggttctcagcttctgctcctccctccgtgcttctgaacattccacctctggtcctagcccctgaggcccagctcttccaatagtgccacttccacctctgctgctgggtacacaggggtgaatgcatacctacctcgctcactaatcatgtgaccttgggtaaggcattgcccttttctgggcttcagttttatcatatctaaaagggaataataaggcctaccttaaaggagtgctatgaggatgtaggagattccatagctcagatgtcaggttatatatcacctcctgcagaaagtctcccctgtcctcccaaggatggctcagatagcatttgttgctggctcttcagttctgaccttcccatgttcacactatgtggtcattggctctctatgcatccatcccccaccaagctgtgggctcctcaaggccaggagtctccaggacccagtacaggacctttacagatgaagtgcctgggaacgttttttgacagacacagtggatgtgagttccctgaaggcaagaccctgttggatctcacagcaccaagcactagatctggcatgagttagtcaaggttttggagcagaagaatggatggaggaaataatttctgaatcgaacttggaattgaactgcctgaactttaatgccctttccagccttagggatgataatgaattaccaaagtgagaaaaatggaggcgcaagctgttgtcatccttccagaggcaccctccaagtgtgtgtgggtgaaatgtgagctggagagaggattgacaaagagcagtgaaaacatattcctggaccccattctttttttttttttttttttttttgagatggaatttccctcttgtcatccaggctgaagtgcaatagctcaatctcggctcactgcaacctccacctcccaggttcaagcgattctcctgcctcagcctcccgagtagctgggattacagacacacaccaccacgcccagctattttttgtatttttagtagagatggggtttcaccatgttggccaggctggtctcgaactcctgacctcaggtgatccacctgcctcggcctcccaaagtgctgggattacaggcatgagccactgtgcctggcctgaaccccatttttatctctggatttttctctctgttgaagaattgctgcagaaaccatattctaagtataaaaggcctttagatacctaagatgatccccagaaccttgatgtgaatccatttactcatactttacattctcactttacactttgagcatgaagcccatggtgatctggttgtaaaaggtttaaaggttaattggcagccaatgttgggggtgagaagttgctgctgcaggcaggcaggtattcaccaaggcagcagagagaggaggcatctgccaggctggtagaaaggaaatagaaaaagaaaacaggccgagagcggaggctcaggcctgtaatcccagcactatgggaggccaaggcgggcggattgcttggttgcagtgagccaagatcgtgcactacactacagcctgggtgacagggcgagactccatcttaaaaaatcataataaataaaataaaaatacaaaaattatccaggtgtggttgtgcatgctgtcgtcccagctactcggggcgctgaggcaggggaattgcttgaacctaggaggtggaagttgcagtaagctgaggtcacacccctacactccaggctgggtgacagagcgagactccgtcaaagaaaagaaaagaaaatagaagagaaaagagaagaaagaaaatgggcaaaagcaactaaaggtaccacagatcaaaacctttaagatcagcattgggtacaccattgcatatctgctctgggcaaatccctttctgggcctcagtctccccatccgtaaaatgaacaggttttaccaagggctctgagggcttatgattctccaggagtttccttatgtgaggcctttctgtccccaaccatacagatcagatgaggtgtcatcaaagtcaagactccaatttctagggtttgtgggttatcaggctttcctgccacaaactttcctgccacgaacctcctgctaggctcctcagggggagttcactactgtggctgtctgggccgagcccccaagaagaaacaaaactctccagggtctggtgcagaggctgtggcccaaggtctgcttgctgcctaaggaagatatgaaaaggaagcctggctctgggtgaaacggaagtgtctgaggtctgacagttgctctcagcatggtctctgcagccaggagggaagtaaaactgtctgggcatctggtagtttctaccctgagagtccacaggacagtgacaagtggggcctggtgcaggcctgttctctggtccagagccctagcttaggccagagacagtctttggagagatgctggcccaaagatttggagggagggcaaaggagaatactctgaagctggttcatgaccttaggcaaatctctgtgcctctttgggtccagtttctccatttgcaaaaatggagtttgggctaaatttgcctgtgcaataagggtttctggaatggtgggcactggggatacagagacaatttggttacaaggaacctggattgttaccctgctggcaagggactcacagcctggtaggacatagttacagaatcattggttaattgtgattatcaatgcatgtataggtgccgaaaagctgtggacatagagcattaattcagcattcatccagagatccagggaaggttaagcaacttgcccaaggtcatatagatattaagtggtccacctggggccagagtcttgaaaggaaggggaattcagaagaggacatggctaaatagaagtctggaagaccagtctgcttgtgcttgctgctgtcatcaagatctgaacaaagttatggagacccagaggaggggagattaattctgacttaggagaaggaggaagacttcacagaagcagaggttttgagctggggtttaaagggcaaatatgagtttatcaagtacagaaagggagaagggtgttaaaagctgagggaacagcatattcagatgtgtgatgttgctaaaaagagcctgatgagttgctggaaaagttgtctgtgtgtgtttgtgcgtgtgtatgtatgtgcggtatgttaggaacaaagagtacctaaaatgggaggactgagagatgaggtttcatagtctggctggaatcacacagtgaagggccttgaatgtgtttggagggcagtgggcagccataaaagggtcttaagccacggatgcatggtcaaaatagcctattagcagtcttgctcgggctgctaggagggcagaggaccaaagtacagggctggggccaggcagaaacaactgtaaagaggcagtggcagaggattgagggtgtcaggtgtcaggcctagcccctgtcaagaaatagaaacttttcaagagactacataggtgtggaggaaacaagaattgaaacctgagcccagctgtggctgtggtctgggcaggtgccgtaagcaagggaagtgaaagggttggggtgacttccagttgaaggagggggatggcttgtgggggatgctaggggcctgtcctcaggctggagacctgttccaggacggggcagggtaaggggctatgcctgaccaagcccctgcctcttgttcctgccctcagagatcccacttccttctgctaggccttaactctttctcctgagatattccttccctactccccacccctcccagtgttccatcccaccctttctagcatcccatggttcctatccaggtcctgtaggccctccagcgaggctgccccgagcagctcaagttccttggcttctcctacaccaacctgcactgctcatgctgcctgagcagtggtctgaccatgttttgccttgaggcctgttttattctgtagtgttggttcaccaaactagtcactgttacttcactgtcacctcactgcagctgcaggtgcccctgtctcattgggctctgcccacaagagctcttgataagtcagaatcagaccctcatgtgcccagagaagctagcattgagtatgcctggcccaaagcatgaacttggggaggggctgttcatgggctgcgctgatgagttctttgttctggggcaaatcttgacatgattgtgtctgtttttttcatttgttcgtttgtttgtttttttgagacagagtcttgcctcattgcccaagctggagtgcaggggcaccatcacagctcactgcagcctggagctcctgggctaaaatgatcctctcaccttagccttgtgagtagctggggccacaggcatgtgctgccacgcttggctaattttttattttttgtagggg

SEQ ID NO: 2706 - DNA, 1773 bp, Homo sapiens
gaaagacaaaggccagacttgctgcctggaagtggaagcagggctctctcatctgtgttgagaaaggcactcatctgtgtatctagcgagacgggagaaagtggtcattttagaacaagccaccacaagccagacaaaggaaaccaagagaatttgccagtagcagatataccctcactagcagatataccctaaatgaatggcaaaggaagtcctctataaccagaagaaaaaggattgaaaaaaggagtcttagaacaccaggaagaaaagaagaataatggaaaaagcaaaaatggcaagttgagcagtgaagtggcagcctgctgtgttggggtgatggcctcacttttgtcatattaatgtgagatacataagcaggaaagaggttagagaaatttcctgaattacctggagccacaaagaaaaactaaaagctaagtttttatttatattgctagcatttttgttagatacaacggtatttgataccttttaacttctatcaaatgtattatttaaaaatcatcaatctagaattgatgcttaataattttgtcaaaaatattaagtattaatcattgtattatcatgatttttttttttttgagacagagtctcactgtgtcgcccaggctggagtgcaacggcgcgatctcagcggctcactgcaacctcagcctcctggttcaagcaattctcctgcctcagcctcctgagtagctgggattgcagatgcgcaccagtattatcacaatttaaaaaagggttttgtaaaatattaactctcaatctccactaaacctaaaacatctcatatacactctaatatcaaaaaacaaatggtttaactgtatttaaacagtgggaataaacatagagaggtcattatgtcaatatcaagttcactctaatgtgtgagtaaattttatgattaagaagtgttgtctaattgttttctaaggcagtgggactcacctagcacagctgtgaaaattccacatcttttcacactgaagtttaaattgaaaaatagaggccatgtaagtttatgaagtatggtgataaagttatttcgtgaccgttttttttaaatgtctatcaatggaaatactgtaactgatgtggtggtaatatttagctaccagaaaaaaaccatggctaagccttatgaatattatcacttctccctgtataggcctgcactggaaaagtcattcattcaactacagtattacacctctcatggtaaccattactggaggctgattctttacctctccacctcctttaatctgtaacaagagagtgatggctacaattccacagactttaaacactggtcagcatttaagtttttcttctatctttcaggaggcactaagaacatattttgcacaaaaaacactaataagattgcagaataaaagtctcaatcatgcatatattctttccccacttcttttactcttctgttgagttagtgcttaaaacaaaataccgcacctttctccatcaatttcctccatgaaattcaaagtattcaggtgaggataggttattttcacatccagcctgtgtatctcgctgcatcatgagaagctcagctgctgctgttgttttgtttttgtctgaaggcaggatgtgtttgattctctttttaaagttactcaagagaaaatgttgactgctgtaataaaaatctggatgaaattgtagtacaatgtgttctgagactcatactctaggaaatgtatgcagagtacactgaga

SEQ ID NO: 2707 - DNA, 652 bp, Homo sapiens
ctgtcaattctttgaacacctgttagctagcattccaacttggttggtttctgtcatttgcaaccgagaattctgtctcttttgtctggttgtctctctgtggtcaccatgcctttatcagtctgtgtcatcccgggctgaagttcctcacgtgatatttagttgcttgtggccaaaacccgccttcactgcaaatgcatcggttcctcatcatttctcctctggaccagcaaggggctttcctctcgcccatccatctcccaccttttcgttttgtaggtagaacctggagggagcggcagtaattcatcatccatggaacgtgcctgtctgtggcctggacctgtgggatttggccggcgttccctttgcattacatttggtacttggaagcaagcatccctcagtagggacaaggctccagctgtccctttcattagggccctgccaaggacgtttcctttgttcagcacctcctcctgcctgcccttaggaccatcttccaaaaaactctgctctgccctcacccgctgctgtcccctcccacctgtaagaccaggccagctcagcacctttccctgtctccttgtctagcactgctgcttctgtgtgatgctccggcatggtatttctcccagaaaaccactggcag

SEQ ID NO: 2708 - DNA, 1488 bp, Homo sapiens
ccggagcctggaactgcgagtggccgtggcggtggctgtgctgctcttatacgggacaccccggcacccgaaggtcgagcagggacccagcccctgccacagcacctgccaagcatctgggtgacactgtggtcgggtggggcggggggcttaagtcaggtgaatttgtcagctcgggcagctgtgacaaagttgcacagaccctggtggcttcaactgcaggaactgattctcctggaagcccgagatccaagggctggctcttccgaggccccgcttcccgctcttgcacaccgtcttcctgaggcgccctcacatggccatccctcggggcgtgtctgtcccaatctcctcttcttacaaggacgccagtcatattggatcagggccaccctgtcttaccttgacaacctttacctgtctccaaacacagtagcacactggggccctgggtgctagggcttcagcttgtgaatctgagggcctttgtctgcccaggcactgcctccaatagaacctttggtcctgcaggccggcaggtgcctctgcctccatgcagcctggccttagccctgccttcattccacctcccctctgggactagggatggtgctgggaggccagacaggctttggggaagttacctgacctctctgagccacgaggtcttcatttacaggatgtggctgtgtgtctcactgtgactctggggagggacaaggcttagtcagtgcctgcccggacgcccacacccagcacacagtaggtgctcagaaaacgcagcccagattgttggaggcagagggacccaggggcccctggaacaaagccctcgttgagctggtagagaccaaggccagagagccctaggcacctcccccgtctcccaaggcctctggggaccccctttccaccgagacccctctgcccctgcccctccggtgactcggtggttcccacgtcagtgacagcagggcccctcccgcccaggacaagcaccaccgcaggctggggctgcctttccctcctccgtctcccctctgcccactcggatcccaccagcctcctccaagggcctgtctggcctgcccagtctgcgggactccagccatggtgacgattccccaccatctcttgggaaggactggagtcatggttcagctccaactgggggagtgctccggttgccagcggccagaggaccccggggttggggctgatcctcgtcagtcaccccatcaccagctgaagacccccagcgcctcccatgccccctgaggtgagggggctgcctggagcatgtgcccctggggtgactcgtccaggctaccagagaggctgcccaggagcacccgtgtgaggggctggcctggctcccatcgtcagggccagggccaggtggttcgcaggctgagcctgggctcctggatcttggagacagaggagacaaaggaagaggtctccagccatctgggccattggtgcact

SEQ ID NO: 2709 - DNA, 4844 bp, Homo sapiens
tgctgttatctttagtttattttagccccaatattgtatcatttgagatggccatttcttcatcactctggcattgaggagctatatgtagctacggtctgcaagccaaccatcctgggcaagtcaaacagacacttctacttaggtcttccagtggatgtgcctctctctggacatttaaaaaaatctgaatattgcctatggaatgctgccctcagctgtgcctggagcacagggcacctccagttcggcctctccagaagtaaacttgtcttctgcctatcttgtgtttgttgggaggaggtgacctgggactctactactattgatgaagaatccgaaaaagtcttctattagccctgtgccacaccctacctatgaggcttttgggaagaagcagagaaatcagtgtttactgcagagaacacagaagccagcaagcagcagggaagggaggcgaaccaatgcagcagcccaccgggaccgaggaggacacacgcagagcaagtcacaggaagcgcagctgaaaacaaatggacgcttatcccaaatgcacaggacacttaccaagaactgatggtccgtcaaagtaaagctcaacagctttggctggcaggacagtcaaacttttggacgacagaaagtaacagtgggaaatgggacaacatctgccagcaacgcgagaggccaagaccatggctgctacaggaggggtcagcgtcacagtacacgcatggcggcggttgcacatgcatgcctggggaatgtgagtgttcagacatgccaggagtccagcctcaccaggaaacaggcacacggggacagaggcgcaaacactgaaaactctcgctgaatccactcggctgagcggtggtcacgagagcacggccctgcgctccccacaaaactgcacctgggccccagggcgagacaggcgtggaaggtgcaggggtgtgtgtgggggcaggggctcctggctcagagccgtatccaggaaccccccttcaggctggagccctgccctgagccccctgtggagagactgtggagagccccctgtggagagggtgactgtgggagagcagcatcaggcctagtctcggctgtgaagtaccccccacctccacgcaggatcccggggattctgtcaaggtgggggccgcctgctcagcccaggctccctgaacgtgtggctagctgagtttgcggaagaaaccaggagagtgccaacaccaggcttgcaagcaagaggctccctgactgcctgatcctggagcgcaccccatcctccctgtgttccctgggcctcagctgttccccagtgaccttggagacaccctgccccaccctggctccacaggagccctgcccatcaccgcctcagctctgagtctcccctggggacacaaccttcctcctggtgcagaggcgcaggatgctgcccctaaggcccatcttcctctgcagcatgttttgatgtcagctcattcacaggaaagaaacaatcacatctcagtgcccagaatggggaccaataggagaggtcactgggaataaagcccacacgcaccccagggtccatgggctccccagaaatgcaggtggcctccgccagagccaacaagcctaagttgctgatcagcccctccctgcttccctgtgtggaagaggaaacagaggcccagactagtagggctctgccgtggtggccggctgcgtccccagacctctggtcccagggctggctgggagtgcccctccctgtgctcacttcctgctctcctgggaaatggctcagggatggggcgtgtggggacagatgctggcatagctcacaaaatgcttgcacaagggacactccatggcaggtccctgcaggagagcaaagtcacaacattcagagattccctgcactctgaggcccgcagagcctggccgaccaagcgaggctgggaggatgttgcctgctggtcagggcagccctctgatcagggcggccgagtgaggctgggaggatggtgcccgctggtcagggcagctgagcgtggctgggaggatggtgcctgctggtcagggcagccctctggtcagggtggccaagcgaggcagggagggaggtacccaccggtcagggcagccgaacaaagctggaaagatggtgcctgctggtcagggcggctgaatgaggctgggaggatggtgtctgctggtcagggcagctcaggaggtgctgcccaggaggtgctgtccaggcagagcctagggctggtgtgggtgtgccatgctcctgagaagtttctgggttgtggctttaatgttctcctgcagtgagaacgctgacacttggccaaagggtcctcacctctcccctagtacacttctgagatgccaggaaggttctgaacatcagattgattcctgggactcccctccagggtggccttactggagtcaggagcccctgccccactaggatggctctgcagtggcctgaggacagtgagcactgactggtcactggtgcaaagttgcccactgtgatggttttgaccgttgatgggaaccaagtgaaagccctgcagctatttctaggcatttcagagggtgcttccctgcatgtactctgctgcagaccatcctccctgggccaggagcccgctacacagtaggagattctttttcttctcttttgagcacttttattctctttttcttaatctctgctcctcctttgaactgagaaatgtgcaaatcttttttgttagttttgaggttgcttcttatgcatatttcatctggaactttcccctttgggggtgatctgttctatcagcctgcccgctgctagagaggccgaggtggtccggccagccgtgcgctgctgctggtgtctctgtgggcatgacctggtgagatatcattctgcatctgggggtccatcctatcagccctgtgttctagattccccagtgactgacatttagccagtctcctctgtcactctccagtgacatgtacacactgttggcacgaactgcagatgtcacgttctgtggctgagagcctcagtgtgcatctgtagtaggaggatgtcagtgaggactgtcctgtcgctgctgagctggcaccgactgtgcctggtctacactccaggtctgccaaacgacccagcaaggtccttcacaactcttctgatccaggatcacacatcacttgtgctttgatgcctgcttctgaacaattttacctcctgagatgtccatttttgggagtgtgagccctcctctcctggtgacagctggctgaggccgtccagcctcaggacacacagggaacggctgcataaggagatctggggcagggggcccaccaggatgttctgccctgtggggggcaacaccggctgtggtctgccggcggcatccagggacagtctgtctaggtgaggctgaggccgcccccactcgctccctcacccccatgctgacagcagtgagctgaccacagactgggggagccccacagggagactggcctccccagcacatgccccgcagtgccagacgcggtcatcacagaggcaggtacacgacaccacggacgtgccacgtacccgccatcgggaccaaggaccactgagaaaccatgaaggccatgcagcgactgtggtggcaggaccgtcaggaggccataggtgccacggctcccctctggtggttcacctgcccacctgtagctggggtggcccctccagtgcgctccccagagcagaacaccccccaggcaacacgtctgatgaaggccaacagcgtcagtcctctggtgtttggtgacatcaaagctgtgccgaaaggccttccctcactgctaacacttgaagggcttctgtccggtgtggaccctctgatggcgaatgtggtctgtcttatgcttaaagatccacctccattaactgcactcttagggtttcttcctctgaaaaggaatgaacacgggaaccccctcaaaggcatttttaaatgaagcgtggaaggcatcaaagatgtgctcttcttcaggactcaggcttctccatcattctctgttccttggaagcgtgagggctaaggagctgctgacttctctctcttggccccacttcaagaaaggcttgcttcccacacacctctccacgctcccagtgcgggactgacactctgcaccgggaggccaagggccaccatcgtcttgctgattatatgtcaagttctgtgtgaaatgagagaccatggggattcattattgctggagttgacggtattgcagttttataaccatctaataaattagcatttaatactgagagatttcatcttaaactcagaggattgctttgttttaaagaagatttttgcaaggagaagcaatggaaaccattcagaaaatgtgggagataaaaatcctattcaagaaaacggatcttggatctttgcattcacttgatttgtcagaatattattctgtgctaaaaaatagaagggattaaatgttaaaaatcactgaggcacaattctcttgagttcaccaattttgtactcctatttccagtttcttttcacatacgtcattctccatcctgattaagcttgttctttctgagctcatttctgataccaaaagaagtcataaagttctataagattaagaattctcttagaagtacagatttgcatgaacgtcaaagaaaaaaatatcacattttactcccatatgctttaatgattattttattaggtcaggcatggcttaggttagaacctttgtggttttttttttttttaaattccatttagttaaatgttgac

SEQ ID NO: 2710 - DNA, 1042 bp, Homo sapiens
cgtgagggatgtcgcgggtgagtggtgtcgaggcctgttgggtcagggcggttcgcagatgaaggcacactccacaacttccttctggccaggcccagacatgtctgtccttgtgagataaaagcttccatgggagccttccttcctaatcaagtctcgtggtggaacatctgacccttttcaagaggaaggatgaaaactctacataggaacacgatgtgaatggaagaaacctgtcattatgcaaatagtacggtattccgaacagacactaaaaatagctgtcatctcaaagaatccagtgcttgtgtcacagtatgagaaagtagatgctggggaacagcgtttaatgaatgaagcattccagccagccagtgatctctttggaccttgcattctccatcagattggatcacctcccaccctgaggccccccaagactttgaacagttcttcagtcatccttacagaaagataccctctccagacaaacgcagtatttatatacggtccattggatctctatgaagcaccagaattatcagtgaagaatatattaaatggctcacgggctactgtaaagcatatttctatcgcttgagagtaaaactgctagaaccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatctttacccaagagacttgtggaattttgtctttggacaggcctctttgacagatggcactggtgaggtggattgatgatgaatcttctggcacacctggagcaactccagaacacagtcgtgaggataatgggaatttactgaaacccgtggaaggaagcctttaaggaatggaaagagtggataataaaatgcctgactgttctccaaaaataaggaccttcaaataggagtgattgaaataaatgactacttgcatgttatgctttcatttgggt

SEQ ID NO: 2711 - DNA, 459 bp, Homo sapiens
gggaagaaatagacaggaaacaaagacagaatagaaggagcaatttaagtgccaggattcaaaaccaagttgaaagtgagtggcagaaggtcaagtcaaaagtattaggcatatgtcagtgcacagttactaggagagagcaggcttctgtaaaaccagggaagcacaataggattctgatgaagatcggagacagagatcaactgccatggcctttatacacaatatggttacagtcctgatgttggttgtgctgcattgtcatctggtggctcacttgggagagaaaaactgttcccagtctcattaatcctatatgaatagaaatacaaggaaaacatgatttaacagtagggaaacataaagaagatacaacaattttatttctcctggtgatgtttctttgcaagtggctttggtcaaagagaaggtaagagagcaaagacaattctatgttag

SEQ ID NO: 2712 - DNA, 16482 bp, Homo sapiens
ccctggccgccgccgccgccgcctccggttcccgccttgctccacggcccgcgcttcggctcctgcttcccgggctgctgcgcggaggcagaatcctctcgtgctcatacaaaggtgccggggctcccgcgaggctggtacgcggagtctcgggaatccaagcccgggccgcggtcctggcaccgaagctaacccggaatccaggggcgagtctgagccgcggctggaggagccggtccagctgtgccggggggcggcggggtcgactgctcactgcaaagctacctccgtgcgaccctccccttcccgcctcttcccctccccccaccagcccgatctgggttcttgggcgcttattgttttaatgaaatttttggttgttgttgttttggtccttaaatgtgattttagctgcgagtaacgtgtcctcgctcctctcgcgctctctcggagggttttcagagaggtctcagtgcatccattttctcagatcctctcctttcggggcaaggatctggggccctgaatgagccttggagctcgaagaccgcggctcgggctctcggagggctctgcgcggtggccgaggaagctccggggtgacggcggtggttctcctgggctggacgacgtgaggggagcaagcggattttcccagcaagatctccatgtacagctacatctttagggccgctcgggttaatatatgtcgtcagaggctcctcacgccaatcccggggcggcaggggcggcgcctcgagctctcggcaataaaactttttgatgttcacgttgctaattgccgaggtcctcttccaggattggctacctcctcataaccataagataattaaaacgggggggggcagggttaaaaaaactttttttatcagtcagaggataatgcaagtgtttaacagatgcttcactattaaaatattttcccccaatattgaagaatctctaaccaggtacagtatcactctgctctcttttctggttgaaaagaaagaaagaaagaaaacgcaggtattgcttttcgaagtgctttgtaggtaatcgaggtaagaaaatatacgcaggcagcctcttacaattttatgcaggggcgccgggagcctcgtgacgggcggtgggggcccccacaaaggcgcggctgggagctggcgctctttgccccagcagggacgaggagcggctggagaagggtgtttctttgacccgtttacaggctcgaaacgccggtctcagtggctattgagttacccaccaagttaccccggttagagctgtttggggtggctcacgttattgcggcaaactttggagatgacggctgagtcctccgggcgaacatgtcaagccgattgtaaatgctgttatttccacatccttcagggacaccagtccctacgaagaccttgggcgattttgaagtgcgggcacctcgattccccgaatctgtagtgtggctggtatcggtgttcccctggtttaactagcctgtttgcgggcatctgtggaaagcaggtttagttatcggaggggaaccattaaacgccagtttaagaggcaggccgggaggacggctcgtggatgttgagactgctggccttggtgatcttgaacgcattataacggaaaatggatctccacttgtaagtcaccgggccgcggggcacccgggccgcagcgcccgtgtggcatgagcttcttgagaaggctcacgtgcggcgagggcgggtggtaaatggcaggagctgaaatcaccccaggcttggccccaagccgagaggggaggctgatgtgtatatgcagattccacccgaaggagttcggtgtggaaaacggtgtcaacaggagcccgcgggctgtaaattagagggaggcgagggcctgcggcgccagcgcgggacagggcggcctggggctcgccgctggtcaggccaggttagcccaagggagaccaaagactccaccttgagcatcgccctttggaggcgggcagagtccggccgcaggccacaaagcgatccccacccgaaggactccacaaggacagtcctttccttgctcaccgccgacaaagtggttggggcaggaaggcgaggtcagtgcgaatggagggcgcccaacttcggtgttgcagttgactctgtgctcgggctctgccctccactagccctagagtcttgggcagcaggattgagaaatatatatatttcaggtttgccgcggctgggcggtaggagacagggacttaaaagcccaggattagagtcggtgcagggcccattctttttctaggaaaggggttaacatccttgaacgtccccagacaagcgtcttaaagcattgaacctagaatagggattaactgaaactaggctcgttggtaagcgccaggggcttgcagttgagctcggaacaaaatagtgacctactgctctaaacccccaacttgcgtgggtctgcaattttttagcacaaggagagccttttaaagacctggttcttcaaggaaagaatgcaggtagtgtggttgggggttctgtttacattttcacccggaggcaaaccccgaatgtgtaaatactggtagttcaattctctgacatttgatacgtttttgaaaagtctgtttataaaaacacatttaggccttgggagcaggtagacaaagtaagattgcactggggctgggaacatataaaaattcagggaaattagttggttggctgctttaagacccaaagggagttttgggaattgaagggaggaagaagagtccagaggagggctgagttagggattgagatgctctgtccaccagagaccagcggtgagtggcctcacttttgaaagcttcagaacttgccacatttagcttttctcatgcttttaattgaaacaaacaaacaaacaaaaatgaatgaattacctcgtggctccagatagcattgcaagtggtaaaggaaatggacaacatggtacagaaaaaagaaatcataaaagatgctaatctgaacatcagttctcactcacagtgtcattatcagttaactgctgtggtccaagggcctaagacttgatgtggctcagaaacccaaatccagaggtcactgccttagaaagctggcttgatgagaggggacaaatggatgaaccctagtggtgtccccaactgtagtaactgactcagggaggccaggctggccctgactggttgagctctaccctaaatgcacaaacgcatccacttttctcttgcagtgtcctttggcctgttttgttccaggttttccaggatactgggttagcctgctcctttgggaagttgtgaagcaaggatgccatctcaagtttgccctcaatttaggtgtcctgggcatcctggtggtagtgatggaggtgttggcagtggtggcaatgaaggagagggtggtgttggtgatgagagggaaagtgggagaagaaagggagaaaggcacagtccctgacatcgatgtcagcatggggaccccactcctgggctgcactagtgtagctgctgatgcacatgttgtaagtactcaaaggcccagggaactggcttgctgggggctcctctgggtgcctgtggaggaatcttagctaggagtgcttctctgcctctcctcagaggctgagggctgagccaaaaccggccttactcgtgtccagaaactgcttcacaaggaggcagcccaggtttgggtgagtgtttgggattctgtacctttgttgtagctgatggtgtacctactgtactgcacatgtcaactgccttcagccaaatagacagaatctggttcaagcatttattttgctcctcatgtctcttgtctctttgccgtcactgctacttctttctctggaaaaagacggaaagagcagcagagaggctgaacatggccatgcaaacattttggtcttgtgagatattattatacttgaaaaaatcaatctggtttaaactaattttaaaaaaatctttagttaggttttagggaaaatacagattgtctcagggtgtttattatttcaaaggcaagggcagtttatatcctctgttttgctcataagaacccaaaataaactggacccaaaaagaatcaggccagagggtcataaatgcacattttatgttcatgggaattatggctcaattctcatcatcgtctttcaaatcttgtttcaccttgtttttctaaccaacatagtggaagtgactctgaccgttcccttaagaatctttaatgctcttacatgagatgagcctcagaacaagctaagaaccatcgaaagaacatcaagcctggaaggtgacagaaggagcaatgtgttcttgaagatgtcacctcagcccacctgctccaaggacagtgcttcttgcgacactctgatagctctgcattcttttctgtaccagggtagggtggagtcattttacatgctatccacttagtcccaggatgtttaggatgctcagaacaaggcatattgtctgagtggtggcaagggtctccctctaactggggttgtgtagtccttcctgtttgtgtagttcttcttgtatagtcttttcttgttggcctttgagaagtagttgtctacagacataccaagtgaaagtggctccagaagtgtcgtgctgctcaaagtacacatctgcaaagcagaatcaaattttgttggatttgagtgtctatttcaaaaaaggaagaataagaaaagctgcccttgtgtcttgtgaggtttttttttttcttcttcttcttttaagcaagttttttcctcttcttttaagcaagtttttggttaagggggtggcatatttaggggttggatcctcttcctttctcttccctacatggagagatggagggggaggggctagttcagctgaatgatgacagtggaggggctgattgcttatgaatccttcagtccagctctaattagaaaacagttaagttggtggagaaaatcagggcttgcttagtgcctgcacattccctcctcctctttctcctctccctctttcccttctttcttccttccacccccctccctccctctctctcttcttctctccagttctcccttgtaatttgccgtctagcagcatttgggattacaaggttttttttcttttcttttctttttttccctatcactgaatctgcaactggcatggaagaatgagatactgattcatgctgaagtcttttaagaaaaatcttaatatccacagtcagtagaattttcctttctttctaaataatcaatgactagatcctcatgttaactggtagatatgttgctgcactggagggttttcattgataaggaagaactaaatatttttccaggtgtctaagtgtgtctgtaaatctaaaatcctcattcagactaaagggaccataagataaccccgtgaaggcctcaaagaagcagcatgatgtagatacatgggacgtattattaacgttattatactagtcctaagaggtacagtaaatctgatctttgttaatctttgctactttgtagtaaaatatagagtttagagcaaaaccggtctgagaacctacatcccataggatttatgttaaatactcattcaaattattgcttcaagcaaattacatacacactagcgacattttctttcaagccgggaggaaatcactcaacattcagatgaggaagtgtgatttttcatacgtgttctacggaaatagtaaataatggacttcacctagtctgcagtgtattatggggttcagaataaaatatgagttcaactggcaatttcaaatgcggctttggagagaaaacatttatttgactgaaagatttgcttctgacttgaggcccaggaacattcccagttttaactgtagtgttgcattcctgggaagttctgttccatagcttcctttgcaaattcatgtagatggatttctttagctctgacagtttcctccaaacctttcctacattcttccagggcctttgcttatagacaggggagttacaccaggatggttaggtttcaggttaacaaaaagaaacacttttattgtcaatattaatggcaaacctcgatttttacaaggcttgggtttagcagtgtgagcagatcaaaagcagcttggtttgatttctcaatattctctggagcttagacaattaactgcaattttgctcctaacaaaacaacacaaaaaagttagttacagaaatgttataggtaatcttttggcagagatttttacctgagtacaacatatcagaatctagaaaatttatctactgaacttgagttgagttttgcaggaaaaccccttaagaaaatcttgtgtgaactacgtcctcggttgcaatgccatgagcctgtttcagtgtgtgcattccaggcttgcctttctagctgggtaaggatccggcagactgaggtctccttggtaatttgggtacaccaagtctccagttaatgatagataatcagcctttgggtcattcggtcattctcttattacaaacccctcctgctctctctgatctcctttcaaactaaatttcacacaaacaaataaagcaagacagggacaagttcttaaaaaaagagagagaaatattagaaacgcctgatacagaactctaaacaaggaaaggcaagctaaaagaggataggaaagaacatcttatcaaaatgaacatgttgtgtacaaaacattaaaagaaaaggctctggtttttgttaaagtgacagaaaattaaaataaaaataattgcaggcaccaaagttataaacagggaaggcaggatgctagctggaaatgcgcagcactagggagctaatttgttgttacagattatatatctgcaccctgcttggagaagtgctactttgttccattttccagaagagaatggtttttcttcttaatacttgtgtgaatgcccacttaagttaacacaggccacaactttgaggaatgagaaatggaattgcattctgcttgcgaagcatccaacttcaaacgaagaaattggttgtgtacaaaaaaaaaagtagaatttcattcagaatacgtttggagacttcactaaattggtgtgactgatgcttttttgttttgctgacagaaggcacagatcattcatgggcagtcctctccaccgcctggggatcttcactttcgcagtctacgactgcctgtgactccagaaagacaaactgcagattggccaaggaaggtctgattctgtccattgtaaagatggaagagatgaaaccaccagtgttgctgactgcagatggaagataattgcgtaagttcacacagccatttatatagaattcttgaaatgacaaaattatagaaatggagaaaagaaaagtgcttatcaggggttaaggagcagtggggtggaagagaggtgagtgtggccataaaaaggcaacaaaatggatgcttatgataatggaaattttctgtatcaatgtcagtatccttgttgtgatattgtactgtgtttttgtaagatgttactattgggagagactgggtaaagcgtgcatgggatctctattatttcttacaactgcatgaggatctacaattttctcaaaataaaaagcttaataaaaatgcctactgatcttcaggaagttcagttccctgttttccataactgatctgaaaataggggaaggacaattgagaatttaggagttgtaaactctgaggctgattttcagcgaactactcaaattattctgatttttccccttgattcttattatggattgtaggacattcttcctactattttggagaagaaaaaatgccacctctctatcataggacttctgttttacatatgatttaaaaatctattagctgactaatttacacactagaagatgaaacttggttacattagatccacaatttattttaaaaatcagagttctcatctttcttgtttcttcttcctgccttactttattttcttttttccttattctatttgaacccatattttcctatattgtactgtttagtctaaaaactagtaagcatgcatattgttgattaaattagcaattgacgctcttaaaatgagaactataaagactcttgagcttccacacattatgctatgcttgccatatgcttgggtgttcttattttcggagagaagtaatggagattataaatgttatttttaaaatttactggtgatttgttgagaagataaagtaacaacactattacagagggttgctcttgatctcccaggccaccagtgcagtcaccgagccctctgcaaacacctgataatgctgaagagtgtgttagtcattgtagaggagctgctgtcatgacaaataggggttaaattgtgagaatttcaggatatattttggggaaggattaaataaatcaggggacttgctgacagcaaatagtatctttgatttgaaacacagaatcagagaattgagatgaatcccaggtggtggttgggagtttgaaaaagtcccagtgagttggctgactaagtgtagacttcatttcaacatcattaaatagtctttaagtggtgacttaataattgttgccccaagaaaagattttgctaaatacagaggtggaattaagtatattaatccaagaaacattttatttaaatgattttcctaacagtaaggttggaaggccctagaactgcttctaggagcttgaagtgcatttaatagttaactgtcagaatgaaaaatgaaattttaaatttcaacaatgcaattaagttcttattttcttatgatagtgaataataaatttcattcaaggacgccattggcagatgttgaaaagaaccattttcactccactagcttgcagtggactaagaggtagcaggaagggagattggtactacagatcctgaaaaaacaaaacaacacaaaacaaaatccacaccacaaatggacacttccagatgcttaccaacaggaagtgccttggaggacaagggctgtgagacaggtgaactctagggaacaagaattcctagttccatgtctgtttacaagaatttgtcatgactggttcacctcactttatagtttcctcagaccaaagagacaaagaaaaagcaaaaaacaaaaacaacaaaaattctgaaacgaatggacaatacaaccaaaactttaatatgaaccaaaacaaaaattgggctgattttatgaggttgacttaaagtcaggaaaagaatgataaacttttgagaggaagaaagaaatcatcaaagccacgaggagctcaaagtggtgtttaatagcagctatcacattgcgcccgagccttgaccacttctgacgcagctgtttcgttttaagatgttcccattcctgttccactcacacagtcctccacagtgacctgagtgcacgcacccaagccggcaggccactctagaaaaccgtaaacccctcagagagtcactgcaggaataggggaaatggaagtgatgaaattcaatatagcatttagctgaatcatcatctgaggttaagcccagtgaacaattagcagtatcgggagtctcctcgtacctgtcaaaatcgcaccgacgggattttgtgcaaagtatgtatgtgtgtggaagttgttttttatgtttaatagcaatggacctggggtagtaatttagatacaactttttaaaaaaaatactaaagggcaagtgtggtgagaagcttcttactcaggaggatcttttcaaacattgcaaaacatcaggccttgaaataattcattttattaagtagcgcactcttgtcttttcattcacaaaaggaggatgatttattatacagataaatgcttgcataggatgatgaacacctgtaggaatgcatgatattctggaagttgatcaaggtccactgtacaccagtaattagaggtcatgatgatgataataataataataataattaataatggcacatactatgtgtcagctcctgttctaacttcgtttctcatattaacttatttatttttcatgattagccactaagatacaattattatccctgttttgtagacaaggaactgagtgaagctcaaagaagtaactaggatcacactgtcacacaggcaggaatgaaacccatgcagattggctccttagtgtgctctctgatctattatcattcatcacatatttactgagcatctagtatatgaaaggtattaggctttatgcaggcaatactttagcgaagccagggagatgtctctgccttctttgagcttatagcttggtgggcaaaaagctaatggtttaactgtataaaaaacttgatgttgtgaaatgatatatgccaatgtttgcatggtatgatgattttgattaagcaccataataaaaatagggagcctgggtctcacacagccttgattgtcttcttccttctgctccccagtggagtgcgtaggaaggtcacaccctcaatgtcaggctccttcactgttctcagtgagtgtctcaggttgtaggctacatgagcaggtttgcacctggatatgattgtggcagtaacaatagatgtgactatacacagtggcagtggcagtaggggtgggagttgggtgatgggatgatcttagaatgcagtgttggtattaactcagttttgttttgttttgatgtacagccagccatacgactctggaatatgactctgggtttaccaacttggggatggcccggggatttaggagatggccccaatggctctcctcttttttagaaaggactgttcaagttccttttttttttctttttaaacaggatctcgttttgtcacccagatcgggggcagtggtgtaatctcagctcacttgaacctttgcctccctggctcaagtgatcctcctgcctcaggtgtgagccaccatgccaggctaatttttgtattttttgcagagacggggtttcaccatgttgcccaggctggtcttaagctcctgagctcaagtgatccatgtttctgcctcccaaagtgctgagattacggtttgagccaccacatctggtttaagctatttcttctaaagatatagtcacatctattatctttgacccctgcctaagcaattctgttcagatcttaagactatttcttcccgggattcaaactcagagttaagtagagtcaactatatgaggtatatgtgaggttaatttttgaaacttttatttttaatttcatctgggatctcctctagggaagaccactttatgattatgggttgcattcccaagttcagttgattgaatttattcatacattatttaataaatgtttattgagactgaaaataaacttgaaatcctagaattcattggttgtcttaaaaattctaaatatgaaatgctaactttagcttcatgagtatttagaatagaaaataaataattcaaaaattgttcaggaaaaaaatccatgatttattctactctggaggagcatattcaatttaaaacataccgattcgtataaacttattggtaatgaggcgatatactttttatgagaacatatcaaaccatagacattgagatccagcatctcctgagtgagtaaaatgtcagggttttattgatactaatgataatgggagtgacatatgtgcatagagtaagtccatggttgaaagcctggctgattaggcgctgcgttctgtggtttttgccacttgtgtgtgattaaaccctgcagaatagagtctgttgccatgtatttggttcgtgaagaaaactagtaaagtgatattgaatgaatgattcagtttctcaaaagggtagactattggcctaacaccttcctaacttggagctgtcaacgtgtttagtttggttctaatgggagctaggctggagaagagaaaagttttgtgagaaaggttatgtgatattaataagaaccacattccgtttgatgttttctcaaatgattttttttatcttcctaagaaattgaatgattcaaaaataataaatcttccttttctatggcccacaaatgatcaacattttggatgatcaaaacaattttgtctttaagatatcacaacttctagtgcctctttatttgccagtgctgatttacagcagaaagtatcacttcatattttttccaagcatcaaagtcatgtgttttacaaatattcacaagtgcttaaaatccatgaacctctctctgtattcctatttttttattcttctataagtatgtatttaaattggttaaacagatggctttctacttttgaaaaaaaaaaacccactaagaatattcacctcaagatggagaactcataggttaaatttcattctggaatgcacgtttacaaccaggtaattaacctttgaaaatgagggtactcgaaggaaacaaggaaaatcttaacaagatgatctcactaacgctggtgtgttagacttctcagaagtagagatgccccagaagtttaacaatgaaaaactttaaaatatttttaaaaacatagttaatctttgtagctttccagttttcgtcctttattacgataaccttaggaggtaaacgcttcaaggggtgtatccttataatcataggaattggtacacagattttggtggaaagatggaggtgtcaacattaaccagtcaacatatatttgttgactgcctaccacatgcacaagtctcttccatgcttgcgaagagatacagtgatgtgcaatgtgtagaatctgcccttcatgagcttttgatttagttagtctgagaaggaatagatcagtgaaaagttaaaaggaataatagatggagtgttgaggcagtccatgattgttatctgagacattgagtttacaatgctaagttaaaagaatgagagatcactatgggatagaatggacaggaagagttcctctccttgaagcttgcattaagccataaaagacaaagcaattttggaaatgcagaatttggagatatgaagaaagaataattcccagaaagggagaagagttttggagccagacagatctgggttcaaatcttggttctcttgttctctagctgtgtaatcttgggaagttacttagcttttatggacatcttctataaaaaggatatgatagcgactattttgttaattttttaggattaattgagataatatatataaagtgttttaagcacttgataaaaggtaatcctctcagttggagagaacatcctaaacaagtctggaggaaggagacagccagccatgttcatgggacaaaaagaagactattatgagtggagggaaagattaagagaagtagagtgagatcacatggaaagataaattaggattagcttcagccattcacttgtttcttcatttaatactttattgcactctttatgtgggaagctctctcatgtgggaaaccctctgctcggcatggatatgcagagacaaagaaaacttagccttggatttctcttgaatgtcaggttaaggagttggaacttcatgctgaggagaattatatctttcaaaagtggaggagcttgaaagtagcatttttggatagttaacatggaatgtgattcttgtgacccaagatatgcattaagttaccatctcctagtggttgatggttaatgttgtgcctggagatgtgacccagattctcttgtaggtcattcctgacagagggtccattccaatgagtgaggaggaggagcttctgggctgaacttaatctcatctcctgaaataaagcaatgacattgaaatttttcatattgcacttgtgtttacatttctcatctaatctgagatattccacgtttggtgagtcttgctttgggcctgcagtcttggtgacccttattagttgcactggaatagctgtctattcagggagaagtagaatcctgggaatctggtcttcagtgactttctccatgatcatgaatttcatgagaggaggtccccttcctgttagtagatctctatagcaagaggttctgaggcacacaagcacactggatactcacctacagttctagtttaactgatggaacataggtatttctttcatgaaactttgcctggataaacagcttctgtatcttctagtgacaaaattttgcctcctgttttcccctctagctctagtcttaatctctacttccttgttcagtccaaggctcaggagaacccagatcatataagatatggaacctattgcttcctaggatgtccttgtacacagtgactaactgctaatttcaaggatcaatttctttctggagttagaatcatattatattatgtttcagaactgaaataaaattcttttaaggtgattatattttggctctcagcttggaagatgccactggggcatggcatacaagacacataacttataggaggacctcctttaatgcccaagtgccagcttcatgcttgttgttatatatcattttattcctggctttgatgcccacacacagacatatatccacacaaagttcaatctatatattttttgtagctgtttagctcaggtgattagggcattgagctaatgagaacaaggtcacagtttcagtctttgtgtgggccagcaaggtttgctttgttcagaggccacagacctggtccagccagctgtccagcacatgtctgccccaagtcatgagaggacggggcaggagtgtgtggatggacaagagcaaatccatcaccacccttagaaaaagtcaagtcaagcacgtgtcctactaatgggggtcaataatgtctcatttaaatggggctgacattttattacctcttgctgagagggtcttttgagcaccaaatttaaacattgtcgcttttttgtgtgaatttatttctaataaatggaaggttgtacaagaccttagatgattacaggtttccaaatacagattaatgacttcaatatttaagaagttgatgtgatattaaaaaagaaagttcagtatggctattcagttatcttcccttattaaaatctgttttggctaatgaaataaaaagttcataagttcttccgagagtaagtgagaatcattgccttcattcaagaatgaaaacattattattaaactcattgataatgagaccattaaaagttagcatgaagcaggtacaatacaattctttattattgaagtcttcagatattacccagcctacacatcccacctttcatttttaggcaaacaaattccccaaactatattttttttaaatttagcattaggtcttgttaggcttcaaatgggatcaaaaccaatcctttccaaagtgttctaccccagctgtttccctcacctgggtggtagtgagtataaaggcatttgatacagaagggggtggtggggcagagaacagaaaggaaacttggtgagagaatgatgaagaatgatatattagagattcttttaaaattcattcattaaacaaatgtagcataatggaaatgtctattaaattttttggcataggtaatgcacttgcaagggtaaaaacagaaatatgagatggtattttatgaaaagttttgctcaccccgcatccatcatgaacccaattctactgcccttgtatagccatttttattagtttcttgtgtactctttcagaatttctttatgccaatatatcttaaactctttcctttttttcatacaaaaattaacaccctatcaattttgttcctggcagggtgaggtggctcacacctgtaatcctagcactttgggaggcccatgcgggagaattacttgagcccaggagtttgagaccagcctgggcagcttagggaaaccctgtctttataaaaaaataaaaaattagccaagcatggttggtgtgtgcctgtagtctcagataactcaggaggctgaggcaggaggatcacttgcaccagaaggttgaggctgcagtgagccatgattgcaccattgcactgcagtctgggtgacagagaaaaactctgtctcaaaaaaaaggtcttgagcttgctttttctacttaacaatatgttttgtaaatctttctgtatacgcaaagtagcctcatttttcatagttgtatatcattctattgatgtgccacactttatttatctacccccctattgatggaccttcatatagtttctaatattttctattacagacaacaatgtattgaattactttggaatgcattaggtagaaagcattcttctttctttaaacatttgcgtagcattccactgaatggctatatcataacttatttctctagccccctattgatcgtcattgagtttccaatcttttatttttaaagacaatgtcata

SEQ ID NO: 2713 - DNA, 47056 bp, Homo sapiens
cctgccgtgtgaggtgtcagtgtgcccctgctggggggtgcctcccagttaggctgctcaggggtcaggggtcagggacccacttgagggggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccgcccagttggagcttcccggctgctttgtttacctaatcaagcctgggcaatggcgggcacccctcccccagcctggctgccgccttgcagtttgatctcagactgctgtgctagcaatcagcgagactctgtgggcgtaggaccctccaagacaggtgcgggatataatctcttggtgcaccgttttttaagcccctcggaaaagcgcagtattcgggtgggagtgacccgattttccaggtgccgtctgtcacccctttctttgactcggaaagggaactccctgaccccttgtgcttcccaagtgaggcaatgccttgccctgcttcggctcgcgcacggtgcacgcacccactgacctgcgcctactgtctggcactccctagtgagatgaacccggtacctcagatggaaatgcagaaatcaccatcttccgtgttgctcatgctgggagctgtagaccggagctgttcctattcggccatcttggctcctcctcctttttttttttttaatggagtttcactctcgttgcccaggctggagttcaatggcacaatctcagctcacttcaacctccacctcccaggttcaagtgattctcctgcctcaggctcctgagtagttgggattacaggcatgcgccaccatgcccagctaattttgtactgttttagtagagatggggtttccccatgttggtcaggctggtctcgaactcctgacctcaggtgatccgcccacctcggcctcccaaagtgctgatattacaggtgtgagccaccatgcccgacctacttttatttctttaaggaatctccacactgttttccatagtggctgtactagtttacattcccaccagcagtgtaaaagtgttcccttttcaccacatccatgccaacatctattatttttaaatttttttttattatagccattcttgcaggagtgaggtgatattgcgttgtggtttttgtttgcatttccctgataattagtgatgttgaacatctttccatatgctttttggccatttgtatatcttttgagaatgtgtctattgatgtccttagcccacttttttataggatttttttttcttgctgattagcttgagttctttgtagcgaatatgacgtatttcttaattttcagagttttgtaatcttcggagagaaaactcttaatttttagttttgtaattcattttgtaattcagataactacaaggcagattggcataaggaaaggtccattaatttagtagagttagcatatttggaaaataagggatagaaatattgattccaacagtagaaaatctggggtggagaagatgaaatgtgaccaactatttgaagtatgcataagactttatgcagaagagggagagaggaacagttagggcagatgtgattgtatgatcaaaggagtaggaattggacagtctgaaattgtatagttggagataaatttggatggaaatctgaggttactaaaggtattgcataaatgaaagataatgccagagtacaataagagttttcagaattacattttctgattttgagaatctagatataatttagtaactttttgctccaatattctcaatagttttttagtactagattttacattttaatatataatttctgtttttattatttttttcctaaactttttcctaaaattatttttgtccagtctagtacactgtcagtttatccttttcctatggaaataccttataactggttttcttgtttccccttttgccctcttccaactttttttcctgtacagtagccacagtgaccatttaaaaaaatgaagcaaattttttcactcttttgcttcaaacttgtgggtggatttccatcattctattttaaaaaatagattaatgaacatctagaagactttaaaaagaaataagctatttgcgatatataagggaaaagagttcgatacttctgaaagaactttctttatgatccataaagcaagacttcctgtcaggggttcagatatataatgtgtaatagtaatagttcatcaccactaggcactgcttcaaggacacacacacacacacacacacacacacacacacacaatcctcaccattattatatgcataaggtactagtatcatctctattttataggtaagaaggcaaaggcacagataatttgtatctaaaaatccagacaaggaaaccttagccaaactggtgatccccagtttcatggtcttctaatttcgtgatcccactgactgcagatcagtggtgtctgcaagacatttttcacttgtcatttcttgatttccatgcctttctactaagttcaatttgctgtttgtttaagtatctagagtgaaaatctgtgggagtgggaattttcttagtgtttgtctaaaaatgtgtttattttgcccacattttttgaatgataatttaataggatatagaactctagactaagatattttcccccagcacaatgaaatattatttttggatgctagcccctgttgctgcagttgagaaatctattgtttttctaattgatttgtttttcctctttggttactcttatttatttttaaaattttattgatgtataaaatacacataggaagtgtacaaatcataattgtacaactctattaattttgatatatatacacacttactttaccactcagatcaaggtttgaaaacatttctaggatccagactgttcccttatgtccattctcagtcaacatccaccctttcccctctagcacttggatctctctccttttttaaaatcataagctcctatctacgctcaattttttttgctcttttatccagcatttctaggtgtttatggatggaagtttttcaggtgatcttgcttgaaatatgacgttaagtagaagtctaaggtaaaggttatttcccattgcacttaaaataaaatctcacctacttaacctggcccacattattctgtatgaactggctcctgtgcaccccttgaacctcatctcacacaactcccttcctcattcaagcagcactggcctcctctctgttgcagagtacaacaagccctttcctaatgccaggccttgtatttgctgtccctctgcttagaacctttttttctgtagttctttgcatggctagtttacccttcaagtcagactgcaatgtcagcgcctcagtgtcctcctcagtgtgaccttaatctctactcatcactctatatatttctttcacagcatttatcacagtgtatatcttaattggtaatttatttttatacttctttaaaaaatcaccttttattttagatataaggactacatgtgtaggattgttacatgggtatattggacccagatagtgagcatggtacccactccctcctgcctcactctagtagttgacagcatctattgtcctcgtgtttatgtatatgtgtgctgaatatttagctcccacttatataaatgagaacatgtgatatttggttttctgttcctgtgttaattcacttcagattatggccttcagctacatccatgttgctgcaaaggacatgatttccttattttttatggctgtatagtattccatgctgtaggaggcatcgcattacccaacttgaaattataccacaagactacagtaatcaaaacagcatggtatgagtacaaaaacagacacacagaccaatagaacagaatagaaaactcagaaataaagccatacacctacaacaatatgatcttcaacaaggttgacaaaaacaagtaatggggaaagaactccctatttaataaatggtgcttggataactggctagccatacacagaagaatgaaactatacctgtacctttcaccatatacacaaattaagataacatttctttttcaaaaatttaatttttaaattttttgtttctgactgcttctctatctcaaatgtcagctctctgaaattaggcacattatctgattcataactatgtgattcgtcaccactatattcattttctaaataaatgaatgaaataacttttgtagcttcagaaaattttaactccaaagaacatatatgttacgtatgcttgatcactgaacacttaagagtctgttctcacactgtgaaccagattcctgcagtgcttaaggcactgctcactaggcaagttagacatcttctgaaatctgggccagttgtggcaagttaatgatagaccatttaatagactagcaaataaatgtattaggttggtgcaacagtgattgtggtttttgccattaactttcaatagtatatcaaaagatatcaaaatggcaatatttctggggtggttcataaacaatctaagccccattgatgttgggtcccactaacccttgttatctcacccccaacctgccttctgggtctaattttaaagttaagctctatttctcccttatctctcttttccaatataagctaccagcccatttcttgctatcaagtttttaaactatttctgcatttcaaatagagtcctgaaaattcctttcgtaaatcagaagggttatctgccattttctaagcagctgatttaagagaattggatatataattgtgccaggtccttagacagctcattatatatgtaagcttatattttattgcttcgagaaaactgcataaaagcaaaatcacaaattccagcagcatactgaagtgactacattgaatgtagatattaatctttgcattctccaatctcttatgtgcaaaaccatttgtgaaagcaaagatagcatgcaagcttcttaatgaatatttgtccagtgagcataagaataacaacattttgatattttcaatccaggtgatagagctttctttttccctctgctctctcagatgtctctagtggagtcaatggttaattaattggtcaatattttaaatatttattgcacttttaccatgtgtatagcaatgggagagggctattatgtgcagggggaagagagtggcatcagtaaggaggtggagacaaagctttaagacagtgtttttacatgaagataagagaacaaaatagtagtcatttagcaaatatttattaagtacctatcacgtattaggtattgtcttagacattggagatacattctcaattctcatggactttaaatactactggagtgagaaaaacatttagcaaacatattggtaaattaaatgatatattatggtgataagtattaaggagtaaaataaaggagtgaggaagtatagcgtgttcaaagactggaggcctataatttaaatagggtggtctgggaaagggacagtgagaacgtgatatttgagcaaagacttgagagaaggtgcaagtgatgtggatatcacaggagtttacggttatagaaaaatttaatattaagcagattatttgtatttgtttctaaatctaataaataaataagaaaataaataaataagcaaaaaatcttgaaacctctatgaatactgtcaaatcagcctgattagtatatgggtctgctctgctagtcctttacaatcctgttcttgcatccagttgaggtgttgtctggctgagcagatgggctgttaataagcttgagttctattgtgccatctgaatcttcttcatctctgtagcattagatgtatcacaaggtgagtcagggagctggtgaggcagatggcacctatgtctcactgtggttgcattaggcaatgtcctatgcatgcatatggaagtgcagacagacagtgcaggtgggtgggaggaaaccaactacccagagaattttcactaggaatcttctcacagcagaaaactggaagattgatcaccttatatttattccttcattacaatgaggacctccagagttttacagcctaagaaacgtgttttaagaggcaacttctccaagaacacttctctaaagaagactttttgtttgctctcttagactggttcaggtgtgactttactatgactttctaaacttctgctgaattctgctcttttcaccactgtacaggaaagggcaggccttgttgactataggattgctatgaaactttcttaaaagttacccagaggtggtgtctgtctttcagaatgtggaagatagtatcactttaatttggccatctctgaagatggaaatagggaagggagttggtattataaggaggaattttgatgttattttttctaccacttgcatatgattaatggccaattacaggtattccaagttagtcataggatccagttattctcataaaattcaaatggtcacctagaagtcaagtttttttttcccataaaatattgggaaagatttatttgtttcattgcttttgttttgttttgttttgtttttggagacagtgtcttgctctgttgcctagtctggagtgcagtggtgctgtcacagctaactgaagcttctatcgcctgggctcaagctatcctctcacttcctgagtagctatgactacaggtgtgcaccaccacacccagcaagtttttatttttggtagagacagggtctcactatgttgcttaagctggtctagaactcctggactcaactgatcctccttccttggcctctcaaagtgctcggagtgcaggggtgagtcaccacacctgggccagaaagatttatatattacattttatgatatctacaaagggaaacttttgctagaagaaaatatgtctattaggcaatcattcatgtcccaaattgcaattacaagaatcaaaaaggatggggagaaataaacatatgttgaaaactttctgtgtgttgggtgctttccatatatggtcatctatttaaacttcacaaaagccccatgaggaaggcattgtcctcaattgacgggtaggagagtttaggaaactttcccaaggtcacacatcaagaaagagttagagtctgagttgaatccagatctgtttgactccaaactacttctcactgtgctatttcctctctgcatggatggtgctttctgactttcccattagtaccattagttacttgttttacatattttattgtctctttggcagataatgggtattaggtgccaagaattcattaaaacattataccataaaacaattatttataaaacaatataatataaaaatagtattaactttctgtattagttatctattgctatgtaaaaattatcccagttgggtaataatgatgcgtcaatgtaagttcatcaattgtaacatatgtaccactctgttgggggatattgacaatgggggcggctctgtgcacacatggagggagaaaggatatatgggatatttctgtacctttctctcaattttactgtgaatgtgaaactgctaaaaaaagaattcttaaaaaaatttcaaaacttatttacccccaaacatagcaagtaatgacaatatatatttatcactttctaagagttaggaatctgacaatgacttagatgggtgattctggctcaggatcccttatgaggctgcattcaagctgctggctggggctgcagtcttctgagggcttgtctggggtaggaggacccatgtgtaaggtggctgtgaagaagaagccccagttttttgccacatgagcctctcactaggttacttatgacatggcagctagttttccccagaccatgtgctacaagagagaaagagagtaagcaagctggaagctgtcctgtgttttacaatctgattttggaagtggtatttcatcacttctgctgtattctgttggtcagtgtgggaaaggactgtatagaggtatgaataataggaggctatctgtgagccttcctggaagttggctatcacactttctacaattttaatactttttcttggttgagaattgggaaaaacatcttccatgaattgtctttttgggcaccttttgcccgcttcttccatgataatatttaaaggttatctaatttgatcattctcttgttagcttagtatcaagcacatgtgctggaaagaactttgattattacttttgtagggactattcaggcttcatatcctgaacactctttatagaaagagatacagaattcttatcctgtatcttattttagctctaaccccaaccccaaacctaagcatcatatgcctgcaaattgcctcaataatgtttaaaaaaatccaatcatatctgatcaaatatagggccatctttctattctggagtatcttttctattactctttgactgcggcaatttttgttttatctccaattgtctcagagttgaagctggcaaagtgagagtaaatattcttccccagtgcaatgcactctgctatttagaccatgtgcatttggtttaatacataagtgcccagtgaataaacatgagttgattttctttaaatgacagctccatcttctcaggacatccaaggtccaaaagaccatctgtgtcattgtggtagacgttgtagcttctccttgcccatcttaagtgcaagtttttacacctcagctcttctctactcaggttgagccccttccctaatccaaggtgaccattatccctcagcagcttagataactcactgtagggattctagtgtcggctttttataaagctctctggcctctcaatcaaagtagtccagaagcccatatcaagaatattttatcttattatttgtcaaagttctactttttggaaggtgggaaaacacttgttaaaaaatgcacatttctaggccttctccagatattctgaatcagaatctctgtaattgggtgggtagggagactcagactatatctgtgattttttttttttttttttttttttttttgagaaagggtctctcagtatcacccaggctggaatgtagtggcatgatcatagctcactgcagcctcaacctcccaggctcaagcagtcctcccacctcagcctcctgagtagctgggattacaggtgcacaccaccactcctggctaatttttgtctttttgtagagatggggttttgccatgtcaccaaggctggtggtttttaatttaaataatacatttattaaaacgaaatttcatacaaagaatttacctttttaaagtatacaattcagtggttttcagtatattcacaaaggtcggcaaccatcaccagtaattaatttcagaacattttttatcacccccagaacaaatcttgaactcattagcaatcactttccatgttccctctccctagctcctggcaaccatgaatctactttactttccgtttctatgattactcattctggttattttatatatggaataatacaatatgtgtggcctttgtattgattggcttctttcacttagcataatgatttcaaagttcatcaatgttgaatcataaatcagtatttcattcctttttattgcccaataataatccattgtatggatatagtatactatgtttacccattcttcagtttatggacatttggtttgcttcaacttctagccattatgaatgctatgaacattcatgtataagttttgtgtggacatgttttcagttcttttagatattgttatggcctaagttatgccctccccacaaattcatatgttgaattcccaaccccaataccccagaatgtgattacatttggatacaagggtttcaaagagatgattaaattaaaatgaggccattagggtggacccaaatccaatctgatgtaagaagagatcatgactgcagagagatacctagggtacacatacacagagggatgaacacgtgaagagaggtggcaagagggcagccagctgcaaggcaaggagagaggctccaggagaaagcagccctggttggcaccttgatcttagttttccagctttcagaactatgagaaaataaatttctgttgtttaagccacccagtctatagtattttgttttgacagccctagcaaatgaatataggtgtacagctagaagtggaattgctggctcatatggtaactgtatatttaacattttgaggaatggccacactgctttccaaaaaattgcaccattttacaatccaattccttcacatccttgccaacacttgttgtctgctttaatttttttttagctatcttagtgggtatgaagtggtatctcattgcaattttgatttacatttcttgaacgattcatgaggtgtgcattatttcttatacgcttgtgttttaaaacgaagttcacaaataatttttattcattccaaaatttgagaactgctgtgcagatttatcatacttcaaagttgttacccagcttaaatgctttatctgggacttcagttgtccaaattaaagtgacctatgctatagtatggtcagtagaaaatatctatgttaaagttaatttatgagtaggccaatcagtccttaggagtatatgtgatgtgacctcagaaacttcacaccagcttgttttcttgcctgcatctgtgacatctaacctctgagagcagtaagtggcaaagtccactttgtcttgggagctagttagtgggaaagagaagccatccttgtgtgatatcctgggtgtgacccttgttatcactagagacacaaccatcactgtgcctcctcatggattaactgcaggctggctgagcctttagaaacaagttcagcatcccctagtttggacttactgctttatccaagtccagcttctgcttttggcttcactcaccttttgaatttacattcttttttgtctaattctgagaaacgtaggtgtttccaaatttacactctctaaatgtaactgagtgttgatataacgtggctctgaaatactgttggagagtctgggaaacaaaaagttgggcaatctttttgaggaaatgctgggcagtagtttttacttgtgtctctattataagtcacatgttcttataaataagcaagaaaattcctttaacattaagtgctgtgtaagaaaactggatggaaatacgtcacttttattcctccttaccattgctagattaaagtgtgtcacttacctgcatgttggggcctcgagatgctgagagtagaaatcaagttctgctctctctccatgaacttttggatcagcaggccgccactgttaatagaagtaatcctaaacccctgaaaatgcagtattattagcttgaaatttctaggcaagttttttttttaaagatttaacaatttttggcaatttctacacatttatattacgtggattgttatttctaattcctgctattaaatatctggcacaaaagtagggatgttaaatctttgcatttcagagctcagctcaacaaacgtggtgaagtttcataacaacaagtgggatgctagtctgtcagttttcagcaaaatgctatctctctttgttatgatgcttcttagtgatgatagtttctctgtaaggcagtccttggtattaactgaacataattaagctttacttctgcattgtagcaattaaagtaaaatagaagaaaaatctggcctgatacatgttagagttgttagattttcatttccatcctctatttctatttgtggaaaattctccattctcccaccattctcctcctaatgaagcttcaagggccctttcttccttttcccgccctctggcattgaggataaactagatcccaagattcagcagctacctcagctgactaggagccagctcaagatttttgtacatgttagattgaaaggcttaatggactcccaagggggagagatctaacaggcagttggacacatggacaacacatttattttacaaagttggacaatgaaaacaatatatcaactcaatgtttctgtttcagtagcaaaatatttgcaagcattatgtaataaaatatgaaataatatagaagtaacctgatagataatttgtacataatgtcttagtaatgtctaaggaaattggtaacatcaattcaaattacagaattatcataatggtttagttatatgaaaagactgttaacatttcattggtcaccattgataatctctttttattagatttatatttaacagtgattaagtaccacaatgtgctggcaacagaatagaataagggctcagaaattgttcctctccagtgatcttataatcttgccttatgcccatgaattttcttttttatttcttctgtgtggaccatggaacagtttgcattattactgctcataaattctgccctgatgagattagttttatagatgtagaatcaataatacttgaacacatttgcagctgtgtactgcccagtattgctcattaatggctttaaaagaatcagtgcattttgctagaagcaaagataatgagccattgattatccctgcacagcacaatttacagcccattttatttttaatgcaatgttaaattaatttgtaaaagatcagaagcattgctttattttcaagctgtgattaaacagttattgaacttttcatggagagcattaatcaattctcatctcttctgatttcccagagttctctgaaaataaagatgaatagcttgtgattacccacacttattgtgaggcagcaaacatggaggagaaaacatccttatggggttcatctctatgtgatggaatttgtcaggaagggttctagtccaagtatttttccttaagttcagattatggatatattctagatcaatgagtggggatggaaatttcactagagttttaactaaaagcaccttgaagagtatgaagatacatagaagttaaggcatgcatgtgtattagttaattcttccactgctataaagaaatacctggtcaggcacagtggctcacacctgtaatctcagtactttgggaggccaaggtgggtggatcacttgaggtcaggagtttgagaccagcctggccaatatggtgaaaccctgcctcttctgaaaatacaaaaatcacacctgagtgttgtggcacacacctgtaatcctagctacttgggaggctgaggcaggagaatcagaactcagaggcagacgttgcagtgagccaatatcgtgccactgaactccagcctgggtgacagagtgagactccgtcaagacctgagactggataatttataaagaaaagagatccacaattccacaggctccacaggaagcacggctgaggaggcctcaggaaacttacaattatggcagaaggtgaatgggaagcaggcacatcttgcaaggtcagaacaggacgaagagagtgaagggcaggtgctacacacttttaaacaaccagatctcatgagaattcactcactatcacgagaacagcaagggagaaatctgtccccatgatccagtctcctcctaccaggctctgactcttaacactggggattaaaattctgtatgagatttgggtggaaacacagatccaaactatatcagcaagagtcatgcttttgctttggaatgatgtatgatttaactatgctcacctacctgtattctttcttcttaaatgtcttttaagctcactttaaaaatatttacaaactcatatagcttttaccttctttatcatttattagcaaacttctatccttaaccgagtctagctaaattagatattaattgtacagaaggactaacatcattgtggtgaattgcttaggccactaaaatgaccttcagacacctgtttgacttcagaagtaaaggactgatttacattctcaatgaagtacttcatagtagatactagggagaaattataggaaaatgagcagagtagaagaaagtgttatatagagtcagatgtcacaatttttgattagatggtgatagaactctaataggaaagacaaaactgttctatctgggaattagcaggatgtagaggcttcttaattacagtgggaagaatagatttagaggggctaagaacaacaactagactttcctattaagggaagggcaagttctagaatggttgggataagaaaattatcctgtaagggctggaagaaggtccacgttaaatttagtatccacggaataaagtcaatcaggcaagcaattacattaggggcccagaaacaggctatagaaatccaagtagtctgtcaaaacccagaaatggggaatgagggacaagttgatcttacgggccccgcaggacagttagggagaaactatgagctcaggattccaatccctacttatcagaactaagtagcagtcctgtttaaagttagaataaatttagtggtgatgttcacccagcatcaagtatctactacacatgctttggcaggtctgatttgttggattagacaacagggacatagggtgaactttagggacctagagacgacctatggagagtgaaatgccttcaaataatactaacagggaacactaatgaaagtgtttacaggctggcccagtaagcaggtagtcatctaaagatgtggttcaatgaccgatgaaaggatcatctgcttcaaaatggctctttgactggcttgctgtctgattcagtatcttcagaccttccccactccctgccacttgctttctctctctttctcctagattttatttactctttgaattattgtttctgaaatatagatacggtgcttgggtaaaaagtcttaatgatttgaggttgacatgttttagactgaggcacagagagaataagacacagaacagatttgctttgtgtagggtaggagaggacagaagaaattagacacttagatagatatctccacagattgcaagcctgggttaaaagtagtgagtggtgctgaacatctggggaattgtgaaagctcttgttgctctgagggagtggagaaattccagtaaaggaatgcagagatttggtaagggcaaacttcagttaccttaaaatgttgtccgcgactgttctgtacagcagtaaatcaacaggttaagtaaggtttacattggaaggaaagatgggttgcgactctttcttgtttgtgtatgtttttgtgtgtgtgtgttgtagttcaaaacaaatacataaataaatgaaattagattgaaatccacaaatgggaaggcagtgggatgcactaacatgagaggcactaagtggtcacatgggaactgttcaggtagtggtgttgtcagagtcagatgtgtagattcctaggtaaagggaaggcatggttagacaaagaaaaatgagggacacataggttatatgcattaaaaggatgtagtgaggtgtgccttaaggaattgtaataagtgacttaaggagaaattgacataagattgaggaggtgttcagtatttatagattcaggatatggggctataaagttacataaaatatttgtagcagcaaagggcttgtgtgaaatcattgtacgtgttcagctttgaacccagatcattgctattatcttttctgtgtcaaagagaggtgtatgctgttttaggaaaactgaatatacaaaagtatatactcatatatataaacatacatgttggaagtgatttgttacattagaaaagggttcatttcagcattgaccatgcattcttgggggactattgcctttgaactggcatggccataggggaaatctgatccaagcttttaccaaggcagggagcccatccatagcaaatctgttacataagtattgcctttgtgttaacacttcacagtatgcagtaaagaaatcactgtctcagttttacagatgggaaactaaagtaagaagatatctaaagttatttagcaaactacccccgatttctaattcagagcttttcccagccggctctccagttgctcatcttccaccaatattatcagatgcctctttgctctgagactttccattaggtggggtattattgagacaactggaagatgatgcagctttgggctcagccctgggtttagacattggctctgtcatctattagctacaattaactaaacctctttgagtctatttgctcacttttaaaatggaatcagatgtctactttatttttttctacaaggattaagtgagatactgaatataaactgcctaggacagtacctgacacttagtaggtgctcaaaaaatgtttgattgctcgctccacatatgcctcagttgttcactttgtctatgaatacatgcagagctatcttaatgacagactaatttctgcaacgtcatgtcctttctaaatatgtagttcatttctttttaacacatgccattcatctaagcctctctgtgggctgtaaaagattcataaaattcttgattttgacatatttctagtgatcgttttgaattagagattaaagtttgaactactgcagaactttgcataggaatttgacttatttgtcttataccttaactgaaataaacttgatattagacctttgcttaagttagctgaattaattctgctttaattcaagttcatctctgcagtggaaaatgacaggcattattgagttatatacacttctcatccttgcaggagcaatttaatacactgcagagcctgtcaaaattcaattcaaggttgaatgactaatgcataaaagtcgattccatatcctatcacagataaagccagttatttctttttattaagtagatggggatgctatttggatctaaggtagtaaaagtttgaaactccaagctttgcaaagttagaggagatgtgagtgtgtggaaaactagggagtttcaggagtaacatctgcctaaagaaatgaatgaacacagacagagtttgacttggtcattttgtcctttatgcaagtacaatttccatagcttttgaatttaggagtaaacttaacacaaagccaagagctggaggaataagaaaagttttctaaggctcttactttctagcaatgctgctgtaatctaaatttatatgtgggtatgtatgtgcatgtgtacatatgcatgtatatgtgtattgggggaacctgcccccgatagtcacgtaggttcttttctattttccctaagtgtcgactggtctgagaaataaagggacagagtacaaaagggagaaattttaaagctgggtgtcctgggagacatcacatgtcggcaggttccgtgatgccccctgagccttaaaaccagcaagtttttattagtgattttcaaaaggggagggagtgtatgaatagggtgtgggtcacagagatcacatgcttcacaaggtaataagatatcacaaggtaaatggaggcagggggagatcacaggaccacaggaccagggcgaaattaaaattgctaatgaagtttcgggcacacattgtcattgataacatcttatcaggagacaggttttgagagcagacagtctgaccaaaatttattaggtgggaatttcctcgtcctaataagcctgggagtgctacgggagactggggcttatttcatccctacagctgtgaccgtaaaagacagctgcctccaaagcggccatttcagaggcctaccctcagggatacattctctttctcaggaatgttccttgctgagaaaaagaattcagtgatatttctcccatttgcttttgaaagaagagaaatatggctctgttccacccagctcactggcagtcagagtttaaggttatctctcttgttccctgaacattgctgttatcctgttcttttttcaaggtgctcatatttcatattgttcaaacacgcattctctacaaacaatttgtgcagttaacgcaatcatctcagggtcctgaggcgacatacatcctcctcagtttacgaagatgatgggattaagagattagagtaaagacaggcatgggaaatcacaagggtattgattggggaagtgataagtatccatgaaatcttcacaatttatgttcagagactgcagtaaagacaggcgtaagaaattataaaagtattaatttggggaactaataaatgtccatgaaatcttcacaatttatgttcttctgccatggcttcagctggtccctccattcggggctgctgatttcccacaacatatgtgtatgtgcatacatgtatgtctgtgtgtgtatgtatgtgtgtgcatgcacattagtgtgtgcaaaaaggcacaagcatgagcataggtcctggcactgcaggcaacctgcctgacatttttctggatgctgaaggtataggagtgaagaaaaattcctaccctatggagcttatattttagtggagggagaaatacaataaataataaaaataataagtatattatgttgtatgtctgatactggtaagcgctacagagaaaaataaaacaggggcagaggaaaaggaatattgtgggaggtacagctttgttaaatagagtgagcatggaaggctgaagtgagccatggaattattttggggaaaaagcattgtaagtagaaagagcagcaattacagaagctctgaggctgggcatgctggcatgttgggagaacaccaagaaggtcagggtttttgaagaaaagtgagtgaaggggagcagtaggagatgagatgagggaaaaacaggagtctagatcctgtccgcctatagaggtgacttaatggactttgtcttcttttggagtgagatgaaagccattggagggttttgcaggaataatatgatctgaattctatttctgtggctgctgtgctcagaatagactttagaggaacatagagaagcagggagaccaactagaaggctaggatatgacagtaaggtgacaagtttttcataatgccactgttgaagcatggctacaggaggagaggctgaagtaggaggaggacaagttaactggaggggaggaggtcagccatgaggccatgttattgtaagggtcatctacatgtgtgaggctaaatgttacctcttgaggagatttgctggatatgacttggggctatactcctaagtcttaatgcctgctgtcattgggcctacagaaaccatcaagaactttcattggaaaagactacagcaggctggctggcattttacctttgttgatatgtacccacagtccttctcattagccattttgccagataatacccaaactcagagttaatacaatgtcggtgcatttattttttgttatactttaagttctggggtacatgtgcagaatgtgcagttttgttacataggtatacacttgccatggtggtttgctgcaaccatcaacccatcatctacattaggtatttctcctaatattctccctcctctagccccccatcccctgacaggtcccagtgtgtgatgttcccctccctacgtccatgtgttctcattgttcaactcccacttacgagtgagaacatgcagtgtttggttttctgttcttgtgatagtaatatcagtgcatttatgatgaaatacactcttccaccaatattctctatgtcctgtcttggagattctactgattaaatacatttctcattctcttggcattgcattttcattttatttcttttgatgagaaattcacttttaatagggaaagtgagctttatgcaggcacatttttagaagtaatttatatggataattgtgtgtctttaaaaatttttgcatcatacaaaatgttcttatgtgataaatataagccagggtttcttttatcagtcagcaaatcaaagcatttaattaatttttgtgtgtggagagcacaatatagaactcagggaagagagctacaaagggaacagaagatataatttttttcccatgaaacttatggaatagtttcagcgtatacagagaaatcgagagaacaataattttcaaaggagcccaccaagcggtcatctagccaaattcctggtagaggtgtgaacagaattaggcttaatcacggaagccttcttagaaagatggacattgatggggccagatttttataatgagcttctatcttagaggtacaaagggagaggaaattccaaggagagaatgaaatgagttccatgcagaagatccaaagtcagtatgtttggggtagaaaaatacatggaaggaaaaatttagaagtgaagttggtgagtcttcactgctgcactggggatttgatatgagaatcaaataatgctggataagtagtgtcatataatgaaaaatggtgctgttgtttttttttttggagacagggtactccagactggagttgtagtggcccaatcaaggctcactacagcttcaaagtcctaggctaaaaccattctcctgaatagctgggattacaggtgtaagccaccactcttggctagttttttattttttatttttttttcttttagacagaatcttgttctgccaccaaggctggagtgcagtggcaccatcttggctcagtgcaacctctacctcctgggttcaagcaattctcgtgccccagactcctaagtagctggaattacaggtgtgtgccaccatgcctggctaatttttgtattttgagtagaaatggggtttgctatgttggctaggctgatctcaaactcctggcctcaagtgatccagcctcctcagcctcccaacatgctgggattacagacattagccactgggcacagcccctgctttattttctttgcacatttataatcaagcacagtctgaatgagctgttttaaaattccctatattatgcatcattttactaggatgtgaagcctgtgaggcaggaatttcattactttttgtcatggccagcatctagaacattgtccgcgcatagtgggtcccagcagacacccgctaaatgaattagtgaatgagctgcagagttagccaacaaagggaagcacgttaagccataggcctggtctacaatggattaatggatttcccattgaactttcagaatctgctggccttctatcacagtcgctctgctgcagagcaccatttttgctattataggcagtaagccagctagcaaacagccatgctggggtacttgccaaactcaacaaatgccatttagaaacaaaagaacctctaatggagacatcagccgtttgttaaacaaaccattagtttggaagcagaagctgcacatgtgatgaatctactaatttacagagcattattggacattagttaattgccagacaacttcatgtcccaggatacattgaggaagcctctattactaaggagagattggatgtcttgcctgttaatgattacaggacgcatatacaagaatgaacgagtgagtagctcctgcatcatcctagtgtttcactgccacttctagaattatttctgagtttttatttttaaataaaagttatacttacacgctgaatatttatttatatttatttatttattcgtttatttcttgagatggagtcttgctctgtcccccaggctggagtggcctgatcttggctcagcacaacctctgcctcccgggttcaagcaattctcccacctcagcctcccgagtagtagctgggatcacaggcatgcgctactgctcctggctaattatgtgtatatatatatatatatttcagtagagatgagttttcaccatgttggctatcctggtctcaaactcctgacctcaggtgatccacccgcctcggcctcccaaagtgttgggattacaggtgtgaaccaccgcgcctggcctttgctgaatatttaaatggaacagaaagataaacaattagaattagtctctttacccgaagtccctttccagatgcatttttttagtcattatccacatataaaatgtcacaagcactcctcttgagattttacttaatgccacatttaggagatttttacagcacaaacaaatataaccaattcttatttaatggttgcatagtgctctattttgtgtgtgtttaataatttaattaatgggacagtactgatagttggtatttaggttttttttttaaactgttatgcaaagaacaagataaatgtacctgtaatgtcctatgaccataatgtcatgagtatatttgtaaagcaagttcctgacagaagtatttctgagacaaggaatatttgtgtttaaaaatatgaaactgctatattggcatcttgaatagaaagtagccatgagagtgcctatttctcttcactgttgctaaacttacatattgtaacatttcagtttgtgtcaatttgaaagttaaaaaattatgtctaatttttatagtttgcatttctttaattctgagtaagtttgaatatcttttccgtataccagttggtcttgtatctctctctctctctctccccctccctgcttcactccctccctccctccctctctccctctctctctccctccccctgtgtgtgtgtgtgtgtgtgtgtgtgtgtgtgtgtgaaggcaaggttaatatgccattcaaaagctttgcccatttaaaaggtgtggttggccttttctaatagatatatatctgtggataggacttaggttccatccctccctgctggactgtgactctgtaatgaaaggactatactgtatttatcccacagtttgttaaatgggtagatttcttttatgtatatggatggtgtaaaaatttgacaagaagtcatttggtatagtaagcatcaggaatagtaaggctaatggatagaaaaataatgaaggaaatcaagcagcttaaaggaagtttgcagccagttgaaatgcaatttgctgaaaacttaatgcaaataaataattatatttgcacagtttatgatgctgcatcacattttcactttcagtttctgacatttgtaggaaaataataaaattttaaaatctccttattatttatttgagatctgttactatttttaacattagtctagcaatgttgatattttctttgtaaagggtagtaagctcagtgtgagttcttaaatatctaggaacccattttttccctctgttaaagcatgtatttaattttatgaagtaagcagaaatatagaaattatatggaaaacagaaaaatagaaattatatactagaattttatttaacttgctggggaaattttttaacatgggtagtgatgcagtcattactttgaataaacttatgtatttatttaaatattatttataatatttagaatactttttcagaccaaatacatgttggaattaagtgtattgtacatattctctgctgttgagtgcatagctgcaacatagatattaaaatcttcttttcaagcaataaaaaactttaagcattgccaacataatttaaatgcatatgtgtgtttcattcttttctctatcataaaagtaatcaaaagagtgttagataccataccaattgtttcaaaatcatgactgccctcatttttgtttgtggtcttaaagtataaatatgtgaaggctacatgtaaacataaagagagcccctttacaaccaatagtccttaaagtaatatactggcacatcaaaaacctgacacagtcttaaatctttaccgaaggtgttgtaagaaaaagcaaacagaagaatgaagtcgtatatataagaacatatgaggtaggtaaagcaatcagcattggttcaagacaataaatcagagcaggttacattatttcctggccacaatccttttgaatgaaaagcaaaggaaaagaaaacacaaagccgtggaagcatagttgttttgggttgaaagtgaaagttggtggacctaaataaatgtgaacctgcttggtagacaggcctctcaagtgtgacttgtctgcagtaaatttaacttttaaccacatattctttcccaaatcaatgagatatttgtttgttttatgggctggaaaaacaaaatgattgttttctaaaagccaaaatattttatttcttttctggattatggaaagtaaaaagcaaaaagatgcaaaactgagaaaaagccctagagcacaactctgattaattactatagctaagtgctctttctttcttctttctttctttcttttttcttttttttttttttgagacagagtctcgccgtgtcacccaggctggagtgcagtgccgcaatcaatacccactgcaacctctgccacctgggttcaagcaattctcctatctcagcctcccaagtagctgggactacatgcacaggccaccacacccggctaatttttgtatttttagtagagacagggtttcaccatattggtcaggctggtctcgaactcctgacctcaggtgatccacccacctcagcctcccaaaatgctgggattacaggcgtgagccaccttgcccagcctgctaagtgctctttctattcacgttctaagtagttttatttagagattattttcccttctgcaatttctctgtctagtcttccctgtcattctttagcagccaagatcactttttgtctagggctccaggccctctcagtcatttggactggtctctgtgggcctttgtttccaatggtcaacactttcaatgacttttttgcctgataggtcttcaaagagttcacagaaaatgcatattattaaaaaaaatgttgttctttgcccatttttaaaatgaggttgctttttgcttgttgacatgaagagacacttctcaaaagaagatatacggccgggcgcggtggctcaagcctgtaatcccagcactttgggaggccgaggtgggcggatcacgaggtcaggagatcgagaccatcctggctaatacggtgaaaccccgtctctactaaaaatacaaaaaattagccgggcgaggtggagggcgcctgtagtcccagctactcgggaggctgaggcaggagaatggcgtgaactctgcggggcggagcctgcagtgagccgagatcgcgccactgcactccagcctgggcgacagcgacactccgtctcaaaaaaaaaaaagaaaagaagacatacaagtggccaataaacttatgaaaaaatgctcatcctcactaatcatcagagaaatgcaaatcaaaaccacaatgagataccatctcctatcagtcagaatggctatcattaaaaagtctaaaaacaacagatgctggtgaggctgtggagaaaagggaatctttaaacactcttggtgggaatgtaacttaggttagccactgtggaaagcagtttggagatttctcaaagaactgaaaacagatctactgtttgacccagcaatcccattaatgggtacatatccaaaggaatatagatcattatatcaaaaagacacatacttgcaaatttattgccatgctattcacaatagcaaagagatggaatcaatgtaggtgacgtcaatggtggattgaataaagaaaatgtcgtacacacacaacatgaatactacatagctgtgaaaaagaattaaatcatgttctttgcagcaacatggatggagctggaggccataattctaagtgaattaatataggagcagaaaaccaaataccacatgttctcacttataacagagagctaaacattcagcactcatggacataaacatgggaacaatagacactgtggactacaggaaagtggaggaagaagtgggagatgggttgaaaaactacctacttggtactttgctcactacctgaggtcgatatacccatgtaactaacctgcacatgtaccacctatatctaaaataaaagttgaaaaaaaaccacagctatgcacagagttgaaaaaaaattttgtgtcaaaattaacttgtactaacttataacactgaacagaatctagtttgaggtactaagaaagataagacatgagtttgaaaagagctcctatcagaacagcatgacttcttcgaaaattgaagaaagaacaaacaccagacttattgtgaagcttgggtggaagaaagaatggtaaaatcattgatcctttatgaaaagtttatggggataataccccaaagaaatcagcagtttataaatggataactcattttaaaaagggatgagatgatgttgaagatgaagctcacaatgtcagaccatccacataaagtttccaggaaaaaattaatcttgtttgtgccctaattgaagaggattgatgattaacagcagaaaaaatagccaacacaatagacatctcaactggtgtggcttacacagttctgactgaaaaagttgagcaaactttccacatgatgggtagagaactgttccacccagaccagctgcagacaagagcagagctttcaatggaacttttaaataagtgggatcaatttcctacagcactggttccaagaattgtaacaagagatgaaacatggctttaccagcacaatcctgaagctaaagcacaaccagagcaatgactatcaaacgttagaggtggtccagtcaaagccagagcagatcaatcaagagcaaaggtcatgacaacagttttttgagatgctcaaggcattttgcttgttgaccttctggaggaccaacgaatgataacttctgcatattatgagagtgttttgggaaagtgatcccaagcttcagcagaaaaacccccaggaaagcttcactggagtctttctctaccgcgacaatactcctgctccttcctctcatcaaacaaaggaaattttgcaagaattttgatggaaaatcataaggtatccaccttacagtttttatttgatgctttcttacttattttgtttcctaatcttaaaaaaaactttaaagggaaccaatttttcttcagtttataatgtaaaaagtcttcattgccatggctaaattctcaggaccttcagttcttcagggatggactaaatggctgatatcgcttataaaagtgtcttaaacttgatggaacttatgttgagaaataaagcttatagttttaatttttatcttctaattctattattctataacctttttgaagttccttgtatttggagtactagaagtgcttcatgatgcctgtagcattcgttgcatgtgtatgtggatgagggcgcatacacacacacacacacgagctgaaggtgaatccatacatgtatatgtgcatgagggtacacacacacacacacacacacacacacacacgagctgaaagtgcatccatgcatgtatatgtgcatgagagtgcacacacacacacacaagctgaaagtgcatccatgcatgtatatgtgcatgagggtgtacacacactgacacacaaacacaaacacaagctgaaaatgcttggagttgtatgtcctccaggaagtcatgggctttcatagccttatgtgatgagggctttgaaagtcgagctcccttaccttcagctgagacaaactttataccccagagctgccctgagaatctggcaaagcctgggacttggcttgtcctcttcccctttcctgtcctgcttcctcattcttttcctggtttctctgggagcagtttcttaataaatcactagcacagaaatctccctctcatgtttacttttggggaatctgattaagagagctgggtatattggagcttaccctgagtcaatgaacagtagcacaagacagtacatctgaatgagtctgaactacaatttcaggttttcttctttgtggttttatttggagtatcacagaaaatttgtgaaatgtgccagacatagttgtgctcccaactcacagatgggaaacaaagggccaaatgacttgctccagcttgtggagcaatcacggcccgggatgcctgttcttcaatgtttcatcttgtgctcgctccgcttcactgttcagcttcttcaagttagagcttttgttctctcccagcgcccccatgaggcactgaaagaaaactaggtcccttttagcttctcgaccctgtactgtccaaaataacagcccctaaccccatgtggttatttaaatgtaaataaagttaaaaactcagttcctcagtcagactagccacatttcaagtgatgaatactcacaaccttgcagaaagttctttggatagtgctgtcttagaccctttactcttcagaagtttcaagtatttttctctttgcgtgtatctgctaacttgatatgtttttctttttttaaaacaatcttgggaccaacatcagggtgattgctaccttgaattcaccattacaggcatctgaatctgcataaacacatgctagatgggctttgggtaaaagagaaggggagtggccacaaatacacatgtaattaggaaagaaaatttcataaggactccatttttctctccctgaaatactagtgaaataattcctgcttttgcctaccacacagatgtagaattgaggtgaaattatagaaataaattagagcaccgagaatgaattagaacaattctaaaacttatctttgagcttatttatgtaggcataatgtaagtatatgggatcattagattttaattaaatgttatatgttaattaacagaagactgctattttctacaaaatgaagaatacattttttaaacagtaataaaaagatttagaaaaaaatgacaaacttatgattttaatctttgaatatgtattatcaacgaagacagtcaatttttttgtgctctggagtagagtgaaaaaaacaacagcatcaaacaatggtaaagaagtgaaatgatagggatcataaaattcggcaggatggtgacgcttgctgtgagaatttgaaggctgccatataccaccggaggctgaggaggctttgtgaggtgatgggaagaattagagaagctgcaagtggtaggcatttttggaaatggaattaaatttagaaaccagtgtttttacaatttaaggctagaatgaaaataaattgtttatgcaaaatttaaatagaagttctttctttcctctttataagtacttttaaagcaagagacactcgaattgatagcaatagaacagaaagaaaacattacatattttggaaaaaaattaaagatttgttttcagaaagcccacattacctgccaaaatttccaatatgtaatttcaactatagagatagagatttatcttttgggcaaattacttttttctaaggcttggcaaatattgcacaataagtcacaaaatgctaagatgaatgaaggtaattgaaatcacatttctcagtataatcacatactcagttgagtataatgctggataatgaggacacacacacaaaatatgtatatgatgaaaaaaatcttcatgtttgttaacattttagtttcaatgagatggactcacttgtttatttacttttaaatttgatttaatgaggttttaaaaaggattgatttaatgagattactcaactattccatctaagtaaatttgagacctaaaagtgctaatgacaccagatgtcactctcaattttaaaaagtaagatcaagacttccgtaggtaaaagaaaaatagttactggggaattattttatattatttaaaagaaagggcgctattaagagaaagcgtagctatgtctactgaaaggaataagagaacatgagaaagctaaattgttctgcataaaaaggccaagggggctggggggatggggaaagaggagaggcattacctctgatgattcaggaggtaggaaaggtgcctctaagccatatagagaaaggatgaagaggtaggtggcagctagagaggagaattggagatgggaggtgttccgtcattcagtgttgcatacaaattacccccaaacttagtgacataaaatgaaaatgtactatattcacagattctgtgagtcaggagttcttagatttgtttgggcagtctctcatgtagttgcagtcatatgctggttggggcttcacacacccgaaaatttgatgagggtgctggagaactcactagcatagctggtaagttagtactggctgttgactcgaggcctcagttctccacgtgggccgctgcatggagctgcttgagtgtccacataacacaataactggcttttcccaaagcaagcaatccaagagggcaagttggaagccatgcttccactatatactcttgatcactcagagccagtgctgattcagtataggaggagattactcaaggtcataaaaatcaggaaacatggatcagtggggtccatcctggaggctagccacgacagagcaaggccacagatatatttattagaaatttgaaaagtatttttacacataatgtgccattaaccattcctcagcctcctcactcaattttcagtaaatctaatacactcattaatgttttgtggagttggatttgctcctgaggtctgctttaagtgggcttgagacaagaggagaggacatctacagttttggacacatctgagttaagtacatattttgacatttttcccaaatgaagcagggagtctctgaattacgttataaaaactcctgtaaaagtgataggaatatctaaggtttctttttctattcttcttgcaagtgacagattactctcattttgtcaccacaattacagtgagaacatctaattattttccttcccctaggcaatgtatacctcagggtgaagagaatagctttcttctatatttgaccttttatattggcttgagaccaaaaaagttcatgtgggagattccacctagtccgatttttgccatatacacatcctcagagggtcacttaaaactctttccttccatgcaagagcactttccctcccacctctcttttcctgataccttgacaaggagaaacaagagccatgaggatccagaatgagaaataggaagacttagggaggaaatgtcctaatccacagtcttctgggaagtcagaacttctcttttcagttcagctcatcttctgtttcacagggagaatgattagtcctgaagaattaactgttcatcaaaaataaaatcaagtaaaaacgaaggtaaaggaaattgactctttaccattgtggaaagggctgaagatctgtcattcctatttcagatttagtcagagagaatttgggtaagcattggctttcataaatgcacttcatggcacacagctccatgaatgttctctcacaaatcgtcagtgtgaatcaatgtaatactcaataacatttccctttggaacctgttttaaaagagctattattgtgatggcaagaatatgctaagcacacagactattatccatttgattttctgctgaagagaattactgcaaaggtaccaaagcagtttgattatcacagggagagtttttattttcagctttttcaagctgtgtattgagttgctttgctttcatttaaacattacattctataattaatttacaatacactcagggaaaagactccttggtgtaaagcaaaaagctacaaaaaagtagaagatttaattccctcaaaggcttcaaattaaatttcaattcaatgcaattaacatttattgaatgtctgcagggatcatagcactgtgtgggtactagaattcaaactatgcagaagttcaagagggtttcaaagttaattttataaatataggtagagaaaaatcagaatcatttaaactatattctttttgaagtctagatttcctttgacagattctcaaaatggtgtgtaatctgattgggagttcccttggaatacggcaaagagcacaaaaaacattctttcttgagtcttaaatttggagtaaataaatttttattactacctcaagaaatggcttaaatgatagaagaaactagtttaaaatattttaactaaaattagtgaatgatagtgttgctttcagaaagataccataaaataaaaagactcctgttatacatggaatttaacatttcagatttggaacgtatttactctttaagtgtcattcaaaaaataacaagtagtagtctggttatcaccaggaactaggaataatttggaaagagagtagagatacttttagaactgctggaatttttcaaaagacctaccaaaatctagcaaaagaagtacatcaaaatttctccagagccctccttacctaagaatgtttcatatatctgccagcccttttcctgcaaaagtcaaagatgggtctagatacaaagcagatgcaatgagttcctttcttaggatcaaaaaccacacctcatctgcagacgagatcctgaacacaaaaacactgtttctttgtctatgttttattatcaatttgtcctgtttatcctgtgagattctttcttaaaattttgttaatgtgattctatgcagccataaaaaagaatgagatcatgtattttgcagggacaggaatggagctggaggcctttactcttagcagactaatgcaggaacagaaaaccaaataccacatgttctcacttataagtggcagctaaccgatgagaccctgtggacacaaagaggggaataacgcacattggggcctattggaggagggagggtgggagaagggagaggatcaggaaaaataactagtgggtgctaggcttaatacctgggtgatgaagtaatctgtacaacaaactctcatgacacaagtttacctatgtaacaaacccacacatgtacccttaaacttaaactaaaagttaaaaaaaattaatttaattctgagtcagtactgtttactgaaaagtacttcctttccccctgccctatggtggaaactgccaccactttcgttgtatattagccaactgtatatttgtgagtctgtttctgcactctattttgtgtcatttttctatttgtctatccttgcatccattccattttaactgttatttgttgacccttgcaatctgaaaatcctctaactttatttttcttttaagtttgttttgggtattcttaagagtttttatgtccatacaagttttagttcaacatcagcttgttaatatcaacaattgaaaacaatagcaacaacaataacaacaacaacaaccaaagccaaaaaccaaccaaccagacaaataaacctcttgggattttatttgaaattgcatttaatctatggagcaatttgaggagatctgaagctttacagtattgagttttctagtatgcaggcgtggtgcattttatcatttatatgggtagctttaatttctcttataaatgctttccagatagaagtcttgtgtaagttgcattagatttattcctgtatttgactgatagttttgaagctattataaagggtagaagtaaaaaaaaatccagttgtttgttgctagcgtgtagaaatacagttgattttgtatattgattttgtatctagagacatttaaaaatcacttatttgttctaatatttcacctgtagactctgctggattttctaagtacaaaactaggttgtgtgcaaataatggtagtcatggtttttcccttaaaatctttatagtgtttctttcatttgcattactgtactagctaggatatacagatcaaaatcgaatagatgaggtaaaagcaaacatctctgtatcgttcttgatttccgggagaatgattttaatgctttaccattaagtatggtatttgctataagggtttttgtagataaggattgatttttattatatctattttagttgttaataattgttaatcgttgtttcatttctttttctttagcctactttctttcagcctgagactgagtcctcctacaccctccaacagctttgtaaacagttttgtaaaatgcctcttgattttccacactgtcaaatctgccagttaatcagatccattcctttttttccttttctggagacatgtagattgtttgcactccacctgggtgcttctaggactccctttgccatcattctgggaattccagttgcctttttctgatttccaggggctgttcttggttccttaattttctttcttcttggcttcttcccatgtttccgtggtaaacaactttagccatttcctttgggcacccgagctcacagtgcagcatggagcatcagggtaggtctgtgggagactgatttgagaaaactcaaatgagcagaggggctttaggacagaaagtgaggaggggaaaatgggaagaaacagctgctatgcttcaatccatgacaataatgaggccattttgagtaacacaaaatttggtcaataccatatctaagaatgtattttccataccatttatcaaaatggctaaagcacattaaaaaaattcaagtaaaatattcacagaattcctgaaaaccactaagatttattaaaatttgaaattaattaccaaagattccaatgaacttttctgtaaataattaatattcattcaataaatattaaaaaatattcaatatttttatatgctcctagatgtttgaaatgcataattgaacaaaatagacaaatctctgctttcatgggggaagataggcaataaacatagtaagttactttgtagcataatagaaagtgataagagatgtagaaaggatatggatgactaggagtcctgggcaggatgaaaagtgcaattttaaataaggttgtcagagtaggcttcatggagaaggtggtatttgagcagagatttgaagaggagcactgcaggcagagaaaatagccaatgcaaaggcccaaaggtgggcacatatctggcatgttcagcaacatggggggccagtgtggctgaagtagagtgaatgagagagagcataacaagaggttaggtcagagagatgatgagggctaagccatgttgaaccacactggccatcatagtacttgggcactcactcagaatgaatataggagccctcagtagcatagatttggagcagagtgacatgatctggcttgtattttgaagcaatcacttaggggtggtgttgagaagaggctgtaggggccaaggacaggaggaggaaggccaggcagaagctactgaagtgattctggctggtggctccaatcaaaatggcagcagtgcaagtggcagtgcaggtagtgagaagtgaacatcatcactgctgggtaacactgccctaaaaccaaagtggcttaaaataatttattatcctcattctgtgggctggccaagtggttcttctgatggtttcttctggactcattcatgtggctgcatctgcggcaaggctggctccctcacatggccaggggaccttggttctccttcatccagcctccagcctttcatcccccagtgctaggccagcctccttatgtggtggccttagggagtattccaagagagggagtggggatgctacaaagtacctaccttgaagtcacataatatcatttctgccacattctacgtttttaaaccaagtcacaagggcagtttagatataagtggtgagggaaatagactccatgtcatgatgggaggaatagcaaagttaattgcaaaggaacctgcatcctggggtaggaggagtttgtatccaattttttaatccaccaaagaagtacttagcatgctctttttttttgttttttttttttttttttttttttttttttttttttagacagggtcttactctgtcactcaggcacaatcatagctcactggagcctcaaacatcagggctcatgttgttttcctgcctcaggggctcctgagtagctgggactataggcatgtaccaccatgcccagctaatcagttaatttgtcagttttttgtttttttaaagaaggggtatttttatattgcctagggtgatcttgaacccctgggctcaagggatcctcctgcctcagcctcccaaagtgttgggattatactttgtaagcccaaagtgtgagccatcatgtccagccaaaaagtattcagtattttgagagtataagttggatatgtgatgtgagagaaagagaggaatcagggatgactttgagatttctggcttaagcaactggcaagtaggagtttttaatcaactgaggtggggaagactgtgggtagactaagttttgggtgagaagagcaggattcagtcaggggaacggaagggcaggctctctgtaccagcactcagtatgcagtttcatatcaagtcaaaggctgtctgagaccaacactggtctttgagagtgggaagttcaagcaagcagaagatgacaagtaggtgtcgctggctctaatggaagatgggcaagagaaggcctctacattctagaaagtgaacttgctatgtggtttgcctggcaacggacagggtgaggtaaataatgccacagaagttccaggatgaaggattacaagaggtttgtaagaaaactccaggggtacagtggttcagaaatggacataacagcctagaggaagacctgggagaagcccttgaataaccattggtccattgtgcatctagggtccttaacaaaaagataaaagacaagtgtataatatgttggaaaaaaaatttcccattcccacacaggtaagtgtctacagcaaagctatccctgggtcttgtaaatgtggaatatggcccacaatttaaagtcagcttctttttttttgagtgaggaaaaatctcataaggaaatgcctgatccttctttaggcataaaaagagcatgattcacacccaaggaagagaatgttggggggagtgcacccacgctgtgtgaaacttcattgtcatgcctctgtgtgagggtgtgtggatacagtgtctgggtgtatttgcacacacatttatttcggcaaatattggtaactgcctgattgacctttctttagggcaaggactcagatggttaggagggagaaacaggttgctcctcaggctggtgcacattcttggctacattttacaaataagctgtaaaagatggaatatatttgctggctggtttgacagtctacccagaggtaggaggatggactctatgacctttgaaagtcaattttcatcccaagatttcatgttccaattatggctgatagactatttaaataaatgatggtttttctattaggaaagaaaattgactggaattcattctatttgagccacaaaaatttgaaaataggtcaactcttaattacccagggtgatataatagggaacatcttggatggattatcccaaaccacaggtaattaacaaaatgtgcaaattaggcactgattcatagcattcattaaaatttacatttaaactactacttaagcagcatagatttatagatgagcaactcaacatggtaaaaataattttaagatgaatatacgcattttaaataaaatgtagagttgaagatattgccaaaagactggacaatctgaaatattttcatactctaaaattcagaacatttacctagtgctgcataagacatttggcagatttaaaaaaatctcatttttataaaaggcaagggagagatcaacagaggtttttcaccccctggaaactcctgtgcccgcccaatgctggacccttccctttgtgctggtgttcaggcccacaaagccacctctttctctccccgacacacttctgtgaaaaatgttgacagaagaacaaagactagggtgagtcaggaagtgagaaaaagaaactagagacaggaataattatagcacaatccttaaccgattatggaaaccaaaattttagtgccatttctatcttacccaaggaaaacaatgaaatgaactttactaaaatttaatatgggttagcacataacacatacatttatatataaatttacatacattggctgcggatattaaaccctggctcacataatcttggtcttcctttgtactctattgtatggcatccagtcgtgcacaggtgtgatctgtcagcctcaagcttcagctcctccatatctctatcatctattattctttctctacctctgtccagccatgctcaagcatgcacaaatatggaagtgtgagaaacttgactcaatgggagctgagagccaatggataaatacttaacctttcccatgtcctggatgaacaattctaaagtgcattctacatggttcttcagagggacctcattggcccttattggcccttaatagtaaccagcccaattatgtcccctttgaattggcctctgcccttccctgttttcccttttccagcccctactatcctgttctccttggtaggattattcctgcaaataaactccctttatggaagccattgtcttagactctttttgagtcttagactctgtttttttgaggaagaaaccaggctatgcaagatttatactaaaacatctttatgaaagggtataagacaaatatttttgagactactaatctaaagcattgattgtcaatgtatttgtaaaaaataagcccacaatatactaatatttgtatatgtggcaagctatgtgccacacatgtgctgtttttatgagcacattaggtatacctctacccccttttctcccaccccatgcagcatattgacacaaatcagaaagagtacttctattatggggatgttcttacatttactcaaagttataaataaagctaatcaagtgtaggctgtagtactttattattaataccaaatttctttgaaggcctggtaactaattgtgattcagaatgttttaggtgggatgctttggttgaaatctctaaagcaaacagattcaggtttagaaagtggaactcgatgctaacaactatttttcatacttaagcaacttctcaagttatttacttataagctatacatataactttacatctttatgtaagagattacatacaactttttgccatcttagtccttgctcaaaaacagctcagaggtttccttcatatatgccaagaaaattaaaaaattaagagtaagttaagaaaacagctcaggggtgttatgagaagggtactttacctctttagcatttttcatcaaaatttgtaacttcagtctaatgagaaaatatcagacaatccaaattgaggagcattctacaaaatgtccagtactcttcaaaagtgtcaagatcccccaaaacaagacaagactaaacaagacaagactaaaaaactgtcatagatcagagaagaatggagagacctggtgactaaatgctttgggctatcctggattggattctagaatagcaaataagcaactttcagtaaatacttttgtaattgcccatgagttgtcaagcactcatgagatgaagttccaactctacagatgaaagccctgtttttgaatcaagcacttcatgagtaaggatttcacaaagctgcaaaatctgctcttgagaacccctgacaactaaatattccatggcttccactgataatcatgctgtcagttaagtattttgctttttttaaacagctgggtatatttttttctctatgaaattctgtgaagagagtttgatgtagcaaatttttttttttaaaaggcttgtcatataccaggaggtatcaacaatcaccaagctctcgtgcattaactacctgtttcacctccattgaggatatgtctcaggtcaataattggatctatggtgagttataccagctgcatttttggattcatttttatatttaacccaaatatatgcttaaacatttttggtcatttttaacaatcataaaaagcaacattctgaatcataaagttatctttaatcaaaaactaaacttggttcaaataaaatgtatttccattttaatccttttcttagaaacctggctgtgataaataccaaggaattctatgccagttcacagcagtaagagtgcagaagtgccaggttagtacaacatgatcattatgttatatgactagatgtgtgtaaacagatccatcaaaatctgtctgtcctttggtaggtgacaaaattagatcaggagacctggcatctatcccagatgatttccttttctttctctatcataaacttgatattgaagcttgaatggatcttgattttggacaattaaaaaatgaaattgtggggagaaggaaaatctttcaactttgaattcagacagatccaacagtgaaccaaaaaaacacttacaattttgcctattataacttgcatttttaacatctaatgggcacttaaaattcatgaatttaaatttgtcattttgactaatggaaggccagagcagaactgctgtttttgagtacatcacatgagtggcaacctagatttgcacaacacaatgctactgccccaaagctcacgtctctcacattttatcaatgtgttgagggataccttggagtcatgggtttttaggatggtatgcaagttgacacccttttggctggtgaatatgccatgcttgccacccagcaactacatctcaattgacttgttatatatgcagacaatatattcgtagattataaaagtaaatctacagagaaatctgaatctgattatagtagtgatggaagagaagataaagttaataagctggaggaaaaaaatgtaaaaatcaatttttcaggtgtgtgaaaatctcagttttatgcctgtcaaatgtcaggaacttcagaacataaaattgcagcatgtcattccctttattatctaagaaggtaatcagtccattagtaaacatatcttcaacaactattttttgttttagcatgattcttgaggcttaagacaagtgaaagaatgaccagagatgatatcaatcatcagttcttcaaacctttttgagaagacaaaaggagcctagaggagacaggaacagtaacagtgttgttataaaagcctgtctagaaaaaaaagagcactgattgggagtcaggagaagcaaatttaagttccagctcttacaataatttttctccactaccttccagaagctgatgtgcccaagaactgagcccaagtcttagcacaagatctccatccatcaaataactgtaatttatcacccagactgagacatttctgagagtgaaagggagcttcatgagtaattattccagaacaactggagtatattgggactgtcttagacaaactaaaaggcaaagtcattctactgccattctactcccaaacttctagactctggctgattctctccacagacctcttcccggtgaaaatatcctcctctttgtagcatatttgtacttctactgaatgataaatgattatatgcattccttgtttttatgtaagaaaatacagtttcctgatattgtttgagaattttagaaattatgtcctcattttggtattttaatccattaatgggaaatttcagactggaagaaagaaaaccagtaaccctagggagatatttttatctataccagtacttttggtcactttcaagtctcctgcctaggcagctgtctgatcagcccatttaaaacaatcactgagataagtactaataaaatgaattcaagaaaattgctttttagatgttaagttgataagaatatatgcctattaataagtacctctgtgcttactctgcacagggttatggtatgtacaatttgtgcacatggcatatatatgatcaatgaaaacatgaaacttgttttaacaaaatcagtaacagggagtaacatacgccaaatgtgtgttggagaaaacaagaaccacgggacccagaaaaggagagaaattgaatttgacatgtaccaggaaggtggatggagcttatacgggtggtgtgtatgtagggcagctggcgggtggcgggtggggggtaggttcggagcatgctggcgggaggacaaccagattgtcttttagtctgccaatggtgacataaaaaaattctgctctttaaatttggctgaccaaattctataagatttgaatcacattttcccatcagaaactaattcacatcacaccgaactgtgaaagttcaatctgcaagacagatttgatttaacagtccatgcattccacttgtgtgtgtgtgacgttattgaagtaggtgtgctctaaaggcattttgtagaaatgcctttgtctaaacggtgcttaggcacaacacgagtggccttgatgatgtactttacgctaaggtaaatgtgtagagaagcctcacgtgtgaatgcgtcgtagtaaatccacagcagactgcagatttatggatatcgttattccgttgtacagacggcacctccattgaatttaatgagctgaactaggtgaaaagttcattctaatctcctggtgcctggaactcaagcactccctgaaatcacagaacatatgccttctcttgttttaaaaactgaaggtgactttctgataaacaagtctctcttgagggtaatgacataggaagttattttgaagacgtttccttcagtgtcttgactgaatattaacctacaacagctacctgttgcaaagctgagaggtgatttgtcaaatttaagatcgatggcagatttgctttaattgatttttgttccctagagtgagtttactactttgagaatggcttagattctctcacctatgtttcctttgctattcagaataagcattagcaagtgatttctcttctgcagtcttttacatggtaattctgaactaattctaacatgtttatcgtaattaggttaaatgtttatgaaagacgtctacaaaactaacctgatgttccctccatatttaaaaaacactcaacaatgaatttaggtaaagaagacttttttgagacagtctcgctctgtcacccaggctggagtgcagtggcgggatctcggctcactgcaagctccgcctcccgggttcacgccattctcctgcctcagcctcccaagtagctgggactacaggcgcccgccaccacacccggctaatttttttgtattttttggtagagatggggtttcaccgtgttagccaggatggtctctatctcctgacctcatgatccgcccgcctcggcctcccaaaatgctgggattacaggcgtgagtcaccgcacccggccttttttttgacagtctttcgctctgtcacccaggctggagtgcatgatctcggctcactgcaacctccgcctcttgggttcaagcgattctcctgcctcaggctccgaagtaattgggattacaggcaccagccaccatgcccagctaatttttgtatttttagtagagacagagtttctccatgttggccaggctggtctcgaactcctgacctcgggtgatctgcccaccttggcctcccaaagtgctgggattacaggcgtgaactaccatgcctgatcagagaatacttttgttgttgttattgtttgttcttgttttttccactatcctccgctagaatagaacttttaaggtctctgatggaagctttgaattctcacagtgctgcattcacacatgggaagcacatcagtgaagtgaaacaatgggtatatctcaatggggaggctcctggcattttgtgggtgtgggggacattttgtgtgtatgtgcaagtctgtctaccttattaaaggacttttacaatcactggaccctacactgtaaatgccaggatcacactccagttactgcaaccaccaaaaacatcccaacacagctatctagcaactcttaaggtataactcattgcagatggtaaaagggcagctgctacctagatgtaagtaatttctaacttgaacagtttatgttttcaaagatgactttgttaagtcgaaatgtagaacacatcactctatatgtaacgcagaatataaatggcgactatgtctccaggctggtgacacctgcctggcttccatgacccctattcacaatccctacttcaagttctcagactaagacaacttaattccaatctttcaatctctttccctcttcctaaaataggctcttcttaaagtctctttgatccaggagaatttacggtgccatatttcaggagtatattgatttcagatcagagttttgcttgatcagaacttgttgtggctctcaccgtatccccagtgagctggttcttttcttacatcccagttactgatgtagtctctatctgggtctcatttgctttatgtcctgctttacttctctctttgctgccactgccagactccctgatggttgttcttcatgtcccacggcgccacttgtttgccgcttttgtggagcctttttgttatcaacacctaatggggcatctgattattccttccttccaggctgaagaggccatgtccatctgcttattgcaatttcttcctgaagattgtttttgggtgctttatcaattgtccacattgttctgggaggtaggtctctagctcctgactctttcctaggaagggcttgcctgagcaccaagcgttaacagctatctcactctactgcagacatgacccagcccaaatcaggaaactggataaaaaacatggaaacaatgctgttgcagtatggaaattaaacgaaactggaaacaaatcgaataagagtttctaaatctttaaatctgatgcataaagtagtcttaattaaagtaaaagaggagataaatgagaatttactttaaaaatctgaattttctgagcctttaaggcaaggtctttagaaactggtggcaatgactttttattatggttaatttcccttcagaacttgtgaatttactgttccttcatatggaaattttaacactactcttaggcagatcagacataattaggataattttttgccacacaagtgaaatgaaaagatagatttccctatccttcctacaagataattgggtaaaaaatgaaatagtgagctaaatgaagaaaagttttaaaaataaatgggtgtgggtaagcaaaatgaacagcttgatggggagatggaaatagcagataaggcaccttaatgcaccttattattattttgtgggtaaaataattttgtcttatttgttaaataagtctgtatttgcgaaatcaaaagagacaaaaagataactactgaaaaaagtgaatcttcctcatacctctttaatcctgctgacccagttgctttccctaggagaagagtgtacattgtggatttattatgtatctttccagagatactattagtttgtttttatttcaatagcttttggggtacaagtgtttttcagttatatggatgaattgtacagtggtaaaggctgatatttcagtgtaccagagatattctatgaataggcaagtgtttgtatgtatacatgcattaacacacacatacatatctaaaaatctgaattacttggatagatttatgtgcaattggcactgaagttgtggaggacccgaaggctcttgtcaagaagttcagtaagatggttatgtcaggctttattaaaaacctttattattagaaacatattttctcttttttttttttgagatggaggttcactctatcgcccaggttcgagtgtagtggcgtaatctcagctcactgcaacctccacctcccaggttcaagcagctctcccgcttcaacctcacaagtagctgggaccacaggtgcccaccaccacgcctggctaatttttgtatttttggtagagagggggtttcaccatgttggccagactggtctcaaggtcctgacctcaagtgatccacctgcctcggcttcccaaagtgctgggattacaggtgtgagccactacacccagctgaaacatatttctttatagtctcatctttcagttgcagccatatgccatctttagtgtggataacatcaataaaatggtggtttggttgaccttatccacgtctacttgttccctctgaatggatggatggctatgatatggtgccttgtgctgtccttgggcacaaattttctaatatgtcctgatctaaaacagtttccatctatcttggaatgcagtggttaacctggattcttccttccccattaccctggacattctcttcactgttctgtttggttgaaggcattttttcttacattttatattttcttctttcttagtttgcttcctcattttgttggaacacataactaccagttacgttttgagaaagggtatgtgacaaataaatttgagatgttgtacatcagtaaatatcgttagtttacttttccacctgattgatagtttgacatgtatagaattctatgtcggaagtaatttcctttcagaattttgcaggtatttcttcacaacccttcagcttccagattgctggtaagtcagaagccattctgatgctgcattttggttttgcagtatattatctgttttttgtttttttaattcccaggagctttcagtatcttctccatgtcctcaatgttttgaaaagttcccacctattgtgttgagcagttggtggctcctttcaacctggaaaatcaggtctattagtcctgggaaattttcttaaattattttatttatgatatcctcccacctgttattttgcattctggaactcttattcaaattaacctaatatttgaacatgatactttttgct

SEQ ID NO: 2714 - DNA, 3254 bp, Homo sapiens
gaccaaagggcaggtgcattttgagtgcgccaagctgctggtttgacggcagcgtacaggcaggaagagagagggagcgcaccttgaaatggaggaagggccatggggcagggtgagaaggggcagaggggactaacccatctctgtttttatagctgtctagagtttgttagtgcctatgtctacacagaaatatatgttatttttataatacagtgagatcatatatattaccgcgtaccctgttttctcctgactgcgtcattaggattttccatagggataaatttaaaagtagtaaacttagaaattttcacattgataactttaataatttaatgcatgctaataaaaatatggatataaattaattttgactgtttttgaattttatgaaattattcagtcatttttattatggaacatgcattcttttgctgggcttctctcaccaaattttaggattttgagattttctatgttattgcatgtgcctataatatatgtttattgcaatatagattctattgacagataaatcttttcacatatcaatgattatttgctcagcacaaatttgaagaagtagaattgataggccaaatagagaaacatttgatagatatatgtagttactctcccaaaaggatacactaatttactcttccactaatggtgcaggagtgtgtctaatactcacccacggcctgcagtgagtatgaactttatttttgcacctgtgccaatctgagagacaactaaaacatttattgttttataactcctcttagaacattttgttagtaatttgcacaaatgcataaaacatttataaatcttttactattaacatttttctttgtctctaaatccacaactgtgtcaccattttaaattaatgcatcataatctataatatggatatgccaaaatttactttctgagaggtcactgtataaaagacattgcttttttttagtgaactcactgtcataatttcccttaatcctcaagaaaatcccatgaactgtggtctctgaatatatgcattttaacaacaaggaaattgaggcacagaaagattggagaacctgacgagagaggcttacactgaagagcatcttggctttgcggcccttgccatacccttgcacttggaatccaggtttgtgtctctctccaacaagaggcctgtgacgctcgccctgcttgttctgttgaatgttactttgcgagcgcgtttacacaactgtcacttgaggtttgtttttagctggaattgtcctctctcctgaattcctctcacatcgctcccccacttatctcccggtaaactaaagccaccgagctgggtgggaagacggttcacatgctgacatttttttgtgtttagaggctggtcttcaaaaatcctcacatgtacaacaaggccccagatttgaggaggaaaataactctgcagccccgagtcagccgttccccagccacctgtcccactcgcttctggtaggtgtgtggctgtgagggcccggtatggagctccaggctaaataaagctgcaggaacagagataaacaagtgctcccaactcaaatgcctgcacacaatatcctttatctgggcaaggagagtggccaagcgccccccatagacggacccacaggcgccccccgaattaattgggacatattgttaaagggctaaggcccctcagaatagatgccaaactccaaggacaccaatgtcaaattccagaaggacagcggcatgggccaatgggaataaaccccagccgttccgcgctgaatcggatcccatagagcccgcctgcttcacatgctaacgtgatgatgaacgtatccaagtatcagcatcaaatccttgaggactatatttgcaatgtcatgtaaaccgtttcagggagcaaactgtcctgctgtgactttatattaatctctggcttctggctggtcacagggtgtcacatgtactataattagattttggaagtgtgtacagggaggaggaaatggtgtaattaaggtaacctatcagatgcccaactgcatccttcagaaaggaggctgaaacgcccgccctcccagctttcacactgcccttcaagggcagaggcaccaggtgcaggaattgcaggcactccagagccaccaccgcagagctcctctttaaagaaacctattctccacaccagaatcaatccggtgaggttgttagctcgtggtgcatatccggacaacttaagaggaaagccgggcagggcacttagaaactttgactttgcatttgggctacaaagtcccatcttcaggatgggggactataagggagtttatggggatgcggggatctcacttaaatagtcaatccaacaagtggcacgggggctctagaagctgatttggccaaggtgagctacagcgaagcaacaccctgcacctttctgcatcttccactcaaggattggcgcttcacaccaggcagctagctcctaacacccacctctaagagcaagaagagaaggaactgagtctggcaacagaaagtctaacccaagctgtccaagtccaacccccgggtattgagctctgcccacctaggacttgagtgatcaggcctcagtggtcaaaggaagcatgtgggttcgaatcccagttcctcctcacctgggctgggttacttcagtcaagttactcaacctccctgttgtaggccacccgccctgcctccctttcttcacctccctgactacctccccttcccactgcctctggtgttggctagaggatcactttggccactgggatgatgaggagtgacatggctgagatctggggagtacctgctcaccgccatgtgctcccctggtaaccctctcaccatatttggaggagccaaggccaccaggctggaggaagcaggaaaaggcccagtggccctgtcatccaccgagctctacacccccgcaggagccattctggcctgaccctgaagcctgaatcagcccagcctcacccgggcaaaatcaacagtggttgtttgaagccactgaattttgggaaggtggttatacagcaattgaagactgacatagttcctaagcctccatttcctcatttccagaatgaggacaatgaaagtcattccctgaagggcagtcgccaggacaagggaggtggcaccccagccctgagcctgggcaaaccccagcccctgccagccccatcacagaggtg

SEQ ID NO: 2715 - DNA, 3922 bp, Homo sapiens
cttgtaagttattctgtttgaagaagcaaaaataaattagaggcatagatacagacataactcattttggtgtggcagaaatgaaatgagttttgttaaaatattcaggagggataaaaggagggaatagtcaaaaccaggctggtaaaatgttcattgttgcaggtggttgataggtacataggggttcattatattatcctatttatcggtgtgtgtttaaaatttgtattaaaaattgaaggaaaagagagaaaagagaacaacaaacagatgtgtgaaaaaaagacacgaagtacaaaacggatgtattaatggcaaatgtgagtattcctagatttgagtaattttcctgccaaagcatttaggtcagaacaagaagggatgagactgtgttttttaattcaaaatattctgatattccaacctcctccttggaacctccaattattctatgtaataataatttgtatctaatgaaaattaagatatgatatttaaaaagccaacctaatgcagctcagtgctagacatggtagatgggtgcttacccaggagccattcaataccctctcttcccttactttttctactttagaagttcaaaagcaaaaccttttttcctattgtccctcacacctggagatgacaaggcaacataatattgtccaaacagatgtcaataggcctgggtgggacttcaggaaagctcatatttgttaaaaaaaggctcagcttttgcccctctcttccacctttttccttcccagagagtaaacttgaagcctgaaattgcagcagagtgggcaaacagaaggacaaaggcctacaaggtaaggtaaatggagcagatggaaagaactgcagttcttgccagtattattgagtcactacagcgagaaaaataaaacgataattaatacaaaaagtagattctacattatgaacccagaaaccaaaaagctctgctctggatctgactctgttacttactacctgagtgacattgatcatgtcatagagttctattccctcctctgttactcaagagaacacttgacttctttagcctagagttatcctatgaaataatgcatgttatatatcttcatacatggtaagagagtacatcaatggaagatgttgcttatttaacatgccaggtggttgatacataggacacgcagtgactccacagttaaatataacagtgcccaggagtctgctttccgttcaaagaagaatttgcagacacttactttgactggcttaatttcagacttcttgggaattctgttctgaagttaggaacttccaaggtagaggacgtttgtgtttgtgtattccaaaatgtatttgcccatgttgggtcagtcagattgagttggcatgttcttggtgaggtatacagtggaagtgggccagtttcctgcttcacctaggctaggctttcctttttcctagaaaaatgaaaggctcaggaaagcagccatgctaactactataccaccatcaccaccaggaaggctcaggacactcattcccaactctggaggatgctgtggggttcatgagcaggaagagatctcctgataaagaggttaaagacctatcatatctccaaagaaagaggttaaatgattttctgtgagcttcgtaaatgtggaagtcaggatttaatgtattgacattgatttgcttaactctgtggggaaggatgtagtcatcttggcattctattttgccgtggcttagaggatgattctttcaatgaaatagactccacctcctcctagaagtatgtacaccactgtacatgcaatccacctttgcctgctggaagaacatatcctcagtcttttaagattcagctcagtgtctcttctttcctgaaatctttactgacctcaccatcatgtattctgaagtatatacagcatattgttgtacattcaccccgtctcctctttgcatttggccattagactgtgagtgccaaaggacaggggctctgtattatttgcttttgtatcatcagcatccattatagtgtctgtcctatagaaaacaaaccttaacataagactgttgaagaactaaattcattgctaagtgattgaaaaatgtgattgaaaaatgggtaactggttgtatctctcaactagtgaccattagcctggcagctttccctgttgcataaggcttaagaatctcaagtaccccactgccctgtgggtaaaaactgtcaactaaaaggagacagaaaacagagtgtgacaaaatattaatatcattccaatttaactgagcagattatctaaggtttccagttatccaaggcagaggaccattatattaggacagatcatttacagtggatatcagactcagatttttagtatgaaagagaggggcaagtattgtactcttttaaaagattacaaatattcaatccttggcaatttaatatttgtcttcctttgtctaagaatacgaggggaatctttgatgaaagacttgttgaggcatatggcaagttttgaaagaatttgaaggtgaataagtaatgaaatatctattccctcttttaacattaaaaacaattgtatttaaccaataaggaaaaaaattcaggtaaaaaaattccatgcatatttttcttttttaatttaatttctactaatattatgactcagaggctgaatccaggataaaggtaatctatcatcagggctctctttcagggcagaaagagaacatataaagactagaaatgaaaaaaagagattaaacaaggcttccacttcatctctggattctatcacttagcatagtgttttcaaagttcattcatttgtatcatgcatcagtacttcattcctctttgtggctgaatataaaatctcgttgtacagatgtaccttgtattgtttgtccattcatctgttaatgaatatctgagtagcttctgcctattgactgctatgactagtgctgttaaaaacatccatgtacaagtttttgtgtggacatatatttttatttctttgggtatatacctaggagtggaaatgttgagttatatggaaactctatgtttaatcatttgagaaactgtcagattattttccaaagcagctgcaccattttatactcacatcagcagtgtaggagggttcaatttctccacatactcaccaacactttgttatctttttgatacttgctatcctagtgcctttgaagtggcatctgattgtggttttgatttgcatttctttaatgactaataatgttaagtagcttttttttatggctcattggccatgtgtacgtctttcttagtgaagtggctattaagatccttagctgatttttaatcaggttatttgtcttttatgattgagtcatgtctttatatagtcttgatacaagacccttatcagatatgtgatttacaaatacttttttccactctgtggtttttcactttcctgatgctggtctttgaagaacaaaagtttttcaattttggtgaaatccaatttatctattatttatttcttttgctcatgcttatccaataattataatccaacagattattatccaataatctgttgccaaagctaaggaaggtcatgaatatttactcctatgttttcttctaagagttttgtgattttagctcttacaattaggtctctaatccatttggggttagtttttgtgtatgatatgagataggaatccaacttcattcttctgcacatgaatatctagttgtcccaatgccattagttgaagactattcgtttctgcatttaataaacttgctatccttgttgaaaatcaattgaacacagatgtatgggcttatttctagatgttgaatttatttctggatgtttatttctggaat

SEQ ID NO: 2716 - DNA, 2093 bp, Homo sapiens
cagcacaccaagctaatttatgaggtctccaagggaccagatggagaacagatgcaaccacactgaagtcagaatcgcagcttgcctccgacacctgacgcttcactgttggcgaggcccactatgcctcgctctccccctgtaatgagttctatcccagaggctcctataccctttagaaataaactgctcaggcagcccaaccagttcatccaagaggcctggaaccacagcagcgtcgacagctgagatgagagttggtccctgatctgatacagagcctgggtttagctttgatttctctcttcctaggcaagatctttagagaataactttttgtgcctggccatctcctgctcttttctcaacccaaaagggctatgttcacctaaagaggaaaagcaagaaggcttcctgggctcgggaggtcagggctggaaagaactgctcaccatttctgagccgatgaggactcacctgggctcctcactggtcagggaactgtggcccagccgcagagtgattgctttgtcaagaagggaaacatttacctttccttcttccctctgctctctcctaattaacaattaaatggaaggagttgaaaagacatgtcagagacttcaatctcctcccggcctgaggatgaagggggctcgaacctgaatgttctcttcgctgtggccagaacctagggggctggggttgctgccagctcgactggaggcctgcttccagccccaggctgtggtgaggggcctcacagatttcacaaacaggagggcggctgaccaagcgccaaactatttagacaaacacacaccctcccttcccgccagagtttgggctgatttctcccaatgctaatgaacagctcataagtattaatagactccttggcacctaggagtcaggcagagtaacttccagtgtgaattttggccaaggaccctgatgcagcctcaggatcttccaagcccctgttgagtccagggggcatgagacacacagggaggctggggctgctcccaggaagcaggctcacaagagccagacaggctcccacagacagcttttaggtcacagaaacctctgcctgccaggtaggcatgaacacagaaaccctcccaaatcctcagactgtggagcacactccaggtgagccaggatcaatccctggtctcagagaacacttagatgggggtgaaaagcaggaactgagagcttcccacccagcacctgtccctgctaccagctaaacctgtgtcggtcagtgcaggaattgtacaggtgatgctctgagcctgtgctgaggccatgtatggactgaggaaacctcactgtgtgtatgtaaagttaattcaaacctatttccctgagtgcttacatattttcataaggaaagttctgttaggagagctgcctgaaacaacacctctgcctgtgctcccactttctcccgctggtgtggggaggagaggctgacatcgctgggtccacgttcctctgccctgggtggggtattaatgctgccattcccacgctgcctgctgtttcccctcatcctcaggagggctggtctctgtgctgcaggcagctccaccaggcctgggagcatgacaccgtctgccaatgccttgcccaggtccactggcctcacccttccgcaggcctgcgccttctgtgactctctgcctcagcaatttctctggatttctttgtcctcaggaatgtgctggggccacaggcaggtcaggccaggctttctggggagtgaatgctctctgccagtggcggatggaactggtagacacgtcccccggattcctcgcctgcaagtgggatggtgccaggaaagttctacaccatccttcccaggtcccaggaggacaagcacagttgtccacaaggtaaccaacctgctcattcaacacactgtgtatttgcttccctccctcatcagcccctttaaaccccacagtaggtaggaaatgacagaaaacaagagaaaatgctagagataaaggaacttctttaggattccgtcaagactacatccctgagaaaagcagactctggtgaatcatttaggc

SEQ ID NO: 2717 - DNA, 3997 bp, Homo sapiens
ttttttttttgagacagggtctcactctgtcgcccaggctggagtgcagtgacgcgaccttggcttactgcaacctccgcctcccaggttcaagcaattctcctgccttaacctccctagtagctgggattacaggtgcccaccaccgtgcctggctaatttttgtgtttttagtagagacggggtttcgtcatgttggccaggctggccttgaaatcctgacttcaagtgatctgcccgcctcggcctcccaaagtgctgggattacaggcatgaaccaccgcacctggcctcaatacatattttttgaatggaagaatgattacagtagcaaagtaaggaaggacaattcctgttcttgacctttgttaagcacatcttgttaacaagatgttaaaaaggattcatttgaactccacttgggtcccaatgctgataaagactaggtgtagctatatgcagaaccagacctaagtcagtttctccatcactagtgcattgcccactgacttgtaagctataatacaagaaagagctaagagtactggagcagttttcagctaagggcaaggacattttggcagcgcttgtttgaagacagtgatttgaaaagaataaagctattgtataattttgcctctttgtctcttcccacagtcagaattattgagaaagtaatgaagttttagctccagaacctcttctcaggccctggaaggagacctagcaatgtgttcccaggtcatacgttttgcaaattttgaaaaagatatttttaaattctttttctttcttttttttttggtggatcttactctgtcgcccaggctggagtgcagtggcacgatctcagctcactgcagcccccacctccctagtagctgggaatgcaggcacatgcctccacacccagctaatctttgtatatttagtagagatgggggtttcatcatgttggtcaggttggtctcgaacccctaaccttgggtgatccacccgcctcggcctcccaaagtgctgggattacaggcatgagccacggtgcccggcctaaaattctttttcttaaagagagccccccaaaactgtgtaagtttcaagccccaaaacttggatccatcccggccccctcccaagtccaagctgcttaagtaaccagtgatccatgtttagttcattgaacccttgaaacaattctataatataaatactattgtcattccaatttacagatgaggaaactgaggcttagggaatagtcattgcccaagttctcacagttagtaagtggtagagctgggatttaaattcagtagcctgtctccagagaccagacccttcactcccttcactagagtgcttgataatggtgtctatttgttttcttgtccatttttccccactaactaggaagtccccaaggacacaaagacaaatcatttctttttcttttttcttttcttttctttttttttttgagatggagtctcactctgttgccaagctggagtgcagtggcaagatttcagctcattgcaatctctgcctcacaggttcaagtgattctcttgccttggcctcctgagattacaggcgcacgccaccatacctagctaatttttgtatttttggtagagatgggatttcaccatgttgtccaggatggtcttgatttcctgacctcgtgatctgcccacctcggcctcccaaagtgctggggttacaggcgtgagccaccgcgcccggccaagacaaatcatttctacatgccaagcatacagcccagaagagacgtcaccatatgttgggatgtaagaaagaggaaagtagcccccaaagtccagaggccagcctgacactcacagccaggacttggccttgtcctgttgaacataaacaacttcatagaacatcaacagcagacaaggccactctgtgactgtaatggatcaaaacacaaataggaccactctgtcatcatgtctgaacacaaacaaaaaatggatattgtccaaaccatgaaaaagaccaaccccccgtccgtgctaaaatgagagactgctgcttcttacctatgacagctttagccttggtctagcctcccctccttctagatacattttatcaagacccccagtcatagaattacccttgctcttgacagcatccaatccaaagccaagccctgcttccttaaactctccccagattgtctaacaaaagcccaaattctgtaaattctttcttccaccttcctacagaaatgcaccccctttgcccttatttccccattgcctgccttctctcttgctgcaatgaataattaatacaacttctttaatacaggtgtgtttccggtggtctttgactggaatggcatcgacacaagtatcagctatcagtgagcataaaatggaagaatctgattgtgcccaaggaagagcttcctaactgtgacaaaggaggaagcaaagtgtgcagaagacacaaaacaaactccaacctcctcccacctccttgagaataaagcgaagcggggaccatttctaggcacgcctgaggactatttgaggagggtgaggcggagggttacgcacgggactaaggcaaaaccctccgctcgagagcagaaatcgcggcggcacctcttcaggccaccagggggaggaatcacaccgcatcccaggccttgggcggtttcgcacgaccacgcggggctggacggtcgcgtagaactctgggaggtgtagttttagagttgtaatgcgcaatctcgcgcactgtacatcgggaattgtagttctagattgaggaacgagaagtgcttccaagcgtccattttgagccttggaaactacgacgaccaaagggccacgggttcatgggtcgtttctcatttccgtcgagttaaacgtctggggctgcttctgaggaatcagcttgactgggtaagtttgattggagaaaacacctatatctcaattgagcttcctgcagacttttgtattctggcccggtttggggcctcggcgtctctcagtcataggaattgcacattaatcttcgtcctttacgtttcctattcagacacctgtagccacccgctcccttgaccctcccacggtcgcctcgcacttttaacggccagtgcccctggaatccccactgagctcccgtcccaggacccagcccccgcagccccaccttggaccccacagccctaccctgattcctcggccctaccttcaccctgcagcctcacatccctgaaccccgggcttctttatgctcctccaccctttgtgtactttactcttactctcagttttctgtttttcatggcggtggaagaagggtccccattccttctttccgatccgcgattaccctggactcgaagtcagcagacccggttctaggccagctctgcctctcaccctctgtgaccttgggcaaatcatacaactctgggactcagtttcttcctctctaaaacggagatgactgttgctccatcagtctcaggtgaggagtgttgaggagccaacaagctagtatgtgtgaagatgccttgtaaactgtaagaccttcacaagagacagagattatttttatcacaattattaatgctctggaacactcttatcaggcctcttctctagctctgccaccttgttgctcaatctcatccctcgagtgcttggtgtcttcattgtctacgagctggatgatatttcctcacttcctccagagaccaaaggtcaggccaatgagcttttagtcttcagagagctttgtctgaaaggaagcacaagagaagtgcttatcttggactgtatcttgaaatagccagtgatgaaagtgtcacacagctggcagagcagcagtcctctgctcaccagaaacagggtcccagcaggagaggacagctgcaacctaagccccatccattccctctgggctcctctgggcctgttcagtagacactggctttggt

SEQ ID NO: 2718 - DNA, 3888 bp, Homo sapiens
atggcatgaagttaggcatctgaaaacgtgtgtgctccaaaacagaggtcagttaatggaaaattttagaagagaaagttgggttagagccagcacagcaagctgaaatctgctcttacctaactggcaaagtcagaccagaaatacaagcaagaataagaaagacacaaatattttagaactaaatgagagagacctgtgtggttcgatgcattctctgacgttattctgagaagaaacaattaaatgcatactggaagacattttgctcttctacatgttggaaattcggtgtcaccaatgcacagctgcagaatgcacagttctattgttttctttctcatcacagatctgacccctcaccatcttcccccgcccttgagcctgatccttttctgactttgagcctggcaccttgctggtgccggcaggcatcatgaaggcatgggctgggagccagactcagccttgcaaaggaggctcagggaagccgactgacatgggctcaataattagttcaatgccggacacaatgctcaataaggagctgctgggttaatggatgtgtgtgctagctagctgtagtaaacaattcaagttgataacatggggctgattgtctgaacagtacaaaagaaaatggaggactgaccagctctttggtcctccaaggtcaatacaacatttaaagccttcttatagagatatacaagttttgttcatttttaatattcatgtcaataatttaagcaatgtgaaaacttaaacattctcaagcatttatttattttttttggtagagaccaggtctcactctgcttcccagcctgtagggcagtggcatgatcctagctcactataaccttgaactcctgggctcaaacaatccctgctgtctcagcctcctgaacagcttggactataggtgcacgacaccatgcccggctaatttttttatttttattattgtagagatagggtcttgttatgtttcccaggcttgtcattttatgtattgtcttgaataataaaagaaacttggacagagaatagcaggtagcaaattttcagatgtagatttaggataatacaaaattttataatgtgaagtacctcagtaccaaaatcttagctatttataatatgatagcccttgatgtagagctaacttaaattcaacatttccatgactaaataatttgtgggctctaaaatattctcaaaattcctagagttagcatttcttaattgatttctttagcctttttcacattcaactatattataaatacaaaatgaatccattaacatattttataatgtgtctttcagtgtgcttcttagatttagtttgatttcagaaagctaagaaagaaaaaggaattttgcaagccacactcaatcatatctgcataggcatagctatatagacacccataaaattatgcataacccccaggttttcaaatgaacacctcccacagtctcagcaacacagggcaacctccaccctctggcatattcatgtgtccatttcactgtgaaattcttatcttcatcactgctcctcagggggcctctacaactctgcaatgttattgttctgagagaaaatggttattttgtaaaattttccttcaaaaaacctatttaatagaatcacaagtttattctcttcagcagcaagtttgctgaagtacattatttgtccaaaaatagttgaaggccacattgattgaggaagggatgaatactcatactaatgagctttctgtcccgttgttgtggaaattttctgtgaatttgctgggattttctgctgggtcatgcagaacctccttggaatgttatagcctgggaaatgtaattaccccatgacgtttcatttttctcacaatttctggtgtcagaggatggaacaatcaagtcctcactctgaaaggactctctcacatgcccatcagggcagaagggctatcattacagaaatacagcattctcctctgtttttcaagctggtttatctccatcccactacccgaaaagtggaattcagagttcccttagttctctgcttttctgtacatagaactacaacatccaacccagcaaacactcccttcctatacagatattctttaccagcagtattttatgtggaaaacattaacaagagattagtgacaaaagaaattactttgggggagtccattgatctttgccttctaaaatttataagctgctttatataattgtccatgattgccttctttaccctcatcatcaacttccacatatgaaaaagtaacaagaatggggactgagaagaaatagtaagatggttcagactgaacgaagccattcagtttttatacgtgtgtgtgattatttcactataaactctgcttccatgactaaaatcatcacaattaccaagcaatggctttatcccagagttactttagaacaaaaaagaaggcatttgtcatgcagtggcatatctcggggacagctcacccctgtgaaccatgtctgccctttcttcctccttcttttaattaacatttggaaaagaacagtgatgttagcagatagcagagctgggaagggagactcagaaagtgatgtgagctttgtcaatcttcaaccttgccaaggaggacacattaaagtgtttttcatggaaaatcaggctttgtcaacacaaattcaaagcaatgtgaccttgacggatggagatatatatatatatatatatatatatatatatatatatatatatatatatatgcatgctaagtaagaatagcacagactgaagcatctttagagaatataagtgaaccaaataaaaggaggaaaagcatcctaaaagaagatgttaaatccaggaaaaagttgtcaagtgtatttccttctacttaccttttctgctgactgggctgtaccaaaaaagatggggatgaaagctaaccaaatgatgcaggtggtatacatggtaaatccaataggtttggcttcattgaaagtctctgggacacctctcgttttaatggcataaacagtacaagtgaccatcaagaggatactgtatccaagtgaacaaatgagtgagagatcagaaatgtcacacttgagcactcccctggccttctctggatctagtgtccgctgctctccatagtcaatgatgatgtgggggggatccacaacaaaccagacaaacactccaaggagctggacggagatgaggctgaaggtgatcaccagctgagatgctggactaatgaacttgggcgctgtgacagatttcttcccctgctcaaatattcggtggatacggtttgttttggtcagaagggctgcatagctgaaacacatgccaagtcctaggaagacccgtcggaaggagcatatgattgtatctggtgctgcaatcattaaaaacgtgattgaataacagagaaaaatccccgttaggagcacgtaactaagttcgcgtcctgaagccctcacgataggtgtgtcattatagcggacaaaggtcacgatcacaaaggtggtggcgatgattcccaatattgcaacaaacacaggcaccacagcccagggagaatgccactccaatttgatgatggggataagctggcagcctgtgcggttcatgttgggtctctgatccagagggcaaagttcacaggacagctcatccacctggtagttgtaaccttcacagcgttcacagtgccagcagcaagggacccctttcaccgttttcttcctctcccctggcttacacggcaggctgcagacagacgccgggtgagtatgttctctatgagcccactgcatgtcttccacctgtgggtataaaaaattaatgagcct

SEQ ID NO: 2719 - DNA, 852 bp, Homo sapiens
gacctatctaacctctgtcactagaaagctatgtgctggcaaactggcctctacagttcaaggttggagaaccccagccaatgccccgagggtgggacagaacctaggcgccaagcagtatcctcaggctgcaatttgctggacacacagagtcctgttctgcaacctccccctacgttgtggctcattgcttaccttctgactcagctctgaaaaactagctccacatttttaacgctgccaagagctcccttctctgtggattcatctaagacaacagatattaacactaggattgtgatggcagtggagtcagtaccaactgacccaagtattcctagcctgtggaatctttagactcacttaattcattcaacatatacttattaagtgcctactgtgtcatgaacttcagggatatgaaattctgcaagatagtctctgcttttcagtaccaggagccccagatattatacttaatgtttcaaatagtggattctgggttgcttgaaagtcagtaggcagcctttttgtcattaaatttcctttattgctctgatgcattttattttatagtgactctgactacttcagattgttcacaatattttaaaacttacgttattaagattgctcaattctgctgttcaaaaactgttagtaaaatgataaggttaccttatggctttgaattttaggtgctttggtatccatgatacatacgtgtatatatagtcatgcaccatgccacgacgttgcagtcaactacagaccacatgtatgatagtgctctcatgagattataatgccatatttttatggtcctttttctatgtttagaaatatttagat

SEQ ID NO: 2720 - DNA, 6338 bp, Homo sapiens
gggatacagcagtaaacagattccatgtcagtggataaacacacactggaaacacataagtgaaacacagagggtgtcagggaggttataatcactacctagaaaattaaaggagggaaggaggccttagggagagtcacctgggaggtggagacaggtgttgaaattgttaaaaatagcatcaggaaaaggcttactgagtgacatttgagcaaagatttacatgtgagggaagagcattccaggcaagagggcacagtgagtgctatggtcttgcaggagcatgcttgggatatttgtggaacagcacaaatcctgcagtggcttgagtatgggcagtgagagggaagagtacacacgagaggaggtgaaggggaaaagggaagatcatgcatccggggccttgtggccactgtgaatactttggctttccctctggttaaacaggaagatgctggaggctgttaaattggctgtaggggcaagggtggaaggagactctgatgagatggcggtagcatggatctagatggaggtggtggaaagaggtcaggtttgagatattttgaagggagagctgatggactagatgtgggctatgtgagaaggagaaagattgggagaagaataggttatggacttgttaaatttagatccatattagggtgctcgtgtcaaaaatgtagttgggtgtatgagtctggagtcaggagagaagcctgggtgggaagggtgtctgtgagccatctgtgtacatatggtatttacatccatgagactgtggagtgactgtgtgttgggtaagaacttcagtgtcttggggttgtaggcatgagaggaaccagcgaaggagacacaggaaaggtggccagcaaggaggtggagacaaggtctgacgatgagtgactctctggacccccgtgcaggtgtgacaacatgcgtgtgtttaagctgggcctcttctcgggcctctggtggaccctggccctgttctgctggatcagtgaccgagctttctgcgagctgctgtcatccttcaacttcccctacctgcactgcatgtgcaggactatttaagaacattctaaaacgggtcccaaattgctgaagatttatcatcctgctattccagggattgttggtaatcttcatcctttcctaattagaagaggcccctgggctgcaactacagtcagcaaggtgcgtgggttagaccggaagaaggagcaggctaaactcagggcagcggagtcttcatgctcatcaggttctcacctcttgtctccctctgcaggcacatcctcatctgccttgctgcctacctgggctgtgtatgctttgcctactttgatgctgcctcagagattcctgagcaaggccctgtcatcaagttctggcccaatgagaaatgggccttcattggtgtcccctatgtgtccctcctgtgtgccaacaagaaatcatcagtcaagatcacgtgatggcaagatggtggctggcttctctgcttatcgcccctcatgcagtgggcttcctttgctaggaagacagccaagggagttcgaatagttggggtgtgggctatcttttcaaaaatctatttgctggggctcttaatttctttagtgttctttgtatgtagggatttaaactttgtcatatggtacaaatattccctgcccccctgcagtttcccatttgtctttcagtatgttaatatttttgtgccatactggttttaaactttcatgttgtcacatctgttaatcttttctttaggatttctggattttgtgtaatttttaaaaaggtcccctcctcctccctaatgtgtctgtggaccacctggattccactgtacaaggggaaaagtgtctattcctttcccaaagatggaaaatggagggcttagggacactagatgcatctttctcagcatcacttccagatgcagtgacttgttgggctgcgtccttaatggccatggcagagcagtcccttgggggatccagccctgtacaatgcatctcttcctggagaaagctggcctgctccagaccccaccattcccaggcgcccttggagtggactctactgatgacagacagaccctctgagagacaagaccctctgactctgtgatggaagatgccagagattttcctttggggtaattgtccttaaacaaaaccaaacagatgaaacacacacaggacttgtggctaaaaaggctagtttttcacttgcatttctcaactaacccaggttttacatgcatctgtgaatccttttactactacctctgtggagagatggagagacttcagataaacgtgaagctaatgagtaaaaccctctctgccaaaacctacactccactttaggcccttcttgaagatgagcacaatttttaaatactgagcacaatttttaaatactgacatcacttcctcttccccctcccaccccagctcagcagcctcaaatctacagagaagaagaattatggcatgaacattcccacagacccaccatctttaagacttgacctctgtaagtttaccaaagggctcctcacaattgtggtgggggttctggttcaaaatttggagcaaacatgaagtttttggaaacgttttctcatttgaagcctccagtatgctgtactattctggaaattaccttcaagagtctcacttcttgtttctgttgtgttttctgtgggcatcatgttcttcacgcttgcagtagaaggtgctttctcggtttcccagagtatccaacggctcacctttctcaagtgctggcagtagctatgcactcacgggctggtttgggtcgctggtgcagcagcgcaaatctgttgccttctgaatttttctcacctaatgtgacactggctacaatgaatcttctcttcatcgggctgaatgaaagattcaagaaccatcttcaaggtgcatggtgggaattatcaacctcagggatactcattttaactcaggcgtgtcctgctttgtaacattccattgttgggagagggcaggacaggtgtgttcttctgtgggcaggagtcatgtcactgtcctacatatgtaagagttgggaaggtgacgatttttgacacatccaggaactcttactctagttagaatttgtaccagatccaaggtgaaaaccccaataagcaactgaatttagagtttaaaaatgaatgactttatgctacatctgtggttatcaaattatataggttgttgagaagcagaacgctgtttgtagtaagaaatctttgtggaaccccagtgtgtgaagtaaattgtatgttattaaatttatttaaggttaaatttatggcatttacttaataatatatgaggtggtgaaaatgcaaattaacaaattggtaatttccaaggtagaaaaattaggtgttgaatgaatgtatatgttggtttattatagttttatatatatatagagagagtgttttgtttttgagtcagggtcttgctctattacccaggctggagtgcagtggtgcagtcatgactcactgtagcctctgtctcccaggctcaagtgatcctctcacctcagcctccccaggagctgggagtactggtgcgtgcctccactcccagctaatttttgtattttttcatagagatggggtttcaccattttgcccaggctggtctcaaacttctgggctcaagagattcgcccgcctcggcctcccaaagtgctgggaataggcatgagccgtcacgcctggcctaaaaaatatttttaaaatgatctttgaattaaatattcgtagaatttctaatgtatctctttgagacctaggaggttgatggaacagaactgctgttaagtcctttgggtttcaagtctagaattttttaaaggcaaatatcagctcattcttattttagattgaccttatcaggcatggattctggtctcatctactttatggtataaatgctccaaggtagggggtttggtatatattttaagcccggcttttttttttttttttttttttttttttttaatgtgagaagcagaatgtgcttctagaaactggttttaaagagatgagctgagaaagaaatgtggaatggagtatatttgaggaggacaaaacataacttcacttttgaacagaaatcactctagcttgccagcatgggatgtaaaccaagagagtagaaatatacccatcttattttaagttgggtttatggcatcgctcatatatgtaaaagcactacaaactctttaaagaaaattgggaaactacagagaagtcaaagaaaaaaaaaagtaacccatatttctattgcccaggtataatccttgttaatattttggtttggtctcctcttttttcccccaatatagttgtaaataaatgatgtctttcagagttgacatttatcctgtagcttgaatggcatgtaaatgccagttgtatattttttcatgaagtgtaggtttggaatacactagagttagctatatgcttgaatgctgatcactggattctgagactgactactgagtctacctttttaatcaagcctaacatgaatgggctccaaaaagtaatgaatgtaattgtactttttgatgtgcctctgcacttggcttggtgagtcatcataaatagctgttaaatatgtgactttacagattttgatatgttcagattgtaaaaaatgaatagtttatttcattaattgatgggcagtcaagaatctccctcccttcagtagggctgacacttaggagttaggtcatggttgtggttacttggcatggctaatcagattttgttctggtcagaatttgcccaagatcaatacccagcagaaactggagttaggctataaaaaaccattcatgtttccgagtgatcatttcagtcagcgattcatgttttacagtgtttagttgttgattattagaaaaagtaatattttcttccctttatgattacatcattataaatcaagtccttccatgaacacatttaaggtgtgtggagatgagatctctgaatccatttggggatgggctgcatttttggggaactctatgcctgtccagtgaagagtgcctaaaacattaattatagatcaaagatgttctgttgagggacaaagcttgatggtcatcaaacacaaggctttgtaaaaatacgaccacctattccacttactggatctgtcaggtgtgtaaaacttctctcgccagttcatcatgcttccatgagccctcaggactgggatttgagccttcctggctctttatcccttggggcagacatggaaccatctctgagggaccaggtggatgctgaagctcacccagtcagggcccctctcctagctccttttacactgaaattaatctgaaagctttcatagccaaggctttgcctaggtgctattattccagctggccaaagagaagtcttgggccagattgggattctcaatggattttatagacataattcccctgcaaacttaaaaaaataaataacccctactttataggactaattgtttgaattgtatctttctctgtatgttaaaccagatttaaaactattttataaccacaatatgtaatcagagcaatatagtgttttcagatatataccttgttttataccttatgtaggtgtcctacataagggtggcatgcccactggctgtggtaaaatttaatcctcattgctttgggagtgacttaaggccttttgaagtggagcttttgcactttatactttttctgtgaactatgataactatatttgatattaaagctgtaagtggcattttcagcaaatgaatatgtacatgtttgtgtctatttccaaaatgatttctgaactatctgcagtgaaaatgtatctgatggattgtagagcaaagcacattgcctaaattcatttgttaatgaattgggtaccattgttattaaaaatgcgtaaagtaattgttgttccttgttggtttcttctcagagctgtgaaattaacacatgaaaatatttccagcataaaatacctaagaacagtttatttttactaaaacttctatagtcatgtcatatagatataaatctcaaatataggcctggtgcggtggctcgtgcctgtaatcccagcactttgggaggggaaggtgggtggatcacctgaggtcaggagttcgagaccaacctggccaacatggcgaaaccccgtctctactaaaaaaaatacaaaaatcagctgggcatggtaactcgcacctgcagtcccagctagtcaggag

SEQ ID NO: 2721 - DNA, 390 bp, Homo sapiens
gttttttagaatttgatctgaaattttagcaagttgcagaatgggttgtgaagcacaacatttcatctctttgattctagacactatcctcagaaattagatttgaaaaatgagcttcattttcgaagaacatatttctttatagggggagaataattgactccattcaagtgttcgctcctgtttcaatcaactatggctgaagagtgaggagacatttggaataaatatggcttctgggggcccattcctatggatcagcagctggcttctggaggcccattcctgtgaatcgtcgatctcatagaagataatattgttagaaggcttacctcattgatgctgaacatcctaaaaagcttctgctgctttgagtcactgaaaaagacc

SEQ ID NO: 2722 - DNA, 1232 bp, Homo sapiens
cctgaccttgcagggaagcttatctgtttaccgtccgagcactttcagggattctaaaatgccgtgagtgggaaccactgccatgggccatttccatgaaaattcaatttcggggattaatttgaacaggtgtctccatgcgagaggtgtcgctgtgaagccaacggtgaggtgctatgcacagtgtcagcgtgtccccagacggagtgtgtggaccctgtgtacgagcctgatcagtgctgtcccatctgcaaaaatggtccaaactgctttgcagaaaccgcggtgatccctgctggcagagaagtgaagactgacgagtgcaccatatgccactgtacttatgaggaaggcacatggagaatcgagcggcaggccatgtgcacgagacatgaatgcaggcaaatgtagacgcttcccagaacacaaactctgactttttctagaacattttactgatgtgaacattctagatgactctgggaactatcagtcaaagaagacttttgatgaggaataatggaaaattgttggtacttttccttttcttgataacagttactacaacagaaggaaatggatatatttcaaaacatcaacaagaactttgggcataaaatccttctctaaataaatgtgctattttcacaatggagaacactgtgcttagtgttgaagataccaaagggaattcaagtgaggggaaaagaggagagcaaactgatcaaaagggaatgcccatgatgctttcaggaaaccagggtgagaacatgctggctggaggatgggtctggtttccagcagagatgataggagttaaaaggcataggtgagttgttcccatccctggcctgagccttactccatagctatagagacatagtctctagaaacaaaggccagagcatccttttaacatttatatcataagtattctcaataaacgtttgcaatttatttgctttaatgtaacttggcagtaaagactttggcctttggaggtctgattctaatcccagttctaccacttactggttatttatcaggtacacgttacctacctctctgtaactcagattgctcatcagtaacatggggagagtggtatcaaccactaagaggattaaatgagtgaatatttgtaaaacacgtagcctagaatagatatttataaagcacaagatctatgtaaagtgtttataacataatacattggaatatgagacttgaac

SEQ ID NO: 2723 - DNA, 5171 bp, Homo sapiens
gggagaggtacttcaaattaaagagtgaaggactgatcaggctgtttgaagagaaactttgccatatctcacactttatcatccttaagaggtgccagaagagatcactgactgaccctcagcttttgttaagtgcactttcctcagctgagtctgggcacagtcacttcccacctagattacatcagtagactcctaaatcctcaccctgattattcacttgtcatcctcacccaatcagactgcaaacagatgtgaaagtgatttttataaaaataagtcaaacgaagccactctctgattagaaccctgcagtgacacagggacttgtgcagcgtgatctgctggcacccattctccacccctcctgtgtggctctgccatgaatttcatgtgtgcacctccagccttctttccacatcgtcactactgtgcagcagaaaacaacagtggtcatgtctgttgttttcaaaatgccactcggccgggcgcggtggctcacacctgtaatcccagcactttaagaggccaaagcgggtggatcacctaacattcggagttcgagactagcctggccaacatggtgaaaccctgtctctactaaaaatacaaaaaacttagccaggcatgggagcaggcgcctgtggtcccagctactcgggaagctgaggcaggagaatcacttgaacctgggaggcggaggttgcagtgagccgagatcacgccaaagcactccagcctgggcaacagagagagattccgtctccaaaaaaaaaaaaaaaagactcctcaagaattataagcaaacaaagcatttaaccctacagagagagtggggaaaagtttacaaagagaactggtttgatacagtttcaatcgggagcatcttcctactggagaaagggaaacacaatcagagtaaatgactgctcggagttcctgcaccatgtagtttttagagttcaatttttcttcagctaattcatcacaaggattttgaaatttaagataaaaaatgaagaaaataagtaatgagagatttaagttaattaagtaataataataccagtcaacagttatttggtttttaccctgttatcaggctttgctgtaaatgctctgtgtgtatcagttcgtttaattctctcaccatccctgtgaggcggacttgcgctagttatttatctgcggtctctcagctttggggccatcctatactatatgtgctttgatgcgtgtcctgggaatttgtgtattactcacaccccttcacctattggctttttgtttaggttctgccagttggaggccctttattccccaaattctatggggcatacctgcttcttgaggatattaatctcacttccctttagcattattggcttattgatttttcagctttcccataactgaatgaccaatttccaatgttagatttcctaagtgaaatacccagagtggtttctgttgactgtaacctaacttttgcagtattatcctcatttccattttactgatgagaaaatttaagcacaaaagtgttaagtaaatttcccagagtcataagcatatttataatatatatatagcttttaaggaatgttagaaatagtatataattaattatatatatatatgcatatttttttctcatctgcagcaatataaaacatgtttttataagactagggaaatcagaaaataatcatgatacacattttggataaaagattcaggttacaaaacaatattcatagtggaatcaccctcttgtaaaaaataatatatcacatgttcatgcataaaaagagactatataaatagaaaactgtgcagtaattatagcttaatgattttaattttgaattatgaggtaaagaaagacagccatgtgaataacacaaatttattagctggagtggcatcattttcgattttttttttgttttgaatctagtatttgattttttgtattctctaaatttttcaatttattaaagatgtaacaggaaaaaataatatattttaacatgacttcacaagaaatttataacagaaatagaatagaatagaaatagaattttataacagagaaattctttgtgttgcttataggaatatctgagattggttaatttctaaagaaaagaggttgaatttgctcatggttctgcaggctacacaagcatgtcactgacatctgcttagcttctggggaggcctcaggaagcttccagtgatggcctaaggcaaagaggccattgctgaaaaaggaagacaaaactttatataacatatgttctcaaataggtaaaatgcatagaacattttaaagaaaatatcaaaaaatattaataaaggaatttcattatatgggaatactgtgggaagctttattgtatatttgtactgtgcattattctgggaagcaatgaaaactctgaatgactactcaatttgtaatacaacattttatagtaacacagagttttatagtaacagagttttatagtaaatcaattgtattcaaaatatcatttttaagtaatttttatttttaaataattatttcttgaagaaaatagttattttccagcaaacatattttaatgcagaaagccagaaaacatatttagttacattctttattccatggccactttgcctattttaaatacataagttttctaagttttctgctttttgccaccaccacttttaggcaccaaaaccctgttgacagtgtgcacccagttgcagaagcaccctgtgctggcccagcctcatgcagggcagtcgaagctagagagctccttcttttgccatcccaaagcccagggtgctcatggaagttgctgcccagaggtgtgttgacttcctctgtttctcctatgcattctgaggtggctcagaaataaaacgcagtcttcatagtctgtacaggcctctcctctagagaggagttctgcagtatgttcttgcagaacgtaccttgagttctgcagtacgttctgaatgaatgaatgaatgaatgaatgatggatgaacaagtagactttcagataaattttttcacttaatcaggtaggaagcataagactcctaaatgaaaaaaacaaacaaggtaacacgtctagaaagaaggaattgatgaatgttttccagccctggtagccttcctagaagcatgtctttccctgtagctcatccgcttccctggatataggaccctggctgtaacagctaccctgtccctacaggtcccatagtggcagacaatgtctttaagttgttttgccttcttcaggttacctgattactcctaataaggcaacagatgcagaagatctttttttttttttttttttttttttttgagacagagtctcactctgtcgcccaggctggagtgcagtggtacgatctctgctcactgcaacctccacctcccggattcatgccattctcctgcctcagcctcccgagtagctgggactacaggcgcccgccaccacgcccggctaattttttgtatttttagtagagacggggtttcactgtattagccaggatggtctcgatctcctgaccttgtgatccgcccacctcagcctcccagagtgctgggattacaggcttgagccatcgcacccgtcctatgcagaagatcttaaaagaaactgtaaaaattaggcaactagaaaatttgtttacatgttaaagccttttttaaaaatatgaataagagtcattataagagaccaatcaaatgcaaagatgacaggctatgcttctagaccttaacatgctgtttgtcaatttaattgcaaaactctgtcaaataactttagtctgtgttccatgactgcagggtatttctggaaagtaatgacttcatagaacatgctgtcatgttgtatgtctttcacagaagttaacaaagaagaaaaagataagtacctatataaattattgtatctcactctaagctagccagcagagaataaaatataaatcggatttttaaaacagcagagtagaatagtgtattttagagaagtccaatgcaggacttccaatgagaagtgtaataatatttctgtcaattagttacaacttgaaaccaaaacatgctccattaggttaactgtaatgttgtaaaaaaaatcttatgcttcaacattaaactaaaatacctcgaaattgatggtgactttatacaattcacagataactttaaatgtgactgggtaagctgccatctgagaaagaaaataaatcatcaaaatgttagcaaatcagttaatcttttagataatgatcaatctaattcaaattgtggtgctaattaccattataactactctctctagggagtttcctggtaattgcaaataagctccagtttgctgttaactagaaaaaatgttttcagaatcagaattataaaagtagcaaattaatataacacgcttacttggctagtgaaattttacactgatccagaaaaactggaagtgtgaagataccttataaatgtactgttatattagaattcactcatttttcagggaatgaaggaagaaatagaaagattataccaaaggttacacagccagaacctagaaaactggaataaattgtgggtctccttacccttcattctgtaactgcaaaaaaacaaattaagagtggtattacccttatgctgtcagaattgcttccaagatggttattacatttggctagagttgcatagaaatgtaaatcaaatcagatgacaaagttgtagtaatagtcagtttttagtaatagtaaaagaggttgatgatgatccctcagaatattatcccaaacaatcttcagctctcaagttttctgtctttaagaacatcaaccaggaaaacagcatttgtagggctcgtgtgtagtgagtgccttagacatttaaaatgcttgatagacatttatttttgcattgtcgatgtaaatacctgaactattttaatttgaaaatttcagaaagaaaatatatgaaaccgcaataacatagtcactcctctttttcaacaccactttattcattctatcaacaattttctgtttcatattttattgaattcaacaattgtatacatttatattttcaatcatttcattaacatctt

SEQ ID NO: 2724 - DNA, 535 bp, Homo sapiens
gagaaaacaacttggaaatatccagaatagataaatccacagtgagagaaaacagtcccagtagttatcagggactggagagagggaagaatgagaagtgactacttcatggatacaaggttttctctgggggtgatgaaaatattttgacatctgataaaggtggtggtagtacagcactgtgaatgtaccaattgccactgaattgtgcattttaaagtgattgattttatgtggaacaaatttcactttaattataaaaagtgaataaacttttagaagctaaccttggaagaaggtagagactggaagggatcacaagaaaggcttctgggatgttgaccgtgcagcataactgtctgacattggcatgccatttgtaaactgtcaaagtgatggttgggagtgtagcagtgaggacaaccagaggtcactctcatcaccatcttggtttgggtgagttttagctggcttctttactgcaaactgttttatcagcaaggtctttattacctgttcttgtgccaacctccta

SEQ ID NO: 2725 - DNA, 16898 bp, Homo sapiens
ctttcatctttgttttatttcttaaattgatcagaatctggtctgagaattaggttgatggctgcctctgacatttcaattgattaggtgatctttaagggctttctcctctatgagaggggaataaaatttactgccgattagtgagtgattactaggtatcatgcattattttgtgtaattttcacacaccttcacatcttctcttttaactcctctacaatctgatgtggttactattcttatgcttattctactgatgaggaaacatagacagaaggatttacttacttgccaaaggacatagcttgtaagtggtagagtccaacacaaattcagtgcagtcggaatttaaaggcaattcctttaaaagatatttatatcgcatttaacatgaaacatatgacaacatgtcctgactaaattaacatgtgatgtttgtattaagtgaaaaatataaaatttaaaaaaggaaataaacacaggcacccataatttaatcatcttctatctgattgactcccccaccccttttagtcttcttttcctcatcaagttaatgctgatagacttgtttgtccctccataactttcctcttgatctgacaaacataggaattcacatatatagatgacttgggcttttttatttgtatattcataaccaaaatctacaaattactataacacttcttattttttacataactgtatattatacatcaaattctaatttaaaattaatttattcatgtttattattttacatcaattagatccaccccctcttctttttatatgactgcatacagcaacctcagtgtgtacacacataatggagtaaagtctgggtgtacttaaatacttttttaaatgcttatatatttctataaaatatgtagatttataacttgagtttagataaatccacttttaagaattcagccttacaaagggtttcatttactacttctattttgtcttgcagagcatttcttattatttaaaaggatttttaaggattttctttgcttcatgaacagatgggcaacatcacatgagaaccacccacgtcaaagttttatacttaatgcattttatggcaggttttccatttgcaggctcacagtttgtaaattcataccactaaaaatattgtgcaacatgcatctcatgacattatttcttttgttgattatggtattgtaggggcagaaaaggagtgatctttttcttcttcataagagcaatggccaacacctctataacaaaagacatgttagagaaaaacttagcacatttatttgattatagttttctgtgacatgagagcctccagaatgaagacccagagatacaggggaagatatccaattttatgctttggttcaatgaagcagggacagccatgtacaagtgtgattgaacagaaaaggacaggagctagcagtgatagactcaagaattctagcagggcctgtttgttcaggttcttcttggcctctctgtacagaatttcttcctcccacgtatggggtaggactcctctgaaatgagggtcttaatttctttatggccagctgttccacagaaatgtggggaaaattcagagtaatatttttaggcttgatagctgactttagggaaaaatgattttagtttctatgacttgcctcaggcatggatgaggggtaagagacaggagacaggagggcaggagaaggtcagagagaaactgcttttgatgccttcattttggggtattattttcagagccccagtagtatcatttacattcttttcatgggtttctttggtctttattcttctgtttttttcattaactgtcacattacataaactatttatacacatacacacggatgttccatatgagtctgaaataaaaatgcataatagttacaaaacaatttaaagataagttagatggtcaaatagtagaatgattaatgaatttgtaggactattcagtttttctttttcatttcatttttaaagttgtacttgcctagcaatttatttcaaatttgttggcatatgtttatttatattatctcattatcctttaaatgcctgaataatattgatattagttatttgtaacttgtatctctgttttaaaaagtttatctatatgtcttgccacagatttattacttttatcattatgttctaagaaacagtttttgccatcttgattctctttgtttacttttttttcttaatgtttcttttttttatttttagtttttggagacagggtctcaccttgttgcccaggatggagtgcagtggcatgatctcagctccctgcaacctctgcctccctggctcaagccatcctcccacatcaagctactgagtagctgagactacagctcgactctgatttgaagagtaggatggttaaggacatcagaaagaatttcacagagaaaagggtcgaaacagagcatgcaaaaccacaaagagtctcagtcttttgccctcacccaggcaggagtgcagtggtgcaatcttggctctctgcagcctccacctcctgggctcaagcgatcctccaatctccacctcccgagtagccgggactacaggtatgcgccaccaggcccagctaattttcttgtgtgtgtgcatgtgtgtgtgtatatgtgtgtatgtgtgtgtaagtgggatttcgccatgttgcccaggctggtcttgaagtcatgggctcacgtgatccactgtctcagcctcctaatatactgggattacaggcatgagccatcgcaccgggttggaaaatttaaatttccatagcgtttacagaaacttaggaaacaagagaactctaattttctaaaatcgagagctaacttgaaagcaaagaggaaacaatttattgtttgccaaagttgtaataatgtttgactgtggtatgattaacagaattgagtaatgaattagtttatgttagatgatttgacgtaattatttaacctgctgttttattggtttgttttattttacataatatgacgattaaaactgtgatttgacagtatcttttaaaatttatgtatttggttaaccactagtttgtatcttaatctaaaaaaccctgtattgatgttttctttggtcataaattcttcttaatttattatattactaaatttgaaatattgacattaaatttcgtcagctgaaacattaaggagataatttttttctctctctcggtagcttttgaaggtggggaaattgtatgaaaccagtctctgtgatagatttattatcaacctttacttctcttgtttggatatataatagatattttcttaaaataatatgcatgtaaaatacagcacatttttaatagaaacacgtcttctaatatttacattgtgttacaaattatgttaagctgtaacatctctcttatttcttttttctttttctcttcttttttctttaggcttgctctccttttttaaattgtacatgtaatattaactgtagggggttttgaaaaagtcaggtgatattgaacaatttcactattaaaaacaagaaagaaaccctggatgcttctcagtctttggtaacagaaaaacttgcagcatttttattttttaggggaagagtcataaactctgttttgtaggtaacctggaaaagggtgtttttatcagataaatggtcaagacagggatatgaagtcactgacatcaatgcctatttgcattatttttatgaaaaaaatgttgttgataccaaaattggcacataatccaaaaaaaacaagcaattcaatattttgatgtgtgctacaaaagtgatgaataatttgggtttgtccacattaccaaaataataataaatccttcaaaaatattagtgtattagatatctttctgggttttgagattttgtttccttttagtgcactagcaatcatgtagatttattcatttacatttgtgtttacctataagacttctatatagtattgtttgtagtaaagtatatttagcccctttttttcttacaaatattgagcaacagcaaattcttttaagtgtgtgcattttttaggtataaagccatgattaatgtctttctctaacttgtctgaattttgtgcaaaatccaaatatatatctggatttcacaatagcactgcttttacctcattctgtcaggtcaaaccttgtacaaactgactcctttccttagcttcaaaatattaaaactcaaatgactctggatagtactataggtcatttactaattatatatacaaacatagtgattattttttaaagcagaacttctatgagcttctgtttctggttgagaattaaatctgtttatcatttgatattgcaaagtcagaaatgatgttatatcatttttaatttagcctatctcattagatgtaaaaatgtctttaacatttgttaatctaattatctgctttgtcaaaatatgtagtggtcagtaaacttttttgtgtagtttttggtgatgttacttcctacctccctcattgtgtttacaataaatatatggtttgtgtacagcaaaagaccatcaatatcttcctactcaacaaagtttagtctagaattgcttgctgtaaacaaagatgagaaaaggacactttgtttactcaggaatgtggtctaatgtctgaagttttgcttttatgagcttagcatgttttgttttttttttcaaatgaatttacgttttgtaaagaagctttagatattctttgtgatagctcagtgttaaggcataaatttaattttgaattcttataaatattctacatcataagtgatgtagaaaatctatctgaactacacagtagtgactgtggtagtagtggtgatagtagtgatggtaataataatttcacttatacccatacctagttttaaaagcaattttgctgtgtgagatagaatagtaagacatggcatacctactttcaggtgaaaaaacaccttcatatagcaaataatgtacaagcccaaagtgaatggtaaagggagtgccaagtaaatatcatagacatatgaggaacatagaaatttaaagaacaaggatcttgagtcaaaagcacctttgtgccagtggtgtgagttgtgttggcagcattttatatgaagtgagcaataatggaaaatcccagatacatgaatggattcagaatggtaagactctaggatttgagagacattttgtgggactgcaagaaagtgaatacagggaaaatagattaaacaagcattctgaatagtttgaactttgttctcaagcaatgggaagacaaactaccatttactggaaattagctatttttcaagttttgtgctatgcactttgtgtgtattatctctctctcttttttttttttaacaacaatccatttaggtagatagaaagatgacatgaagagaaatagaatagctttactttcacaaatttattcattgtgttagagaaataaaatggaaagcatatattctgagtgtgtatgagggttagttaaattaagttattttcatttctactttcccacattttagtcatgtatttacattgtggtgaatagactccatgttctagatactgagctgcaacttacagtggtaagtagttgaattggttgtcaaatgaagttatttgtgttccagtctctgtgccacagagcttctcagaggcagtaggtctgtcatcaaaaaaatggcactgtgaaagccctcttatgtcaccatctaagattttgtccaagagaatagaaactaagaaactgagatgctgactttgccagagtcatagagccaggaaatgatggatacttaacagctcccttccccaaaacaaccttgaatggtccaccagatggctggcatcaaggttcaagtatgtttgacattgggctgcctttctgatgctactgtgcagttctcatttttctggccttactttgttacttgatatagagacacaaactaaagcttgaaaaatccagtaaagtaaataaaaaagcattactgtttctatttccaacttcccttatatatcaaaaatattcagcttaacttctaaagccagagtagagttcattcatgtaaagccatttctcctagaggctaagatagaagagatttgcagaatggttggacaattaaagatggagttaatcattctcttttcattaggaagcacattgctacatgtccaagaaaaacaacaattttaaaagccctattttgtcaattagcataaaatatggtatttctctggtttactaagtcataagaaactcaatttttattactcttttctttgatattttttccataactatatattttttatttttgccatcattaggaatgcatatttgaaagaaatatgtacccacattaaataatcttatctgtgaaaggcaatagtaagtagcaaaattgactcagtaggcagctattatgaatgcctgcatagtacctcaggaaatatttaataattggaggctttaatattctaacacttcttttaaggtctcaagctaagaaggatcgctaaatttctgtgtcttgagcaagtgaatatgaagtagagatgatttatgaggtgaacaggtagtaaacaaagtcattttagggctcaagcaacttattgcttgtattacctggagaaagtcctagttttctcatttgttaaaaacaaatggtataaaaatatgtgttctgattcattggtttggtataggatttcattacatgttaggaaaagcaaaaggttttcgaaaactctagaacttatttcaaataaacactgttttaaaaatgtatcactcctagttattatcaatgttacttcttacccttttggtccccaacttttactgtcgtttttcagaatataacatttcaaatctgtggctcctttgtgaaaatgtggaatggggctctgaaacactgagcacatgctagcgttcagtgctcagtactctcagtgaggctgcccatcatctctcaggggaagccagagtgacagcatctcagatccacactgtccttgagcagggaagttggggcccagtcacagctcctgtacttctcagtgtgctcatcacctctctagggtttcacttccttccatggcaaaaaagaggaaggttgaaatagctgatcaataaacttctttcaattgttaaaccccatgttactatgaactacagctagagatgatgatcttgggatgctgagtaaagtattttaaaacataaatttagagaagttaaaagtagaagttttgaacaaataactaagccaagacttcattactttttgctgtagattttccattttcatactttgtattaaattagttaaagtgaaggaaacatcaacacaagtaggtgtgtagaaggccatctgaggggagattaaagtttatttatttatgtgtttattattttttgagataggaccatggtctgtcacccaggctgaaatgcagtggtgcagtcatggctcactctagcctcaacctcccatgctcaagccatcctcccacctcaaactcctgagtagctgggactacaggtgcacaccaccacacctggctagtttttgtatttttttgtagagacagggtttcaccatgtagcccaggctgatcttaaaatactggactcaagcaatctgcctgcctcggcctcccaaagtgctggccgcactacagactgtacctggccaagcctaaatttttagaaaatgtaagttaaaataccttattttaaaagactgcatatattttacaagtttctcagaacatttaatcaacatacttttttatactgatatttaagaaaataaaaaacggtgattgagagcttgaaatttggaatcagagacctgagttaaatattggctccatccagttttatcacttacagccatatggatttggccagtttttccaacttatttcagccatagtttctcatcagtaaaatgagaataatttagcacctgactcatagggtagttatgaagattaaatgagaatatgtgtaaagaacaaagtggagtagcagtgaatatgtgaatgtgctataactattcatatgactaaggataatttgactgatatattaacagtatttaaagttataaaatttagaactaacattccaaggttaaatagcttattgatgaaaaatatgataacttcctttttatgtactctattccagtcttttggattgctataccaacttgcattgatcactcttcaaaagtctctccatagcttacagaatttttattggaacttaagaccagagaatgtaccaatgtggaaagtaaagagctgttctggattagaaggaaaaaaaaagaaatttaatgtgcttttccttagttctactactgtttttgcttgctttaatgggtggaatggaactgtgactataattaagtaaaatgaatattgaaataaatattaacttcagaatataaatgggagaaaaggcactaaatacaaatttgcatctgcaagaagtgagaggttataaatatgttgttagatcacctataatgtctgctttaggcacctagttcttgcagttttacattgaaacacagagacaaatacaatataaataagtcattacaaagctcttaatccaaagagagagatacacacagaaataattaaaggatttcctaaataaaggactagataatgtgctgttggactaaagtgatggaacttctgaattctttttcagaagatggagaaaggaggcttcccaggtgttaacattaaattctagagcaaagaaaaaaaatgtgtagaattgtgtagttccttgtgtgggtacagaattttggggaaagcagctgttcaataataagtcctgatattttctatatatgttcagaaattaacatgcacttacattgttgattaatcctcacacatatttatgaattattattattattttaaataaatgatgtaactcagtgacatggcttgactctgtgtccccacccaaatctcatgtccagttgtaattcccagtgttgaaggaggggcctggtgggaggtgattgaatcgtggtggtggacttcccctttgttgttttcatgatagaattctcatgagatctggttgtttgaaagtgtgtagcaccttccttatccctttactctctcctgctagccatgcgaagatgtacctgcttctgcttcatcttctgccctgattgtaagtttcctgaggcctctccagaagcagaaatctggaaagtctgcagaactgtgagcagattaaaccatttttctttataaattacccagtctcaggtatgtctttatagcaatgtgagaactaatacactcagactgagaaaagttagtgacttatctaacaatatataatacctctcaattcagttttcttattattctgaggaaatgttttaaacacatgtgagtttgaaagtaaagtaaattatagtaaatttaggcacattattataataagaaaaagtactcaaaaggtaattgcaatagtttatgaatattaacatagtctaaaatgtgtaccacacattcactttctctaaacctattaaatggaatcaagattctgaaaaaaactgcaagaaaacaattatttatgtccagtgttgtcttaaaatgtcattgtaaattgcaagattatttattcctttttttgttttttatttcgtgtttagttgaccagatgttatccacagataacttcccataagaattaaatatagagccaaaagtattgcattaaaaatattgtcagtgagatagaaatccaggaactgtatgtgagaaaccttaatccttctctttatttcacaagttgggaacaagttccagtagtaagtaggcaggtggtgtaatgaatattttactatataagaaaatccagaagttactttcagctctaggtctgccatgtaaaagctttgggactatgaataaattatttaatttttaaatcacactgtcctcatctgcaaaataaaatatactagcctaaaataaaaataatctagtctaaatgcactttaagatcctttttagctttaactttacttttgtagaaagcttcagagggattttgacatgcattaagggataatgggataatttcactaaatgtgttagaatgaggaaaataaaattcgttattagtgcatcaggaacataaagaaatgttgaatggattttccatgggagacaacaatggctccatccaaggttataggaaaaaaaataaagtgatagaatatatcttcgaaagtagcttttaacatatgtgcagagaattgacacggcactaagatatttatattttaatctattattctggtaatattgcacaatatggggcttgaatcacatgacattcaaaaataggtttggtaaatcattttgaacttcattttgaacatgtctgcatggacataggaaatggaatgttgagtctgtttaagaggtttaagagagaagaagaaacaagttagggagagattctagggaaaggggacgcaggcaagaggggtatgtattcacaacattgtattactcccttataacagggactcttgcagactgagattacattttggaagagagagagttgaaattaatgttgacttctggaaatcaagccttatattaggtcacaaatgtaccaaagaggtacaaatgaagaaataataaatgaaataatttataagacaggttatatgtgtggagggaaactctctgcatgctgcataagtaggagttctggaaaatgccaactcttttctcatgtgttactttagacatcattcctccattaagccattctgaacctatctaagtctggattttgtgccctctgatagaccgggacaaatgtagcccataagaacttgtatcagtcacgattgtctttatgcttgccttttcccccactcagaaggtgcacaggcaggttttatcttaagcattgttgggcattgcacttagctccatttttgccatgtagtaggctgacacaatgaactaatggtctgtggtggcagaaattaagcttgtttgcaaagaaacacaatataacaataacaataaatacatcaaaaaatagatgtgaaaacagaagtgaagtggttaaaagctagggttctgatgaggaggagtgtttcttatataagatgaacctattactgtgtcatcaagaatcagtatcttcatgattttcagccttagtttccaaatttgtaaaacggagacaacaacaatgtctatctcataggggattttagaagttgaaatgaaataatacatgctcatgtataacctatgtatatgtaatacaagactaagtgctcaaaaatgtttaccatttttattaaccataacttctcctataaatgtcattagaatacagaaaaacaaggaaggattttctcacaacaattaagtgtgttaaaagtaatatagattattttgtatcaggaagaaatttcatccagcgtaaacacttttcatttcaaaaagtatgagattagaaattgtattctttcaaaactgtagtcagactgtatatttccagtgcctggcacatatctgtcaaatatgcaaagccatttcgtttcattttttttttattattatgctttaacttctgggatacatgtacagaatgtgcaggtttgttacataggtatacatgtgctgtggtggtttgctgcacccatcaacccgtcatctacattaggtatttctcctaatgctatccctccccctagcctccaacccctgacaggccctggtgtgtgatgttctgctccccgtatccatgtgttctcattgttcatctcccacttatgagtgaaaacatagtgtttggttttctgtttctgtgttagtttgctgagaataatggtttccagcttcatccatgtccctgcaaaggacatgaacttatccttttttatggcttcatagtattccatggtgtatatgtgccacattttctttatccagtctatcattgatgggcatttgttcccatcaatgggaacaagtctttgctattgtaagtagtgctgcagtaaacatatgtgtgcatgtgtctttatagtagaatgatttataatcctttgggtatatacccagtaatggaattgctgggtcaaatggtatttctggttctagatacttgaggaatcaccacactgtcttccacaatggttgaactaatttaccctcccaccaacagtataaaagcattcctatttctccacatcctctccagcatctgttgtttcctgactttttaatgattgccattctaactggcgtgagttggcatctcattgtggttttgatttgcatttctctaatgaccagtgatgatgagttttttttttcatatgtttgttggctgcctaaatgtcttcttttgagaagtgtctgttcatgtccttcacccacttttcgatgggattgtttttttcttgtaaatttgtttaagttccttgtagattctggatattagccctttgtcagatggatagattgcaaaaattttctcccattctgtacttcatttctatataacaacttggaatatcacagttctatgcactagaaaggagatttccatttttttcttaaccaatgaaacttcatatcctctttgggaagtaggtcatttaatgagtcattggtggaaagaaaatctactttaaaaacacaatactttctcttttgtttcacagatacaagtttctacaagatgcatttccctttacagttatgatagttctctttagaatctaaaggttaactctagcttgtgtgtgtatggtgcatgtgctgtgaatgttgtaagaaagccaattcaaagagattatgtaatttagaagatagatgctttgatttttttttcttttctaagaaccagcgtgctgccttttctaatacaaggttgggaaatagttctgtagctagatggggatatattaatatatactcacagggcacataatgacagtgcaaaaatatgctttcatcaagaacataaaagatggaacagaagtaatatttaacaacaggtagagattggttaccatggcatctattacagtgaaagtgtctaaaaagcacaatctgttgctctatttaatatagtaagtatatatttttgcgtttgtaaagttttgagatctagtctaatgcttttaatatatgtgatgcttctatatgccttaggaatgactactatttcaaaaagaaaaggttccatctagaacaataactcaaatataatgaataagttaatgcgtatatagtatggaaaaccattccaaatgattctgattgccactcccaggggattatgacttcctctcactccctttaaaattcaatatgttttttggcaatatttctagttgttcatacagcaacgagcctcccgcttttcttccatatgtgaattccatctaaagtattacattttaaaaaaatcttttatagttacacatggccatataatacatatatttagtgaatgacatttatcaaagtctggtaggtatttttgagaaagttttgctttcttgaatttggtcccatacttctttcttcttctcttgtctggaattcaatatgaggctgaaatgggaattatcatcttataaccattgagacaaaagtcacatggtaagagtaacttctgtgaggccaggagtctggttcttcagatttcctcaagtgcccagatctgtgtgggaatgccctacctggtgatttcttattactcaaaagacataaattggtttctgaccacagtagaggatttcaaattcatatagatgaacatcaacttaaccattacataattaactgctgtgtatggatagttatggagacttagtcctgaagtgttttttattaggattatatgatctatatactaatgactcctgtatttatatctccatcttgaaacttctgcctatttgtcttggtcatgtaattgtctggagtactacaaaattaacaagcccaacacagaacctcaaagtaccacttactcaccagcagaagctgctcatctagcagaattcctcatttctagctacagactcttctgttcaggttgtttcccaggcccaaaaccttgggatcatcctcatttactcaaaactcatatgtatcaactcaaaagcaactgattttgtttctaaaatgtattatggtataaccatttttcactagttttattgctattaaattaattcaaaccactgttgcatgtttcatgagttctcctaactggtcttcctactttcaatctgtctctccttccatgtattgcaacagaacatcaaaaggaatcctattaaagagtgagtcaagtagtgtcatttgtctgctcaaaaccatctcattcacaaagtcaaaaatatatgctcacaaagcgtgcacaatttgtcctccagtcatctctcctaatactctccacctctctcactctattacagagattttttggtgtgtacttttaaatgattaaagaattctgtcactcatactctcttgaattttcaagtgtatcctcatttcaattatctcagtctttctcagtcaaggtagtaattttgtaggccctaaaattaactaatattatactatgacaaacgttttgataatcagatttccttttgttttcatcaatctcagcttcatactatgaggcttaggagaccttttcagcatgtttattgacttcttatctgtgcccttagggacatccattctcaacttcaggttattcaccactgcctgctacaagttgctaccttatcttgtggtcctttgattccaaatattcaatttttcactattgtgctttgtcctattaattttcattctagaaaataaatgaaacaatgaaacattctttcacttgcactagaacagataattgcaaatatggcacatttttctcagtctgttgcctatatcccattattttacactcatttctgattcatttaaggttatttggttgcatttttaagctgactttggctaacattttgggaaaaaaagggaagatatttgaattctatttgaattctaaaaaaattaatcaataaccataaaaccagaggcaagaacaaaaactaagtggagagaacaatagaaaattcaaaaaatcctgtgatacaaacccacagccaatattatattaaatgggcaaaagttggaagcattcccgttgaaaccctacaaaaggcaaggatgccctctctcaccattcctattcaacatagtattgcaagtcctagccagagcaaacaggcaagagaaagaaataaagggcaaataggaagagaggaagtcaaaatatctttgtttgcagaaaagaagattctatatatattaatagaaaaccacatagtcttggcccttcagctccatcagctgataaacaacctcagcaaggtttcaggatacaatatcaatgtacaaaaatcactagcattcctatacaccagcaacagccaagccaagagccaaatcagaaaggcaatcccattcacaattgccacacacaaaaaaataaaatacctaggaatattgctaaccagggagatgaaagatgtctacaatgaaaattacaaaacactgctcaaagaaatcatggaagaaacaaacaaatcgaaaaacattccatgctcatggataggaagaatcaaaatcattaaaatggacatactgcccaaagcattttacagatttagtgctactactatcaaactgctaatgacattgttcacagaactagaaaaaatactattttaagatgcatatggaaccaaaaaagagcctgaatagcccaggcaatcctaagcaaaaagaacaaagctagaggctttgttacctgtagaaggaaacaacagacactggggcatacttgagggtggagggtggtaggagggaggagcaaaaaagataactattgggtactgggcttaattcctgggtgatgaaataatctgtacaacaaatccccatgacgcaagtttaccttcacatttaccctcaaccttaaaataaaagttaaaaacaaacaaacaaacaaaaaccagcaaaattttgtcatagtagaaacaagcttgttagggctccaaccttatgaaaagaaatctaaacattagttagtatgtgaattgcttaatattcaaagacctgagagagcatttaattggctgacactagctatctgattgacttctggctctgttctaagtgaaagaaaagatctatctggttctttggcatctatagtggaaaaatttaccatcccatacaaatggaggtgaggattacaccaaaggaaatccacctgctctttagatggggtagaatgaaaaatgagcgaccaagaaatatcaaagatctaacacagagatcctatccaatatttgtttcccaaatggcagatgtctactatgaaaaattattattttaatcttgctggttgagagtttccttgtcaatgttttttttaaattatactttaagttttagggtacatgtgcacattgtgcaggttagttacatatgtatacatgtgccatgctggtgcactgcacccactaactcgtcgtctagcattaggtatatctcccgatgctatccctcccccctccccccaccccacaacagtccccagagtgtgatattccccttcctgtgtccatgtgttctcattgttcaattcccacctatgagtgagaatatgcggt

SEQ ID NO: 2726 - DNA, 5517 bp, Homo sapiens
cacagactgtctttcaagtttatttagagcaccagaacactttagcccgtgggtgaaaaggcttgccagaactcaagttctaacatctggcatggatgattcccttctagttagggctgatttaaatactcccttcattgcggtatggggtgacagggctgctgctgggggatggggaagagatggcattggtgattcaagactctttgctatcctcttcaatgcctctttcagtgtaggaagttaaaatcagttatgtaatggaattgaatgaagcaagtgtcagatctacatctctacaaacactcactttatcagttcagagaataaagagatgaatttaataatgccactggacacttatactctatcggatcctaataatttctcacactaatgaattcttctatcaacttcatgttaatcaagaggagacagagccaagaagtgagtaattgcttactgaattgtgaaagctgggatgatttaactacagcctccctagaatgtgacagtccacagaaatatctgatttcaaagagatgcttgcattctgtactgatgccatctagaattgtaaatgaccagtgtcacactgctaagtggagaaagcgtgaaagaagaatcccatcagtacattcacgatagaggaaataagaaacaatgaaagccacaagtttactcgaaggcagcaaaattggccctactcccaaccctgcaacatgcaccatttccataaacaatctacagagatggctgagaaaaagaaaaaggggtactctcctttaccccttctccaaagcccgatgaagtaaagagtagaaatcaagagtgtctacaagaattggggattggcattgattctccactgtgtgattactcatgctttatggcaatgtgcctatttaaagggcaggtaatgacttagcaagaaggaaggagagagaatgtcaaactcacctgaagtcttaccaattggtgtggcaggtatgtggctgtttcccatgagtgaatacactataagattattaggctctagctgttttgcttgtatctaatccaggtgacaccagcatttagagactatgaggtgtactgggagctgagataatgaaagaggtagcattaaagtaatatcccccaaattatggcagatctatggttagaagcctaagaataacatgtgaaaacctcatgtcagagcctgacaatataccagaatttggatacctgccatacagaaggtaccagccgccaaggggtaactgtcagaaaagtgacaacaatcacaagttgggaaaaggacttgtctctttgcccctcactcctctctgtgcccaataatttggatgagctattgcctacagaatgaaaggagagttgtagggctatgaatcaaatatgagacaagttttaaatgagaagaaagtaacatttaataagcaaaaatgcccagagaactatggaatcatcccaagaaaggattaataaacaaaaattggattcaatagaaaacacatcagagaaaaaagttaatatttttataccatagatgtgagagtccttaatgcactagttacagcatattagtgcattatgtacattccatgtgactctcttattaccactatacccacaatgcttagaactgggtcctcaataatcgagtatgggtggctaaaggacttttcattttatgtggcagaggataataataaaaaaagaaataatagaggaagaaactggctttggtgttctagacatattagggctgaaacccaaatattcagttacctgttttgcttggcctacatccattttcagcagtgcactcaaagtctccaaagaaatttgcagagaatttcttccagtagccccaagagttctcagcataagtactggaaaaactcactagcatggaggatgcttctctccagtggaatcaacagtggcctctgctgattcagagacttcagtgttccacagtgaaactagattgtgatgagagcaaatatggctggaaggcaacactgctcaggtggttagagcgtgagttctgtagtatcaaggagcttttttctcagtgtgtctgtcagtggagaatttgggggaaagatcaaatcaaattgctaaataaaacataaagccccacagagatggaagccagcaatatgtgtatgctgtggtttgggtgccccctttaccttccagaatgtctttgaactgcatgttgagctggtttcacctgggtgaaaacatgagggaaaaggaagtaagggaaggatggacagatagtggtagagactgatgaccacttcaagtaagtgtgctatcaggagaataactctcccatgtcttcataggagtcagtgaacagtcacctgttgtatagaatcacccatgggcagtcactggttaccagcagcagcaccaaccaaccacctgagaattacaccaatggtcagttaggcaaagagacatctgcctccctctcctcttccccaacacttagattttacttatcactgattcttgcatagaaatggttctgactggtgaaaacaaagagaaaaatatgttgaaggaagtacctatgaacctaattattattttactcatttttttctccaaagtctattgataaataatgttttcagtgtcaactttgactttattttcaatatacaaagtcaaactaaaaactttcgtatttcaggttgaaatttatagtgtaactctttacttttaatggcttccagttgttctattttggtttctggcagaaatccttttggtatgttacatagaaatatagatagataaaggaaagccaattatcttttctttacagagaaatatcctgaatgctgtaagttgaggggaatggcagggtatgtactggtatgactggccaatacagaatctagtctagctgagatatggcttttagtaggaagcctcatagggaacatgatggaggaaaatcctttcatttatggtatcaagagattttcattttaatcccagctatattttacatcaatgttgtcatgcattctatcttctctgggcttgagatatacaagatgaggatgctgatttagcagaagttcaagcatcctttccaaggtgaacatctatgaccactcagtgttgagaattacttcagactattattaacactattattaaccaaaggaaggacccccctgattactgatcagttctccagtccattgggaaatccttctaaaggccatttcatttcagactgaaatgtacaaatgtataaagagtggaaaagacatcaaaactaaaaatactatgttaaactttgttccatataggacaatacatcaaagattaaagttaggttgaaagcaaagttctatgaggataagaacggagtctgtcttatttattgttttattgtcagtgctcagctcagaatgacatttaagaagtgtttaaatgactattggctgaattattaaatgcagataattggttacagtgaaaaaaaaaaagtttgtgggaaaaaaaactgcgtagctggattcctgtgatcccacatcatcccaaccctgtaagttcagggtccaggccaatataaacatgagacagaatataataatgcagtatctgcctcagaatctaggcagcaagacccacagcactttgccccttgagtgaccactgcattacttcattggatccccagtccttcttgataccagagtgagtaggagttatttaattccagtgctgactactagccttctctagtcaaagctgaccctctgttgcagacaattcacctctaatccctcatttcagagtcttctctctccctattgttatgagtgccacttacagtcaggtttctgctttaatcactgctttatattctgacttaagtcagttgccagcttctaccgtatcccagtggtgattgtacacttaagtagatttcttagagtcccataattatgtaaagacgcccctcacctaaatcccaatccaaaggccaaggccccattatccatcatcagcagtttcatccacacaattttatcttattacctagaattctgaatttgcacatcggctttcccatcctgttgctctttttggagctgctttctatgcagaattcttgctgtcttgctcttctgatggaatctccacctatggacagggctgatgggcacagtaacctaaatcttccttagcttggtataaataaattattacatttgccaggttgtcctgagttgtaataataagtcattcattgcacctatacgagcaactaacatcgcttttcatttttaatctatgtgaacatgatctgacaagaatattaaatattcagaccctaaattttcaaatgataaaccagtgggaaagttgttactagaatttctaattttaaaaggaatgttccatcatattatttttgaaatatgtaagtaaaaaaaactaaaatgcactcattatcatagtctttaaaatgatgtgtaaagaactgaaagtctcccttttactaattctattgtttagagaaaattattgttagtatttattgagccctaccatgttccagaaactgttctaggccctgaggctagagaatgaccagaaaaaattaggtgccttcacagaccttatattttgatgaggaatacatacaagcaaagggaaattaagaaaaataaaagataaatgataaggagaaaaataacattaggttagatacaggagctgttgggggagaacatactgaaatattggattcagtggccagggaaaatgtcacagaagaatcgatcagaccatccatgcaaatctctggcagagaaaattccaagcaaatggaatggtaagagcaaaactctgagttggaagtctgattagcatatatgaggacagcaaggagacttgtgtggataaaataaagggaaaggaaagaaaagaaagtgacagaattgctcggtgggtatggggtggaggagaaccaaggatccatatcataataagtacagccactcattgcttaagaacagtgatatattctaaatgtgtcgttaggcaatgatgtcgttatgcaattactattatattcttgtgaaatcatagagtgtacttacacaaatatactatagcctattcctcttaggctacaaacctgtacagcatgttactgcacttaatactgtagacaattgtaacacaatagtatttgtggatccaaacttatctaaataaaacaaggtacagtaaaaatatggcataaaagataaaatatgttacatctgtatgggacacttaccatgaatgaagcttgcaggactgaaagttgccctgggtgagtcagtgagtaactgattagtaaatatgaaggcctggacattactgtactatacactactgcagaatttagaaacatggtacacttaggctacactaaatttataaaaagttattttctttcttcagtaacaaattacccttagc

SEQ ID NO: 2727 - DNA, 3224 bp, Homo sapiens
gtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttgaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgtaatataaagtgtttgagtttttaattgggctgttatgatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatggcctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcatttttttttttttagcatagattgagaacagttgaactcttaaatcctcagatgccaggggtctgctctagcatcagtaagtatttagcagaaactaactccgtaatgaatggaattcaattccacacatggtttgttcaagcacacttaataagtagcctattttttaaatgtctttttaaaatgtaaatatttggatgaagtttttctttgttttgatatattcatttgctacaccaactatgttttcagaattcatcttttgaacaacttggtttcagaatatgtaaaatgactttaaggatcttgtgtatcaaacctatccccgga

SEQ ID NO: 2728 - DNA, 13226 bp, Homo sapiens
gcctcctgagtagctgggactacagtcacatgccaccacacctggctaagtttttgtatttttgctagagacaggggtctcatgttgcccaggctggtctcgaactcctgagctcaagcaattcgtccacctcagcctccgaaagtgctgggattacaggtgtgagccactgcacccgccttcaagagttatcaagagataaattatatttcctctctgaagagaaggtgaagtcatcttctgagagtgaaatagggagtgaggtgggagttcagaaagaatggaaacgtttttgaagagtcaaaattattgactggggacaaaggaaaagatttccatacagtgttctgttggagttggaaagcatgctctatgtggcatgatcgtctcaatctgcaccataccccatgagcagcgagttggggtcctctttgggtagatgttttgggaaggctggcagaatcacaaggcgctgagcatgctggtgagacccaggggagagtaaagctagaaggtgcctgaaactgggagaacgatgagatagaagaagagatttaagggaggaattgaatgagaaatgtcaatggattgcagattgagatcttgacagatctcagaggcactttaagattctaggctgacactggagaaaacgtggcttcagcaggatgcatgtcagtgaccacctactttaaactgacgctggtcttatttacatgaacaaaatatggagctgttgaattgttgagagggtgactgagaaaggctgtaaaaatccaggttgggtaatccccaccatcttggattagttagtgtgggcctctctggaatcagataggtctcacggcctgtctgccaggtcttatgattatgtacaggaaaagagcccagctaataggtgttttgaaaagcttctaaaacctataattgtgagccttttctaccttggacttttgaaggtttaaaccacagaatttttttttaaaggttgagttattttatgtcacaatgccttacaataaatttgtctcttccagaggacagttcctatctctcactttatgaacttttaggcccatgaagtgaattttctaggccattccccatacctccactccagccaattaatatcatggtttgcattttcatccaatcatgcatattctgtggggttggttcaccacacagacacatgcttttttacaagtgttgtcaccaggtgccaggcataggatgaacctgctgaggcagacaaaggatctttctgtcatgcagggaagagcaccagcacgtgagagccctgcctctctggccctttctggcttgtcttgctagagttctccatgatttgtctatccttactctctgtccttaccccaggctcagcctcaagctccccctgtatctaggtgttggatcattttaacatctgcagtttggtggagctgcatgtctctgttctacatacaaataccaaaagaacacaggtctctaggtatctgtgaacaactgacatcatccaaaaagagctttaaaaatcaggggaaaaaaaaaatctctgttgtgttttatctgcctgttgctttgattacagagcactgaagcaaggttttcaaatgtcctttctttgtcaacctgttatcctgccttacaggtggttctgatttcttccactgttattacagtaggagactaaatgtaattacccagcacttcaatttagacgtcaaacacgattatacagaaaacaatctgttagagtgtcccaatgattcagttgttacttggttttatggtgaattctagataagaaatactaataattaggatctcagttgccctttatggcttaacctttatatgttcctggccatttaggaacctagattcatctcatttaaacttctacagatgaagaaaaagagaccaagaaaatggaaatcactcatccaggttcagaaaactgtctgggagtaggtttgggactagcacccccatctcctgatacagaatttaatgctctgcagctctctggggaggagccccaccctctagttgctggagaaggggactcagaggtggtgtggaatggtgctctcatttaggggacagcttgtggggcaacatgtaaagtattctggttctccattggccttacaagcagaatatcttgtaaagtttttcatcagtacccaccaaatctctcccctccttccctcgttttctggtgggtgtgtgtttaaggtgaaataattcgagcaggtaaattttgttttaccaccacacattttaatatcatatgcatatgaatagcaaataaaaattaatctcctgattatttataatatgtcactctctgttaacaggcagagatttgtgttaataattgagagctctctggctgggtgcagtggctcatgcctgtaatcccagcactttggaaggctgagttgggtagatcacttgacgccaggagatcaagaccaacctggccaacatggcgaaaaccatctctaccaaaaatacaaaaattagccaggtgtggtggcacatacctgtaatcccagctcctcaggaggctgaggcatgagaatcgcttaagtccaggaggcagaggttgtggtgagccgagatcgtgccactgcaatccagcctgggccacagagtgagactctgtctcaaaaaaatatataaataaataaaataatgataataataattgagagctttttttaccctaaaatttcactggtctgttatacaacaaagaggctaaaactgtgttgagcagcagtaaggtttacctggtcttacagctggagggtgtgggggtgtagatgagatttagatagcacgggcactggtttttctgatggccagtcaactgttacctggcttctgatctaccaaggtatggcacagactctctgtgatctgcccagaagaggagactgaatcagtgctattagaactctggcgttccctttcagaaaaggtagaagttctcccaagtcactgctcagggccttgtcagtcagtttggtagatttgatgtttattgatgcagaaacagggaccaaggaaatgtccctaactctgggatttttgtcactttgcagaaaaggcatagtggaagaggataaaacattctttgaaagaaggaaatctccaaggtgtatgtatgtcttacatacttaggtgggagaaggttatttgactatgaacaagaaattgaataggaaccagttaaattgctgtaagaaaattaagggagtcctctaagaaagtgtcacccctctgcctccctagaataggagttaatgaattattctgtgaaaccctaaacaaaatcagataggcttcctttgctagagcttgagatcccttagtttagctatacagcatgtgtggtcattttggaggattgttttctatttgctaattatttggctctccaattttgctttccccagggagaatcccatctggataaactatcagttaacagccatgtagtcatccatgttaatagctttactgagtagctagctactcagacatgctagccgtgtagagaaatgtgagatgcggtaggtgtttcaatatatcaatggtacctatggtttgattattttcctggtctgttcaaatgctattaactgcttccaaaatgttataaatgatgtgtttgtagtgtggattgtttctctgttatctatattagtgtttctgtctgttcttaaatcactcatcaaatacttttgtgttgtatctgtttcattctcccctgccccagtcaaactgagcctagtattatgaggtaggccattttgctgttgagtcttgaagacaaagaatggtaatgcaaaatagacattactacttatagcccccttcctctctcataataaaccctgtctctgttgaacttttaactgcaaccacagtccagagtttcaaggagccatctctcaaacatgggtatcattaaggtccagagatttctaaccacagacttactatctttggaataaaagcctgagagcagcctaactcacgtctaatgcaggaagggcaagttaaaaacagccttggcatccttgagatcactgaccctacaggcattatagccttcgagttttattttgataacagcctcctagtgtacttgtctgctatttggttaaattgttgcaaagcaatagacagcgaccctctgcttttatttctagctcacttcagggtagggctaatgagctttcactctgggctgagtgcttgggtcatgcggtgacagatgtaggagaagcaatcctaggaatgagctatattaaaacataatctaagactctggtgctgcgttgccatgaggcaggggcagtgtggcgtctgtcttccccaatgtcacaaaaagcaaagtagtcacagagtttcaacaaagcatgttcatttgaccttggcattgatccaggtctgatctattaacatatcggaagtaacatgatctttaccatccttatcatcatcgtcactaacaatcttttacttatttttttactaaaaatcttttattgaaacttttactatgtgccaaacactttgctaaggatagtatcttcatgatctcacttaacttacaacattaataagtgagtattattaatttcccaattttagagaggaggaaactaagattagggagactaaaagacttccttaaggttatttttactggtttgcagatctggggttcaaatctaggtctgatttcagagcccgagcttttaacacaactatgtcatattaaacaaataaatcaaccagcgtggtggctcacacctgttaatcccagctactcaggaggctgaggcagaaggatgccttgaggccaggagtttgagaccagcctgggcaacatagcaacatctggtttctattaaataaaaaaaaaagagagagagacaagcaagcaaagaaatcagaaactgtttatccggcatctcctctttgtaagatgctatattagatttgtggggttggggtacaaaaaagcataagttactttccatccccaaatggctttaagtgttattggccaagaagtcatttaaaagataactagcaatgtactagatgccaagtatgtggagcatagtaaatattatatgaataaagaggaagtttggagaaggtgagagtcacactgggccttgaacactgggcaaggtttatatagatggaaaataaataagaaacacatttcacaccagggaggtgatgtgaacaaatcctaaggatgaggaagtacaaggcatgtcatgttgttgaaggttggagaatgatgggaatggggtagatgaagagtcagttattcaggaaagaagttttcgtgtactcatctatttggccctcagatatttactgagcgcctgctatctaaagttgtttctgggggaagaacaagagagaagggtgaaaaggtagatttttttttttccagagttgtctggctggcctgcctcatgcaaacatgttgggcattggcatttggtcagcagcctcttctcttaacttcacagttacgcacacttggctggagtatgttctggctctgacctttcttccctggccaatatgtcagaaggaaagagaccagctttggtatatcaatcttactgatttatttctaaacttgaaaaaaaaatcaaagcaatatagcagtgttagaaaaatgtttaaaagaaatgggcaatcacccatagtactaccttcttaatataactaaggtttctaatcttttctagtttttagcatggaaataatgccttttttacatgcttctaatcagatggtgtgtacagttttgcatcctgctttatttacagttagaactcatgaaaatgtgttgagtaaatgaacattgatgcatagtgtttacgggaaccaggtgtactgcctcttctccgttgttaatataaattgttttgaatgttctctattttaatggagatggggtcagtgaaggttttcaggcatcctacttttaaggtatggcttttgaattctgatacagacaatcggaactatcttagcatggattcaagagacttgagaattgaaatcctgataggcaggagcaagataaatatcactctagttccatctatccctaaggagaaccagcttaagcgcaaagacaatctctcatttgcaaatatgggcatgattcctttttttgcttttaattgcccaaatcttgcccctttgtccggcatctggtcaaggaacagggaagttctcagataagggatgtgggagaactgggaccaagtccttggaatttgaatttttcctcccacggtggttgtctgggttgctgttcttgcccactctgtgatccaagtagttgctgagttcagaattgccatgggcttttggaaacctcagtaactgctagttaactaaagtaacaggtgtgaaattagttctgtggttcagttctgccaatcttaaacccataaaaagtacagagttctacgtgtattaatcagcagtatccttctctctcccatccattttcgcctgcctgaataatctccaagaactactctaaaagaacacaagtattgactttgacaaattacacctccctttaaacattcctctgctcagcttctgaattcttctgacagtctaaaaaatagatccaataagacaatattattgcatttcctttagattgatttatcttgggagcatctcctctttcttgtctgtacacctggcactgagatggtagctggcataaaaatccaaagataaatgcttaaaaacatcagcaaccaaattaattcaggaatttatctcactcatgtgaacttaatgatcattctcatgtttgatgagatgttctgggtggataaagcatcagagcaaagagagcaaaatgcgtggtgggtgcaggaaaaaggaaagttccttaggagaaacagagttgagcagtcgccagagtataactcagtagtaacatcaccaaggaagagaaggggtctgtgatgcacaggaagccagcgccaggcctggtgaatatcaaaagcagcagatggggagacaaggaggccggctggaagggaaagggtggctattgtcctgctctgtttatctgttgcttgcttttattgagcacccaagaggacaaatctctgaactagacgtgctccctgacctcttcctgcaagtaacattcagaagagctggaagataatatacacttagaaggtccagtggctctccatttgttattcttccaatggaagaccctgaactaggaacttgaggagaaagattagccatctaaagaaaagacttgcaaaagatctcaaactcaaatgaaatggatcgccttccaccaccatgcgcttccagctgaaaagtggtcatgtgtgtgtatggcagtggctctgccaccttctatgtggctcctttgtgttttagactgagtatggaaaggtgctcagcacactctgtccttttttccctgttagcataggtatatttctgtgtccacaggtacaaagccaaggacctatgtgttctagtggtcagaacactggacttggtaatggttatcaaagctactgtttattaagcgttttctctgcaccagggaggtagtcgaaggtgctatcttacttctgaagatgctgaggcttgaagacattgattaacttaccaagaccgtggaattagtaagaggaagacctgcattggcacccaggttgatctgacttcaaagcctgcattttttttactgcctatggcaatctgtctcccagaaaccagaacaactagtttaaattcccagctctgctactccctagctgaatatttcatgactctggccctcagtctgtcaaatggaagggttgtgctaggtgttttctaacattcctactagttctgaagtccagtgcactgtctaaggcttttatcaaatatatgatttgcaaaacttctctccaattcatcaggttgtcttttgcttagttttaagcaggactttcatgagtataatctcaagcagtctggaatgtatggggaaatggtaggagaaattctttgattactatttattgagtgcctccccaaggatatagcagagaccaaaactgtcatggttcggcctttgaaaaaccaatgaagcagggaaaacagccactgaatatgttacaagggttgagtgttatgcagaaagattacagcatatgtaggcccttctgagggtaattcatgtgaatctggttcagccagttcagtgaacatctgcatgtatcccagaccaagcaagcaacagtatttattttattttcattaatttttaaattatttttctgcttagagtcttctcatgcacaagagcaataggatttaacatctaaatgtaacaggtgtgacaggccacctgtgttcagtcttctcttgttattcttttcttttttgaggcttcttacataccccagttttgatgggagttggcagggcatgtggagttgtacagtgtcagtctaaagaggaacaagggaagatggagataaggaagaagttaaagttaaatcaggggttaaagttagagggatggaatgaggtaaaaataatgagttataccttaggaatgtctcccaaattctcgcttactgcagcaggaagcataggttagaagggagagaagaaaagaaccacagattcacagtctctctgatttgaacgggacccaataagacatgtggtccaacctcatctaattattcaaatggcatctgcaacatcccaggaagactttcagtttgaatgctttcgttgacggatgatgcctacctgacaaggcaggccattggattgtagggcaagctcaggctgtgaagagagacactgctttttgttgagatatcttaaaaaaaaaacaaacttctatcttctagctttaattctggccttctgtgttctttcacttaatgtttacaaagttcatccatgttttagcatttatcatcacttcattcctgtttattaccgaataatatttcattgtatggttaatatcacattttatttatccaaccatcggctcatagatatttgggttgtttttacttttcagctattatgagtaatgctcctgtgaatattagtgcacacatttttgtgtggacatgttttcatttctctgggatatacacctggaagtgaaattactgggtcatatagtaactgtatgttaaacactttgagtgaccgccagactattttccaaaggactgcactattttacattcagtgtaagtatattgcatatatatgcgggttctaacttctccatctcctcgtcagcacttgttatcatctgtcttttatgttataaccatcctagtggccatgaagtgctatctattgtggttttgatttgtatttccctgatggctcatgacgttcagtatttttaaatgtacttatcgaccatttgtatctattcttttgagaaatgtttatttaggtcctttctccagctttaaaaaaattattttgttattgagttatagttctttatatattctagacacaagtctcttgtcaaatatatgatttgcaaaacttttctccaattcatcaggttgtcttttcatttattgatggtatcctttgaaacacgaaaccttctaatttcgatgacgtccagttcactcaccctttattgcttgtccttttggtgtcatagctaagaaaccactgcctaatccaaggttacaaagatttatgccaatgcttctgagagttttatagttttagctcttacatttaggtctttgatcctcatggtctatttttaaaaagcaagttgtatgacatttaaaactcagatactcagtcctcattaaaacttcatctgaaatcaagattagaggaaaaagagtttagcagagtccttccttgcaagtgacccaaaaggttgcagttttataagacaaaaatagactagacatctccagagactttattatgacttttattaggactttattatgactttcattaaggcttgggtttcgaggtgttcaaacctgcaaatatgggtgatagacggatggaccctttgtagttggcgttaggtgataaagagaataggaggctgctgcccaccgccgtttcaacacggccagcagctctgctctctgcctcctgtcctgtgtccttcctcctttggatctcttggcctgagatcctttcagatggtgatttttggtccccttttgtccacgtagttgcttacacatgctagtgcacccccacagcctcatgtctgcctgtccaccccatctccctcctcattctgggactggagacagtttggtttttttatgtatcaggataatgaccacctctttttcttcccatatgagctcccactcccttcttctctacgtaccttccttggagctaattcacacatacctcagggtgcttcttatttttcatgttttttttctcttcctatagatagaactcataaggtttccatggaaacccctgatcagaggtaggggattcttgaatagaggtgagatacacaagctttgctcatttctgaggggctctgggagtgtctccctcactcctccgccaactccctctccaactcttcctgggtcagctcttgggtctgtctctataagatgcttcaggagcccccagaactttgtcttaggatagaacagatggtggtgacgatggccctgagagtccgggctctaggaagaggctgctgctgggtgggttgtttggcatctgcagaaaacctgaaatctggtgtgtttcccaggaaaagggaagtgcttaatggcaatccaattctccctattgcgtcatgagacaagtcctggttaggagagctgggtcccaaattaccagcattgccttcccatctctggttgagattcttgtatgcccggtctttatatgaatggcaggtcttaggcatgcatataagcaaattaacatgctggaactggaagggattcagagtcgaggttctaatatataggttgaaggttcctggaggactgcagagttacagcaaaggctctaagaggccatgtgtgcactgaatgctgcctggggaacaaatacatcaacgtggtcaccatctcttggaactatgctatttttttaaatgataaaaattaatcccatacttgaaaaaattgcaaactactgatttgttgtagacctattaccttgcaaatgaagtaaacaggggctcagacagcaagagtgaggtggcgactagcctgaagtcagccagctaggaccggaggcttggggtggggtaagtgttagtggcagcacctactgctctgtttacccacactgtggaaagtgctatactgggaaaaggaggcctcctctgaccagcaagtgcctactcctgcagctcagagcctgagaaagaaactacacattaaaagtgaaactgaggtggtttcatcttcccagaataaatgaatgatatcagtagaaaagctaggggatttttctggggattggggggaagggagttcaaggaagcagcagttctgaggatactgatttcattcattatctttttgaaaaataaattaatattttaaattaggttcctaatcacagagtgtgaatcataacagaaggattgggtggcctccctttcaagaccagcgctgggaagagctttgaacctgagcctaactgtggatttagatctggtgcacttctccccacttctgtacctaggccagtcaaatccagaacttgttttttttaggggatttcagaggagttgagaacacgaaggtccataattaagcatcattgatttttaaattattttggctctgaggtttaaactggcattgaactctcaggttcagtttagaactctcttatattgtgaaaactgcctcagtgtttccattctgaagaccttgcagttgcttgatttgcatataggagtgtgatatttaagtgtgtgggaaagtggatgaatgtgggtgactatgttatgcgtttgtgaaaaagcatccaggaatataggtgatcatgtggcttgtcaggacttggcaggatgcagatggcacactcggatagggtaatggggggcgtttaagaaagggactctctttaaaggtgtgggtaaagttaagggatatcagcaaaggataaatggagcaaaggataaatgaggcaagagaggtcacctgacctgagctgtggccttgggtgcagagatgcagtcaatccacaggaaagtagcaagggagaagctgagggacaagcccctgtcccaattctcctcttgccctcctgtatccagccagtgcctcccttggcaggacccaaccagaagccagaaggcaagagaactggttacacttctcagaagggccagcctcctgggtcacagagcaagatggggctgtggggctgtgtagcaagatggggggatctactctacacatgcagagtggatccagagttgaatgtgtaatggtaggtcgggtaaaatcttactgtgagaacactcaggcattaactggggctgacctggacttgaatttaaagagtgcttcctacttcagagtcttgctctctctctctctctctctctctctctctcatttcacctattctgcttctttctccctgtggtagggaagaacctagtttccaatgtgtggcatcttgattaaatggaaagtacatgggctatggagctaaatcatattagcttgaaattttagctcagccacttactgaatgtgagccttgggctagttactaaccttgcaagttccagtttcctcatctgtaaaatgttggtaatgttaaactccttgcaaggttgatataagaattaaagactatgtatctttatctgtgtcagtatcttcatctcccagtatagtggttcattcatgttaagtgttcaataaatactggctatttttctcatatccaccacctgggctgtcggtcacacctactcattttctcttatactttgcttcacgaattccttcttctttcctacatcattaatcttttgctctctagtgggtctttcgtttttatttcttaaatacacatctccctgatgttaacaaagaaacctctctcccaacctaaattcttctcta

SEQ ID NO: 2729 - DNA, 8563 bp, Homo sapiens
aatttctactttaaaatacaactatgcacctccactatcttctggcatctaatatgaggatgctttttgagaggcttttcttcctgaaagatggcaaatgcttcaaaaactgaacaagttgataaattataccgggacgagctcacccaccactgaagtgcaaccatctttggggtagctccctacagctgtttaccaccatgctgtggtgcctaggagcagtctgtcataaagaaaagaagaatgcacttggaatataagcaacaggcaatttgcagaagagaagatataattatctagattggaatatgaccaggacaaccataccattcccacaaaccaccaagaaggcaaaaagaagctactcagacagtctggcatcaaagcgaaagcatcagtcaagagaaggaagtggcccaaaaatgggagatccagcaaggatccaaacaagagaatctccaaattaattttgctaagatatcctagaatgacaactgtacatcaggcattaagaacaaccgtcttgcaggtgggaaagcacactgaggacagagttttgttttctgattatacattctttgaatctaataaaattgttggagcatgtttcaaaaatagaaaaaaaggactatccaaagaaagaaagacatgagctctaggaaagagagaatcaaactcaagaaaaaggcaaagagaaacccaaggatgacagcttcattgcagtcttggaaaacatcttatccagggagaaaaataataaaaatgaccaaaagagtagataccaagagtaaggtaaaattattagatttactagattacctgaaataaaaatttacctcttgaaaaaagtatattgagaagatattgaaaggcatagaaagagttgccaatatgcacaaaagaaaataaccagaaagaaaacaatttcctttgctggaaataccttggttcatatatttttttcaacatctccatgtaaattttcggtttccccttcaattttcctgatgaaaactccagttgatataatatttgatattgatatttgaaagaaatagtctaatggacataagaattttttaaaatttctctaagcacgaaattctttctccatatcaagtctgatcaaaagcaatctatggtactggactacatatctttgcagttttacctaagtggcatttgttttatttaaacatctagggtttaaccatcatgagttatctttccttttttttcctctctctctctctcgttttcttttctgtgtcacttcactatgaagatatttagcaaaggatttggctttgttgactttttatcatagatataaatacagcccctgagaaatctttgctgatcctattctcccattgaacaaacatttattgagcttctaggtggtgtcaggtcctacacacgggattaacagggtatgcatgtcaggatttttggacccctagggaatcataatttcttcacatcatagttaacagagagcaaatactggttttttaaatagtcctatttatcagaaggcaagaatttacactattatctattaatagagtaagaatcattatgataaacacagaactttgaaactcccttagaccaactctatacattttaatgaaatttaatgaacatagaatatctacacattcatattatgttttataaaataaatttcaaaacctattggctaatgcatcagtccatgaccaaggttccacctgtgagactgccatgcaggtgggcaaattgcacatgctaaaggaaatagaccatgtcagatatcatcattgaggtctgtatgggcaccagaagccggctagagttggcagcagaagaaaccaatcaaaatctcagctgctctggcactgagccactttccaacctctcttcccagggagaagaatcagcctcacctctggcttcaactttcccaggaagagtagaaggggaaaatgccaactcttttttccaaagcaagaacggccagaataagatcagttatgagagaaagaaccctaatacccaaagcctcttctatcaccagtttcctttttactggtatgcctcatttgctcaaccttttctaaagtctcatgcttatcataagggatgatgtttgctacaggagacaagaactaggatcttccttccaacatgtccctgaaaaggaggagcgaagctatgatgtttccattgcttgctcccaaaccattgatctttaatttcatactacctgagaattttagcacaacacaaactccttagtgaatggcctaggtttcttgatgcaatattcaccttgaattgttttatactagcacttgggcagtaattaaagggacctagaaagaagcaggggaattgtggaggtgagctggggaaagaatagggaataaaagtaagacaaagagcacctgaaatacatcagctttgcctccccttccttctgccttgaaggcttctatcaactaccttggctacaccctcccttcctaccataatcacctctccagattcaaaaaggcctgtgaaagatttattttctctttttttttttgagatggggtctccctctgtcacccaggctggagtgcagtggcacgatttcggtttactgcaacctccacctcccaggttcatgggattctcctgcctcagcctccagagtagctgggattacaggtgcctgccaccacccccggctaatttttttgtatttttagttgaaatgaggtttcaccatattggctaggctggtcttgaactcctgacctcaggtgatcctcctgcctcaacctcccaaagtgctgggattactggcatgaggcaccctgcctggctgagagatttattttctaacctccttccaaaacaccaccaggctaaaataaaagggttctcgatttcctatctgacataagctatcccttgaaaaaactgagaaacacatctcttgttaaacttgttaaacgtaatttttataggaagcatagaaaagcatgctcttttctatcttcatatctagcatagttctaggggtgggtggtagtggtttagactgcttattactaagtttgaacttaaatcaacacaacccctagttaaatcataaatttggtttgttccccgtttggtgtggaccatttcaaccataccttgattttaatactcccttagaacagaagggttttctctgttgaactgtaaatctagttctaccaacatttttacattaggatggtatcttaactatacaaacatagcaacattaaattttttgctagagaaataaagggatgccttagtaagaatcaaagctttgaaatcacatagatctgtgaatactagctcagttacacccttgctgaattattttgatccaatgacttatcctctctgagctgtggttccctcatctgtaaaatgggagtaaaatccacttgctcccatggtggttttaaggatgaattaagaatgtaaagtgctttatgtagtgcctgtcgcacagaatgctcaaaaaagggctacttccattccttacagccccacatactaacccccgtgtagatgccacagcagcccttagctgacagatggctacaaagatgcatgcaaagggtccttaaaaggagtaacaatttagttaggtacatatgttttgtatacagctaattataatacaaggcaaaatgtattaaggcctatggtaaaggcaggcatcaacaacatttacaggagcactaaaggaggagtatgtctagggagcagcgttcctggaggagatgacagaagaggtaatcatcgcactaagaccttgaaagatggatgacttttgacatatgaaaaaggagattggaagtgaagtctgaaaaaaggagcaatgtagctacagagatgcaaaattgggcgattgtgggggacactaagcaatccaacatacacagagtctgggctgtgggagaggaagtaaggtggtaagaatgggctgaggccagaataagaaagaccttgaattcaattctacggggattcacatttattatttaaacaagagaaatcaatatttaaaaattgtgaatgaacactacagtgtccttatggaagtaaaatgccccaaacaagtgtagtgtgttatatctatagaacttagcatcaagcaactgcccctttcattcgagagtgaataataccaggcttcacactattggaacatactcagtcaattaagaaaagtactgattgccggctgcaaaatatccccatggtgccaaagtgtctgtggagtgggtggggagggggagggaaggtgtgataattaaaagaattgttacttgcaatgtcacaggagccaatgtgttaactcggcatgctgggaagctagaatgctcccagctgccacggggagggaggatgtggtttgatccctggcaccactcgttgggacaagatgaatcacaaatgtgttaatagtgaggttccatgtcataatgtgccagatggaggtggttacatctctgattgattgcctcctggccaagacaggagttttccagaaggcaaacgtctccaaattggcattcaagctctagggatcagcaggtctttatcatggtcaacatggacctgacattctcgactttatgaagtgtggctacccccaagacatgggcagccagaaacagtatctggatgaggaaagatgcgatgagggggtgatatatggaagaaacaggtttgtgcttgacagagctcctatggctaagcatgactattaacgaatctatgaatgtactggaaataaaggggagggggtggggagatgcagggggtaccctgcttgtgaacaaaataaataaccagagagagaaaaataaaggcaaaaaagagaaagagcaggatagaaaatacttcccagcctcagacaccaaatccccaaagcagatgagtctagatgccaggctgaggccaccgggcaggaatatagagcaggggacagcaagacgactctcctgtccattcccttccactcaccccgatggcgactacccagccctttgttgctgctgcttttttcccccagtgcaagcttccaacgacaaacagccaactacaagggcaataactgtggtgtcctactgggaactaatgcagcctctcgtgcaggcgctgggtcctaatacaggacagtgaataaagcttcattacagaacaatggagttagctgccagagcctacagatttgaataaacaacaaataagcaacatctgctccagcatatgtgtatggtaaaaaaaagtcacaaaataaaagaatttgtaaatgccaaaagcaacactaaactgccagtgctactgtagagtgaatttttaattgcacatgcaaagaggcaggctgtgggtattagtctcacatatgtcttgttgctgccaacctgggagtatagatgaatttaattaaataaggattatcccttctccccagtacaattacttatttataacaatgataaaattgcctaataaaaaaattgtaatattttaaaaacaaggctagagaacaccctgctttctgtgtaagtcgttcggggctgtttgaatttgagtgtgtcttttaaaattaagtctatgcctactgccaaggaagaaaaaaaaaaccccttatcataaagcctgctgcagttaaacagccagagactacattatggagaaatataaagaagacacagagcagcatggaaattgactttcatgggtgtgtagaaaattaagcaattggactcaaattgaggccaggtgactaagccaagggacagggccactgagacttgttctccaccagtgttctggtcgcccgtgagcagttcccttcgtgttggttatccctcttccatatgcactaattccctgaaaatgaacagcactacccaaaacaaaacaataacaaaagagatgggcactctcgtccctcttctcagtgacggtagagtccctttttacctccacattagcaacctgcatcatcacggaggccagtggtaataaaccaggtatgaaactagagacagcaaagtagattcatgtgtaggatgttactacagaaatcagtatcttctgagtctcaggatctcagtttctttcatctttgagcaattttgttatttaatcacttttcctcactaggattcaaggcaagtcagagcacttgaccaggggcattctctcaaggtcaattcagagggcaaccagaaccaaaagatagtcaaggtgtctaagtgtgtggctgtgggcagttacacaatcgttctacctcagtttccttatccgtgcagtggcagtggtaaaaccagaattcacctccaaagaaagtttccatgaattaatatgtgtaaagtgactgaagcctcagtaagtactcattcaataaacattgccaagaatttaaaaggatgctttataaggcacctagatctgtatctgtctctccctggatgttagcagctttctatttatctattgttttatttcttcctgacacttatcacaattgtaattcaataagtaattgatttcttctgatacttacaaattctatgagactagggtctgttttccttctatttgtatcttcagcattctcttaaggtcgactcaggaggcaaccagaatcaaaagacagttaaagtcttacaggtggctaggcatgagcagggcagaagacggctctcccccaacccactaggaatcttgggtgatgttttggcaattattgcattacctctttaaaaacgataacttggcaaccccagggagaggccatttcctgatgatccacacctgttaacatcaaactagtagttgaattcaagccccaggaagaagcaacttcctgggcatgcatgttgagagacaaaaatggtgaagtatgatcttccgggtacactccaccagaaaagggaagaaagcctcgatgattcccatcgaggaataactccctaaacagaccacctgtggtcacttctcaagggtaaggaaggctctgcgcatgcaggcagctcaccccaagggaagaatcatgggaaagagttgggcttataaagtcctaggatcccggttatgcaacgcacttggctttctttctctctttaacctttttctgtaggagcatacattttactttatgacttggttttgtcccttaactgtaggcctttaaaccactatgtgatgaaataccagttgtgttctcatttttaaatgactgcataattgtccactttatgcgtcattttttaaacaatcccctttattgaaatgtttagggcagttctaattttttacacctctcttataattgccttagagcaactttctagaggttatacacaggtgaaaaggtaaataaagttaaagctttctgatacatattgttatattccttccagaaagcaatgtgcttccttgccaacattagcttatatgaactcttaaacctccaccaatttaataactcatttgtctatttggctataattttaagttgtatttcttagattataactgaggttgaaaattgcttcatttacatatttcttatgtagtaaaatttctactgactttttttgttaaatcttttgttaaaaatactttgtgaaatatttggaaatatttcaaacacatagaaaatatagaaaataactggctgggtgcggtggctcacgcctgtaatcccagcactttgggaggcagaggccggcggatcacgaggtcaggagatccagaccatcctggctaacatagtgaaaccccgtctccactaaaaatacaaaaaaaacttagccgggcgtggtggcaggcgcctgtagtcccagctactcgggaggctgaggcaggagaatggcctgaatccgggagggttcagtgagctgagatcgcgccactgcactccagcctgggcgacagagagagactccatcaaaaaaagagaaagaaagaaagaaagaaagagagagagagagagagagagagagagagaaaggaaagaaagaaaaagaaagaaagaaagaaagaaagaaagaaagaaagaaagaaagaaagaaagaaagaaagaaaataacacaacaaatacatattcttcatagccaccgatcagctctattaaaacttaacattttgccataattacttcagattttttaaaaggggaaacatagatacagtagaagtcctgagtttattctttcctcctttcattcatgtccagagttaaccaggatcctgattatggtggttatatattccctttcatatttttgtgcttttactttgcacattattaatatacagcagatgttgctaaggttaatatatactttatatattgtatgtacccaactacgattaatttacccccaacttatatttgtaatatttatctatgtggatagactaacttctttactagcattgctgtatattattctatttatgagtacgatacataatgtttaaccattttcttattgatttgattgcccttatgttgttg

SEQ ID NO: 2730 - DNA, 1484 bp, Homo sapiens
ctcggagatggaaacccaaggtcatgcagttgtgccaatgcccgttgttagacaacatgcttctattcctgacaaaccagtctcaagcagctctgactgatggggcggatttcaatgctctccaatgacttccaagtgttaagaaaaagctgctgctaccctacatgcccaagctatacgaactacttttttccaggcaaacaggattcctgcagacaatgctcggatgatgaaatctgagaggctggatgacagagaaacccacatgcatacacacacactttataaagcttaggaacaaaagcactttataatctccttctgatgccaagtttacagtgcttccagagtcaacaaaggtgactcaggagagtgcacccagctcctttcagcacttatttagctcagccacctgtgtgagctcaaagacaagggtgccgacttcacctgagtagaccctgagtcacgtgatttcttgctggagatgattcagcaaaggagcactaacctctgagacaaggcttcagcttcctgagctctgctgactcgcctgggacttccctaagcccttctggacctagatgagggcaaaactcagtggaacctcagaagccctaaaaaaatgatagactttcttttgtctcatcattatcagcattttgggatgatttagtcagcctaagaaacctgatggcatgttgacaccagaaaacaggtagtatatattcccaaaccaagttaaaaaaaattaagaaataacagctggaatgccttttattttttctttacacaaatgtgtgtgtcatcgtcatatgccttttttgtgttaatttctgaggatcctgccagtgtgaatactccattctctgcgagtcgcaggtcaggctgcttttgaggcaagcacacgttaagtattgagcagaaacatttgaagcaaagatgagaaagacagaaggggaagcaagaaaaatagtcttcccagtgtgcctatttgggtgcatataaagttacttttagatgtgcgattactggttaatgatttggggaattcttttcaagtagaaatcctgggctaaaaactaagtgtgctcaagctacccccgcacccactgattctgcactccatgggaaaagttctcacaagcaagtcctttgtccactacccacgtctataggaaatgtttgaacagctatacacaaagaactcacaagtccacaacctcgggggtgttgcgggtggagagggcagtggtaaaggtgatgacagggagggcctgtggggacagtaatattagattagtggtcagaagatgctggagcctgccttgccagtcacacacttttagaggaatgctggacagtacacaccctccccaaccctgaatgtaggccctcgctgacatcacgccagatgaagccctgaggtctttaacatctgtaactctatggcatgtaacataaacaggtgtctgaccagtttcccc

SEQ ID NO: 2731 - DNA, 393 bp, Homo sapiens
aagagtcagaagcagaactctggagtggggagagcaggaggtcaggtggcttcctcttggactcactggccacgttttgccttttccataatgtttttcaaaggagtaagttgcatgaagtctgtggagaccatgatgtaaaagctattaaagaaatctgtgtgaaacagacgactggaacaggagctggcaggctgagggggttacagaagaggcattgaacggcagcctccttcatatgtgtttcctcttctaccaagcaacagcacagactattcctacccatcttgggcccagccctgtagacttgccaatcctgctgtttaaaagccagctgtgcttctaccaccataggaaccaggacatcaaagtctgtcttgcctgctgccatgt

SEQ ID NO: 2732 - DNA, 6166 bp, Homo sapiens
gtagaattagaggcagttctctctctaatcttcacagtcacttcactatggaagaatgccttccagatgttgtttaaaataaatgaaggaagtttggtgacaaaaatagaaagaaactatcatcagagtgtacggacgacctatagaatgggagaagaattttgcaatccacccttctgacaaaggaataatatccagaatttacaaggaatttaaacaaatttacaagaaaaaaaaaacagtcccatccaaaagtgaagaaaggatatgaactgacacttcttaaaagaagacttctatgctgccagcaaatatatgaaaaaaagctcaacatcactgatcatcagagaaatgcaaatcaaaaccacaatgagataccatctcacaccagacagggtggcagttattagaaagtcaggaaacaatagatgctggcaaggctgtggagaaataggaaagcctttacactgttggtgggagtgttaattagttcagccattgtagaatacagtatggcaattcctcaaggatctagaacaagaaataccatttgactcaacaatcccattactgggtatttacccaaaggaatataaatcattctactataaagacacatgcacacatacgtttattccagcactatttaccagagcaaagacatggagccaacccaaatgcccatcaatgatagattggataaaaaaaaaaaaatgtgggacatatacaccatggaatactatgcagccatgaaaaaatgagatcatgtcctttgcagggacatggatgaagctggaagacattatcctcagcaaactaacacaggaagagaaaaccaaacatcacatgttctcactcataagggagtgttgaacaatgagaagacatggacacagagaggggaacaacacacaccagggcctttgaggggtgggggatgatgggaaggaattagaggttgagtcagtagatgcagcaaaccaccatgtcacacgtatatctaggtaaaaaacctgcacattctgcacatatatcctttttgcttttttgttttaatttgggattttagaagaaataaagaaaaacaacttaaaaaagaatgcaagctcctagaggaagggtaggttggagggtggatagggaaaggggagatgttggtgaaaagatgcaaggttttaataaagaggaataggttttagtaatctcttgcagagcagaaagaccattgttaataataacatattttaaaattgcaaaaatattagattttaaatgttctcaaaactaagaaatgataaggttatgaagtgatagatatgtaaagtagtttgatgtaatcatttcacaatgtatgcatatatcaaaaatcatattgtagcccataaatgtataaaattattacttgttaattgaaagtttaaatgaagaacacttgggcacaaaggaaagaagaaacaaacaagtggttaaaggcaatatttattaaaatagataagatgcagttccagatttgacctaaagataaatttccatttctcccccctccctttttttttccttcctgtgaccctcttgtatctttatttttgttctgcctcaggttggaatcctggcctcataatggcttggctctcaatagtccatagctctgtaattatccagggctcacataaatgatacatagattccttaaaacattggggttatatctgtacatactatgggaatgcatttcagttccaaccagatagtcaagttggggtttcactttccaccttcactgaccctctggctatcaaaagtaatttttttggcttattcatcaaatatactgggaatttcaaaaggctaaatgctctacactcacctattcaaatgactatcatcagttatttaaaaataaatattttcaaagccatctgttgtgtaaattattttttaaatatacatgttttacataaatgaaaataccaaagatactgattttgtttaatcctttttcttttgacttttttttaactcttatctattcatctgagtgattaatccaccaaataattcacatacacaattcagtttaaagcctctgcaagtttaactattttaactgtatagaagaatacatagagttttctttgtcatttcataatttaaagtggaattacttttctgctggttttagtgaacaatactttatggaaattcctccatttcaagtggcatatatgcaattaattgtgcttaatgccttcataatacttagtagtggggtacaccataatttattcagttacctcacaaatgatagtgatttatgttattttcactttttatctactaaaaatgatgcttgccataaaacttttgatacatatattattatacaaaggtattctatttttatggagtacatatcccaacagaagattataagtttaaaggggaaatttatcttagtacatttaatttgtgctgctcaatttcttgccttaaaaccaattcagatttttacaagcaatataagagtgtcattttccagtccccaaaagcgatgtctttttaactttttacatacaaaatgtaagctgatacatataaaatatcaagtcattattacctgtattttcatttatctgaatactagtgaatttaacaatttggattacttttttggtgaatttcctattcatatcaattgaccattgttttttgataattgtgtcttttttaaaaagcttattgtttacattacacacatgttttccattgccatacatttgttattaatttttatgcaagcaggtattactatctttcattttggttgttggttccttttacaagtatttttttttttttttattccttgactacagataggagtttaattttagctaaagttggatagtcacgcagtggtagaaatccaagctatccctatacaaaccataagaaaaaggtagactgtttcctcctgctgatgtgtgtaaagtcatcctcctacctctttgttgtccatatattctctgagaattacagagatattcagctcaactattcaactgattatgggggttagtcagactgcttaatattgttgtgaagtattgttaaaaatgtcaactgggaataaaaaggaggtaaaactctctaatatgttggtgaagtgtctgctcccaaaattagtagagaatatcaattgtagagaatacaataccagctcttacttccccagaactcaagacttcatttgcctaagctcaaattgtcatttgacttggcagaggcagattgtataagtgattttcatataaaagaaagaagataatttcaggtcattagccttcttagaatgccttctttgacactctgtgttcaaatttattttgttgctgtcaagaaggaggggactgccctagggttgattatgattaattaacattctcatatcatacatataatccattactatactgctatttgtacatggcatatatacttttatggaacactggctatgatttctgatcaattctatagatctttacatattttctttacatttggaaaccatgaaaatgtaaaacattgccccatgtaaaacattgcccctttatagaagggcaatgttttacccaatgttgcaaaatgagttgatacttgtcattttgttgcatgaaatacctatgataccataaaccagattttagctgctcatcactcctttcagtgatacaaattctgttttaaatgcaaaatacatttggtgaatcattagtgtctcaaacctgaataactccattacaatgaaatcactatgtgaagaaaaatgactgacactacccaaaacctctgaatttgtatgcattgaaattactgtaccagatatggtgtggaagagaagaattaatcatttttattaatatgatattcaaaaaagtgtactttctcctcattttcatgaccaacatatcatgtctgacacatttatttttgtccttcacagtgagttacatttcatcttttggattattggcatgaagtaaaagagatagtcttgctgagatctattaatagtttcatatatcactttagtagtgactcagcatttccactacataagttcaatttatctctcttcagtattattcatacatttgtagcacaattcagagttcaacaattattttcctacatggaaagagcattcttctcatgaatccacacagcatgcttcctgaaacatttaaaatgtgataatcctattttacatttcaaacatccttaaaccatgtagcaatacatttgtgatcttggtcaagtccctatctcccttgactcactttatttatgtatatacaactataatattacacattatacatatatgctaattacactatccttgtccttaaaaatcttcctttggaagtgttgtaattttatgtatcctaaagttaaactaaaatgaagaatttgatgtttatcaatcaatatccatttaaagacagataaacaaataaagaacaatttgtattgttttctctatcttctcccagtgtacagtatctttctttagttttttgatgattttacttgtcatccaatttgttgtacaccaattctatcttgaatatttatgaacataagattgtattaattgatctatacatgagaatgttttacagaagtttagaaattccatcagtaaaaactagttatttttccccctgattttaaagtaagtgacttcaccacctgtctcttttcttatgagtgtggctgctaaaagcatatctggatttaacatgcagagatcagatttttttcataatgcttggatttggtagataaggtttgtgaagcagcaaaagctttcgcaggaactctttaaacatgttacaaaaagttacagaaaaaaactcttttagagatgtttttattttttggcattgactagttgaaaagaccaggttatttgtctaatagattgacacacatttggtgtgtggcaagtggtctttttctgatgttgtttactttttttcgcaattcatcatatttcctgtagaagagtaattacaaccagaagtttgattagagttatattcaacttttgtagaacaaaaataataatgcttctgtgttatttctattgtgttaaattactaaacacagaatgtctggttgttctatttttattaatgtaaacattcaccaatgagtaaagtgctatcagtctaatcactctactataaaaattctttaccacattttcaactaatcatttaaaatcattttgattattgcttagattgattgttccattatatgttacaaaatgttaatattccaattcccctttccttttgaatttattagataaaattcttctctaaagaattctccctcttccttctgttatgctaaattaaagtccataaaggtagatgagataaatgctttctattcttacattaccaattttcagaacaatgcattgcctattaatatcattatgaattttggaatttataaaaatcaattgtactttctcatgttattctccacttggttcataagcatagtttttgtgaggtttcctgtggtctttggagatgaaaatttttaattttcttgttgctttctagcccagaaaatgcctatggggaacatagagaggcatgttcccagacagatatggattgatttatttcttgagaacataggatcaactcagaagaccatggatggtaaattggatgaagaaaatgtagtacatgtgcaccatggaataatactacataaagatcaaaaagaatgaaatcaggtcctttgcagcaacacagatgtagctggaggtcattatcctaagtgaattgatggaggaacagaaaagcaaatactgcatgttctcactcataattggggctaaactgagcgcacatggacataaacatgagaacaatagacactgcggactattagatatgggagggaggaagggagaagtgcaaaagttgataaactacttactgggtactatgcttactacctgggtgataggatccgtactccagacctcagcatcttgtgatacgcacatgcaacaaatctgtacatgttcccctgtatctaaaatataagttgaaattttaaaaatccc

SEQ ID NO: 2733 - DNA, 2207 bp, Homo sapiens
caggagccctggagggtttgaagccagctcggtggtgggctttccattccacaccaaggccagcggcaggctcagctcaaaccctgagagtctggctccaaacagctccaggataactgcagtctcagagaagacccccagaaacccaaaatgcttccagccacagaggaggagagcagctggcagccagaagcatccattccaagtgagagacatcgaagggaacaaggcttaaccgccttgtctttgaacagcactaaatgattcagcaaaagggatgagaggaaacctttggccatgtcacgggttcacagccatctgtatatgttcctatagtcctgctttgtacctccagcctaaatgatggggaggtcgtttgaagatgagactgacccttcactacatgtgctgcttccaaccccagattccatcaggctgcacttctgagattcagtgaactcccactcatccttcaaaaccctatctcaatgtcgctgccatagcaaagccttccctggccccctcgggtagggagggtctctctgcccactggcaggccaagaaggccaagctctgccctctgagaatccatcagtgtcccaagctgactttccctagcctcgtatcccttcattccatgaaaggggaacttagggtggagtggaaattttgatcatctaaaggaacaataattgctttcattcattcatttaaacaatatgtattgagcacctaccaaggaccaggccttgtgctaagtgcccccacagaggtcacaatagtcatatactacaaacaaatacagcatcacaaaggttggcgcatgaagagacagcagctaagggcatggtcctggagccagaatgcctggatttgaatcacagctctactacttcccagcagcttgttgagcttagccaagtctctaagcccctctgagcctcagctttatcacctgtaaaatagggataaaagcagcatctgccctattcatctgttcacaggaatacatggcctatggagggaaagtacccaggctcctgagtgggccctcctggcccacggcagaagccgtgtgcatgtctgttcaacagatacctttggtggcctgtatgtaccaggcgcttctattctctgctggtcaaggaaggctcacggtggaataggatttagccccgggagagacagcaggggcattctaaagacatcgactagctggcatcctgtgccaggcatcccaaccttttgcgcatcgcggctcacctggaaaagacgtgggggtgaggaaggaggtgccacctgcatgaggcatggcagaaaagcatgacatcacctttatagtgcaaagcttgacaggaagaataagatacaaagtacttaaagaagataatcgatattggatgtgtattaaatttccaaggaaaatatttttaaatatgtaaattaatcttgagttggcttctacaagcataacttttttttttctttttttttattttgatacagagtctcgttctatcacccaggctggagtgcagtggtgtgatctcggcttactgcaacctccgcctcccgggttcaagtgattctcgtgcctcagccttttgaataactgggattaaaggcgcacaacaccatgcctggataacctttgtatttttagtagaggcggagtttcaccatattggccaggctggtctcaaacttccaacctaaccgggacccaccctgatctgcctgccttggcctcccaaagtgctgggattacaggtgtgagccaccgcaaccagccttacaagcataaatttttttataccaatgtaccaggtttcatgcttgagctgactaagcacagtccgggatcaggaatgtttttcaggggtcagtcctttgggttcctgacagtcaccactgatgagaagcggccgggcaggcagtagtggatgaggaccacctgtggcactacagagagccctctggtggcaggtgggatgtcgactgggcacagctgctgtgactgaatctgaaaggtgacagtggtgccaaagttaccttccaataaaatttcaactgttgcacgtttttgaatggttgtgaaaaaatgattttgtaactataaaaatgtataactacaaagaatctgtaagcttcaatggctggcaggttagggttggaaacctgggagtttgagggctccagggcctggg

SEQ ID NO: 2734 - DNA, 629 bp, Homo sapiens
caaagcaggtccagcctggatcctcataccggggctctcctgtccttcctcaggattcgaaatggggccagtcacacattctcccagccctgacacctgaacctgagcagcagctctgtgaagggggccagggtctgctctggggagaagccatgaaatggaggcggtcaacccctgcaaagcctcgaagtgtgagtggcagcctggcttgaggacgcggacacttagaaccaggacagcggagtcgagacctggccctgccccttcatagctgcatggcttgggagctctctcagtcacctactaaaaatggggatcgtaagattacagaacagtgatagcattaacctatttttaaggatctatatttatatacttagatcaatctgatagggtgcagactaaaatattaagcatcgtcttgaggcgataggatatcagatattattttctttttttgctttatctgtattttctaatttttcttcaatgaacatttggagtaaaaaaaaaacccaaaatgttaaagcaacaaccagataattagtacttaagtatttgtcctgacttacaggacagtttgagaatgatgtttatgaaagtggtttacaaactgtaaagttctttgc

SEQ ID NO: 2735 - DNA, 10600 bp, Homo sapiens
gccaaggggccagtcgcgagctacaaggctttggcccaccaagtgtgtaccatgctgctattgtcatcttccttgaattctttgcgtggggccttttgacaactccaatgttgactgttctacatgaaacattttctcaacacacattcctcatgaatggtctcattcaaggtgtaaagggcctgctctcttttttgagtgccccactcattggtgccctgtctgatgtgtgggggaggaagccctttctcctcggcactgtattctttacctgcttcccaatcccactgatgaggatcagcccatgtttatgcaaataccgtatacgtgataaacgtccctacaacatgatctttggaatgaactaagacaaaggaaactctgaggaaggaccatggcctgagaggtggaattcatccttccgaggactgagatgaggacggaaaatgaaccatcggggggattgacggtgaagatgctaatacctgcccagcatcgaccctagtgcgggtcccaagaccatccccctgtgcaggctccaccaccgctgtgctaactggaccgcggcagaagagtggaagttttcatgggctgagctgctgagttcagcctgggaactgaggccaacaagggagtctcctcggcacacaagtttgaaagaagtcctggtgacttcaagctcagaaccatggacggcagggctccctctggatgtggaattctccgtccctttccagggagggaacaaagcccacagcaccgagactccttcagggtgagcaaaggcctggaaacctgtatgcagttaaagaaaaggaaagaaagagataatcagtgcatgcagttgtcagctggctgggacctgaggagagtcacttgtggaggcaactggtctttatccctattgtccggtacaaggcaggcattaatcctgtgatccttatctgaagctcaggtttgattttattcttttcttaaggacctagtgttatccccaagcttgtaataatagtttaattgttacagccaatatctcaccttcagaaataagatgcttaggaaaccaagacaaggaactgtgtgttgcaaacagcatcaccctggagaagaggtggcaggaggtgacctacagaaaatggagcaatagcctagagcaagaaacacagaacaaaagagaaatgaggggttaggcaacctcctggagcaccaccgggacaagcacatattcaggggcctcctaacagactcgacttccagcatcctcagatggggctagacacgttacatagacattcaagagcagagaactcagggacttctgatttatatcaagaaatgcatacacagcagacgtgtgcctgtggagtggaattctggaaaagctcacagcccagaacataatgcagactcccccagccacagcaccttccaatcctgagaagagtgctgattctccatctgagcacccattctcctgcaacatcaggggagaggatttcacctaagggtcagaccagcgtctccaaacccagctccccacctttgcctgttggtggcacttgtgggagaaggggagatgatatgaaaagagccacaacaggagtcacctggacagggtggagcttgatggaaactgacatttgtgcccattggaggcaaatgtagaatttggtatcttccgtagcgtcaggcacatgaaactctccagtgcccatgacttttgacagtgacttcagagcacatctgggagacccatgtggcccaggctccacacagaggatacagaggaccaactgtataccacttcatgtgatgttggagtgctgttctgcacgcctaactttatggcttggtggatcagacaatgcccaatgtatgatggaaagctcaggttgcagggtagctaggtggcccatgcttgagcagtctccactaagtcccaggagcaagccaaaactgcttctgaaaaggagagtagttatcagcggaagatggcatgctccacagttctagggtccacactgatttgcctgtagaggcctgccagtggcttcagatagtatccctatctgccactgacacttcaagcaccattggatctcctgaaacataaagcccaagtgggagagcagcttgcacagcagcctggacctgttgcagagcctgcttttatcctgggcttaaaactagcagctttttgggtcacttggcaaataggtcagagagtaacacactcaattgaggaatatgttgcctctaaaatccaaagagggcctaatggtgttatgcctctttttttggttgtacaaggggctagatgcaacaacttattcttcactttagaagggatatctcgaccactagactcctagaaatttcgctgaagtgaaaggcccttgaatttttataggatttattttccaccctctgacatgcaaatgtcttagtagtaagtctagaatagttgctacttcttactgcttccagtcagcattatgtcatcaatgtaatggaccagtgcgattgatatagaagggaaaggcaattaagatcccttcagattaaattatgacatagggctggagagttggcatacacctgaggtaggacaacgaaggtgtattgcgagcttgccacctgaaaccaaactgtttctggtggtctctactaacagacatcaggaaaaaaagtatctgccagatcagtaagtgcataccaggtaccaggggatgtattaatttactcaagctatgaaaccacatttggaacagcagctgaaattgatgtccccacctgattaagtttccagtaatttactctcattctccaagatctatctgttttcttcacaggctaaataggggagtagaatgggaatgtgataaaaagtaccacctctgcatccttcaagtccttgatggtggtactaatctctgcaagctctacaagaatgcagtattgtttttggtttgctgtttttctagatagaggcaggtaagtggcttccactttatagcgtaattgccctcactcttcaggtcaggaaaccagtgtagggattctgctaattgttgagtatgtctattccaattattctgcagctacagagataacaagacgacccactgcaagacagacctaaactaaaactccattgatcacctaacctccctaagcccctactctcacttgtgaaccagagtgatgcattagttttcctggggtaccctgagtctgagttcagaaccaatgtccagtaattcccccaaagtctgattattcccttttccccaatgcacagtcaacttggtaaagtgctataggtccctttggggaaggctgagagaaaaatgaacagtatacaattttggtaatgcagtggggacacagcctcctcattatttaaggagatatgggtctgcaaactggcccaagtcttggaattgattcaggagctgtgactccgtttttttgattcgagttagacttttattcacttgattcttctttttatacagaacagataagaatttagtaggctttccatctcttttatttctatggatactatgaccagctagctaatgccataagtctctgtaaatcggactttctaactacagttttgactttactgtccattacagtaaccatgttcaccttgtctttggtgattaaatgctgccacttggcccctgccatcctgggatccagttactctccttatacttaagaatcccattcagtggcagcagttcccactgtaatttctgacctatacagaagagcaaccacagagctctttaaaaatattggaactccctcacaaatttatttctcatagtcataacagaaagtgtgtcctgagctagatgtggtagctcacacctataatcccagcaccttgggtggccaaggtaggagaatcgcttgagctcaggagtttgaagcctgcttgggcaacgtagcaagaccttgcctctataaaaatttttaaaattagccaggtatgatggtgcatatagtcccagctactcaggaggctgaggcaggagggtctcttgagcccaggagtttgagggtacagtgtgctatggtcacaccactgcactccagcctgggcaatagagtgagccctgactctaaaaaataataataaatagaaaaagaaagcatgtcctcttgttaaagatttttcaatgacacttgttcaaggatggtaaggctgactttttcaagatcatcagaatagatacagggaccaatgcaatagcattttacagcgagggagagagattgggctcaactctgaatacagtttgggtaagtgggaatttattgccaaggagtagggtgggggtcagtggattgaaaattactaagaggaaacttcaagagtaaggaaagattctggcttaactgacctaacaggattcttgctgaaaacaggctggggtgttgagacactacctgggagatggtggaggatgaagccctgatcagatatggaggatgatcagatattgagcatggaggttctttttttttttatgctttaagttctagggtacatgtgcacaacgtgcaggtttgttacatatgtatacatgtgccatgttggtgtgctgcacccatcaactcgtcatttacattaggtatttctcctaatgctatccttcccccctcttcccatcccacaacaggccccagtgtgtgatgttccccgccctgtgtccatgtgttctcattgttcaattcccacctatgagtgagaacatgcggtgtttggttttctgtccttgtgatagtttgctcagaatgatggtttccagcttcatccatgtccctacagaggacatgaactcatcatttttttttttttttttttttgagacggagtctcgctctgtcacccaggctggagtgcagtggcgcgatctccgctcactgcaagctccgcctcccgggttcacggcattctcccgcctcagcctcccgagtagctgggactacaggcgcccgccaccgctcccggctaattttttgtatttttagtagagaaggggtttcaccgtgctagccaggatggtctcgatctcctgacctcgtgatccacccacctcggcctcccaaagtgctgggattacaggcgtgagccactgcgcccggccttgaactcatcattttttatggctgcatagtattccatggtgtatatgtgccacattttcttaatccagtctatcattgatggacatttgggttggttccaagtctttgctattgtgaatagtgctgcaataaacgtacatgtacatttgtctttatagcagcataatttataatcctttgggtatatacccagtaatgggatggctgagtcaagatggtatttctagttctagatccctgaggaattgccacactgttttctacaatggttgaactagtttatagtcccaccaacagtgtaaaagtgttcctgtttctctacatcctctccagcacctgttgtttcctgactttttaatgatcagatagcctcctattttttaactatgagttggaatttgctgcttttgatatgataagaaagttcaaagtttctcttccttgctttgttgtgtgttctaattcttttctgcccatcccccagtaaagaaaaggctcagtatgatttcttgaatagattgtttaagctattttcaaaacaggacttggtcaggggcaggtagtcttaaatgttcagaagccactggatggaaaattgtgagcacataagtgtttttcttggtcaaccatgtcattttatagccaaagtttgacttgacatactggaattaatccacacgactttgaaaagaataaactctttaaaaagagagtgagcgctccgagggtgttatgagagtcactgtctgaaaccctattgatcatattgtggcagaagaaatagagtcctgccatgaattatacttttcaggttaaaaaaaaaaaaagcaatttgtaggacagtttgaataatttagtacaattgttaaaaatacagacatgcacattcctgtatgtgcatttttaaatgttcacgaatgatataagccagatatatttcttagaggtgcttgaaaaaagttatttcttcttgggctttattatctcaatttaaaaaaattaagatgcataattctcataagataacagattcagaagaatatagttcaagaaaaaaaattaaagaactcataaaggagaaggaggaggaggaagagagtgtgaaacaggagcctcagataacttggtaaaggcatgtctcccatttgggaactgatgttcctaagatccgcactgacgctgctcagccggtccatcacacagcaaaggcgtgaggaagggtcactgcccagctggactccagggtggtccacgcatgacagtcacaccgaaccttcatgaggatgtgaactgttggctccaatttaccattcccagcaattccactcagatatttgtatactaatgttcacagcagcgtgaactccacagcaggtggagtaatgttccattgtgtgcatatgccacattttgtttatccattcatctgttgatgcacatttcggttgttcccacctttgggctattattaataatgctgctgtgaacattcccaagagaaataggaagacggctttgctaagaactaaaaaagggatggacaacaagggcatatacccaggggcagtgttctatcatgacagctttactgagagcagagtagttctgctcagaatcagaacacttgttccctatagcccccctgattgccccacaaccaccaccgcatactccccttttcccaaccatgggcagcagattgagctattaacagaagtgtcctttcgctggatttctcaaccctttcctcatcgtccacatagagaaacagtaacagattgctactcacccaacacccaggtcaagtccaatgcaggtaggaataacagcaaatccttcaatttcttgattctgctcttaaaaatcttaacagaggccgggcacggtggctcacgcctgtaatgccagcattttgggaggccgaggcgggtggatcaccaagaccagcctggccaagatggtgaaaccccgtctccactaaaaatacaaaaattagccaggcgtggtggtgggcacctgtaatcccaggtactcgggaggctgaggcagagaattgcttgaacgcgggaggcagagactgcagtgagccgagatcacaccactgcactccagcccaggtgacagagcaagactccatctcaaaaaaaaaaaaaaaagacttaacagagcatttcacggggaagggccatgagggaacatcacctgggtgatggtaacattctgtatcttgataaggatttgagttatacaagtatatacatctgtcaaaattcaaagaatgtacactcaagatctgtgcatttcattatatgtaaatgttacattaaaatgttgtaaacaaatattgaacaaatatacgcatgctaaagtatttaagaggaagtactggtgtctgcaaaacaaaaattttttttccattttctgtggtaaaatatacataatataaatgtattattttaagtgtacaattcagtggcattaaatacactcagaaagttgtgcaaacatcccatttattcatttccacagattttttaattctcattccaaacagaagccctgtacccaaagagcaataactccgcatcctccaatccccactctctggtaacctctattctactttctgcctctatgaatttgccaattctaggtacctcatataagtggaatacagtatttatccttttgtgtctggcttctttcacttagcataatattttcaaggttcattcatgttttacatgtatcagaatcttgttttttcaggtggagtaatgttctattgtgtgcatatgccacatttggtttatccattcatcagttgatgcacatttcggttgttcccacctttgggctattatgaataatgttgctgtgaacactggtatacaaatatctgagtggaattgctggatcatatggtaattctgcatttaactttttaaggaactgccaaactgttttccacagagctgtaacattttacatccaaaccagcaataggacctggataaaaggtggctaaggcacagttaaataaaatactgttagttactgcccatttgcattgggtttctagtggcaaataatctagccgtgtccttgactggatctcccaatgattcttttcagtcatttgaatgagtatggtggtggtgacactggcaggaggctggagggtactttaattaacacgcgaacacacacaaatccattgcaccccactaagccgcccaaacacacatgaaacacaaaaactatccttgctagggaaacacagccctggaacaaaccccctggaccccttgtcaccaccagcccatcctgtaagaaaatgatggttgaagctgcagtgacagaattggagagatgctctgttagacaagtctgtcagctgaaaggggcagaaaccattgttgaactgcttatatgagaggaagacctgggtggcacaggcctggctggacgcagggctcacagagcgtcatcagcacttcatctcttcccctgcgggacctgctgtcctctgcgttgcacacaccccccgccaggctcatccctgtatcctccttggaggaaagtgccaggctggtgctacttggccctgcctgggtcacacgcctgcctcgggatgtggaggatggtcagcccagccacagcacatggattgctatgtgaaggatgatgttccacaagaaaaccaggacggcttcaccagggaggcaagagcagcagatgcccatgacagagggtgtatactctgaataaaagaatttggatttttaaaaagagacaggaagaaaaggacttccaaactctagaaagtttaaaactagtagaatgaaacatattgtgtataaatgtaaagctctttgttgagattaaatatacgtatcagttaaattttatttaaacatatatatacacatatacacacacacacatacatatatatgacccaagtacaggataaagatgaaattaataagtactctttaaaaatcttagttttggggctgggcgcggtggctcacgcctctaatccaagcactttgggaggccaaggcgggcggatcacctgagatcggtagttcgagaccagcctgaccaacgtggagaaaccctgtctctactaaaaatacaaagaattagccggacgtggtggcgcatgcctgtaatcccagctactcgggaggctgaggcaggagaatcgcttgaacccgggaggcggagatcgcagtgagccaagatggtgccatgtcactccagcctaggcaacaagagcaaaactccatctcaaaaaaaaaaaaaattagttttgggataccagtaatttcagtattattaacaacctgacttgggcaccccaaaagtttgcaataatggcattaaatggctggatagagaaagagatggtggcgtgaatgcctgcttcctggtgtcatgtctggaatttcatgtccagtcctgaaagctgcattttaggaagggtgctactgagcgtccagagaagacagcatttcgcttggtgaagggagtgggcttatgatgcatggcaggaggagtaatgtagaaagaaataagctttgcggtgcatagtgtagagaaattcctgctttgcgtcaaacagactgaccaggcaggcctcacagttttgcaaagccctggaagcacaggcttggctgcagatgttggatgactttccagaccagttttggaaaaagctcttgaggatcagaagctcctgggatttctgttatcacctgatttcatggagagagacagtccagggccgggaattatgtggcatctatgtgttccccagttgtgggatccatctggccgatggttatggtggtcagtgactttcagaggcctggaattcatgacagatgcttttgctaatgtgcttggtgccccactgaggctgctgagcagtgcttaccatgcgcccgatgtctcttctgtgtgcctctgagagcaaaagtggcctcagagtctgaaggagggcaaagtggccacagctgcagacacaaagtccagactagctcttgaccacatccaagtgcatcctgcattaagctcaggcacatcaaacctgcccaatcaaggtctgccaaaggaaggagtctgcaaatgacatttctcataatcaaacacactcttaatttgtttttatattattcactccattttttgattattataacttttaaaattatgtctagtagttttatcaattgctgagaagagtgttgaagtccaacttacaattgtggatttgttgatttcttctttcagctttattggttttggtttatgcattttaaggctctgctcttggtgtgtacacatgtaaaaccattttgtcttcatagtaaattaatttttaaaaatcattatgtaatgtccctctttgctccag

SEQ ID NO: 2736 - DNA, 967 bp, Homo sapiens
ggccttgagatgaggtgctgcacactgacatgctttatttggtggccagccatgtgggaaggagggaaaatccccatctgagccacagatccaaaccagaaggaactgaatgagatgctccgagggataaggcctgtcttagagacatcctcgcatctaggagagggggcggcagatgggcagccgtggagcccagccctgaccagctgctgtttgcaggggagagctgcctgtgtgcccctgtggtgagtgcgtggtgacagtgggattaagtgtacccagcaacctcagggaccactgggtggaggagacgcacggcgggcccttctgcctggcccttcccgcaactctgagtcctggatgcttggggcttgctaatctccatccccacggcagcgggatgcgacacaaccattactaaggccatggaatctcccacctctcgatggccaggcggttcacccagcaagtgtctcctaatctgaagagctgggagagcgaaagattttataagttatcagagaaccccctgtaacctcccttctagaaaggaagatgtaaaccaggacaatgggcctgtagctggcacctgaagtcagtgatctctctcctcccctcctctaaattctccttcttccgtgttttctacatcccccgtgatttgagtctgctgatttcatttgttatgtctgccttctgtttcctgcctcatttcacaaagaattagatgctgctctcaacaatacattcaaaataatacaaccataaagtaaatatttgagtaatttggagccagaggaatatatggtaacaccctgaggtggatgaaatgccgggatttcttagtgaccccttttcagaatactgcttctggaaccattctagtgtgtctcagaatgacatgtgggacatattatctttttttttatgttatataagcaatttattcaatgcatgtttattaaag

SEQ ID NO: 2737 - DNA, 40606 bp, Homo sapiens
atagccacgtctccgggattcctcagctctatttctggatttggtcagaaaacagcctgctctgctggattagctcatctctccatggaaatgccaccctggagttatgaggtagtgttatgtccttggcttttagagagataatataagaaacagacagttgaaaggcatttctgaatcttttgcaaagcctgagatgagggcattgtccattatgtgaccaaatgtcacccaaataaagatttctcttcacaatcgcttataatattcagtgctagagaaaagttcaattctccaggaaaacctgaattctttctttttatagataagcagaattgcagtgcccatcatgctgtcatttattttttcattatcttccaggggattctgttcaatccagcaaatattgaatgctagctaccatgtaatatactggattataaagatcaatagggccagttctgggctctgagacacggtctagggaacacagaccaaaatacattatagctatgctttcctcagatgccttttgtaatgatatctctttgttcccagtagtttctgaaaagctttgttctctaaatttttatgtgctatgttgtatttatgtagttttccccagtggaagacagacttttggaggagttttttgttttatttgtttttggctagttgttgtcctatatttcctactgccctacatccccctttcagagcacggcctctttctaaggctttctggtgcaatgcaaccctcctcgatggccacagctgattgactggagtgaacctgtgacctgaactgggccagtcagatttttcatactggaaatttggcgtcggagccctgagaaacaagtcaggtggtctcgggggctgaagctacccctgtggggtgactagtggaactcctggtagtgagaaaaagtgagatgagactgatgatcttcagaaggaaaagtttggactaaacacccagaggaaagctgaaatgagagaccacatggaatgaaggagaacgtgagtatgagcaagcgaaggtgagaaaaacacacggaagcacatgaaagttctttttggcttgttcctattttctctgtgacataaaagggaaggtctttggtggagagtaggaatgggaagagggtgggcaatttgagaagagagagggtgtgaattactcatcatggagcaggggtgtgaattgactgagggaatgtggttggagggacaaacagcactacaggcacgctggaggtttttgtcatgagtttacatggagacaagtcgtcctagctgcatgctttttctctggacactttcagttgtgtgggtgtggcacaggcagaaagtcagatttaaccagggctgggttttctgccaggtgactgtgacagaggaagagaggagcaaaggagttgatggtgtcttcaaaggactgatgataacaatggaccacagagcctaataagaaagcttagggtacaagtggacagcgcaatgatggcagtgataaacatcctagtgtgggctaagaatcattggtattccagtacagggggagtaagctggggagataaaagatgatgtttggaaaataggatatgtgaaacacagattgtgaaggagggcaataagtggcaatgccatagaataaggtcggggagagcagaggtagggtggacaaaataattggagatgagaagatcaagaaactgagagataaagaccctcgaggtgtcatctgcatgaatactgaaatcatcaagtgttagtacaagagtggtcttagagggagagagagggaaacggagcagagtcgcttggagacctttaagtgtctcctacaaaaaggagcaacagagagattgaacagtgcataagcttcacagaagctgtgtgtgggggtggtttatggaaaagataggaagaaccaaactgttttttcctatttttacacactcactcaatactcaacacagaatatttcacctctaggcaccaaaatgtacaggagtttctcccaaccccaaaccagttcttcagcagacatcagctgggcatcctccaatttaattcaattctgacactacctacctggagacagtatcagatcccacagattgagggctccatcccacaagactgccctctactccagatgccagttgtaagtcccgagttgagacctgtgctgctgaccaacaggctataaattgggcattcccaagacccccttaggggttgatttgctatggcagatcacagaactcagggaaactctttacttatgtttacccttctagtataaaggatattacaaaggatatagattaatggcaagatgaagaggtatatagggcaaggtaaggggggaggggcagagcttctgtgccctttctcagaaccttcacactttcagcaacctacgagctctctaaatcctgtttcttttttttttgtttgtttttttgtgttttttttatggaggcttcattacacatgcatgattgactaaaccattgaacgttggtgagcaatttgaccttcagcctgtctcctccctggagccacctccagggttggggttgaacgtttcaaacttctcatgatgtggttggtttcctggacagctagccccaccctgaggctacccaggagcctccagccaccagtcatctcattagcatacaaaaagaccatcactttggagactccaagagtcttaggagctgtgtttcaagaaaaggaggtgaagaccaaatatgtatttcttattataaatattatcataacagtttataggggaggaatggagttctgaaaatagcaatgagaagtgggacaacttcccactcacaaactcagtggtagcagaggagtgagataaaacaaatcttgagggggctgtgtgggggtgttgggtgggtagaagtgtcctcagggaagagcctggcttcagcagagcaagaaatagaaggaaacactcagagaagaagataaggctctcctctttcatactggaaatgaacattcagagaaaggttaaggacagatggtattttgctgatgataggccatgagtttcagaagtcacagtgaaatagtttgaaggggtaggaatttgggttctattatgagatgttcagaactttgtgagggcgagagtccaggtggagagaaaagaactgtggttgtggacatcctgtaatgatctagggaaacagaaatgtagggccaggtggtagtgagactgatggcttcttaccaggaggtgagtgatccactatttcaaaataagtaattcaaaatttaagctgttggaatcttaaaatattctgagcctcaagagaatgtgattatgggacctgactcaggtaaacagggagctataacctttgtttctctgattatagattagctcttttccttacctacacgggttagtaaaatgttgtaaatgactaaagagccccagggaagacttattttctatgttgattgtcattatggattaacttctctcttacttttctcacataaagacttcattatttcattgcctaagatggaatgttaagtacactcttttaaattggaaaggaaatgaaaataagctgtatggaaaggacaacaaactgtaactaagttgtaactcataaaccagtcttgtatagaaaatgttataatcctactaaatttctttgttttctgcctgtataagcaagaacttttacctctggtgcactgaccccgttactctggagtccatgtttttaggatggatattttcagatttttgtgtgaataaactctttaaaactggattctgatccttttgattatttcagattcacaattgtaaatgtaggttctattactaacatgccaggggtctgatctaggtttcattgcttactgtacagaaagccaatcactgagacaagtattgccagggaagaaggcttttttgggtgctacagctgaggagctgggaggtcaaaacagtgtgggaaaagaaatttaaaaaaatgttattaaagaagctactgtcaacctaaaggaagaaactgaggcaaaattaatgtaagtaaagagtttatttgggccaagatgaggacagctgctcagaagattcaggcccaagtgatcttggataggagctctgtttggcctttgttaccagcaggtttttaaaggcaaaagcaaggggatacgtagggggatgatacaaagttgcttgtcaggaattctctttggtttacagaaatgtcattcattagttattgcctatacattgttgacatatagattatgacctaatgatatctatcatgtggtgtcattaggttaattttgagctacttgtgagaaaaggcctagagtccacatagcaagcaaattcaagagatgattatttagctcaggaggggaagtgggatgtgactgtagcctcattctcatgcctcactgggcctgataatttaaaggaggttcacattcctcagatagaaagtttcttttctttctcgctataagcctctgtctttcttgtctctctattgctaagtggtttggcataaaatcatgtgctctggtagaaacctaagggctttttattcagctgttgaaattcatacccactggagattctagagccatcagtggccatggttcctgccactggaggaaactgtctttagagagtgaaggtgaagctgacatttataaacagccacggtgagaggcagggctggaaagcaggcctggctctgttccagttcctgtgtccattttggagacgagtttccgtttcctatggtttgattacgtgatcccatgaatctccatctcctgcttaagctgttttgagtgtcttgtccatacatgaagtgtcagggtgtcctaagaagacagtggaaagtgatggggtccagcatctgggatgttgggcatcttagtactgggggagtgtgtcagtctatagcaaaatcttcacttctgggctgggcttcaggatggaactcaagtcttttggagggaggaggagttcctagaggaactggggtcgcaaatgagttccaagtcaaggactcaagaccatgagtcaaatatagatgcctgagtgctgtcctcagcaagcagtcaagggtgttggacccagacgcccagatggagtccagggtaggcatcacttacaggtcgtctttgatgcatagaaataaaaaaggcaatctaaagggcagaatttgggttgaagccccataataaaaatcaagcagcttgttctaagtagcagttgtcatttggaagaggctaggcagaaagggtgacatggtaacatttacagatagaaagaaggataagcagatgagagaggaaaacttcaaagaaaaatgaaggaggtagaatctgaaaaaaaaaagtcctggactgaagagaacatggtgttgctgcttttgtaagttatctgtgggctaggttgtggatatagagaaagctgctaaaggtgatagttcactgaagatggcaaaagcaccatgagcagaactgggacacaggatcagggccagatgagactacaagatgacaaattttgggggtcaggaggggaagtgagatgtgactatggcctcattggtagacttttccattcatggcccccaagggaccgtgtctctcagtattcatgctcttgtgcattgtctcccatattggactctgggcttggcaaggtgacttgctttggccaataatatgaacaaattaaatagggataaattagaggcctgataggcatttgcatattggacctatgctctttgaattctgagattgccagaggatggattgactagctgtcattaccttactacaagcctatggatgaagccagcacaggaggtaatggaaggaattgcagagctacgaagctgtgactgtaatgcagcatgcctagtccccttcctacctctagtcttcttgttatatgaactgataacttatagtttaaacttctcagtaagttcactttcttgcaactgaaagtgtcctaatgacacagtgtattagtccattttcatactactctaaagaacttcctgagcctgggtaatttataaatgaaagaggtttaattgactcacagcttagcatggctggggaggcctcaggaaacttacaattatggtggaaagcaaagaggaagcaagagaccttcttcataggcagcaggaaggagaagtgctgagcgaagcagggaagagccccttataaaaccatcagaccttgtgagaactcactcactatcacaagaacagcgtgagggaaactgccctctgattcaattacctccacctggtctctcccttgacatgtggggattatggggattacaaatcaagatgagatttgggtggggacacaaagcctaaccacatcacacagccttttgtttttaattttttgaggcaaattcccataatgacatggttttttttttgaagctgggaattctataagtaaaaatatttgcaaggcacttaacagcttcgatggggaaactctatccctgtgtccatgctttctacttacctgatcccctaagtaccattttctgaaatgctgtccactgggatgcagcaaggagtccagttggtgattttagagcatcacagccatgaagagttactgagttgtgcgtactcatctgaaactaagacagcctttttggttccagttgtcagcttgtgatctatttatctttgctcccagggggctatataaaggataccagaaacaggtacttctcatgtcccttctagctcaatgagtaatagacttgatggtttttccctctgatgtctgaaactttaaaaagacaataaaaacacacagatcaatatactgaataagtatatcttccaaacctcatactctgtttctcattataaacatataaattagcctcatgcaaagaaaagaagcatagcttgtaacatcttttctatctgacatgtgctgctgcctagaagactccttaacatgctccctttattacatctcccatcatattctccacttgagtatccagcaactggaatacagtgttatagaaatgagtagttatatatctgtaattatttccagcttcaaccgtgtctataataagccaatgtacttaggtcactaagctctaaataggccagagggtatggaagacatatctatccccaccactggaagaaagctcaaagcttgtccttgttgctcacgctgtgatgttttcccaaagggagggcagcagggctgttatttggggacagctgagacctgcgaatgcataagagcagaaatgatcaatggagcatccccattgtccatcacagggaaaacccagagagggaaaatagggcatattttccctcactgccctgaatgcaatacaaatctcatcactccatctccctttttagcctgtgctggagcaaatagttttagaacatgcacaatttgaagcaaccccattaagtcaggatggcaaatgctataatttatccatgctccctccttggagaagttgaacaaatattgcagatgagctttataggtaaagactgtagcagagccttattaactaggtttagaacagtaggttgaagccctttctcagacaagaaccacagactctgtttcctcttgatgtgatagatctgttaggggtgcttgtgtctgcactaagattacagctctaggcagggtagttcttgagacacttagaccacagctctgctctttgaggaatgaggcaattcaagtgttaaatgggctccatgttttaatctttagcacttgaacttattctatttctgtccccttctttgcaatgttaggctcagctgtctgtggtgacaggacttcttctgcagccaaccagcatacagctggtcactacagccctaggtgctgccaaaggctgagaggaatgggaaatgctagtactttccttcgtgcaagagtgggagatggtgcaagggcatttctgtctagttcaagtaagcatatattgagttctccctactggctaggccattagagacatagaaatgaataaagcatggcccctgcctcaaaagctttcattgtctacagtaaggtttggcaaactatacctgtgagggtgaagatgctgcctgttgtaaataaagttttatttaaacacaaccatgcacactcatttacatatcgtctatggctgcttttgtttctacaatggcagagtaggtctaacaagatcatatgggcccaacagcctaaaatatctactaactgatccttcacagaaaatgtttgctcacctctgcacaacttagtaatttttggtatatttacagaattatgcagccactaccactaccaaatttcagcattttcatcaccccaggcgacatctcatatccattagcagtcagccccagcccttgataaccactaatctattctctatctttatgaatttgtctattcctgacattgcataaaagtgtagtaaggcaaaatgtggccttttgtgactggcttctttcacttgcaatactgttttaaaggttcattaatgttttagcatgcatcagtgcttcatttctttttattgcctaatagcagtccattatatgtatataccatatttggtttatcttttcctcagttgatgaatgtttcggttatttccactttttgactattatagttaatgatattatgaagatttgtgtatgagttttgcgaggatatgtgcttttgcttgggtacatacctcagcatgaaatttctgggtcataggataactgcatttaacattttgaaggactggcaaactgctttccaaagcagctatgctgtttgcaatcctaccagcaatgtatgaaggtttccatttctcgacattcttgctaacacttgttattgtctgtctttttgattctggttgtcctagtgagtataaggtggtccttcattgtggttttgatttgcatttccttcaacgctaatgatgttgactattttttcttgtactcattagctatctgtacaatgtcttctctgaagaaatgtctatcaaatcctttgcccatttaaaaattaggttatttgctttttgggttaagttgtaagtgttctttatatattctgaattctagtttcctatcagacagtatatattatgcaaatatgtcctctcattctgtgggttgttttttcacctttttgatggtgtttttggaagtgaaaacagtttgtaaccttgatgatatcccatttgcctattttttcttttgttgcttgtgcttttgatgaccaatctaagaaaccattgcctaatccaaggctacaaagatgtacttctatgtttttttctaagagttttacagttttagcttttatgtttaggtatattatccattttgacttcatttttatatatagtgtgaggtaggggtccaaaaatcctcttgcatgtgaatagacagttgtcccagtaccatttgttgaaaagactattctttccccattcttcacacccttcgtaaaaatcaattgactgtaaatgtgaagatttatttctggattctcagttctattccactgatctatatgtctatccttatgccagtaccacacaatcttaatcactgaaactttgtagtaggttttgaaattgggaagtgtgagtcctccaactttgctcttccttttcaagattgttttggctattttggattccttgcatttctgtatgaattttaggataactttgtcagtttatgcaaaaaaaaaaaaaagccagctgggattttgacaaggaatgcattgatttgtagatcagcttggggaatattccaagatcagttttaatctttttgtttccaagatgttttgagcatggatcatctgggtaacttgcatcaatgattcccagcatttctgagggttaagtttcttttataatgtaaaccattattactgtcttctcaaaggataaaacttttacttttctattaaaagcatcattttattgcccaagtacataagaccaaacactattatgaactagagaatgcttttaagtgaatttgtattttattaattcataatagtgtctatatatacttcagaaattatagagcaaaacatggagaaatggtaaatattctgtcttcagccactgcttggtatatttatggagtcattgtccggtttgcaaaaaaaaaaaaatcagctcccacttagggaacctctagttagcaagaaaatccttcttctaaagcaggtctatctttctgtccagagtgcctcagccatagaacagggcagtgtgagcaggactggccttcgtaaactgaataaagatgccaaatagctcacgatcaacctggtgcttttaaagagttgactttcttgtgagggaaggaaattgtatcccaagctgcttcccctgttgtctaaagctgactttgcctcacctggcctgggaaactttgctccctggatgctctaccaattgagttaattggcagtatgctcagatgaacaaattcagccacagaaatacctctaagattttctttggcaccttcaattaccagtttttattaaaaagaaaaaagaaagcaagcaaacagaaatctcatgtgaacattctaatctttcctgctggcatcacctttctttatatttggaacaaaatggagaagtaaaaaatcgtccttttttttttttctctcagtcaagacgctctattgaagaaaagaataaagtaaattgattgcttataccagtccagaaaatcgttcagatttgtattctcttctacttagacacatccactttgccatattgtagtggaaaggtcactgatactagaatcagaatatcttaactcaaataccaaatccctgtcttgctgatctcaatttctttacagttaaatagaattagtaatagctaacttttgaatgtgagaattaaggagaaacttgaagagagtaaagcagttaaataattcaagtcttgtgttgtttttttttattactagcgtgctatttttgcacgaaagataatgcacccgccacttcctgagattcccaacctccttctagagggccacgtttttcagtgtggcatgggtccccgcaggcttcccttcctgctggagcaagtggagactatgcacctccccaggtgtgtgcccaaatcatgcagagagggctcaggagctcccagggcccagcagcttcttcctgatggcaggagtgggccaaggcagcatgccagggcccaggtaaagtgagacccagacagtggggagagagggcgaggaagtcaccagacagagagatgaacatagcccttcttttcctcccttcccatttcccacctgtccatgtaactagcatgacttacatcttcgtatgtgttctttgaccccatgtggtgtcctttcttttttagtgttaaacattttctaggcttctggcttggtgcaaatgatttgcctttggaaaaaattatatttattgaaagcttcaccatttaaataaaacccctctaataattcccacttccctccttattacccctccttcctctgctggctagattcccatctgtgttcattgccttggggaggagcttgaaaaggcggggtaacctgctagtcactggcttcctgtttctggagcctggcccatgatgggaagcagtgaggtgccctgggtggggtgaggtgtaataggaaagcatgaagatggtggaagtgggagtgcctctgaggggaatgctccaggtcaacacagaagagcttctgtccctactttcctgctcttggactacagaaacgtcctctgggccgagggcaggctcagagtaaggaggagagagagagagagagacagagaagcagcaagaagagcagaaaagtcaacaggcctgagagggccatggtgcaaactgcttcaaaggcaggtccttggagcccatgtcactgcagaggagttggagggctagagaacagagaagtttggcagccatcatccttggccatagttccggaaggctgcaagaggctaggtgggcaatgtatgagcaggacatctagcaaatgggccatggagagcctgactgagactcttatgtcctattctggcccagaaacttcacaatgggtcttaaatagcacagagaagtgcagccctgaaaggttcacatggacaggagtctcagcatgtggacaggtgatagaggagcaaatggggtgaggcacattttagccaacacctgtaactgaggcttaggagatgccctcccctttttcccccatgacctggtactaagtactctctcttgaactggtgaactaccctggacaaaggactgaattcccagggactgagattacatttttgtcaccctagcaagaagagggctcaaataacaattctaaggcgttatagaaaattttgtatttcttgcacacttgagttggtggaatgaaattcatacccaccacactgttctttgtctattccttgtatgtgttccactctagttgatgtgacttggtgagtcttttggactggattaaatatggcacaacaagtctttgtcaagcttaccatttgcctgttcctctattaggtaccaggaacaggtgtgtgaatgagaagtggttggtagtaggcagcctcaaaggccctcatgagctgcacctcctggtattcttgaccttgtgaatgctctccatttgaatatgggctggctctagtgatggagcaaacagaatatggcaaacagaatatggcaaaagtgatgggatgtcacctccaatatcagattacaattagactgtggctttccttttgctcattctatctctggctggttcggagggaagccagctgccatactgcaagctgcctgaagaatagatccagagaaaacgaactgatatctccagaactgaagacctagttcctactaatagccctgctggggagcttggtttcttcaagtgttgaaccttgagatgactgtagtcctgtttgacactttgcagccttgggagagactcagccagaggcacccagctaaacctccaggattcctgaccctcagaatctatgagaaaataaatgtttctgttttaagttgctgtgttttggagttactcattatgcagcaagagataaccagtacccagtccttgccctccaggaactcttgctctaggatgagaatttctttggaaagagcattcatgataataaagatcagagagctaggcataatggcacggattctgttaattaggcttcaggcagtgagaagaggagatgagacgcaggatgctgaacaggcaataatgcctgtgaggtctgggatcggtttcctctggccaacacattctctttaattacaaagcttagttcctgaaatgacaattttctatttttactcagtggattggtggaagtaagagaagtagcatcccgtggtagaaatgagagagcagggctgtttagggaatttagctcaaatcaacaactgtttttggggcggccactctgtacctatgagcccttctctcacatactcatagatgctgtgccccagcctctactgaatcaccctttatcgagggcattttgctaggatagactgtgcttgtgactgatgttcttagtcatcacctcttctgtgaggtggagccactgaaaaatggtaactctcatctgtcattgttatagttgcaacagatttaaagacaacttcattgaaaatagaaaagggtggtggtggaggcggctgcgaaggagaattggtttttcttctaaaaagccctgactcaggccacacattgagagtgctgcaatctttttggttctacaacttatatcccagaatccccaacccactatgaagatacactcccttctcatctgaaacattgtgtgctaacaatagcaacactgggaacttcggatatttccttgcaaatggatttttcctttggatatgactatattaaaatattgctcctggttctggttcttaattttaggtgagttcagaaaaaaagatgcatcagattgaaggaggacattgaaatcaattatatactgattagctcggaggaaaggtttccttgttctttttcttttttttccctctttctgtattggctaatccccatgcacactgcaattgggtgcagtcaagctgttccaggcttttgataactgcctcaactgtcagaagtcactgggagtgccagcagtcagccacagaactaccactgagctttatggaactttgcaaatcttactggaatccatcgcatttcatcttgtcagtccaaccagctcactgtttgttgtatgtgatgttttagagataatctctctctgggcacagcacagtgtttgttttgtctgctgagcattgactgccttatcttctgttaccagtattctgattctgtggggaagaaaataccactctcagtctacatgattggggtgggactgatcccaatcctgcttccagaagggggcaggtaacccatggatgggcgattacagtgctttatcccctggtcccaaggcttggtttaggatggacatatgacccaatccaggccagacatagccattgagacttggttctaggacttctatttgaggagtgagaaaaggcctgttatgctccattggggttggtgctacaggtagctttcttatgatcacaggggagtgcctgtccatgaatggagaccacatagaggataggaggagagagagagagagagagagagacagtgagagagacacacacacacacacacacacacacacacacacacacacacagagagtcagagagagagacaggagtttcatggtcaatacattttttgtcattcttccttttgtttaattaagtttaagctgggtttttgtaatttgcagctcaaagaatcttgactatatgctggagcacagtctgccatgggccctgcacatttttgcaggatatgccaagaattcaaggccatgcatctctttcctaagacctttctcagaatcgtgtttgcagggagcaatgttgcaggatgaagtaacctctctcacaaagagcaggcttgcatctgcttcctataaaagcagtgagtctcctatgttcagtgttcctttcttgcaacacaatccttcttgggtgcatgcattcgtctacacccccactgtgttgtccctgtgggacttgggggcatgaggaacagatacaaaccaacagcatgttcatgctgttactgggctgtgactactaaagacttttgcctctgaccgaggggtcttgtgacttctgccaacattcaagaaaaataacagtctggcttattagcttaaaaagtaaagcaaacccttaacccttcttgacactgtatggctccttcgggcttctgtaggctattgaatgttgcatagaagcttggttaagagcacatgcttgataggaagacagatggatttgagtcctggctctaccattctctatctgattttgagtgagttatttaacctctctggccttctggtttctcctctatgaaataaaaataatacttccaattacaaaatacatgtaatgcccttggctgagaacctggctcagaggaagttcagtaagtggtagctatatgtaactgcctagtggtagcacttagcatatgatttttaaaaaaatatttaatcatattttctcattacaaaagtaaaaaaagtcattgttgaaaaattgggaaatatatgtcagaaagataagaaaagttttttaaaaattataattccacaacctagataaccattattatcatttggtgaatatcaatatggagtgtgtgtgtgtgtgtgtgtgtgtgttttaaaccaaagcagaatcatgtcatatgcacaattttatctgtttttttcttacttaatatatcatgaccatctttctagttcctacttcttttgtagctttttatgaaaacatattataaaatagttggtatgtataacacaatataaatagcatagaaataattaagaataataaaatggacacttaggaagtcaccatgcaacttatgcagtagaaaattaccataccttgggaggcttccgtgtgaccctccctgatcacattagcccaccttcttcacttaccctcaggataccatgatcctgaattttgtgtttttcattctcttacaatttgtgcagttttaccatgcatacctgtatttgtaaaaatttagtctgctcatttcagaactcaatgtcatggtattctgcttgcacgtattttctgtgacttgcttttatgctggacatatgttcctgagatccatctatgttgatgcatagagttgtaatttattcacttttgggggtgtatggtattctcatgtacacatgtgccatgatttagtcaagggtatctggaaaaatcacaaaggaaaaggatttgattgacatcatctgcctcccttggcaggtgcttcacactctggatgggggatgggtgtctcaccctgaacctagctgtttgctttcaggcaggccaattccaggtttcccagccccaggcaagctgaccccagacaatgcaggccccaggagtatcatggaggaagaaaagaagggttgagggctggaggttatgggacagaagacagcatggatgtctcaggtagtttacagctatttaactgggggaaaatgtagaagagacagaaacattcttccatcaggatatatggctggagatacagaattgaagaggctgagattactctgcataagaaagggcatggaaaatgttagaaaacttaacctgtgtaagaaagctaacactctaaccttactaagaggaggctaagtcagcataacctacatgtaggacaatttggctaaatctacaaaaattaaaaattcaccttccctttgatccaatgattaaatttctagaaatttacagatgtataaaatcatatatgaacagttacttattgcagcaatttttatgataacaaaatagtaaaacaatttaaatgtctattaatgtggaaatagataaataaattatggcttatttatccaatggaaaacaatgcagtgcgttaaggagaaggaggcaactctatagatactaatatggtacgatctccaagttttattaaatgtaaaagcaaattgcagtggtgtaaaatggtgtgtgtgtgtgtgtgtgtgtatgtgtgtgtgagtttctatctgctatctgtatatagaatatctcgttacagtggttacttctggggatctggataactggggatatagatgggagaaagataaattactttttatgtctttaaaattttctttttttttaaaattatactttaagttttagggcacatgtgcacaacgtgcaggtttgttacatatgtatacgtgtgccatgttggtgtgcagcacccagtagctcgtcatttaacattaggtatatctccaaatgctatccctcccctctccccccacctgacaacaggtcccggcgtgtgatgttccccttcctgtgtccatgtgtccttatcgttcaattcctacctatgagtgagaacatgcggtgtttggttttttgtccttgcaacagtttgctgagaatggtggtttccagcttcatccatgtccctacaaaggacatgaactcatcattttttatggctgcatagtattccatggtgtctatgtgccacattttcttaatccagtctatcattgttggacatttgggttggttccaagtctttgctattgtgagtagtgccgcaataaacatacatgtgcatgtgtctttaaggcagcatgatttataatcctttgggtatatacccagtaatgggattgccgggtcaaatggtatttctagttctatatccctgaggaattgcacatatgaagctaccaatgagccaaaaaataagtgaaataaaaataaaaatatgtggaaggcaggagtcaaagagcagaaagtaggtaagtgaagatgctggtatggagctttgcggagaggcaggagggatttgttctgagagggacgagtgggaaatttgttgtgaagaggacttttgagttttgcagactattgggatgctgtatagccttttgccagcatcccttttgtccaagaaaacctttactccttaatgccacttttgaagctggattctttttcctttgttatgtgttccactcaaagagaggactaaaggcaacagacgcaaggctctttttaggcaaaagttgtaataataacataatagcaaaataaagacaatactaataaagaatggctactattttagcatttacagtgtggcagacattgactaagcattttacatatattatctcatttaatccccatataaactatataatgttggtggtactattcccattttatagataaagaaactgaggcacaaaaagattaagtaacacatgttcaacattatatagctagtaagtgatagtactgaaatttgagctaatttggtttgcctttgaagattgtgcttttaacacttcactatattcttttcctaaggaatgaagaatttcttaggcatagcagcatgatcgtgtgcacgtgtgtgcacacacacacaaacacacacatatctaacttaagacttaactgtgtacaaatatttatgggccaattttcaggtagagctgagacaagaatgtagaaacattataatcttgttcacccaagaaaaatctggagacattaggattttaggcagggtaatcatttggggaatattggtaagaaagatgcctgcaaactgacaggcaagcaggtgttgttgccattgctattaggccgttgggaattcccagaatgggaggctgaggaagaaatcaaataaatagtttgctgactcctctaactggcaaaagtattttcaaaactccgtgtagattacttacccttgagcggccctgagaacttgtgtgatatatttcagagatgacgtgttaacccaaaagctctgaaaaatctccctggagctcacatgagccaagctgcttcagctcccattgtgaacgaaatagtcagtgttttcataggaagactgactagttcttctttcttgtctcttatcgttccaacaaggctaattccagtgagtttatgagaacaatttaaggcttattttctcagccgcttttccagagggagctgaagtaatgtcagttccttcattactacctacagagggataaagtgcatctctgtattgttccctatattaaactgttgtttatttggacaagagaatttccaggcagatacttgtattcccaccaacaccaacacttttcatctctaatttaaagagaaaagacactctagatttgggcttccaaatagcatagccactagcctatgatgcagctgttagcatttgaaatgtggctagtctgaattaagctgttctgtaagtatacaccacatttcaatgacttaatgtgaaaaaaaggatgtaatatatccccaaacttttatattggttacatgttataatgataatagaggcagtccttgctttgcctgttggtgtagaaccatgaaaatgatcctgcaagctgaaatgatacaagtgattttaattaacaatgggtgaaaattatgattattatgcaacctttaaaacatttttgtctaaactttaaacattcttactgtcagccataaatatacgcagaaatttaaaagtggtaaaatgaacctatttagtacacagtaatttcaaataatggaaacatcgagagttaaagtacttcttttcttctttgtgagtagtttgaacagtgcttccttcttcttgtcctataacttgtattgtggagagagcatcttttctaagctttgccaaattgtcatattacttcctaagatcagcttccaacattttctccttgctttcccaatgttgtgaaatccgagagtttcttcaatgagaagttttgtttcgttttttgggttttttgttgggacagggcctcactctgtcatccaggctggagtgcagtggctcgatcatgactcactgcagcctcaaactccctggctcaaaagattgttccctgacctcagccaccctggtagctgggactacaggtgcacacaaccatgccaaaataatttttgtattttttatagagatagggttttgccatgtcacctaggctggtcttgaattcctggactcaagcaatctgcctgcatcggcctcccaaagtgctgagatcataagcatgagccacagctcctgacccaatataagttttttgctggtgtcccttcctctgggttatcattgtttctgggacagtatcgtttttgggacagtcatgttccacatttatgtccatgcatttgccttcactaagttcctctggctgcgtgtcttgagactctcgaacagcagtagtgtcaacaatccctacagtgatccatcttctgatcacgcctacattcacttccaacaatatcactttttgtttctttgctgcacttccatctttgttggccattccctccttagattattcatttctgtaaaatgtcacgtgagtttaccactgggagacaaggaatcaacacaactccatgcatgcttcactgtctgcgcctggactgaataacagatgcatagtgaccaatcgctgatagacttcaaaagaaatggcatgactggtcactgctattgatgcacacgtgttgtttacgtagtgatttgtggactgaaagtctagcagcaaagtttttactttatgcaataaagtaaaactgtatattaactgtatgcaataaagtacagttaagcataatgtacagttaatataccagagttaatataccacagtaactgaaatttgaaccatgttgttggaagattagtgttatttaattaagtggtggtaactggaatttatgcatattggaaccatgcaaagcaaagtatgcctgtatttttggatactgggttaaagtatataattaaaattatttgtacctgtttctttttactttttgaattaactaatagaaaaatttaaatcacatttgtggctcacactatatccctactggacagtcctgctctgtaccatacattaaccaaaatttaggagaagaaaataaagaaatatacagttgaaaaagaatgaaacattgttagagttttaagtagccggcaacaaagtaagagattccaatcttcacaaattgaacatgattgtatggtgaaaaacagtaaagctaaaattaaaaagataatagattgggaaaacatttgcatcatatatgtaagccaaagacaaattgccgatattatgaaattattcattcaaactcattccaaaattatcaacatcccagtagattgttaaacagatgaataggcaatttatatgagagaaaattgaaatagcaaatgaatacctagaaaaatgtttatcttgtctagttatcaaaggcatggaaattactgttaactttgagttacaatttactatccactctattaataaaacaattacaaccctctacactgtgggaaatttggtgatttcatgcaccatgactgacattgtaattagatacaatacttttgttagcaatattgtataaataggaaaagacaaaaagacatttttaacccttggacctagtaatgccactcctgagaatttaagacaatgaattaattcaacagggacaaaaagttatatatacagtaagatgtatattgtgtaatttcttataatagcaaaaaaaaaaaaagaaaaagaaaaattaaggacattctaaatgtctgatatagaacactacatccaacaatgacaaaatgcattgtgttttccaaatgcttatggaaggtttactagagtttagcacatgctgtgtcataaagcaagctgaaatatatttcaaaggagtgaaatcatttagaatatgctctttgagcacagtagaattatgctagaaatctgtaacaaaagctaaccagaaaatcaccaactgctttaaaagtaagctattaaattacaaataactcatgaatcaaagaaggaaacacaataaaaattagaagatattttgaactaaatgatagtggagacatggcatatcaaaacatgtagaaaacagataaatgatgctcaaggaaataactgccaacctagagttctataataataaaaatatttttcaaataggatggtgaaataaatatatcatcagattagcaaaaactaggagaattcctgcaatgcctagaggaaaatttatattctcaaatgtatatattagaaaagaattaaatgctacatatcaataattcaagttttcacctcaaaacgaaacataattttaaatatcaccacacacaaaaaattagtccaaagaaagtagtaggaagttaatagtaaaaataaaagcagaaaaaagataagtagaaaacaaatattaatgcaataaagaaaaaaacctaatttcttgaaaaagacacattaaattgataaaactatgacaagactgatgtaaaaaagagagcaaattaccaattccagtaacaaataaggagacattagtatagatgctatagacatttaaaagagaaaaagatatcacaaataatgttatgccaatttcagtgaatgaaattccttgaaaaacatagcttaccaaaattgacacaataagaaagagcaattagagtattatatgtctactaaagaatttaaatgttttatttaaagcctctgtgcaaagtatactcctggtctgggtggtttctttggtgatttgtagcaaatattaaagcaagtgataactccaatttttatatactcttccagaatataaaacagacggtagccttcctagactttctataggaccagcataatcttgataggtaaattacttaaggaaattgtaagaaaggaaaattacagacaaatttgtagcatgaattatatatatgtaaattctaaataatatattagcaaatagaattctttgatatgtaaatggagaaggtatcacaataaaatgaagtttatttcagaaatgctaatgatgatttattatgaataaacaatatagttcaccatatttgcagaaaagtggagataaataaaattttcttaatgattacaaaaacacatttgataaaacacaatattaattcatgataaaaactcttagcaaaccaggaagtcaatttgatggtgaattattgaaaactttcttcctatgcttaggagcgtgatatggatacttgctacttctattaaaagaaaaatggaagtcttaaccaaggcaataaggctataaaaagaaattttgaaaagacagtttggaaaagggtgaaataaaactgtcactcttcatggacaacataattgtacatagaaaatctaaaatagaatctagagacaactactagaatttataagtaaatttggcatggttgttggatccaagatcaatgtatgaaatcaattgcatttttatatattggcaacaaaaatgcaaataaaattaaaattaaaattaaaaagatatgatttacattagcataaaaactttcaaatctagaaatgtatttaatgatagacatttaagacctttacactgaaaactataaaactttgccaagagaaattttaggagcctaaatatagagagattccaccccccccatttttgtggtttagaattaaaatggtcaggatgtaaattgtctccaaactaatctttagattaaacacaatcctgattaaaatctcagcaggttttgtgtagaaattgacaagctgattctaaaattcatataagaatgcaaacggcaaaacatagtcaaggagattatttataaaaagaaagattattttgaggacttacactctcagatattgagacatatcacaaagctattgaaattaagagagattgaagtttgcataacaatagataaaaagaccagtggaacagaacagagagtccacatctctatagttatctgatattttacaaaagtgatactgctgtatagggtagaaaggatgacctttttaacaaatggtgctgttatttggatatccacatgggaaaaatgaatctttatcttacacaagtcaattccagtcagattgtagatctataggcaaaagttaaacaaataaatgcttttaggaaaaaaaaaacccacagaagatatatttattatctcaggtagacaaaattttcttaattcggatataaaatgtactagttataaaatgttcacttggactacattaaagttagaaatttcctattcattaaaagacaccattagagtgaaaacataagccacacaatattgagtatattgttaataaatataaaaagactcatatccagaatatataaagaactgaaaatcattgagaaaaattaaataatgcaatataaaaataggcaaatgacttaaatagtcatttcatgaaagaggatatccaaatggtcaataaatgtgagagcatgtttaacctcatcatcaaggaatgtagattgaaatcacaatatgacactactactcattcattggaatagccaaacaaagaagatggataatacaaaatatcagtgagggtatggaacaagtgaactgtcattcattgccagcaggagtgtacattggtacaaccactttgaaaaaatgtttggaagactcgactagccatatacgtatcctatgaggcagcaattgcactcctggctatatacccaatagaaatgcatgcacagtgcacccaaaatatacaagaatgttcattgtattatctgaaatagttccaaactggaacaacatgtgttcatcaacaaaaaatgaatacatgaactttggcatatttatacaataaatactataaagtagttaaaaaaaatgaaccattgctacatgcaacaaagggtaagttttcagatgttaatgttgagttaaataagcctgacacatatgactttatactgtatgattatgtttatattaagcacaaaaatgtaggcaaaaccagtctttgtttatggaagtcaacgtaatggctaactttgggtgggtacggtgattgaggtgggttgctggtaatgttttgtcattcatctaagtggctgtttataaactttgtaaaaactcatcaagctttattaagttttgtgcaccttttgcatgaatgttatatttcataagaaagtttataaagcagaatatgaacagggaaatgtgtgtgtgtgtgtgtgtgtgtgtgtgtgtgtgtgtgtgtgatgtgttcagtggtcaggattgctgactgtttctgcacactttagaaaaaggagaggcataggagagaaacaattgagcccaatcgagttgaaagtgaggaaacctacataggattcatgaagatggatagtctgccatgtgttctgtgatttatagctcataaaggacttctctgtacattaactcaattcctcttcacaacaaccttttgatgtaaaaattaattattatctccattttgcctttcagaaaactgagacagatattgggtgatatttattttcttttcttttctcttttcttcttttctttttttttgagatggagtctcgctctgtcgcccaggctagactgcaatggcacgaccttggctcactgcagcctctgcctcccgggttcaagcgattctcctgcctcaacctcctgagtagctgagattataagcatgcgccaccacgcccggctaatttttgtatttttagtagagacggggtttcaccatgggtgatgtttctaaggaagcaaaaccatgaagtgtagagccaccatgctcttttcactacactgctgttagaaaactagacatttggatggaagaatatgctgtggtctgaaggtttgtgtccctccaaaattcatgttgaaacttaaactccattgtggtaggtttttttttttttttttttttgtgacgaagtgtcactcggttgcccaagctggagtgcagtggtgcgatcttggctcactgcaacctacaggcatgtaccattgtgcctggctaatttttgtatttttagtagagacggggtttcactatgttgtccaggctggtcttgaactcctgacttcgtgatccgtctgcctcggcctcccaaagtgtggggattacaggtgtgagccaccgcacctggcctgtggtagttttaggaggtgaagccttttgggaagtgactaagtaatgcggcctccacccacatagatgagattagtgtccttataaaagaggctttggagagctgcctggcccttcattccttccaccatatgaggacacagcatttgtcccttccagaagatgcagcaacatggtgccatcttggaaacagagagtgaaccctcaccaggcacatgggtcttggacttcccaggccccagaactgtgagaaatcgatttctattatttatatatttcccagtgtaaagtatttcattatgacaacaggaatggaccaaaacagaatatgctatatgctatttggaataaattattcctcacaacttttctatgaaattggcattatcatcctcagtttgcagatgtggttcaggaatacctaataacctatgaacatacaatctagtaagtggccaaggcagtatctcaacatgtatctgtctcactctaaagctcatctctttctctcaaatgtagctgctagctgcttgtgtgtggtataaatgattcagctgcaagagctcagacagcagaaagatcactgcagggtgggtcagggagccttcgtggaggtgaaggtaccctttgggatagatttaattaataaatgaattaattaattttttctcaacttttatttcctattcagggagtacatgcacagatttgttaccttggtatatcacatgatgcttaggtttgggggtacaaatgattccatcacccaggtactgagcatagtacccaatgattagtttttcaacccttgacccccttattctctccctcctctaggagtccccagtttctattgttgccatctttatatccatgggtacccaatatttagctcccatttatgagtgagaacgtgcagtacttggttttctgtttctgcattaattcacttaggataatggcctccagctacatccatgttgctgcaaagaacataatttcattctttttatggctgcatagtagtccgtagtgtatatgtaccacattttctttacccagtccaccactgatgggttgattccatgtgtttgctattgtgaaagtgctgcaatgaacatgtgagtgcatgtgtctttttggtagaaaggcttgttttcttttggatatatacccaataatggttttgctgggtcaaatggtaattctgttttaacttctttgagaaatgagatgggattaaataggagaccaagatgtggaaagaactctgagtttggggggaatggaggagatcaagaaagtgttggaaggctcattggtcagtgagcagctttgtttggctgaagtacagggttttttaagttccaagaagtcagagactgttttgtgaattgacttatccccaatgctcaacacaaattaaatgctccagataaatgaataaactgattggttagcatcaaaatttgtgcactttttagaaacgtaacagtttatggatggcatcgttcattcagtcccctggtaacacaatgaggtttaatttgacacactagttaaaaaactgaaaagtacctagaaaacgagatggtaccagctaagccagttgagaaaatattcaggaaaatcagagtgttccaagtgtgactgcttttgagtcctaaaggtatctgaaggcacagggtgaaaatggcttagatgagtgcctatcctggggccagcatctgcagatcgtactgagagtgcctgcccaactcctttcatttgggacttttgagcctttgtccttgctgtcggactggtgcttttgggaaacttctctataagctctgttttcacaagaaaaataatttgttgggataatgatctacacaatgtgacagtatttcaggcactacctcctgtttgaatggaaaaatagcgttacaggtcgctctctaagaattcctcttttttgatcttgcaggaacactactccccaaataggttctgcccatgggatgtggagatgatgaattttctaacctcagtgttgctgacacttagatccatgcgcttctggaaagactcatttctaagccatcacggctgattgaatgattgtatcccccaggtgtttaataatggatccatgtcaatcctaaaagaagtatctggtggactgcaataaggttctgcctgtgatcgtcttcattttatcatccactcatgaagatgtgaaagccagacttcagacagacaattagagggcattagtaatgcatattggatgagaagttgtgacacaaaattttaataggctgcaaagatgtgctaaaattcactaggtataaatgatgtcataggttcagggagatactgagacaagtgtgaacagaatacatgagattacactgaagttcaattaactgctagtcaaaaactaaaaactaaaacaatgtattctgtagtgaacacttgcagatctgtgtgcttagttcaccttttctagaagttgccccttcccttgtccagatggttgcaaaaaagcactgacgtcacaacatgacctggttcctggccacagttgataggtccagaaactgatactcaacttaagaataaggatctgttctgtttattttaaaatcagaaccaagaatggtaagctggactgtcttcgaaagcctggactctaagaagtaaagctttggatttataggcagccatgtcccccaccactggggtggcagaggaatctagtctttggagagaggggtggacatgagagatggaaagagactcctgtctacatgttcctatggctcagttgcatttctcttccttgagtatcactgtattctaataacctaatagatcctcatatcttccctttcaactcaagctaactaagtgtctcatatttgcaaagcaaaatgttccaagtacatgacttaagctccagctacagtgccctgaataagggtgggataatcataatagtaaatttccaagtggccaagtcttaactttgccttggccacactaatgtggtccatgtggtcatttccaggctcaactttctgaagatgatggtcaagagacagaagtctctgaggaagaggaggtagctgtttagaaatgtttaaagggttgccatgtataagtcaaagtaggtgttctatgttgctccaacagacaaaaatgataccaatagtcaaaagttggaatgcagattttgactggacacaacaattgtttttgtaagtattagacttatccaataaaggaatggatgacctagtgaaggatcaaggtctctgtcaatggaaggttgggtcagaacttagatatacatttatttgggagtttgatgaatagatggctattaatagctgtcatttatcaaaggctttttatgtgtgaaacactgtgcttgacatatgctttatgtaaatttacacatcttcataataatcatatgaatagatataccttatacatttaataatagttatcaaatatttataagaacaatattttggtaattttaaacgtaaaattaaaaaaatttgttatgcttcaattgtagaattatgctacaattaatttcagtctttgaagtatttgtaattttaccacttcatggcatttttctactttttttttttttgagacggagtctcgctgtgtcacccatgctggagtgcagtggtgcgatctcggctcactgcaagctccgcctcccgggttcataccattctcctgcctcagcctcccgagtagctgggactacaggtgctcaccaccatgcccagctaatttttttgtatctttaggagagacgagttttcaccgtgttagccaggatggtctcgatctcctgacctcatgatccgcccacctcggcctcccaaaggcatttttgctacttttaagttttaaattcttttactgatacataattttatgcatatttatggggtaggtgtgatattttattacatgcatagaatgtgtaatgatgaaatcagggtttagggtattcatcacctcgaggacttatcatttctgtgtgttggaaacatttcaaatcctctcttctggctattttgaaatatacaatacattgttgttaactataatctacctactctgctattaaatattagaacttattccttttctttaactgtatgttagttctcaccaacccacctcttttcatcccctagcaacaccccaccaacacacacacacacacacacacacacacacacacacacacacacacatttttcagcctctggtaactatcattctactctctacctccatgagatcaacttttttagctctcatatatgaatgagaacatgccatatgtgtctttctgtgcctggcttacttcatttaacataatgacctccagttccatccatattgctgcaaatgacaggatttcatttttttatggctgaatagtattccactgtgtatttttgccatattttcattatccattcattgactgatggatattttaaattaatgaataattctcaattttgactcaattctataggatatggtggcccttccagattttcaaataatacaagctaccacattttcatttccattatgattatttcagttacatttacccaattgcttcccatatatttttctggatacaattgataatgtccttttgtttactatatagcaggaaaaccaacttttgttgtcttaatattctctagctgtggagttcaactattttatctttcatagctgggtaagaacaggagtaatattttctattttactgttgatcaccatccccaaaatccctaatattatctgctccataaaaatccccaaaaccaacactcaagggtttgcttaacatcagactgaatgaataatttctttgaaaagataacccgaatttgatatctagtctgacctatgatattctttataaaataaggaattattttgtatcatactgaattctaaaatatatgttcttgagctttaaaatgctttctaaaactttctatttaattctgcattttttcaccagctactgtaaaaattctgccatatcacatcattgttgctttactttgttcatcctttttttctagtttgtcccacattttttatctctataaaatgtcagtgaagagactaaacataaatatacaaagatcatggctaagccagatgcagacagcctgatagtgaatgccagatgccagagattctcttcagtttaaatattcagcaccaggtggttcagttgacctaacaaaagaacacgtgttcatgagatgcaaagatagaattggagatactagttctcatttggataaaatttagttatttaatgaaagcatgcaagaagggtttgaaatcaagtaaaaatgaaattaagttaaatcattcattcacatctatacagaaagaaaattttattgcaatttgtaaaatttcttttcagaagtaattcttagaacaaatgctagtatttataatatcagctagagaaaaaaatcctttaattacgctttagtgaaagcataatattaagtctgtttccaactccctgaagagtggcaataattaagataatcaatgtttcctaatatgggttagagtagaaatagaatttcttataaaacacattgtatttcttgttttgaaagatctcatagctcaaatttaagttgttgcctttataactagctacagtaaataagctggccatggactttgaccttacacagaaactaatgaccttaggagtatttcaagatgttttattaacataagtgaagtgagttaacacagatatgctgcaataagtgtttgtgatacgtgttcacatacatgtgaagcatatgtgtgtgcatgcagttgagtacttctgttgtcaaagtggccactgtcttagaaagcaatcaaatgaaggcaggatgttaactttaccattaactaagcaagacgacattgccatcacttacatttattccttacaagttactttttaagtgtacaatagaggttcatgaggaagtagccccttaaaaatgttttagacaatatttaaaatatatatagcaaatgaataactatatagtcaatgcattggaatgatatacttgctgtacattattgctttgtaaggggttgtattagttttctgttacttctgtaaccaattactacaaatttgacagcttaaacagtgcagacttaccatcttagggttctagagagttgaagtcccacatgggttgccctgggctaaaatcaagatatccgttgtgttctttcctggatactccagggcagaatccatttccttgccttttctagcttgtagaggccaccacattccttgactcacagtccccttcatccttcttgaaagccatcatcattgcatcactgtggtcacattctctgaccgactgtgcctccctcttcaacttttgtgggccttcgtgattacattgagctcactggacaaaatagcacaatcttcctattataatgtcaatggattaacaacctcaattccacctggtcccttaattcctctttgctatgtaaacacttgcagccctgtgttcacaggttctgaggattagaatgtgaacatttgggggcaacacttattctgcccattacgaggggatttagggggcttcaccatccaaaaagcagacttttgcataatttctttctttttaagacagcagcccatcttttgctactcctggtgtttggactcccttgattcaatttctcttcctgtcttctgctattgcaaaggaaggccacagtctaactgcatgtggctgaggaggaaaccttggggtttatctccttcttgaccaacgcttctcttttctgtcccattctatttccctatttttagcagtgccgtgtcctcccaattttgaggctctttagggttccagcctgtgaattagtttccaagcttggccactgaaagaagtttcgttctacttaatagcattttttacccacgatttttctctctctaattctcttgtttcttatggacaaaaaattaattgctataattttagaaaggtttcaggagaaagtagagacatacatgtgtgttccatcagccagataagcaaataaccagaagtctaaggtacttattttttataagacaaagtcctaaggctgacaagtaatttgtctaagatcacaaagacaaataaattggaaccagaattctattctgggcttttctgatctttgttttgggaggatgattagatgcaataaactttaaggtctctctttaatataatatattaaagatacattaaaccacaatgattctcaagatttattgtctgtctcagctgagaggcaatttgtattatacacatgccatatagttcctacaagattttaattagcttgagaaatttatatgtcttcataactcatattgtatcatatacatgatggtcacctgataaatattataaagaaagaatatgaatgcttatttgccaaacagaattaatcttcagagtttcctaacctgtaatcctagggtctggcctagggctcagattaaactcctgatataatgtaatggtaattccatagcaagattcttcactcgagtcagctgtctgctcacatgttgctcccaaagctcttatagaagcacatttgagataagatggtcaaggttaactgtgtgtattattactgctgggcagctattggcatagtatctaaatttcaggtagttgttttggtaacacatttgatacctggagaacattaatgggagtcatcaatgttagcgatattttctttgtagtctcctagcctcaggcatagtggagatagtgtttaggctgagctatgaccttcactgctttaagaattaaaaagtttgcagtgtcaagggaatgagaagacaagccacagactgggagaaaatatctgcaaaagacatatctgataaataacaattatacaaaatatacaagaaaactcttaaaactcaacaataagaatacaaacaatttggttaaatagtaggtaaaagaccttaacagacaacttaccaaaggatatattcagttggagaataagcctatgaaaagatggtctacattttatgttatcatggaaatgaaaattaaaatgacaaagagatatcactatgcacctattagaatggccaaaatccagaatgctgataaaaccaaatgctgacaaggatgtggagcaacaggaactctcattcatcgctggtggaaatacaaaatggtacatcactttggaagacagtttggcaatttcttacaaaactaaacatgctcttaccatatgatccagcaatcatgctacttggtgtttacacaaaagagttgaaaacttatgtccacacaaaaacgtgaacatggatgtttatagcagctttattcatagttgcccaaactcaaaggcaaccaagatgtccttcggcaggtgaatgggtaaataaactctggtgcatccagacaatagaaaactattcagtgctaaaaagaaataagctgtcaagccatgaaaagacatggaggaaatttaaatgcatattactaagtgaaagaagccaatctgaaaaggctacatactgtgtgataccaactacagatgctcctctacttactataggatacttcccaataaacccattgtaaattgaaaatatcctaagtcaaagatggctgtttttgttagacatgatgggatgggaaatcacagacacaacacccaaaaaacgctggcaagacagtacactttagagcatcaattgtttaccctcatggcggcgtggctgactgggagctactgctcactgctgttttctagtatggcaagagcagcaacagagagtctcctatcatgtattgccagcccaggaaaagatcagaattgacaatttgaagtacagattctactgaatgcatatcactttcgcacagtgctaaagttgaaaaacagtaagccaaaccatcataagttggggaccgtctgtatatgacaccctggaaaaggaaaaactattcagataggaaaaagatcagtggttgtcaggggttgacggggggatgaacaggtggagctctgaggatttttaggcagtgaaaatactctgtatgatgctataactatggatatgtatcattacagatttctccaaacccatagaatgtacaacacaagaatgaatcataatgtaaaccatggacttcgggtgataatgtttcagagtaggttcagcaattgtaaaaatgcaccactgtggtgggggatgttgataatggggaggctatgcatgtgtggaggtaagaagtataggggaattctctgtaccttctgctcaattttgctgtgaatctaaaactgctttaaaaaataaagtctataaaaaaaggattacagtgcccccccactcccacatatttttaaatcacaaattttaaaattatgatatccttcatatataattcaaaattggtacaatactaaattgaaaattattttttaaaatttcctaaatgacagcatccctgattttgggaggaaatagcaaattctatttttttttttttttttttttgagactaagacttgctctgtcacccaggctggagtgcagtggtgcgatctcagctcactgcaacctctgcctcccgggttcaagcgattctcctgcctcagcctcccgagtagctgggattacaggcgcccaccatgatgcgcggctaatttttgtatttttagcagagacggagtttcaccatgttgcccaggctagtctcatactcctgacctcaagtgttccgcccgccttggccttccaaagtgctggaattacaggcgcgagtatttccactgagcccagctagcaaattctttcaaagaatattttcactctcctttttctgtgggtgctcctgcttactgcagcttggggtgatgccttttcggttacctgaggtgggtagcggagattcccaattcccatatcccttttctttccccagtggttccttcggcccccatggccgggacacatggaaaggtgcaaggtatgaaaatccccgcccatggtgagggacctgtttgggcctcgagatccattttttttggttcctcaagtttctggtgagtttggcaagtcttcagaggtcccttccagggtggtacatgaagttttgacagatgggtgtgaatttgagagctatcctctcttgtctagcagggtgaacttagataattcattctatgtctttgaatcttgggttcttttataacatttgttttaaagcttttgtaatatgcataaaataccaacctcttagggagaatgccaggaagaaatggcataagacacacagaggagtcagtgcagtcccttcaataagtatcatttccactgttctctttcccaactccatcataaaaaaggtggccctggtgatcataatagggcacattttatagtaattcacacattacaaagcaatttcatacacattggtagcattatcaaatactagtgtttgaaggcaactggaaaatctagttcttatcttatcaataaataacctaatcccaagaaacctcatgtaatttatcccaggtcatgcagctaggtaaaggcacgagcatgattgaaagcatgggtggtattctgctcctaaatatgccttttgatatatctaatccttattgcatatgtaatatcttagaataatagctgctgtgtatattcacctaccaaaatgccacacaagttccccaatattttctcatctaattcctacaactatcttccaaggtgagtattattattttctcatttaaggaatcacagaatgagggctcaaacaagttgagtaccatctgcaaggtcacccagcccataagaggcagggtagaaatgggtctgacaaacaagcttatgctcccaatactcaaggttgttgtctagatggggttattataggacaaggcagatggaattagttgagctgttcaaatcatctgtgtgagtgactccgtgcgattggtatttattgctaggaaacatggcagtggagtgtgtatatgctttgtagttagacttcggttggaatccaaactctagagaaggtggcctgtcaagtggaatgatggagcatggactttgctgtcaatctgacctgtgtccaagtccctgttctggtactcactaactatgtgaccttgggcaagtttcttttcttctctaacttctgtctgtgagatgggataataacagcatcaatctcctggtgttgttctaaagaggaaatgagagatattgtttataaagtgtacacacagtactttgtacagtacttgctacctagtgggtgcttactaaatgttaacttttcttattattgttttcattattgtatacacagtactttgcacagtacttgctacctagtaggtgcttactaaatgttaacttttcttattattgttttcattattgtatacacagtactttgcacagtacttgctacctagtgggtgcttactaaatgttaatttttctcattgtttgcattattgtatacacagtactttgcacagtgcttgctacctagtgagtgcttactaaatgttaacttatgattgttttcattattatttagcctctctgagtcttggttaactcattagtaaaatggaaaaatgataactatgttatagtgtcagtgtaataattagagaactctatgtaaagtgtctggtccccaacatatggtcactcaaaggagtggtatgactcaagtgtatactagaggcttctataatgaagtcacagataactgcagataaatattaacctattggaaaagtatagataagtagtcttaatggcaataacgttgttctctgtgggaagctgtttccaaatctccattttccattttgtaaaatcaacatcagggttaaatgtaaagctacgggttaggatagagatgagctttgcccaggactaagtggaggaatggccaaaatgtcttcaactccaaggttgaaatgcaaaaatctattggtctctgttgattgctttcccttgatcatggaattaaatggcaggcatgttgtggctttgcagcagactgctgtgtgcaatctcagctcagttttctgtcaggtgtgggccctgtgtgtaaataaaccaaccacgctgttaccccatgatgcaaccatctgtaaaatggggattaggagtgctgtgaaaatgaaatgtgggaatgtgtttgacatgatgtattgtcatgctccataaatgtcttcaaacattaaaaaacaatttaaaagttgaatgttggagaaatacagaatacattatgaccaaaaaagaagcctagctttccagacctcccattcaaagcatgaaataacacccagggaattatgttgataattacccaagtctaaaacagtagtactgtttaaaaaataaccttttatttaggttttagtggcttaaaactgccttgacaggcatttttatcaaacattgacatactcttcctaaattattttgagaggcaaagtcttaaggattatttggaagaaaaaatttaatcttcttgaacatgcggtatctcagaaagcaaatgaatttctaacattagtattttaattatttggctattgtctagaaggaagtccttttatagttccgaaaagctccctactgtcatctgaattatgacaaagtatttcgttttgtaggaataccacctctttcacaaattacataattgcagaaagatcaattaataagtgctgaattccttatttgcatacagtttaaggacatcactatgaagactcagaatattcttttttataaattcgctcatttctgaagagcagccaatactggatctcttgagtattccaactgtcctttatagaaaataaaagcatggaagaaacaacatagatttctatacagaaagacaaaacccccacttccctcaaataatggtgccctagagaggagggggaataatatttattgagcacctgctatgaagcaggcattgtgccaagagcattagatgcatgatttcttcattgtaatcttggcaacaaccccatgacatagacatctcttcacatctttgttcattgtgctgcccaaacctatctttctccccattcccttcatctccacttcaactccaggtagagaaatgcctcccagtgttttcatgctatggctcacggagaaaagtgtaacatttgcacggcacactgcaacaaacagcagagtattctggaatatttagataaggcttggtgaaaaaaatcctttttatatatagtataatttacaagaaaaaaatcatgtattgtaggagatattaaatattgaatttgtactgttgcaggactctctccttagttcagctaaagatgggtccttgtcacacagtcatgaaaaattagcctcgcatgcaatttgaagggtgagaataaatggaatttattgggcaaaaaggcagggggataagggaaacagagaccctctacaaagccagaatgctgctggtgtgcttcctgcctcgcagattgaattccacgttccacccaggaagaggaggggccaggctcctccttgctgcaaacagtgcgaacttcccaaggctccccaccagtgcacatccctcccagtgtgcaggctggttggagtttctcatgggaccccttcccacctggctgtctcagtactactcttacaaataaaaccatttaatggatataaggctatttatatatttttcttttttgttgtgtcagtttgggtaacttgtgcttttcaaaaactatgtccatgttatctgacttgtcaacttcattaatacaaaactgttcatagtatatatgcccttattgtcattttaatgtctacagaatctgtaattttgtcccctcttacattgctgataatagcaatttgtgttttctccttttttattatttatctatttatttatttattttttctcttttttttattatactttaagttttagtgtacatgtgcacattgtgcaggttagttacatatgtatacatgtgccatgctggtgcgctgc

SEQ ID NO: 2738 - DNA, 354 bp, Homo sapiens
agacggaagtgagccacacactctgtgtcctcgcctcaccaggaaactactaaagttcctggggaagcaaagtagaatttcataagaacaaaatggatggagaggagaaaacctatggtggctgtgaaggccctgatgccacgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacctacaaggttcgctacactaacagctcca

SEQ ID NO: 2739 - DNA, 494 bp, Homo sapiens
gcctgtcataaggtccagcgagctgccttccacgagaccagcagaagagtgggcaaacgtgaagtccagtcctgctgcccaggctgccattgacctcacggcgggggctgcaggttcctgcttctccacgccaatgacatggtgagagaatacagggggagctgaagacaaacaacataaacttatgtttgcaaagcaccttttactctgtgaaataaagtgagtgcaagcagtaaatggaacaacaagctttcagagtcactgcagggcaagagctggggaaggaagagctggctggtcagggaggatgcactggagagaaaaaccatcactcaattggctaggacattccaggacatcagggagaccacacaacagccagagtgtctcttctcctccaaatgaacgcaacacctctccagcaagggcacagaactgggctgaggctgagtattgctgaggcaataccgtttagaacataggcacgggtaagg

SEQ ID NO: 2740 - DNA, 15178 bp, Homo sapiens
gcaagtgatgagctacagaagcaatgcagcagtctgatatgccaagttctgggtacctgaccactggcaggttcagtatcagctttcagcctgctaaggcatgggtccggtttaccacctattttgtttgtataaaactatatagaaaatctatttcaatgtaattttttaaacagtggactgattgattatgtagcacatttaccatggtttttctgtgatttttcaagaatcactgatgtgtcctattgtatttttgtcctagttaaacttcacagcgtctctgtcagtgtactgttttttatctgcaattgcaaagtgctgataaaggtcctttctgttttccaaaagagcaatgatagagtgaaaaaaaaaacccaaatagtctcgtggtactcattgcagaaatatagtttagcccagagtaaaaaagcctttaaaacttcatattatcttgccacacttattacttctgaaaattttattagtgttttgatcttttggcaatttaaaaatgggagctgcatgtttgaaaactaaaattattgtttggaaatgtctaggaaatatggttttattgataaatttgggtttaagtgttagtggacatgcatagcttggtagatacataagatcccattatactatagccaaatgtaggattttaaaaattatgattaaaatgtctactacctgtattttaagaccacatgagtccgaatctcatagatttaacaaattcaggtagttggaactcagttgtaaaccaagaaataaagccaaaaggaatttggtgcagataaaattgatacccagaagcttgtatagtctcagctcttcttccttctcacctccctcccctctccccctacactatgggaggttcttttaggagcttgttttacagttctaatagttctctgttttttttttttaatagttctctctagttaaaaagaggcagttccaactctgccagaaaggcagacaaagaaaaatgataaaaatcagacagaaaaactctaaaagcattgggactatctagtgaagtgacaggaagccctgaatatttcatttgctctaatacagaacaatgtggatattcatcataaccgccctgacatgttaagggaagattaaattatgttcaatacgttatatcaaataaagttcagaaatgtacagtacatttcaggaagcattctgtgcaagaaagttattgtctttatgaatgtaaaggaaaaaaaaaacctcaactcagcagagaacatagatatccagaatagcaaccattgtatgattacatattaaccttcccattgttgatatgtactggggacctctgttgtttataagtgctgtgaccttggccgtgagactttatactaatacctatccctcagtaatgttctgtagattcaccaagatttatctttgtaaagtttttcacattgtacttgccaattagtatatatttaataattgtggctattatgcatttcaagcttcctgtgaacaaaaaatacattggaagccaggtcgcgtcaaggattacagaccacacattacattttcatgagcctacactgctaggtgttttcttgttgggtactctgaaaaatattacatgaactaaaagactgtcaacattggagagagtatgccataatcttgaagtagctggcattgttactggatatgtatggcttaagtctttggtttggaggtgggaggctgtcctgtgcattgcaggatggttggttaacagcatccctggcctctacccactggatgccagtagcacccctcctcccaccccagttataacaatcagagatataggcattgctcaatgtccctgggggccagatcaccccggctgagaaccactgcactagagaaacaaatgtgtaaatatggagcatgaagttttaaatagtggtcacaagtgaatgctgagtgtgtttaaattctcattccttttgtgctatgaggctttgactacatgtatctgctttactataattctctctctgtgtgtgtgtgtgtgtgtgtgtgtgtgtgtgtgtgtgtgtcttttcaccttataatttaggtgttgtttagtgacagttaaaggatactaagaaaggattgggatgaaacagtgtgttttatccagtattttgagagtaaggcttcccaggtgagcttccgtcactgattttttggatggctgtacattaattaacatacatttattgagtgcatacccttctaaaaagtcctgtgctaggtactgcaaggaaaagaattttttttttttttttttttttgcctgaacctcctggatgagggaatttcttttctggcatgtaacgtttcttttctcggcccatgtgtctggagtgctagttattcttcccctccagtcccaaacagcttcttttcctatggcttcactgacctttcgctctaaaatcctcatgcttgtgttcacctcttcccattcccccatctctattgcatcattatgcgggtttgcaaacatcatcatcttctttctggcatgactcagactcctgataacgttcatttctggttgccttatttagggaaaatcatcttcttcttctaggccatattagcatgggacactcgtccatctattactcagtagctctttaatttcaaaatatagtcctaatcaaaattttctagctctttattttacttatattttgggggactcatcagttatgattaaatgggtcaactagtaacagaaatctaagtaatacttgtaaactaaatagaattaattttcccttgatgtagaagtcaagaggctggtatggtgatgttgtgatttcatcagcctctcagtttttctcaatccttctattctgcgttcctattctgtagcttccatcctcaaggtcaagtcatggtctaaagatgtctgtctgtctattgcagctccaaccatcacatctgagttttagaaatagagatgtagaaaaaaagaaaggcctgtcaatggaatgctttctgcttctctgaagtccctcttaaaattgtttaaattttaacacctatctacaagggtggctaggatatgtagctgggcacattgttgctatcaacaatacagagattgtgttaataaggaggaagtgagaatagatattggccaggcagcagatgtctctgcacacagagaattttgagtggaatttatgtcatcgatgttttatacaccatatacaaaataggactttaagaagatgtttcataatctatacagcaaaatttactatattaatattgagttattactcctaaaatttgttccttgtgctcaaatacagaattggaaggattctttatcattgctccaaggaatgagggggaaaactgtcacattcctctgaaaagtaaaaaatgtggtccatcaatctagttgactattttttttttcacactgatctgtcagaagtggctgattagctgtgggtttctatacatagctagcatttatcagagaaatatcatgaggacactctttctgttgaatatacgaaaaccataaccagtttctacatgtaagggaaggagtggtacacaggtctgtcaaactgtgatgcagggtggtgtggggaaaggaacggactacgttcaagaagcctctcttctgcttcacgttgaacatttctgactctgtcacttttcctcaatcactgtaagcctctgcttttcatctataaaatgggactaatccttaactcggctatcatttgttgtgtcccttcttaaagatacattgaatgcccatctgtggcaagataccagagtaggacagagctattgttatgcttaaataaaatatcttgtagaaaatcatatgtaaattcaaagtgctattgggttgctgatatggagattatttattttttttatcatttagatccagatcagattttagccattcttggcaacagataaactctatttctcaaaaatttctagtagcaatcaattatctcaaaaaaattctgctgtcctgtgtgacactgcaactatgtattacccattaatgctaattaggaaggacctgggaagcacagccagataacctatagtttattcccagccctcctacttggcctccaaacttccacaaaacactagcttcctttgtgcctacttccaagcctaaaattcttaagtaactttattatttatttgtttatacagtggcaaaatcctgaaatccttcacatacttgttaggcaacattaaatatttgtgaagtctgagtggcacactcaccttaagaagcttcaaatgaggccaggtgctgtggctcatgcctgtaatcccagcattttgggaggccaaggcaggtagatcaactgaggtcaggagttctagaccagccagaccaacatggtgaaaccccgtctctactgaaaaataaacccatacacaaaaattagccatgcatggtggcttgcacctgtaatcccagctactcaggaggctgaggcaggagaatcacttgaactggggaggcggaggttgcagtgagctgagatagcgccactgcactccagcctgggcgatagagcatgattccgtctcaaaaaaaaaaaagcctcaaatgaggaatatatattgaaagagttttatttatttattttggtttaatgaaaatttgatctgttgtatttttaattagaaattatttgcttcaaggtttttatacaggacatacaggaactaatttggatatttttaatattatagatctgtactgcgttctcagaaggctacaaaactctgtaagagaaaaataattatttggcctgcattgtttaaaaggagatcatatctagttgaggaaaactggtggcgttggagcatggctttgacagattttgatgggcacagaaagcgaggctggctgagcattccaggaagaaaccaaaatgtagggaccagagaaactcctggggatgatttgggaaaagtgagattttttgattattctaaagaaatggactgaatgcctcaaaaacaagagctatgacttatttctcgtcaccactcctagcctagttacagtgatgacataaagagagcttggtgatcatttatcaaactgaattacaaccagttttaagccaaacccaaagactgcagagaaatggatatgcccaccgtctcttctgtaactgtcatgcttaaatatgacataggtgttccctaaagagcatttcacaatttctattagtgcaccattcgaaatatgatgttacagaaggctaacagtaagttctgtgtcacaacagaagtttattccaaggagagtagggccacagatggcatctactcaaattaacaatgggtgcttaagtctccctttcagtagccctaaaaagtgatgactcaccacctcagcataaattcctagtttattcccaaacagtccatcttgcaagcttctcttacatgagcatacaaagttagcctgtagatttcaggagtgtgttggtaattctgggttagaactgacgttttttggtataaggatattcaaatgggcggaagtccttcaaagcagtgattctcaaatttgagtgaacatcacagtctcctggagtacttgctaaaacacagacttctgggccctaccctcagagtttatgatttggtaaatttgtgacactagcctgagaatttgtatttctcacaagttaccagataataccaaggctgttgatttgggcaccacactttgagaaccgttcttaaggatattccgaagccaagagcaagtaaacatcctctgtggcaaagcttggagaatgaaaaacatagagaggatattttactttgctgcctcagggctggtctggctttctctgaacaaaacgatgcccactcagtctttctcctgccatacaggccaaaagaactaccttcctgggtgagctttgcactctcatccatccgggctgtcattcctgctcttctttccatgttggcacgccttcccttgctatgctccctattgaaatactcctccctcttcaaggcctagctaaatgccagaggctgtctctgattctcatgaacatgatgaattgttcaatgggttcccatagttccttgcttatatctttatgtcccacttgtaacatgtgcccatggcatacaattcgttttatccactttaatctctcctggaagtgtaagatctagaagtccagaagggcagggatcgtgtgaggtttgatattccctggcatctagcagagtgtctggcatagagtaggtgcctggcaaatagtttttgaataaataaatgagccttccaatctcttctcttctcacttagccacatcctctgcatgaataatatgactggagggaggggttgcattgataacagaatgaagctgaattgaatctagagactgacaattgaagcttagctctacatttattagttgctggacctcacgcagtacactgaacctctctgtcccatcctctgtctaaatcaaagggtcctaactctcagcggtgtttcaaagattaaacaaggcattacacatgagtgttttggaaaactgtaaatcctatataaatatgaatatgttagttgcttaatatttccatgtataacaaaagtatgtacatcttctacaatgacccaaagtgacagtggtttcaatatattttctataatgaactagaataaatgctttatttgtccacccattttaaatgtgttgcatataagaaaagcatcttatttttgtttttaatttgttttattttttattttttgtcttcaaaggcgaggggaaaaatgagattgttgaattgagaagcaggcctcttatttgccatataccagtaaatatcacttaacctccctcgtcatttattataatttgaaacaatccatagcttgacagggtgtgagacctggaagactctagggtatatcatctaggcccctaattttacagaagaggagctgcagttcagaaagaagtcccctgtccaggttcatatgactggtttgtacccaattcaccccacctgaatatcccactctgaaggcttcaacaaatgtcggttagtctgagaaggtcaatgttctgtttgctcatcagtcctgggactaaggtttctatcaacccattgacccaagtaattagaatgttttgtgtgttttggaaattcacctgaatttacacatttaacttcctagtaggtgtctgtgcctacgaatacaaaggacatagatgtacagatttcatctggaaactattttttggtgtccagataatcaatatcttcttagcaacttgagacattaggacagaaatatatttaacttaaaatcttgatcactgtttagaattaaatgttggtcaatgaaacccattatttactttttatattcatgttattcatatttttcaagtaaaaaattcaagctatcttgtcggatgataggacagaatatgtaaagtcataattttcctattggacatacattaatatgtggcattattttattatatattttaaaaaatattactcttgaagagatgctgtttcattccttaggtcaagaatacttcagatttattcagaaacttttatggaacatctttgtgtgccaggaactgtgctaattgctaataatatgaatttgaaaggtacacaggtcttgtttggaagaaacttatagacagactaaaaatgtatttaaggacaaagtatgacagtgaggtataataaattcaacaatgagataaataataggtatagggttggcacaagtacaagggagtgggttgttgtttgggtggctcagggaagctcatacagatgggaactgtctttcagaatgagtaggagtttatcaaaagtggaaactaggaaaaggatggcagttccagtagtggaaatagcaggtgcaaaggcatggagatgtgaaacagtatggcatattcaagtggttgtaagtcggtagacacctctgaaatgcagaatttgtgtaggttggtagtagaaactgaggttgaaaaaggaggtaaggacaagttcctggaaggcctttgaaggcccattaaaatgtttaaagtattctgcaggcaaaaaggagtttggagtatgtgtaattttagagacatgtgacatgatcagatgtactcttaaagagggtctttggggcttcgcccatgactctctttggttcttcttccttacagtctgcaacagtgaaagactgtttcctacatgaagtctgtgagagagagaacaggtttgcatgttgccaagttatcaaagaaaatacatttccttcaaaaccaacttatcccctgaagctgctagtaagaaaaatatgagcaaaatataccacagaataaacttaagctgcattttaaaaagactattatcttgtatgaaaataattcataagttaaaatgttaaaaggccagggaccacacctgtaataccagcactttgggaggaaggggtgggcagatcacttgaggtcaggggtttgagaccagtctggctaacatggcaaaaccccatctccacaaaaaataaaaaaaaaattagccaggcatgtgacggtgcacgcctataattccgcactcctacttaggaaggtgaggtgggaggatcgctggaaccgggaggcagaggttgcaatgagccaagatggcactgtattccatcctggaagacagggtgagactctattaaaaaataataaataaataaaaataaatagttaaaatgatatttcagtgtaattttagtaacacagaaaactcgatatatttattacaactcaaagttataataataagaataaaactacattgtcaaggcaccctatgaattaagaattaaaacggtcattagttaagcagcagaacgcttaaggagaagtcaatgaataatgagatttactgcactttgggagggcctagctctttccgcccattgaatagacattaccattggggtcactctacttactataagtgcttactatcgtatgcagtggctgaggttttggctgtggcgatcaatcctctactgttggataagggataggtgaaatcacttcacaggtcacagtaatgaatttttcactgtctgggacactatcagttaaatcatatcatggctacttataggcgtattgatttgagagctaagacaactgcaattggatagggtgactcaaaagccttcaacttttgacaccctgcttgtgctgatttttaacatgatagagtgaccccttaagattgcaacttcccttcctccatactcaataacatttactctaccctccaaagagaaggatgacttgaaatcattccaagaatgagttccttgatttatttgagaatccatattggagattaatcagctccaagtttggtgaactccctaactggcttctggccccatacttcaatttcagtttatatttagttgttactcaatggaaagccttacctcacagaaaatttattctgctttctgcaagcattgtttaaaaagtcttttttccttctatttttctgttgctcccttctaatgccatttctcatccttcatattttgcgtaaattttggagcacaaagcataatcatgaataaaataatctctattgaagcaatgattatttgcttaagagatgtttatctagttggagaagaatgaaaaccaacaaaagccagaaaattcatgggtttttaaaacaatttgcttttgttaaaaggggaaatatctactgatgtgagaatttgaaattctaagagactaaaaaaaaaaaaaatctaaatagtctttgttcctgtaagtccatggatagttgagaattgaccatatcgtgggggagacaatcattttgtgtatatagatgtatctcagtgccttacttttctttgtgaaatgaacaaaaaacaatgacaaaaatcaacaaaaccaacaaaatcaattattttttctaggatacattattatctggaccactagtcagttgttatagaccatttctgttatatcttatgccattatttactttctatctgacatttgtgtatatttttatcctacaataataaaaataacaataataatagtaaaaataatgatagaatattgtgtcatgtcagaatgtattggacttgatgtcagaagatttgaattgatataaaactgaatatgccacctcctagaagtgtgagtctacataaagtggccttacttttccaagcctcattttgaccctttgtgaaatggggctattctttctgcactgctcatttcatagagcagatatgaggatcacatttgataatagatgtaagtggggacctatcaaatactaaagtgtttttattcataaatatttttaatctgctattcttgagcagctttcctatttagtttgcttggttatttattcatttattcacatcttattttctaaggagttcgttaatttgatggaatctccatcatatattcgtgtgtgtatatatatagtgtgtgtatatatatatgtgtatatatacatgtatgtatatatgtgtatatatatatgtatatatacacatatatacatatatatgtatatatgtatcttcatttctctaaacatccataataaatgtgttaagctatgttccccaggttgatatgaattccaggtaattattcattctttgattattgactatcaagggaaagttgaaaaattgataagtccactttttttaatacttcctgaatacttgccattataaggattcagcatcctgataagtcactaggtttcttaaactagaaatataataaaattttaaatcttaccttggcagtcttcagaatgttggatgaatttaacccctctctatcttcttaatgaaatgaacttgtaggttagtgctggcagaataaatggagtgcaaaacaccccttctagttcattgatgaatattttatgtgagatagaacccaaaacctcattaaaaccccaatgtgttataactctgcctcatttttgatcaatcttatcattcagcacgaaggaggagacttcctaactgtacttttataaggtagcaagtggcaacgtttcataagacacatggatcttgtcatcttcatgtatttgtgatggattactgaaagcgttttcagtttctttccaagtaaaaaattaatcttatgaaactgaatttccaaagtcattgttaaatacagacataactcatttagccacaactcgttgaagacaatatcggttttcaaaattaattctggtaaaatcctacctaagcaagctctctagatctatctctatgttagtgtgtcatatattgacactaacaggatgcaaggaggtctcccatgacatttaaaaaaaactttattgatgtataatttacataccgtaaagtttacccatttaaaacatacaacgtactggttttcagtatattcgtagagttgtgcatctaccaccattatcaaattccagaacactttcagcactgcaaaagagaacctgtacccattcagcagtcattccccattttcccctctccctagcacctggcagccattaatctactttgtctctaacgatttgcctactatgaacatttcatattattggaatcatacaatatgtggccttttgaatctagctgctttaactgaacgtggtgctttcaagggtcattcttgcagtacatatcagtatttcattcttttgcatacctaaacagtattctcttatatggctatttcacattttgtttattcattccatgagttctttagtttcatcaaagtgttttgtggattcctcttcctactccccagaagagaacatttctggtggacaaattagccatatataatgactcatatatttatattaattgggagaaaggggctcattagtagataccatactgtgctggaaatggtcaaaatctaggtttcttttgtaggctttacttcccctgcctcttttattaaacgttgacttcctgcattccacactctgatgattgattgattgattgattgatattgtgtctcaagttatacattttctctgcataagtagatctctttgaactaacccctttctacctctcatcctgggtacatgtgagatgtcccaaccacactgaccttttcagtatcttgaatacaaaactgtttctcgttttggggtcttcacatatgctgttcccacttggggtgatttttcttagctaaccctttatcaggctttcgtttcagtttaaatgcccatatttcagagaggctctgaccatctcctactccccaactcagtctagattacatggcccctgctattcctttttaatagcactctacgcctttcctttctggaacttaacgtaaatttgttatcgtggatttgcttgtatgctctaaagtgtaaccttcactagaatgttggttccaagaaagctagacttttttttttttttttttttttttttttacctgttttgtcaactgctgtatcctcagcatctaaaacagtttctggcacagaataggcattcagtaaatatttgtagaacaaacatttgactttaattaccacctgtactctgatgactgcctacttggaatctctcccctagacatatctgatgctccattctggtatgggctgtcatcttgacatctctatgtgaatgttccacatgtacaccgaagtcagcagttctgaaactggactcattatctttcttcaccaactttgcttctacctgccctctttagtggaataaaaattcttcttactacctaagccagaaatctgagcatcatcttaaattcttttctttcttcagctattaatatggaactggtcataaggtccagttgattaagtgtcctaaacatttatttaatatgtttttatttccaccatcactatcttaattacttcttttctctctgttgtgctgttatgatatcctcctaacttgcctcaccccacccaagtcttatttaattcatacctcacaccgctgtgagctttctaaatctaatagttgaccatgtcaactgctttgttacgaagcctttggggattatttcttacaggtgagatcccaacttcattacttggcctgcaagccccaagcttctttggcttcagcaggagccatgttccagtcatgccaaactgcttttattccccgaaatatgctactttttaaaaactgtgtgccttttcccataaggtttccttcacccacaaagccctctttctcccatctacttaacaaacttatagtcatttttttaagattctgcccaaatgtcatatatttctcaaagatttggctaactaccctagaagagttaggtttccttccaccatgctcaacgacacctgtacttatctgaataatagcttgaaccctgtgaatttaatcatcatgatagcgatctgtaacactagacatgagcccttgaagggcaaaggctcttctctgctgacgtaggcttcagatgatggcagacttgtgtttaaatcctgattcttacttgcagtcccacagcttgggtgagacctttaactctaactgagaagatgtgtgtaaagagcctattatagtacctgacgtacaataagtatttacttaatgataattcttattcatattatttttaataatagaagtaacaacagtgtcctaggtgtgagacagcaactgacatttggtaacatttgttgaatcaatgattcaacaaaaattaactttgttgttggtgaatcatgatgaaaccatcatgcaataaaataggagtgaacataaacttatgaggtgatccagaaaacaggtgcacaaatatacgacaacaggggttttagcctagagtggctggagagagggctgggtgacttggactttgcttcccctcaacttgctgaaggccagatctgaaaatctgaaagaattcatacaagaatccaggactccaaagattgtgcttgaaatagtcgcggacagatcccagaaatctgtgctttgaacaggcactccacgtggttctgaggtaggaatggagatgagactaccttagagaccgtgaagtctctgcaacattctgtttgtagtattttctcttatcatcatttgcctttgtacttttttgtattcatgaattgggatgatgctcaaagatccaataaagaagtttattggcacactctttccagcagtcacttgaagtctgggagccaaataatgcagggaagttagtttttattgcttactcagccccagcagcacaaacaatcaaaagtccaatctagaatctgttttcatctgacttctgagcccatttttgcagatgcagaagtttgcattcttgagatcgctggtttcctttttctattttatgaggcttttctgaagcctaactagtaatatctccccaacattttaaactctttagagaaaaagttttcataaataaatataggatcagtcatggtggtgattaggtgatttctgcagtaatgcaggacaagggaaaaactttctggagtttgtctcagatgaagtaaatcaacttgctgtgttcagtgggttacttttggagaacatgatatgctctagggcccacatgttaccttgttctccaaaaatagcatttcctactcattaagcaaattaattctttgtctttcagaagataaataatttacagattcttcctagattctaaacctcatagtcagtcatgatagtctgttttatcttatattcatataaagttaaaattaaacattattagaaactttgtagtttacagaaaccatgttccagagagaggaaatggtttgctcaagatcacacagtaaattggtggcaaaaacagtctcagcctctggttcttagctctgcattcagtggccaataaaaataataagaatattctccatacctatattagtcagggttctccagagaaacggaaccgataggattgtgtatgtgtgtgtgtgtatatatattaatatctatgtagaaagtaatggtaaaaaccacaattacttttgcgtcaac

SEQ ID NO: 2741 - DNA, 821 bp, Homo sapiens
ggggagggagcgggcaccaacatcctggactctggagcctggcatgagagcagtgccattcctaggttatagatgagctaaattagctgtgacgctcattagcggcagctcctaattagtgaaaattaatattggctttgataaagacgtcggcgccagctctccaaggcagaggcattatcatccttgtcagctgggctaacgactggacgagaaaaattgaggctcagagaggttgaggaacttgccctgggacctctggataccaggatttgggcccaggcagcctgactcaagagccatgatcctgactttggtattatcctgcccttcccttcaacctcacccccaaaaggggcactctggatgccagccccatcgtataccagcacgtaacatcatatccggcacacaaacctgtacttccatttacagcccctgagtaagtccaggacaaagtctccaggctctgtattccagaacaccgcctctccagtagggaagactccgggagcatcctgccttcccaggcgggaatggaggccaggaggctttgcccagaccttgactgtgctattgccaagtgaccagctctggggcctggctcctctgccacttgggagaggactcggcagatgggcttcccttcaccccagtccctgctccccagccagagaccctgagttccagcccagggtaatgaggggaagtaacagatacacctacttttaatccaaataaaggaaaaatgtttgccaccatggagtttataaaaataacaatgcattattcgggtattaataacaataaagatgtcaaac

SEQ ID NO: 2742 - DNA, 8299 bp, Homo sapiens
gttgacaaatagacaaaatggaaataatgaataggaattttatttcatgtggatacacgaagagaaagttgctcattttcttgaagatgttgcatttcaccacacctcatgaaggctaaacaagggaattgatctaggtagaagtctatctgaaatgctccaaaaataatcagtcccaagaaaaaccagtgctgagcattgagacagatgcaaagcaagttgagagcatatacccctacctgaaagtcactgagctgtttagctctgaataattggcagcagtgagtgatgtagcttttatttataattatgctagaaaccaacttgtgaaatctgattgcagtttcttgccttttaatttatttggttcttagcccctgggaatgttaggaggaggtagaagatgagaggctattaaatggtcactttgtaaaagtatcctctgtccctcatctttcactgtctcttcctcatcctgctttaactctcagaattcctcgcacttctgtgtttctggaagaaccatctatgcctcaatttttttcacacacctgattattttctgaatgggtagcaggacatttgtgcccatgcgtgtgagttgccatggtttcctctttctgcagatcctagagcctctgtcttcccttcttgtcagcatttccattaaccattattaggccaacccaagtatagcaccagccatcctgagagaaccacaacccgggcattaacgtcagggtctgcgcccgggctacatggccttctctgtgcaggctggggctggttctgtgagttaccccctctgtctgacaagctgtatttagttatggggtgacaggcagctgatggggtttccaaactgaaccttgcagcacttgattcagatagctaaagtactgttttgaatgctatttttcctgtaattttaaatttcatgttggtgagtaaatatgaccacttttctccaaaccaagggatggttttgctgcagcattgccatgcatgagcagccagcccacccagggaggcctcagagcaggatctggtggtggccctgaagctgtgcagcccttccccgggggatgatgccacaggtgctctgtgctttccaggtgggggtggattcagaacccagtggtgggaatccagacagcgtggcatggtttccagccaccctgcagagctttctttattccctaaccctatagtgatacagttctacctttctgcggctcatatctatatatcaacagatatatataattttatatatatgtgtgtgtgtatatatatacatgcttttttttgttgttttatctgtgaagagaaccagttgaaagcagttaattttgaccctgttcctttggttcctgggaaccttggatgagctcccagtgtttgagcctgagtctgtgtggggtgggggaggggaaggcagggcagctactaaaaatctcctggagttgtacgcaagaagccacgttggtgcccgtgtctttctggggacaggatccttctcttgtatcacatcttcaaagaggtttctcacccataaaagctgaccctgagctcttgacaggctcttggtccctccttccccttctctcctcccccgttctatgtgctgagcttggtcttccacgttccattctctcagccggggcagtgacaagcaggcgaagctaatgaggtttgtcctctagcttacctgtcttaaggccaccaatggtagagtccctcatcatcccagtcaaatgtcagaaaagccaaaatcgagctgcattaaagaagaggggctgaccaggagcagtggctcacacctgtaatcccagtactttgggaggccaagatgggtgggtcacttgaggccaggagttcaagaccagcctggccaacatggtgaaaccccttctctactaaaaatacaaaaatgagctgggtgtggtggtgcatgcctgtaatcccagctgtttgggaggctgaggcatgggaatcgcttgaacccaggaggcggaggttgtagtgagcgaagatcatgccactgcactccagcctgggtggcggagcaagactctctcaaaatgaatagattagatagataggatagatagatagatagatagatagatagatagatagatacatacatacatacatacatacatacatacatacgtagagagtgggggaatatggaatgtccaagcccaacgttccttacctccagaagagagagaatcctgaggtgctcatgtggagaaacactggccccctgtttgcttctgattttaaccttgtggttgccgtgtctcctgtaacacagtgcagaggaacacctcctctaaattgtgatttctcagatggatgggccccgttgggcagattgtgtttaggactttgtaaccaagactgtcactagtgggtggggtggcctggtgcggtctagctcagtaggggaaaagggcagccaccatttccacacctcagcacacacctccatgaaagccaggggctaatgtcccagagccaggccatccgcccacttacccctgtgtgggcagcccttggcctgctagcctatgaagcctcagggcagaactatggctgttaaaaaaggaaaagcattgcctttggctttgttgttgcaccttagtaccacttcctggtcattttcctgtcaccaccactcctgcctaaaccaagagcaggggaggcatgactaccatttcattccttcctttatggaacttgcttaggctgcctgtgtgagcagccctggaggatgggcttctcaaagcttttctccaaaaatttccatcaacggtgctgagcatggatacctctgtcagcagcaaaactgtttagctgggttcagccgggcgcggtggctcacgcctgtaatcccagcactttgggaggccgaggcaggcggatcacaaggtcaggagatcgagaccgtcctggcgaacacggtgaaaccccgtctctactaaaaatacaaaaaaaaaaaaaaaaacaaaattagccgggcatggtggcgagcgccggtagtcccagctactcgagaggctgaggcaggagaatggcatgaacctgaggggcggagcttgcagtgagaggagatcgcgccactgtactccagcctgggcgacagagcgagattccatctcaaaaaaaaaataaaaacaacaaaaaaaaagactgtgtagctgggttcaagcatagttcaatggcattccttaggttctgttttaaaacagcagtcatataaacacatttactactgcaaaattgagtccctgtgattcatagttttcagggcctaagggtagagggttgtggccctgtaggaggctggcagctccatctgtaaggccggaagctttgcgggggtggagtgatggctgccagtggcttcttagtagtgctgggttggccagcagtgagtaactgacccaacaccttctgtcttaagcattcaggtagaactggaagccgaggcggaaaagatgcgggtgtcccagcaagaattactttctgttgatgaatctgtttacactccagactctgatgtggccgcaccacagatcaacaggaacctcatccagaaggctggttaccttaatcttagaaagtgagaacgccaccgtctgcctctttttctgaaatccgttttccctaagaggtggctgaaaagcaatcttacgtgcctcattaaagtcagagggaggtgggtgggtgagactgggaagaactcccatcacagcagccctcccacttgcaacacaggaaacctctggggcccaggcgccaaactgcactaagagatggggctggaaacgagtcctctaagagcctggtgctgtggactctggtcactgtggccatgtgcaaacagaccactcttaactgttgccgtcctggaccactgacagtttttatcccctcatgccacttcccccacaccagctggcagatgagagccatgtgctggagacctacctgcaaggccagaggcaaggtcaggaggcttttagagtcagttcgattcatactgattgagtcacacatttaccactcaggtctttaagtgtccgttttgaatggaagggatgatcaggtttaagtatttctgtgagcagagaggatattgtcatggtgtggtgtgaaaagcactgactttggaatcagacatcccagctgggctgagccttgatctcttcatctgtaaaatggagctgataactgcacctgctttacgaagttagattgaatgtggtcatccctcccaggcagtgagcactcagatgtcagccgttgccatttggggaaattattggggcaggaaacccagtgcctttggacatagttgctactcagtaaatactgagccaagtaaatgtgtttgataacccccagtggagggtccatggagaggaactgccagctgttaccaggctggagtacctctaaggtctgtgaacttgcagcgatcacaagctaaatgtcccctgtagttctgcagatgtagaaaacctaccgggttctgtcgttatttgccaggaactagattttccttttgtaagctgcccacaaaacaagaatgaccttcaattacagcaaaatccagtctgttgagagcctcctaggactatggggtgggtgctgtgggctaaggcaaccctgactagattcagagcagctcagctccaggtgtcagagaaatgattctccaggtgttcagtccttaatggtgtcggactcattctagttgcatctcctggtttagtagtcagcatgtggctgtggtgcggggagtcggccctgggactggtgtctcccttggaagcagagcccatgatctcccagatcattccagctaaattgtacccttctgctgctctttccacttgaatgggcagttttgctttaacgatataaagaaacacattatttctaaaatgccaccagtacccataacgaggtagcaagacttggaggtggccgctggtgctttctggtactaatgggctttttaaaacacaactcacagcaaaacagggctggtcaccaccacctgggagaggctttatttcttcacccaaggcgggaatctcatgtgtcagcccaggggagccgtggctggaggtttgatccaggacctggacaactgctcagtgatggccgtggattgcgaagaccggcgctactgcttccagatcaccacgcccaatggaaaatcgtatgtttcacgcgttttatttgggaggagaatgagtatagtggttccacccgttccaagggcctcctagttcattcctatgtgccagccctctgtgggagaggccccaatctgggtattgttgacctttcaggaggatgattttctgctctctttaaacaagcccgcatgacccataagggatccagcctgccttatcccatatggagataagtgagggtttgtctgtggctttggagaagagatgacctacgtgtgtgagacagcaacagaagtcgtgcttgttagcatagattctcagagagagaaggctgtggctactcctagcctgttgtaaagaagcatttgtgtttggattgcagcaggggagagtaactattttggtaaggacgaccttcctgagaaggccatttttccagcagaagcaggagttgtgagaagtgtactccactgcagcagcatcgtcggctgccaggctgttcccacatgtcctgtgtacctgaggggccccaaagaggtggtactttaccaatccgcaggctgtggccattcacagtagatcccatcccagtgggatcccctctcagagtggtggtttttaaactgctccaaggagttcagggtcccatggaggggcttcagggtcccatggaggggcttcagggttcacctgcctggggagaggagtggccctgcccgtcatcagagccgctcttctcacactgcattctattaagatttgacctgaacagcaggggtaggggtggggacggcattgggatgatgtctctcctcccagcttggcagagcagctttagacctcatccttcctgctttggtgatgggaaatgacctgggaatggagattcctggatgctcatcatggtcctttgcagttacctcctctgggcctcactttcctcagatataaaatagggataagatctatgttactccatctgccacagatgagaggaacaagggaactggcagatgtggggtctctttaaaaagttaaagcctcggctgggtacagtggctcacgcctataatcccagcactttgggaggccgaggcaggtggatcccctgaggttgggagtttgagatcagcatgaccaacatggagaaaccccgtctctactggaaatacaaaattggccgggcacgttagtggtggcgcatgcctgtaatcccagctactcaggaggctgaggcaggagaatcgcttgaacctgggaggcggaggttgtggtgagccgagatcacaccattgcactccagcctggtgcaacaagagcaaaactccatcaaaaaaaaaaaaaaaaaaaaaaaaaaaagagttaacgcctccacaaaggtagggcagtattactgttaccttattcccgggcctccatacgcagcagacttttcagttctgggaaaggagtgaatgggctgccaagtccttctttgggcatggtttgaggagtggctgggcttggagtcctggtcatcttggatcattagaggaggtcaacaggtggatctcactgtacaaacacagatttgggctagaagatccgagtcccgccttctcatttcatagatgaacatgctgaggcccagggaaacggccatgtttgtccaagatcacatagtgaatcagggcagagccagacctacaagcccattttcttttttctttttcttttttttttttttgtttgagatagggccttgccctatcacccaggctggagtgcagtggcacagtcaccactcactgcagcctcagcctcctgggctcgatcgatcctcccacttcagcctctctagtagctaggactacaggcacacgccaccacgcccagctaatttttgtattttttgtagagagggggtttcaccatgttgcccaggctggtctcgaactcctgggctcaagccatcctcctgcctcaccttcccaaaatgctgggactgcaggcatgagccactgcacctggccctggaaccccattttctttccctctcatcatgctgccttcatggcacttttcctcccacaccccagctaagttcagtttatgtagagaaattcccagtcactgagatcagggaagcacttaattacttagacacttttgtttcaggggaataatcctccaggctgagagcagaaaggaaaatgaagaggtaaaaattttgtttgtcatatttctttcctaacgtggtgggtgactttgggattcagtgttcttttttaatgtcctctacagtggatatgtgcaataaacaacatctccagacagatctacctgaccgacaaccctgaggtaattatcagccaccggcatctcagcccttttctcaacctggaaggtaagcgtccacctcctgggactgagtgtgtcttcctgtggatttttaggcagtcgcgatcaagttgaatcagaccgctctgcaagcagtgactcccattacaagttttggaaaaaaacaagaaagctcatgccccagccagaacctgaaaaattcagagatggaaaatgaaaatgacaagattgttcccaaagcaacagccagtctacctgaagcagaggagctgatcgcgcctggaacgccgattcaattcgatattgtgcttcctgctacagaattccttgatcagaacagagggagcaggcgtaccaacccttttggtgaaactgaggatgaatcatttccagaagcagaaggtaagtgactagtttggtgtccttattctttcctctgcacaaaatgacaacggccattgaaataagatgtgaaatcatgttttagagagctatgattaggagtatgaattaagatttgttgttctgaaagtttagtaagatatctgcagtggaggcaagtcttggataaaaactgaggggtagctgaaagaccacctacagctatttcaccattagccatagcgtttttgtagcatagcatagaaatgttgtgaaatctgaatctgttatcacattcaaatgcagtcttggtgaactggaaatacgctgtgtcattttagaaaaccaaaagc

SEQ ID NO: 2743 - DNA, 1729 bp, Homo sapiens
gtaagacagtctcagcagcataaagaaagctgtctagaaatacagaggagggagagattgttctggctgactgtagggctagagaacagaaatagaatcagaaaagaggacgagatctgtggcatgtgagggtgagggcatttacatcagtccaaatggatgaagaggagattccagtctagcacagcatggccagtcagagtagaagggaggccccagcatgtggggaagctgcaattaactttttaccaaaacctacccctggtgaggcagaacagagagaaataataccaaaagccacccaactgaaaaggtcttcttgacttcctggactatgatgaacggtcgtcttgagaagaccccctacaccaaatgcgcgtatcggaacctactcactcagaacagcatgggttagttccacttactggtttaagaaagctcaacgggcagaggaaaaataaaagctgctgtctccctaaaagcctcactataatacctgtagggtattacatagctgtgactggatttaatcagttaaggtcataatcattagcattcattagtgtcttttgaagtcttaaggaggtccagggagattcagatcctgaagtgattttgttttggctgttgcctgctgggaaaccaagataagagcctccagagaccgcaaatacaatagaggttcacagtggaaggattcttggctgaatctgttcagtaaggttagtcttgccttccagagagcctttgactggtaaggatgtctgagtgttattcctccactgagctcttactgcgtacctagggcaagttgttcccccttttagacttggttttctcatggataaaattgatataatgatagcaaggctaagactttgtggaggaggttttatgtatttatcatagtgcaacatgaaagtgagtgcttgattgtgtgtatgtgtctggagagcatgcatcacaagtgaaaaaacatctaaaaactgagatacgtttgtcttttcttttagtccattatctccaaatgacagactagactgacatcacagacacacattcaatgagctgtttgcaatcacagtcttcatctcttggaaacattcgtactggtttcatttcaaaggcagtgctgtctaaaggctatgaagtatcttattggaaagctccagtaaacagtatcttatttcactgagaatttctggaaagttacttcagaatttttcaagatggtacaggacaatcctgctctactcaaaagaagcaaagggtaatttagtagctgtggggtgaaattaaatcatgttgccaaaacagtgtgaagaatcttgctgaggactttaatggtatcattctcaatttcatgaaagctaagtacaacctagggtttctgatgcactctcttaccacacagttctttcatttaatgtttaatctttaccgccgctttgatgtatggatttgtttattttgtaattattttgtttaagacactctatgattatttcactgttgtgcccattcttgcaatccgtggggttttaaaaaatctacctatcgcaggcaatctctagggccattctgccaaaagaaaatagtaggattaaaatcccacacacatgcaagaagcagctaggaatatagtggagtcaatttaaatatatactaaacacaggacaaatgcatcaagtagaatgcagacgtgattccattccaattccaggcttct

SEQ ID NO: 2744 - DNA, 4557 bp, Homo sapiens
gattcactgggttatttactgatttgtggacttaccacatactcagaggccaagccctgtgctggctgcagtgatgttgagatggatcagccctgcctgtgaactcagtggaggaggcacggggatgtgaaaaaggccagagaagtgtgccacagcggggtgcaccgatgccaggaggggcaaggacagctgaggacgactgaacctgtgggcatgaggcaggaacgacagagcagggcatgccaggcagcaggcaccatgtgcaaaggcatggcagagcagagcttgttgggcaccagggcacaggctgcccagcacttggcccttgtccaatggggaaatggagtccttgtctccgcaggctccatctatgagatctctgggaatgagtgctgcctctccacgggggacctgatcaaggtcacccaggtccgcctccagaaggtggtctgtgagaacccgaagaccagccagaccatggagctcgcccccaacttccaggcggctgagtgaccaggctggggaggatgaggaggaagagtgcaaagaggaggcagagagcccagagcgggtcctgctgcccttccacttccctggcagtttcgtggaggagatgagtgacagccggcgctacagcctggcagatctgactgcccagttttcactgccttgtgaggtcaaggtggtggccaaggacaccagccaccccactgaccctctgacctccttcctgggcctgcggctggaggagaagatcacagagccattcttggtggtgagcctagactctgagcctgggatgtgctttgagatccctccccggtggctggacctgactgttgtgaaggccaaggggcagccagacttgccagaggggtctctccccatagccacagtggaggagctgacagacaccttctattatcgtcttcggaagttaccagcctgtgagatccaagcccccccacccaggccccctaaaaatcagggcctcagcaagcagaggagacacagcagtgagggaggcgtcaaggtactagtataatcccagagggcacggaggggtcacctattgggatcactgcttctttgtcatgtctgcctgtcatgtttctcttgcaactgtgtaaacttgtagtttataaacttgcacactttgcacccattattctcattccacctcacaattaatcctgaggttggcatgattatcagtatcttatgattgagaaaacaaggacttggagaccctaagacttgcccagggtccctgttaataagtgggaggactgaacttggccatggacagtctaactccaagttcatggtgctttcctctctccactactgctgccttcactccctagttcgagcctcatcatttttctcctaaactacttcagcaggctcttacaaaagctgtcagaaaggcctcctaactcctttcttagtcattgatggacctcagctccatcttctggaaccttctgtggctgcccatcatcatgggatgatgcaaaccccttaacatggcatccagggtcctttataagctgacttgtcgcacctccccgacccatcttcctccactcactctgctgtccacgctccagcgagagaaatgcccgcagctccctcatggcgccgggactcctgctccagagccccacacccaggccttctgccagcagtgttcttcctccttcaggctcacaggcaaggtgggactcggatttctcactcagcagcggtggtcctgcctcctcttctgtgctcccactgcacgctctacgtagctcaggacaggttgtttttagtgagtcctacctgagtctctggctgaaaagagttctgtcggggcagggaccttacctgctccaaggccagagaggacctgctaaacggggccaaacagaatcacagatgagcgggagagagccaggcatggggtcagaaagactaagtttacgttccggttcacttactctgcctgtgctgggtactcctccgagcgtcctttttctcaccagtagacctgtgatatcctctgcagctgctttctgtgacctgcttactctgtggcaggcccctgatatgctttgtcccaaccaattctcacagtgcttctgagttacacaccggtgtcctgcttcacagttgagaaggtgagaggcacagagaggtcaaatagtttacctgagatcacacagccaacaagtggcagggccagagcttgcaattgggtctgaccacacagcctgagcttctaactaccgtggtctgctgagaacgggaggggatgagacagatcaaaagtcctttactatccccagctcttgttttgggatcttgggtgactcgtatttaatcacgtgtggtaggcagcaggtggcagtggaaattacaagatgactcctgagtggtctcagccccagcaggggcttttatctgtggcgtgagcgtgggaagtcattttctgacaatggctggactgaaacatccgaaacacaggccttgtgccagtgctgaaaagggtactttccagaaccgacagaccttagcccgtgtcttggctcccagtggagggactctgggcccggtcactgctgtcgccctggaaccacaacttttcccctctgtgcgttggaatcttggtgctgatcagggagctgtgccgcacactctgtaaagcgtggtggggcgccaagacctctgcctctacaggtcacaggcgtggctctgggtccaaaccttggccctgctgtggatccccgtgtgacctttgacaaggcacactttctctcctacataaactgggaattgaaaccactcagagggtaacttgaggattaaagagcagacgtcatgtagcatctggcacatgggggaacgcaatggaagtcctctttcttctgggccacctcagctcaggcgtcgtcacaaggctttgtggctcctttcttacggtatccccactttgcttttttccccttcagcaagagaattaaaggacattgaccaaattcctaagtggaaaatcccaggaacaccctgtctccaacccccaaccctatcctcattttctaccctgatccctttctcccttgccagagaatatttcacatgcatgtagcaaaaacaccaggggtcttgagaggtcatagcctgaaaaggaagtagagagagaagcagaggaagtgacacttaacgtgaatgaccgtttttcatggactctgcttccccatttcttgagaccctgatgatttctgctttttctcccaaagtcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaacttggcttcaagaacacaaccttaggaccttgggccccaaaagctggtggtgaaatgaggaggagccaatttaagaagacccttatggagacctgaggctgcagaaactggtaggtttcatcaggtggttaaagtcgtcaaagttgtaagtgactaaccaagattatttcattttaaaaccatagaataaaaatgacacctgagcttctctatgaatgagaacggtatcatttattaaattctgactgcgtgccaggcacttacaaaccatatccaaatcctcaactttccagaatgcctgattttaaagattagggaacaggctgcatggtcaagtaccttaggacgctgacaagttgcagttaagggtgaggacctggaaagtatgagactgggttaggatcccagcttgctacctaccagccagggctatgagcaagttattttaacctaagtttcagttttttgacatgtcagatgaaactatagttactaccccagaagactgactgttttaag

SEQ ID NO: 2745 - DNA, 928 bp, Homo sapiens
gtgaggggcatgggaaggttaagactccttaggagggtctaacaatgctcagctccagttggcaatgactaaaccagaggacttctaaagacacctccaaccttcccctttgtgatttctagtctgtgtcatacataactaatggccaaaattcagagtaaaaatttttcagtgattcatgtaacgagctcatccagccagacatggtggctcatacctgtagcccaagctattgggaggttgaagtggggaaattggttgagcccaggagtttgaagctgcagtgagtcatgactgcaccattgtactccagcctgggcaacagagtgagaccctatctcttaagaaaaaaaaagaatcaaaaaaatctcatccagcccaaagcactcaatagtagagtacctcttttgccacatgtagtggattttattggttcttttgtgggatgcatttaccagattaccctactcctacctctaactcttccattaggatagcaaaccaaacagaagagggctgtcattaataacgttctacttaataggcacttgatgaacatcttccacatttggtgtaaattccattcaccctgcgagccacccatatcctgtctatctgaccgttgggaaattgattttgttatttttgcttctccctggaggactgcacaaagttttaagacaggcttggcatgagccacagcacccagcccagagaaacctctttatgtcccatgagcattagagcagtacccagaaccatgtaaggtactagcagtggtaaatgcctggcaggctctttgctcatcttcctcctaagccaggaacaggcatcagccctcacccagagcacttggatctccccacgtgtgctaagatcccttcgcagcatggagcttcatgcagcaaggccgatgacataagctggc

SEQ ID NO: 2746 - DNA, 16948 bp, Homo sapiens
tgaggagtgaagagaccgtgtttacagtcaccagcaggctgcgtaaagaagtggcccagtgagacagggaaagtgacccagaaaatttagttttgttcagaatgaaagctgctgtatttcatttttgtttcttaatttgacggagtaggaacgttattttccttctctgtcattgagaccagtagcatttctatgttacaaactgaagatatttggggtctcgtcggcttgggattatcaatgcttgggagtgtgagtgaagacactcaggatggctcaaggatccggggatcaaagagcagtgggggttgctgacccagaggagagttctccaaacatgatcgtttactgcaaagtttctcaaagggctgaactgactcaaatatactggggactccctctgctcctcacacctgcccaggagggttacttctcaaggtcttgtgccagccattagtgttgtccactcaaactgctcaggaagcgtggtaagcacggtcagttgtgtcagcatttgcacaaagtcagtgacttacggtgcttccttgtggaggagttctctatccaatggtgccaggcttggccatgtgacttgctttggtcaataaaatgtgagcagatgtgatatgactatccacatccgtgcttaggctgtaagagccatcatgtgactcagccatgctcttctctctgccatgagaatggcatattaccataggaaatagtccttcagcctgtggagatagggcaaaacagagccacggcccacctgccactggcatgtaaggtgagtaggaaataaagctttctttgtagtgtacacccctgtgattggaaggttatttgttactgctgcataacttagtgaaagacaacttatatagtaggccagagacctgccaactttttcttaaagaccagatagtaaatattttaggcttgtgggccatttacagtctgtcatagctactcaattctatggcaaaagcagctattgacaatatataaacaaataggtatggctatgtgccaataaaactttatttacaaacacaggtctttggcttgtgggctgtagtttgcccacccctgccataggattttgcttcctcacctccttgaagttggatgtggccagtgaagttgggtgtggcacttgctttgcctagtggaatgcaagctatttaaagaagtggtgtaagtggtggctactctgtcagtctgagtcttgagagataccattagagagctgagcatcggccaacctatgctggacattcagcataactaagaaataaaccttattgtttaaaaccactaagatgtatggggtgtttgttactgcagcatatataactgcgcctatctgtactgatacaggtctatctggcattacgtttcggggcaccacctctgctcactgccatcccagggcacctcacgtggcattctttgttactgacttctttataatgtttgcgttgtagaccacgatgacagaatttacttaacgatgatgttttgattatcatgcaagtgtgggggaggattgttctgttgaaacagcgtgactgcaaatattttaccaatagatcagtgaaattcacgtgcccttgaacattttcaaaggtatgaaatcacctgaaataattttttagttcattttttagtggctaaaatctgttaatagtttgattcacaagcctggcctttgaaaaagtaaaaattggataatgctgcacaagccatgttctccctggtgtgtaagggttaattattggactcttgcttgatgatgacagtgcaggttcattgaagtcatcactttatatcaccagcctgtctgcagcactgttggggccacgcctcttgtgcgatggttggctcagacctgtagcttcctttgccttatcccctttcacattgaagcctcatctgctgcttgacagtgcatgcctgagagttgcttttccacagtccctgttcttctcctaggtctggttaattgcttctctgttaaacagagaacatgttgaacagcagccttaaattattgtccaattttagcctactgggaacccctctgcagctactctgatcaccactgatatttctagaaagttcctattcacaggggactcttttctcccttctttatgctcaagggagaataaatcacagaagcagcaatccctccatgtgtcaaactatcaatcctacatggagctacaaaacaaaaggcagtatccctttgttgccagagaacatccagtccctgtacaagtctgtgcctcaggggctcaggctcattagcaccatagcagtggctcatgctttccatacacttttctctaccaacacctacagttagtctcagagttgttctttatcatgataggttacagagcagtgttttaaccatattaccttgactgaggtatggtgaggccagatgtggatcaagagaaagaaacagggatggattttatggttttgaggctcacagttccctggggagacacagcaggctgtgctgggccactcagcggaagcacagagtgaggcatgaggcagagggagatgggggatggtagggaagcagctttattgtcgtctccagggaaaggaaaaggaaaggcagggtatgcaggtttaggattggctaatttgaaaatgttcttggggctctggggcatagaggctgtccccggttgtctcatacctggccccagggtgatgaggtaggtccacggtggcctagggtgcaagagccacttaagggaagtggtgggagtttaaactacttggttgactcctcaagaaggggaactgactggcctctagctagggcctcaaaacagggtgaagacagtatagaataaaaaatatattacaactaggacagataccaacatactgggggtttgtacctaccacagttattccttacatttatgtttcattttgtctagtaatagtgaagtgaatggagttctagactgaagtctctgtttaggcagactctgaatttgttttctcattggttcccagagatggactgagatacctcagtcctgtggatacctcaggcaggcttaaaatgtggcacaaattctctttaactattcagttgatactttttcgtgagggcttcaaagaggctgattttctattgctaaaaattgcatacctctctatgttcaaagaaaataccatttactttatatatgaaagagcatttgcttatttggaaaacttttatttgcatttcacattttttatcacttcttactaaatagaagtttctcacattctctagggattgaactaagtgataacttagaaagaaagtattgttcaaatacccattttttggcttttatgttagtaaaatgtttcccctttttctagcttttctttgtgatttcagaaacgtgcaacttctttgaacgcatattaaatgtttttaaatttaaataatgaaccacttgcttttgttacagcccagtggttcttcttgcctgctgcacagacagagccaaggcactgagacagtagtgttgcagcgagaaagatttaattattgctaggcagtcaagtgacagaatgagaggcatttctcaaatccactgccccaagagctcagaggctagggtttttaaggataatatggcatgcagggggctagggaataggtgctgctgattggttaaagatgaaatcattgaggtcttcatgcactgagtcagtttctgggtaggagtcacaggaccagttgagtcagttccctggtgtgagtcatgggtccaggtagagtcagtcagtagccagaatgcaaaagtctgaaaaatatctcaaagaccaatcttaggttttacaatagtgatgttatctataggagcaatttgggggcattaccaatcatgtgacctctggctagatggctcctgagcagtaagaaattatagaaaagcaagctaggggacaatggttggttatcatttagttactcctacattttagcagaattcaggcccctcccataattctaaccttgtcgcttttcattagttttacaagggtggttttcagtccctaaacaaggagggggttagttttgggaaagggctattatcatccttgctttaaaattaaactgtaaactaaattcctcccatagttaggttggcctatatccagaagagttagcttgggaggttagaagcagaatggagtgagctattttgctgactagctttctgtcattgtcataatttttagaaaggtggtctcactcttagtaaacagtagtatgctatgctttactcagttgtataatttcatttgaattcaacaaataactacagacagctgtcaacttagtgatgttgagattggggctaggcctgcagtaatcctctgaaatatgtatgtgcaccccaaaaacatgtcattgagatgggtagacacctgcaagaggagtgcttttaaaacgtttttacatgaagatgctttctacttcagtgagacttttgccagtggtgttagaagttgctgtgaaaaccaagataaggagccactgtgtttttgatttgttctagggatttaatatccctcatagttaatcactcaggcaattactgggttaacaatatgtcctgaagaagagtagtttttgagccatgttctttgaatcactaagattcttcaaaactgctttagagtttcccatgaacatttggatcacattaaagcaggctcattatttccatcttcatgtccatgtaaatgaggttgagttcttcacttggttctcagctttagtgttgttagtatatagaaatgcacctgattttttatgttaattttgtatcctgaagcttcattgcagtcgtttatcaggtctaggagtcttttgcaggaatcttttgggtttctctaagtataagagcatgtcactggggaccccaaaagtgaggaaggtgggagagaagtgagggttaaaaaattctctattgggtacaatgttcactatttatgtgatgtgttcactagaagcccaaaccttaccattatgcaatatacccatgtaacaaacctgtacacatactttctgaatctaatataaaataacaaagaaaaaaataacaaaaagtaggctcgttagtaagacaatagctgaggagccctgaggattggtcaccttctagcagagagaggaagggccaagctgatttacaacagtcctgatcaaagaagggtgacctgtccagggcaagtccacaagcctccccctctgtgtcatgaggccacagagcactggagttccatgaagtcaatggaaaagaagagttctactgcttaaacaagtttaaaaaccactgctctagcattgtttataagaaaagaaactaagaataaaaacaatactgaattcaaacagctaattccttaagacctgggaacattgtgtgttcttatgcagttataatttaatccaaatacattggaaccacaccataattcaattctaggtcaagagcagagttttgtatacagcagattcattttggagcactctctggggatttggttacagaaaaatccagaggatttatctgggctgtcttactcataaaactgcacaatggcctagattttagagatgacattacagtgaggtctcctccaggacatgctatggtatacaccactatacaccacttaatctttagagggctcatttgaatcacattatttatgtagtgtgtccacatgttagatttggccagattctcaaactggggtgtcagttccacgtctagcccattaatttgttgccattgtgaagacagtagacttgaatgccttcagaaggagcatgctgtactgcacaagtgcgaggggcctcattcctaaagtgatcacactgtgttttagggaattgtgcccctttacaatgctgtgactttgggtgacactctctagcttctatagtacccaagtctgggttgcgtctgaatttgaaatctctactatgagactgtattgtttgtttttaaagtcgatggagcacttgacttggagccagaagagaaagcttgggtcttcacgcttcttgattaattatcaagccagttaattttctagagcctctgtttattcatttgtcaaatgggacaaataatgtctgtttcacagggcttgttgtgaagattatactctgttgtgttatagaggtttaaagtggacctgtgggtttgtatgaaatacagcaaggtaacataaattaaaagtagatgagggataaaagcggggaaagggtctaaaatggggttaacaagttgtaccttttgtgcagatctatatgcttgctaggaatgagccacaaatttgcttctgtgccctctagcagccaaggagaaaatggaaaccttattttctttaatcatggtgtctacgagattgggaacacagtagggagtcatgaaaaatattccttttcctagtaacttaacagagagagaccaccctcaggggtctgcaaaagaggacattgcatggtacagcctatagtgtctgctacacagagaggttgcaaactggcagtccaccagtgtcaccatttgttgggatttttgttttgttttgtttaggcttgatgtctaaaaagtttgatccaacatttaaaagaatcagattttgcaaaaataacatttttaagttttctttcaaaatcagatgatcagttaatattgtaactatatatcaaaattaattggcactgtgtagcagcttttttttaatgtagcaatgatttcaggtttgccacagtctccaccattccctactgccttacttactacattttatttcctacttggcatttaggcatctgatttagtgactcctattctacagcatccttgtagtaggctcagcagtacgcttcataaggctgagaatccctgagaggattgattgatatgggaaaatgctggtactctgtacaatattgttctacaataaaaatgtagaattagaatattgaagttactgttagaactttgaaatcatgactgagggtttaaaaatgcttaatgagggccgggcgcggtggctcacgcctgtaatcccagcactttgggaggctgaggcgggtggatcacgaggtcaggagatcgacaccatcctggctaacatggtgaaacctcgtctctactaaaaatacaaaaaaaaaattagccaggcgcggtggcaggcgcctgtagtcccagctactcaggaggctgaggccggagaatggcgtgaacccgggaggcggagcttgcagtgagccgagatcgcgccactgcactccagcctgggtgacagagtgagactccgtctcaaaaaaaaaaaaaaaaaaaaagcttaatgaacgagagtctcaaatagctaattaaaacaacctcaacttccaaactaatctcctagcaagtagtttacccagagtatccattccaattgctctttaatcaaataaaaatttcagaatattttatttaaatatttacatagctatatattttcatcagaaaagagtatcacaggaaagacatgttttaagtatgcttttaactgtataaagtttgattgttaggctctatgatctggtgacaatagtcgttactgttagaggtgaatccttgtaaagttgttatttttgtcaaggtccactttggcttctagacttgttgagtttggtaagatgttttgagcgctgagttgctaattttccagaaatgtaatttgcaatgaagatgttggatggggctttcccaattatcagaaggaattctccaaagttgaaaatgagtgataattatctaatattctaaaacatgctgctagacatggatatagagtgtttaataaaagatgtcaaagttgtgttgtggccaccagccaccatcacagctctagccaacattagagatgactggtgatctaggaggagattgtggagggttatctcagtgaagagcctcataaagagtattggggaattttccctcccattgccgtggagagaagagatgagtgctcttaccctttccccaagccaagagagaagagctctgatctagagataggggttatggcaaccatgggagattggcatctcacttcccacttggatgcctgcggagctctctccaggcccatcagaatggagcacagcgatgattttagggatctgtgagcatatatacagatgcttccaacatacagtatttgatagatgcaaagttgctagagcagcctgtgaaagtgaggcaaagaaaaagatgttcagtggttgacaagctcaacttccaccatttggcagagaaagatgtgtacattttcgtggggccaagcaacatcaggaaaggtagagagtttgagcaattgttgctggttccttgtccagaggtggccttttgggttgaggcaacccagactgtgagaaccctgacatgtatgttgaagtagaagatgtgtgttttgggggaggggctcacaaaaggctggtcaaatggttcttccaccatgctagggaacttggaatagagggtccatgtgggcctctgaagaacctacaaatgcaccctgtgaaggtcccaggatgtgactgcctgccttgcacagctgactttggtagccaagagaattgaaaacagcacgacctgatgtaagaagatgttccgtttcctcaccactgatgtcacttccctgtgttaacctgagaagagctacggcacagagtgatggaggagagaatgaaagcagaggaggagggtaaaaggaaaggctacagtcccttccccactacaggtcatacaaaaggaggagggaaaagctttgagttggatatgagattgaagttttgatacgaaattactatacttttagtaagtgagtgagtcttagtttccataaataaggctattataagtgaaagtgatggaaaaatgatggggtcttcctgagctgtccagctgcagggaatggagatccactggaacaagtcaaagataataataatgagaaaaaaaaagattcttaaatccccaccattcaatgaaccagttaccaaacccacacgatacagagacattgagattccaatatgaatctctccacagaaggaggcaccttctcttgccatcttctgtgtattataaccatttttgggggggtttggtgcttcttgttcaaaattgaagtcttgtagccaaaagtcaaaatcatattcttctaaaattcacttgaaaaatatttccttttacagttgaattaaagcaaattacttggttaattaatgtcaaaggtgactctgttctagagataatttctgagtcatgatacctaatatttaaaaattatgttttgatttttatctttagtcatggtgatttcaaatgaggttattaaatcactgtaattcatgatttatataaaatatgaagacattaacctacaacatcttggattgctttttttttttaattgcattagtcactagtaccttctaacagttccagtttttggaaggcagcctctagtttcctattcagcctcatcatagctgttccttttggagagcggtggagaatacaggattgaaggtgaccctcacagcatgacaaattgtcaatctggctccctcagaaaccttatagggagtgtattagtcagctttggctgtcgtaagcaagtaccacagactgggtggcttaaacagcagaagtttattttctcacagttctggaggctggaaagtccaagatcaaggtggaggcctctcttcctggtttgcagaatcccaccttctcactgtgtcctcacgtggcctcttttctgtgcacttaagggagggagagagacagctgtctggcgtctcttcctcttcttctaaagacaccaatgctacctattagggcccatctcttatgaccatagttaacttccctaaagggcctatctctacatatattcacattggggattaaggtttcaacatataaatttgggggcctggggagaacacagttcagtccataacagagaggaagaaagagattcttaaaaagtgttctcttctgcaagttgacatttctgaaaaatatgtttattctccaaatttaagagacttttagaaccaattacctgtgaaattttcttttccaaatgaccgaaactcaactcaaactagctgaagcaaaagtggatattttttggctcacatagcagatggccaagggtcagatatgtcagccacagctggatccagggtcgatgtcatcaggtctttgtcctccccttgagctctgtgtccccccatgttggcccctcctcaggagggtccttttcctgtggtggcattgattacctggggcagctccaggctgatctggcccttagaatttgcagctttaaatggagagaaactgtctcccaagagtcaactctgactgcccccgcctgggttagggatacatattagcagcctggacccagggcctatctgggtggttatgggctggcattcccaacagctgggagaggaccaaatgaaagattccaggcagatcaaactgtaaggcatgtccacagtcttccccttctaagtttctgagctaaaacaacttatttgtcctttgtgacttgtataattgtataattgatagtccagagaaggtccaaattagttcatctttatatgtgtaagagattctatctaaaggtcatcagaacctttttgaaagtcaactgatgtcatgttggcctttgctggtgtttctctgcagactctccggacgacccagccttgtcaccacctggagatttggctccagcctggctaaccacaggctgttgacatgatggctgtggtctctctgcactcctcctccaacctcccccttctctatcctcttatgcatacctattgttgtggtctaaatgtatgtgtcccccccaaattcatatgttaaagtcctagcccccaaagtactagtattagaaagtaggtcttttgggagctgattaggtcatggaggcagggccctcatgattgggattagtgcccttatcaaagaggcttgagagaggtctctcacccctttcaccatgtgaggacacagaagacaccatccatctgtgaaccaagaagtgagccctcaccagacaccaaatctgccagcatcttgatcttggacttcccagtctccagaactgtgagaaacgaatgtctgttgtttatcagccacccagttggtggtattttgttatagcagcccaaatggactaatacacctaatgtcacccatctcatgtgaatgtaggtgctcatctcttgcctgaaattcttggggtcaagtgtgttctggaactcagtttctaatttcagaaaggccatatcgtatacacactgtttactgacacccttagcagagtctgggacagcacccagaaatccatctcattaacatttctgcagagaaacacgtgaacattcatactacgtaggataaagaaaatcaatagtagccttatatcagttcaggtcaggttttgtcaccaaacacattacgagaaaggtttgttctcagggcttttcgtaatttcagaattgtaaacaagggatcccgaatttatattttcttgtatgcattaagtgctacctttgttggactctcagcagctaggactggtctccataaaatttaaaacttaagaaacattttaacttaaagcactttaagcagcactttccaaagtttaaagtatgtaagtaaatctgtgtgagtagataactataaagaacaaactttcagccaatatcttcactttgagtggttactggggggcaaagaattagaaagccactatgtataaaattaaacatttttatttgttcatttctttaaagtacaacttattttccgggagaggaaagtactctcaccaaagaagatttttacagagagaaatcaggtcaacttgaaacttgtttgcaactctctatttgtaacaacctttgtggggttttcataaaaggattttccaagtcttttgtcttcaagaacataaattagaggacactcttaccaggagtacatgcagtttaagtacccaaaaataagtttgtttaccacttagaatcatggagttcaagagaattttcaagtttgcaatcctgggtctctcccagggacattgagagggcagaatcgattctagttttgctaatgcgcctgccaactggtgtcaccatttcccatcacgatatctcagttatcccatctgtcagctctaagagtctttgatgtatttcaacataccatgctttcaggaacctctcggtaccacgttctggtgcttggcagctgtccaggatgaatttgatgtacctctccctgatgcctgccaggagggagttggaggaggggcttaaaggattttctggtaaatccaaatgatcacatatgagctgttatcaatgtgggagaatggaattaggggatagtcttctcattagaattgtgaaaattcaggatggtggaaatactcagtatgaagattttcaggttggctaagtgtatgtgaaatgtcctaatttgaaaaacactttggatttgattgaattagtggtgttaaattagtggggtgtggtgggcatggtgacacggtgctgggcatccttgcatacatgacggatcagaaaaccagcaatccaggcaactctgtggccaatgcggcattttgggtccaagccccttgaccctgtgtctctctccttgcttcatgggaaatcctgccacctggctcagacacaggcctgggggttaaatggagcatgtgctgccaggtactggtcagtgccctcaagggtggagaagacctcttgggaaccacagacaggctgtagggttgtcgtgtttgtctgtttttaagtgacaggctgcttgatctcatcccattagtagtgacgttgctagaggtagagcttgcaaccacccccttcccattaactctaccatcaccacctgccgctaactactgacggctacccaatggccacaaggcacataatattcacggagagccaaagtggcttgcctgtgtcattacagtagctctccttgttaagagtctcttaaccatttccctccttcccacaccccactcttcacacatacatgtacatccctacctgagctagagccctgcttccatccactttcctggccttccccaagctgcctgtgcaaagcctcccttttctgctccctcagcctccggtttcttcctttttctatacctttccccaacaatttcagcctttattaaccttttccttctctaactatcagtcctatcgcttttttgggggggggggcgggaggcaggtgggaggtgtacagctcctcatacttgctgttctgtttatgtatgctctatagcaaactatccccaaatctaacggcttaacacagtaaactgtttccctatcatcactcatgattttgtggatcgggaattccagccggactcagctgggaaattcttttgctcctcgctgtattgaagggggtcgctggatactttcactgggcagatgggtgaactggaggtgattaagatggcttcacatgcctggcgccttggtgggatggctggaaggcatgttcagctgggtgtgtccactggggcttccacacatggtggtctcaaagtagtcagacctctttcaggtagctggcttccacaagagtgagcatttctagagaaaggaagtgtaagtggccaagcctcctaagcctgggcccaggatcctctctgctgtattcggtggttgcacagttatgccgtcctcccagtttttacctagcccccacctctctgtgtgttacaacaaagtctgccaccactattaatcttccacacgtgcctcctccattctcgaatgttcttgaagattatattgctttctccaaacctaaactgtctcataagtttttggcgcttaagacaagtttcaagaaataagaattgaaaagtgttggaggaaagaaagtttccatctctaaccactttctcagaagggcatcagggtttttgcagcaatgtggggatacctcttctgatctcatagcttagggctctgaactaaactgatggccttttctagatttcttcctaggggtgtcaggttggaagtgctgagggactgctctttctccccagggctcagctgtgtcaaggctaagaccaggagtggttcccacagccaggctgggtgagggcaagtttatcctgcggtgcagcacctcagaccagggtctagccaatggtggcctgcaggctgaccccagtccaccacctgtgagcagccaccaccacctgtgtttatactacccatgagctaagcacgattgtcatattttgtttgtttgtttgtttgtttgtgaggcagagtcttgctctgttgcccaggctggaatgcagtggtgcaatctcagctcactgcaacctctgcctcactagttcaaatgatttctggctaatttttgtatttttagtagagatggggtttcaccatgttggccaggctggtctcaaactcctgacctcaagtgatccgcctgcctcagtctcccaaagtgctatgattataggcatgagccactgcacccagccaatttttatatgtttagatgattgggaaatagattttaaaaagaataatatttcatgatacataaaaattataatgacatgcaaatttcagtgtccataaataaagtttctttggaacacagtcatgctcattcgtgtacatggtagctgtggctgctttcacactgtgagagctgggttgagtagttgtgacagcaattattagatgacctgcaaaaccaaaaatacttgctatcttgctctttacagacaagtaacttttttgctgttcttgccaaagaccaaatgcatttttcaaagctggattccaggctcagagttacagcaaagagaacagaaagtatagctcatgattgggtgctgacaggacaagggagagagacgaaaaccattaggagcattagcaacaaatatattttttgccattccaactccatggagcaaatggcttcctaaaagccagcagagaaactaattacctgaactgggagaagaatgaaagactcattgttagaatattcctcagagctgaatcccttctttcagcctactgtattttagtgattcctaataaaagaaaaaaatgtatttttgtcctcacagccaattaatttctgctccaaagcatagaatatgattatttctgtcattattttagtttccagagtcattgatgagacagggaatgacacatacctattaacacactcgcacactcactcacacactcgtgtgggtacatgcatttccctagaagatgtactggaaggatctgactttactttcaggtgccttcatgtcctcgcaattattctacaaatggtttttaagatatttctattgtatttgttgaaattttcctgacattttgacttgtctagacgattattcttgcatccagcacattgtaggaaacactcatttgaaataccccactgtgcttccgggggagctcatctttctggagcatggcgggtccctcatgaggccctctttcgttaaccgaagaacaagctgcagtctgaatgtgagttgttaaaggtatggtattgggagttttctgttctcctgttttcccattctgtaatgttttctttctttctttccttcatttcatttcatttcatttcacttcatagcaacttttgaatgaaaacctccccacagggtttgacaggcaatgaaacttcctcccttgggaggtgtctcagcctgagggaaatggaacagcaccccacagaggattttcctcacttcctccctctctcctttacaaatcaatgttaaagagcctgcatggatgtggttagcaccatctctgccgcatgtgacttttcagtcattttcacccgaaataggatttcattcaccagttactataagctactcgtgccttctaatggactttgcagcagtgattcatccaccctgtgctgggagagagaaagagactttaggtgagaaagaatggttgggagaggggagacaggtaggcagaacagttgtggtaccatcccgccccataagacaataatgatattcagtgttaggcgctttataccaagaaatattccacctgacacattatcctggttgaatcttatgacacatctgcaaatagacattaccaaatacagagggggacttttaggttcagagaggttaagtgacttgcccagtaacacactgctggcaattcgacctgatctctctctttcttccgccttttccatttcagtcagtggcagtgccatctttccacctgcttctgtcaaatgtgttggtgtgatttgatttcttttctgtttctcttgtatcttttaatccagcaataaatccctgctggctctacttgtaagatatacccagaatctattacctccgcccccccaccacccaccttgctccaagcctccatcatctctctcctggagcactgtgatacccttcttcttggtcatcctgcccctgccctgacttccctaaagttgatgcccaacacacaggcagataaaccagatcagacttgtgactgttttcccattctttgggcaatcccattgcattccagataaaagcggaagtccttagagtactgcagtttgcctcctagcccacgttatctctggccttcctttctcactttctccctccattccagccacgttggcttcctgctgtctcttgaatagtcagggcctttgcccatgctactccc

SEQ ID NO: 2747 - DNA, 7676 bp, Homo sapiens
ggtggaacctgggctccatttccagctgcagggacagctcagaactcccatgtttcctcaaaaggttccctcctgctgctcacctgagctgcctgtcccagcacacagccaccatcaccagcaggttccccaagatggccatcaggataaccgtcgagagaaacgtgagcagcaccaccttctccactgacccgaaaccctcctcagaactgaaagacacacacaagcacaaagaattgaatgaaactctgggacacaagaaggaaaattcgtcttttcatcattgaccttcagaaaggtaacttcaccatcagctgatgacacatatatttatcatgcgtttaatgtacaccaaaatctgaaccggtcgcttgacattttatcctggttagctcctacataagaggagtatgaggcttagagagctgaattaacaggttattttccatccaagcacttgtggctttccttcagggcatttagttcaactagcattcagacatatgtagttgatgcctgttttgtgcacctactcaactagattgcaaaagctgagtgaatgaatgatagtaactttgcaactgcaggagcagcccaatttggtccaactttgtgtataaaatggtgagttgtgttttagttgccatggacccccaggttgcaagttaaactgaccaggcccagatgaaccaagcatgcaaccacagggtggaacctaagtgcttggaccaaggcatggggaccaaataaagaagtggacgtctcatggcatgatccacgatccaatcatatagagccctagcatcaccttgtggcataatccagtcagatcatacctcttggcattaacttatcacaagatccaatcagatcacaccttattaccctctacctataaaacctgccacagcccccagctcagggggacagatttgagctttgcctcctgcttccttgccgatcaacttacaatgaagcctttttttttttcctcaaaagccagggccatagtattggcttctataaacatcagcaaggagcccactgcttgctcagtagcaacttgaactggttgttactgagcaagttactttgcattcatacagttacttggcctgaatgcaaagccatcttgttacagtgtcccattccagcccatgcagaagcttctgcttacaggtaggttctcccagagagaaaagattgtggtgtgatggttgttcttacatcagttcacctggacaaattgaattcagattctgtgaagtctgttggagagatagtagccaataaataagctcagtggctcctttcaccaccctgatcatttcttttagtgcccacaatatgtcattgttttcccagttcaaatttgtgttcttgtcaagttcagcatctgatttagtctacaaatgttgccttccccatgtaaactcagcattttgttttattaacttgaaaatgaagatcccttttcaatgaaagcatgatatctgcagattaatattcagaagctatagggattttaaaaacttttatagtataataaaatgttctttttaatgaagtttcaaagaatcttaaaactcttagaccagcggtgtccaatcttttggcttccctggtccacattggaagaagaattgtcgtgggtcacacataacatacactaacactaacaatggctgatgagctaaaaaacaaattgcaaaaaaatctcataatgtgttaagaaagtttataaattgggttgggctgcattaaaagctgtcctgggctgcctgtgccccgacaggccatgggttagacaagtttgtcctagacccaaaccccacatttgaatatgggaaaaccagggcccagaaaagaagagctgacttgtcagagcgtgctagtggctggtctgggagaggctgcttgtcctgtgagcccaccactgagaacacacagttccaaaaatcaagaattctctgtctttcctgagctcttttgactgaaaattaaggtgcatgccctctccagatggaagcagcctgcaaagtcatggctttggccttgtccagaacttctgttaagctggcacagaagacaaggggccaaagggaatgaggaaccagtctggcagcagttggagaatgagaaagtccctccattcagctgagaagtatttttataggcagattgatagattgtttatgactgaagttcagatgaaaagaaattccagatatgcttatttaaatcacccttctacacttaagttctaactatcaacagtacaaatatcagatagggaagatttaattcaatgaggaaaactgtacacttagaaaaaagaccttaataggctgatgtggccaccaaaaattcatttgatcttaggtcatgttagttgagttaaagcactaacaaaggaggtgatggtggttctcttccctgtccttcttagagactaacggcccccctgaaactcatctcttccacccccagggcctctgtatttgaggtgccttcttcctggaatgattcttcagtgacagacttcttgtcattcaggcctcagattaaatttaacccccagttagtgtaccacagccaacaaacatttttcattttctttacagcatttactgttatctgaaatgacttctgttattgttttctgtgccccaattccacagattgacttttgttatctttttcactacaatctccagtgtctggcacaatatctagtctagagtatgtattaatgtacatgaaatgctatgtattaatattacatatgtagatgatgcattacatagtaagtgctcaattacttgctgattcagtgaaagagagatatattgtgctcataatggttatatttattattcaatgtctttgaagcctggttgaaagtatagagatttcacctagagaaaagaaggcccagagatgaaatgcaaaagctacttgcagctatctgagcgctgtcatttgaaataagagtagattcacatattcattcatttaacaatttctgagcacctactctgtgttaggcattgttgtatgtcctagggaaacagcaataagcaaaacagagagaaaaacagacaataaacagatgcatgagacagtatgtaaggtgtcagctgatagtacagtccatggcaaaaaaaaatatctaggagggtaaggaggactggatggcctgtggcggattgcagactggctatttaataaaggatgtcagggaaggttcaatgataaggttatcacaggttgtgaggctaactaagaccagtgggtgaactttaagcagtggttcccagccttacctgcatatttaagttacctgaggagccttaaaaaatgctgattctgggaatccaccctcagaggtgctgatttaattggtctgagttgcagcttggatagagaaatttttaaaatctcccaagtgactctgatgtgtaatgaattagagtcactgacagggaggcaagatttagtaccagataataagagccttctaacaattaaagatgatctgcaatagcttcccggtgttgttttgtgttccctggcacagaaagtgtttaagaataccagaatggcaatgagatactaatttgcactcattaggatggcaattataaaaaataaaacaacgaataaaaaataacaagtgttggtgtgaatgtggggaaatggaaacacttgtgcattgctggcgggaatgtaaaatgctacagccactgtgaaaaacaagtttgatggtttctctaaaggttaaatatagaatgcctatgtgatcccccaattcaatcccaggggtacacccgaaagaattgaaagcagggatacaaacagacacttgtataccaacagtctatagcagcattattcacaagagcccaaaggtgaacacagcccaagtttccattaatagataagtgaataaatagaatgtggtatatacatactacaaaattttatttctctataaaaaggaataaagtttgttgttgttgttgttgttgttgtttttgagatggagttttgctcttgttgcccaggctggagtgcaatggcgcgatcttggctcactgcaacctctgcctcccgggttcaagttattcttctgcctcgggcttccaagtagctgggattacaggaatatgccaccatgcctggctaattttgtatttttagtagagacggggtttctccatgttggtcaggctggtctcgaacttctgacctcaggtgatccgcccgcctcggcctcccaaagtgctgggattacaggcatgagccaccgcgcccggccaggaatgaagttttgatacatgctaccacatggatgaaccttaaaaataaatgaaacaaataaataagtgaaataaatcacacacaaaaggagaagtattgtgattccacttacatgaggattctagactcagaaaattcatagggaaattaaatagaaaagtagttatcagggactgggagcacaggtgaatgcggagttattatttaagaattatagagtgtttggaatgatgaaaaaattctggaagtggatagttgtaatggttgcacaccactgtgaatgttctttttttagctttttattttaggtccagaggtacatgtgcaggtttgttatacagggggtttggtgtacagattatttcatcatccatataataagcattgtttgataggtagtttcttgatcctcaccctcctcccaccttccaccctcacgtaggtcccagtgtctgttgttcccttctttgtgtctgtaatgtactcagtgttcagcccccacttgtaagtaagaacatgctgaatttgattttctgttcctctgttagttttcttaggataatggcctccagctccatcgatgttgctgcaaaggacatgacctcattctcttttggggcttaatatcactaaattatatgcttaaaatgcttattttatatattaataataaattttattatttatattttagcattatataaaaaaagaattcctggatgaccacatatcaaggtactgtacagggctcctatattgggggcaggctggcctggctgttttaggtcgcttttttgtctatggactgtgatttaaacatatccttataacatgaattctccatcaacaccaccaccaccataagaataatctttcttatactgtctttactcttgtaaaagaagaaaacagattcagagcgtctgtgatgaacatctctggctccagagaaggtacattttgaaccaagtgggaatgtcagggttagagagcaccaagttcaatgtaatggttcatttgtggcatgccaattaggagttagaaatagcttaactttaaactaggagtgacgagcaaaatttaagcatagaagaagctttttaaattaggcagaactgtccattgaactaaaagtaagtccagtaatgacaattaaaataaattccaaaccacttctgcaaaattcatgttaggtccttgggttgcctctgacaccctcaagcaatcctgtcaaccacaactggacagctttcatctggctgaagagctgtccactccactaaattggttcgttgacagctattcttatgagaaattttactttctcttcttttttgctttctccgtgatcttttgatccattaataaactccacaaacttgtgggctggttttgccattttctctgctcttcatgaaagaaaatataaagacacaaattctgggtaaatttccacataggttagtatatgtgaaaatggactgtgaatgataaagtatgataaataagtgattattgttattaataatgatagagacaatagcaaaggaaatcttaggttatactttgtcacacacacacacacacacacacactctctctctctctctcatactttctggagagtcaagaacattttttgttgttatttatttatttatttttgagacagagtcttgccctgtcccccaagctggagtgcagtggcacaatctcagctcactgcaacctctgcctcctgggttcaagtgattctcctgcctcagcctcccaagtagctgggattacaggcacctgccaccacacccagctaatttttgtatttttagtagggacagggtttcgccatgtgggtcaggctggtcttaaactcctgacctcaggtgatctgcccgcctcggcctcccaacttgctgggattacaggcatgagccaccacgcccagactttattgttattttttgtgggcttttgcactggttttgttcataaacagctgtatgacttcaaaaaattcacttgacttttctgagcctcagtttcttcatggatcaattgagaaagttagattaaatttcttattcatcaaatatgtattgagtgccaactatataccaaggactgtgctgagtactagattcaatagtaaagaaaatggacaaatttcctgacctcatggggttcatagtatggatggaaacagacataagcaaatgcacaattaaataaataaatacagtttgtgatcagttcttcccagttccatttcccaaatgttaatatttatattaatccactgaggatcttgataaaacgcagattctgattttttttaggctgaggcagggtctgggattctgcagttctcacagacccctaggcattgctgatgctgctggttcctgagtcacaggtggagtagcaaagtataaaaggtgtaaacatgacattatgatagaaaacacgctggcttagagagaagtgtgaggtggttgggaaacactggaggtgacagtcaactgagttctgatgtatgcagagaatttggaagtcagaggaaccaggataagtgcattgcattcaaagggaagagcaactgcaaaagccctgagacagaaaagatttttcatgttcactatcacaggggaaatgagcaagggactgagcatctgagatgagctcagacaagtagtcggaagccagaccctgagggcttttttgtgctctagggagaagtttatgttctattggaagatcaatgagaagacacagaagtgatgtaagcagagtaatgacatgggggcaggggtgataatatgccaggggtttctgcaggagtccaggtaaaagaagatggtagttaaaagtagcatggtggctggggagatggagagaagtgggtggaataaaggttttttggggagtaaagagatagataacaaaaatagattccatgagtgagtgggaagaagcacaaataaacgccatattttagaattgcatatctgaataaatgttggtacaatttaatgagatgggtgaaacacattaagtgtgagatacctataggacattcgagtgaagacgtcaagtaggcaattggatgtatgtgtgtctggagctcagagggatgactgggcaggagatacatgcttggaattgccagcacttctatgggatttagagaactgaggaaggatgtgatcacccaagaagagggtcagggtcttgatgaacagcagtactgagatgtgcagtagagaaggtagaaccagcagaggagactgtgaaagactatccaggatgttctggggacatcagatgagagcggtattttggaagccaagaggaac

SEQ ID NO: 2748 - DNA, 5082 bp, Homo sapiens
gtcaagcacggaggtgatctgggcaagccttgttgagtgaatattgaccacttcactaaggacatcacaatgaagaacctggtggaaccttccctgagcagctttgacatggcccagaaaagaatccatgccctgatggaaaaggattctctgcctcgctttgtgcgctctgagttttatcaggagttaatcaagtagtaatttagccaggctatgaaatcatcctgtgagttatttcctccataataaccctgcatttcccattaatctacatatcttcccacagcagctttgctcagtgatacccacatgggaaaaatcccaggggatgttgcttactctttttgcccacactgctttggatacttatctactgtccgaaggccttctttccccactcaattcttcctgccctgttattaattaagatatcttcagcttgtagtcagacacaatcagaatcacagaaaaatcctgcctaaggcaaagaaatataagacaagactatgatatcaatgaatgtgggttaagtaatagatttccagctaaattggtctaaaaaagaatattaagtgtggacagacctatttcaaaggagcttaattgatctcacttgttttagttctgatccagggagatcacccctctaattatttctgaacttggttaataaaagtttataagatttttatgaagcagccactgtatgatattttaagcaaatatgttatttaaaatattgatccttcccttggaccaccttcatgttagttgggtattataaataagagatacaaccatgaatatattatgtttatacaaaatcaatctgaacacaattcataaagatttctcttttataccttcctcactggccccctccacctgcccatagtcaccaaattctgttttaaatcaatgacctaagatcaacaatgaagtattttataaatgtatttatgctgctagactgtgggtcaaatgtttccattttcaaattatttagaattcttatgagtttaaaatttgtaaatttctaaatccaatcatgtaaaatgaaactgttgctccattggagtagtctcccacctaaatatcaagatggctatatgctaaaaagagaaaatatggtcaagtctaaaatggctaattgtcctatgatgctattatcatagactaatgacatttatcttcaaaacaccaaattgtctttagaaaaattaatgtgattacaggtagaggccttctaggtgagacacttttaaggtacactgcattttgcaaaaaaaaaaaaaaaaagtaatcttttagcaaccccagtattccttcactatttcgcttcctgcattagcaaattttacttacagtcaaaagtgcagatttatactcctgacgtgtctcattcacagctaaataataggccataggacttttggtaggtttaaacttttaattctgtatttcatgattataagtcttgctagaattttttctaatctttagtagatttgattaaataatgattcacagaatttagtaacagaatcaaactaagccatgtatgagggtaatcgagatgaggatattaactcaaaagaaatagggtgatttttaaaggattaataaaattctgaaatgttaagtagaagattacattgtctagtcttgtatttcctccttctgttgctctctttcattcacacactctcagtttctcatatttgtagctcatttatttggttatttcctaagaatattgaaagtgaagcaactatgtgactgtattcttcaggtaaacactgactgcgcttgttggattttccctatttttgtgacttcaagaataatatgccctgctgaatacatgccatttcacattctgaaactgggtagagtggttgggtgttctgccaacaattgctagtggtgtgaattcattcatatttgccagtattgctcacttcaaagaaactccttcatcaagcagtccagagctaggccagatcaatgctacaatcatgaagttctcattgcatgcaattgtgtaggattgacaaggaactcagataaaaatttccagggtgcacttccagaaccagcttcaacatatgtctacattgcccccaagttaataaagtgccaaccctttactctctcatacagccagaaatgttagaaatccaaaatcttggtgcattattttttcataaacgctaaaacatttgaagaaacaatttaattatttaaaattcaagtattttattcacattatttgcaatatccaaatgtttaaaaattcccagataattaactagctattacagatctcacctagagggttgatgttatgaagactccagtggactgtactcacaaattgactggacaccctatgaaagtgggtagacctctcagcggaaaataagaagggcttttacctacagggcaggacagggtcccatgagagcagttctgtggagatataaaaagaatggaagaaggaatgccttatagtgatattgtgacattatatctatatatctacatatatctatctatctatatctacatctatataatcttacatttaaaattgtattcctacacatattagaaactcttctaataaatgaagtaaaaaaattaaaaagaatacaaatattccagccccaaatgagaaatcaaacatattaaaattgttcaagaaaatttctttgaacacttctgaaagtttttggaaacttagaaaagagggaaaaaaatccagtgttactagtaatttccatggtaatacagataaaatacattcttttaattctgggaaattagaaaaagtggggtgatctttccaggaaaaacatgtgtaacatctgcttatcactccagctccctcctcctcctcctctccacgttcccttgagtaaatgtctgggaaagcatgaagcttgatgcaagaaccctgttgtactggcgttttcctcccctgtgaaaacgtaactactgttgggagtgaattgaggatgtagaaaggtggtggaaccaaattgtggtcaatggaaataggagaatatggttctcactcttgagaaaaaaacctaagattagcccaggtagttgcctgtaacttcagtttttctgcctgggtttgatatagtttagggttggggttagattaagatctaaattacatcaggacaaagagacagactattaactccacagttaattaaggacgtatgttccatgtttatttgttaaagcagtgtgaatagccttcaagcatgtgaataatcttccatcttccccgccacacatacacacacacactttttgtttctttcaggtagacaccttttaaaatgcagaactaactgaggcatttcagtaactttgctttcaaatcaataaagtcaaatgtatggaaacattttgtgccctactctccataccccgtgtactcaaattctctactgtatgaattatgctttaagtagaattcagtgccaaggagaacttggtgaaataaattattttaattttttttttatcctttacaaagccatggattttatttggttgatgtgtgctctgtacacaagccatttcaataggatggagctgttaattattttccaaagagtaatagacatgcaaaagtttcaataaaaactgggccattaacaaataaattaataaactaataagcattcccttctaggtttttgccaaactgcctatccaataacaaatttgagaatcgttgtaaaagctagttatatttcagagaaatgattttcattattgaaactgttctccctagcaggccattttccctttttcctgggagtttagcaagtttaggagagaatagtcatgaaaagaaagggaagaaaggggagaagggaagaggttaaaaagtaagtgctcagacctatgaacgtaatccctttgctacaaatatttaagagcagctcagcttggttgaaactgagttttgtcatcttccatatttgcaggaaggtattttctgacttgcaatgcagctagatgtaaaattttattttatcatcctagaaagccttgactagaaaaatgaataaatattgagggtttcctgtccatatctggcttgcatgtgccagaaagcagagaatagaaaatgtaatctccaacatccaagcatcgaaacccaaggggtaggcaattctatgtaggttttggacatgaagtttggtgcatcttggtttatgctggctcaactgctattaaacctctctggcttatagtctcttcattctattagacaagcacgtatcgaacacttgcttcgcacaaggctctttagttaacaatttagcagctactgtttgtgttaaacacacttttcaccaaataggttctgaggcaaacgagagcaatgactatttaaagaaaggctttcccagcatcacttacacatcccaaaactaaaaagatcaactcttccaactgagaaaagactcctggctttgaatggaaacttacagcagagagtcacaggccacggcaacaacaacgacaacaacaaacatttggaatattattctcaactcacgttttaataatacatcttattatttttctagtagagaaactacaaatcagcctcttcaacatttatatacagtttaataagcctcttgcaagttacttgttctctcacctgaggtatttttttcctccccaccttgcccctgttcctcccttcctcttctccctttgcaagaggaaatatttaacatatttgggtccaacttcaataatgtaataattaatacattaaaagcatttaacttcctttctagaaaaatgcacaggctaaggcatagacaaaacaaagagaaatgctgagaaatttgccactggagacaagcaatctgaataaatatttgccaaaagttctttttatgtcatatagtgtcaggatttgaaggagctatttttttttaatgttgcaactagcaactcatcttcggaagacacagccaggagaatgaagtagaagtgaaaggtttataaatccatttgtaagcatttatccca

SEQ ID NO: 2749 - DNA, 3816 bp, Homo sapiens
aagaagtagaagctaagtcttttggtacgatctatttcttcttcaacctcttcttacctcccctttcccccttcctcaagtttgattaaacctctatcttgaaaaataatgggaggctgaggcaggagaatggcatgaacccgggaggcagagcttgcagtgagccgagatcgagccactgcactccagcctgggcaacagagcgagactccgttctcaaaaaaaaaaaaaaaagaaagaaaaataagctcttacctcccaccactgaaccatactgtccattcctgcaagaagctctatttcctgtcaacaaagaaaaggaatgtgctaatgtaagcaaagtgtgtatccctagagtagccacaagtctgggtgggctcacataggttaggggaagaggagagaccagtagtcattgcttatggcaagttttctgtcttctgttaagccatctccactaccaccatcaccctagacattgtccagtgtccagtctctggcactggctggctggagaggaaaacaagaccacctgggcccagtcttcattacaccaggtgtggctgctctctggatctctcagaccgagtgtggctcagcactggcagctttagttgttctggtctggttctaaagtcaggtctcctctttgaggcagtctctcctgtgtgtccctataaccacacactatagcaggactggacactggtggaactggcctcttctttctaaatgggggatctgaaaatagcttcacacctttcctcctctcttgactcgcctgcctctgccattgcataccattatttttacttgattgtagcccatgtttcaagatgactctggtacagggtcttatggccgcaaggtggtacagatgttctacacacagagtagggacactcttgcacaggcctactttttaaaaatacagcttaattaaaatttttttttttttttttcctgagacagggtcttactgtctcctaggctggagtgcagtgccacaatgatggctcactgcagcctccacctcctgggctcaagcaatcctcctactttaatctcctgagtagctgggaccacaggcacacgccaccatgcctggctaattttttaatttttttgtaaagacgggttctcactacattgtccaggctggtcttgaactcctgggctcaagtgatccttccatctcagcctcccaaagtgctgggattacaggcatgagccactgcacctggccttaaaaaattttttgttccacatcatatatccatctacataaacaattaagctactttggccaggtgcagtggttcacgcctgtaatcccagcactttgggaggctgaggtgagcagatcacttgaggtcaggagttcgagaccagtctggccaacatggtgaaaccctatctctactaaaaacacaaaaattagctgggtatggtggcaggtgcctgtagtcccagccactcaggaggctgaagcaaaagaattgcttgaccccgggaggcagaggttgcaatgagccaagatggtgccactgcactccagcctgggcaacagagggaactctgtctcaaaaaaacaaaaatggaattaagaaaccttataatagcaaacatttaacatttttaagttagtgatttcagagtctatctgaaaataaaaatggttaaaataaatttttctttagacatcacattgcttgaaatggcccccagtttctaatggctaaaaaaactgaagatgagtgattgaagttcatccctgggacatacttcttggccctgggagggaaggaatgcatgagattctttagtaacattcatatgcacaagaaatgactactgacataatctttaatagttaggattattcttcagtttattatttaaaaccttatgacagctaaaatgctaaggtataatttataatgaaagcatttgagtgattgaggtatatttcactgagctggtttgtcttatgagttgaaattaagacttgtataaacataaaaagggaaatctttcccaggtttatgtagttaggtaagaatacttaatgtccctcattcccaactgtgctgcagtgccatctgtgcagtgctcagagtctataggcagcaaatctacaggatttaagcgacatttatttttcagtacaacagctgcatataagaccaccagctagcatcacataacaaaagtacatattatctttgagatacacaactttacagtattttcctagtgcttttaaaattttacaatcttagcttttgagttcttttaaaatgacagtaacaaaaacaaaatgaaaaaatcaaaagtgcatgtatcagagaaaaacagcaatactatagtgtgtcttacatcatctgggaaattaggtaatcaatcacatcctccagccataataggctggagtgcagtggcatgattatggttcattgcagcctcaatctcccaggctcaggcaatcctctcacctcagcctcctgagtagctggcactacaggcacacacaccaagccctgctatttttttttttgtatttttagtagagaaggaaggggtttcaccgtgttgcccaggctggtctcgaccttctgacctcaagtgatcctcccaccctggcttcctaaagtgctgggattacaggcatgagccacctcgcccggccaccagcaatgatttaaaaaaactcagccggacgcggtggctgacgcctgtaatcccagcactttgggaggctgaggtgggtggatcacgaggtcaggagaccaagaccatcctggttaacatggtgaaaccccgtctctactaaaaatacaaaaaaatcagctgggtgtggctgcgggcacctgtagtcccagctacttgggaggctgaggcaggagaatggtgtgaaccccggaggcggagcttgcagtgagccgagatcatgccaccgcactccagcctgggcgacagagcgagactgtctcaaaaaccaaaacaaaacaaaaaacaaaaacctcattaatttgtcaccaggttaagacagaatctgctagtgctagaggagtcaaagttcctagcttttcaaataaaatacacaattgatataatttgcagtaacccacacatagtaagaaaagagcatttagattaagccatctctcaaaatatctaatatataaattgagatcagaagcagtctgatttgtggtttcttctccctgccagctaataagaacaatacaattatacatggagccaacaagccacttgtcttatcatgtcatgataacaaatataaatcacgtgttcatttctaagtgaatcatgttggccactgtaaagagatgttttgtattagattatttcctcagtggtggctcatcctcccaaagtgctgggattacaggcgtgagctaaatcttatctagctaaaaaacgatatctagaagtcataaatattagaatatttggtatgatactaagagaacatcctgattaaatgtctgtatgtattgacatcatctagctctttttttttcttttttttttattatactttaagttttagggtacatgtgcacattgtgcaggttagttacatacgtatacatgtgccatgctggtgcgctgcacccactaactcgtcatctagcattaggtatatctcccaatgctatccctcccccctcctcccaccccaccacagtccccagagtgtgatattccccttcctgggtccatgtgatctcattgttcaattcccacctatgagtgagaatatgcggtgtttggttttttgttcttgcg

SEQ ID NO: 2750 - DNA, 489 bp, Homo sapiens
ctctctggtctgctgtgccctccccctccccacacccataaataacagcagcccttccaactctcctcctgatcctgtgctcagtgatgggggccttgcagtgggcagccagggccagcatggccagcatggccaagccctgtcagtcccttccctctgaaggtgaactggacagcatttgttctctttagtgtgtgatttggatttagacaaattcaaaagctgccgtatttcagagcgtgtttgtcactgccatcatcgttcttttgttcaggcagcagtgagaatctgctaagcacttgtgaacactatatgctgaaatgcctgaaaaggctttcctgccctgcagggacccgggctcagcacctttttcagactccaggaagctcatatcccgctgatgaacagctcgtggccattgcagcactatggaaaacccgcagctcctggcgtcatttaactacatgccactcaggcacattgaagtcc

SEQ ID NO: 2751 - DNA, 524 bp, Homo sapiens
gctgacagctgggattgaaacaaggtctgcttcctcaaccagggtgatgcattgaattgtgacacatgggggtcagtgaaattaactatctttcccatgagaaataatttatcattcagcatttgctattaatgtgcctctgctgcaagtgaatgaagacgtataaagtgtatggaaattgtagagcagatgaacactgcataaatatcctttaatgtttatgatgagtacaataattttctcatctgtaaatgggagggatttgggctgcagaaaaagagacgttgataaatttggttgctgtaaaaaaatggctgtaatttcttctatagaagctgtacctctttgggtctaatttgaattttgttttctgcctgtttcaaggaggtcttttaaaacttgtgattactattggatatgattgtgtctgtagaaagacttcccagccttctttagaacttaggaggtgcctctgttctcagcataggcaatattaatctcagctcacattgtctctggatggg

SEQ ID NO: 2752 - DNA, 1825 bp, Homo sapiens
ggaccactagggctgtgaggtgggaacgtgccttgtttacgactgcatttcctgccagctcccagaggagcagcctgattgctgagcctgatagcaggaaatggaggaggtgggggatctcaccaggaactgccccccaactctggcaacctccgtcccatcaagctccctgctaaaggagagaagagaaaccccaaagccaaaagaggcaccctgtctaggtcagaccgtgacacccagggcctgagtggtcatgggtggggtgtggacgggcaggcgcactgccttgcagtgctccactataggtaggcaggcccatggctccccatggggaaaggagatccagtgcagctcaggttctctggagagtaatgcgcaaaggaagggcatgaagaccacttccctggttaatgagggtttgaccaggagttgtctgccttacccaaacttgaaaataacccctagcatgtttaattgcttaaaaatccactctttcatctgatcttcactttcgtttcctccaaatcctatgtcaggctccatgctaagtgctgggaatacaagatgaataaaacccaaccccatcctgaagcagctcacagggagacgacagagctcaggcctttgggaggtgcagcagatgtggttctgccccttgacagaggagacaactaaggctctgagatcagcttgcccagggcctcccagtgcacttgaaccctgacttcccagcacccagcccagggctctttccttcccaacaaagagccccagggagctcctcaagcacactgggaaggacctgggatgcaggaggcactctgaccggtggcatccaggaagtaaggaatatggactaaagggagggccaaggaaaagtttacaggatgtggctgtgcagttggaagatgcagacgcgcctcgcttggtgctgccaggttagatttgcagaatgcagtgaatgctcttgctgacaaaggatggggaaaagtgaactggggaatcatgacctaggggaagccactagctcaaatactgatccctatttaagtcaccaaaatatgctgggcacccactgggtgcccagctctttcccataagtgatcccaaaccaggagctaggccaagcctccaaagacggctgggtagttcattggaatgagggctgcagtgactccagaggagcaggactcaagagaaggagagccagggaagactgaggggatgtgtaggtgaggtggcttttttctggctgagagaatagaaggtctccagcccacaccaagggctccataatggaagggaggcctagggtgggtcctcccctctccccatcttcatcccactcagcccctacctggcctttaacacactgggtgggagaagtgttgctgagcacagcagtgacctgaggccctgggcacccatcccagcttagctccctagggggctccagttgctgaggaagaacatagaacttatataggatgggagagctggaaggaaacttaggatcaattgttacagcctctaactgaatggtgagaggccagtgagagagccagagctagaatccagggccctttccatgatattgcacctcccatctcagccctgtctcttatgaaatgccatattgaagctttatgtattggggaaatttaactgaggctcaaagggacacaaattccctaaagccacatggtgagtcagacagcgaaatgcaaggtttctggtcctttcccagcatccaacaaacatttcttgggcacctactacagtcaggctgggagcactttcagacattctctcacttaaatctcac

SEQ ID NO: 2753 - DNA, 814 bp, Homo sapiens
ggagaatcatttgtgtataaaaaggaaaggccatcctcttacctatcttatcaattaataccatagctaacattttagttatctgggattttatttatgtctgctcagattgcaagtttgaatgtttgagactccactttccttgcaggattcgggctaatacatgccaaggaggcatagatttctttctgtttaattgtaaggatggaagtgaaaagcaaagaaagtttttgtcagttggtggtagttgatttttggtttattttaaaaagctgtctgcagttttcttgatcatttaagaaatttgttgacatggcacttttaatagattatcctgcttttaaagaatgctggcatgggtaatgacctcactggtgggcacagaacaataataaagatagaatttttttttttgtattttcagaaatttaaagttatgaaacatttttagactatccagtggcaatgtgcatttccagtatacttttgtatgatggtgagaagctagggaccttctaatgggtcactaatgaaatggactccaactcccactctggatctctcactcataatccacaaggattaatttaacctgccagatgctacccatttagcaagctgaaaggacacagtgccccccaatgcctgtagccttgtctgctgttattgctattgctggctccattctataagtgagtcagatgatttagatacatatatgtttactaatgcaatgggtagtttttcttggccaggctcagtatattatttgtgttcttgtcagggagagctaccagtgaattttttcctgctg

SEQ ID NO: 2754 - DNA, 1075 bp, Homo sapiens
gatcttgctatgctgcccaggctggtctcaaccttatgggctcaagtgatcctcccacctcagcctcccaaagtgctaggattacctgcgtgagctatagcgccctgcctgttctgggcttcttgcagagcctcttcagctgcagagaagcagctctcctttctccaagtccagagccaacaggacgaataatgaagctgttgggaagatttactgataatacatgtaaagggtctagcacattttaggagctcaaggttggtgccttccctttttctttactctgaaccggatatgaggccttgagaaagaagagaggcgcttgcaaaacgaggtgaggtctcaggcacagtggctcacgcctgtaatcccagcactttaggagaccgaggcgggcggatcatgaggtcaggagttcgagaccagcctggccaacatggtgaaagcccgtctctactaaaaatacaaaaattagacgggcatggtggtgggcacctgtaatcccggctacttgggaggttgagggaggagaatcgcttgaacccaggaggtggaggttgcagtgagccgagactgcaccattgcactccagcctgggcaatagagcgagactccgtctcaagcaagcaagcaagcaaacaaacaaaataaaaaacgaggtcaagtttcaaaagatgtcacccccaacctggcaaaacttctcctcaagccctgtcgttccactcttgtccgccaggaggagaaaaggttccctcgaaggacgtctttgcttgcgcgttcacggagccttgagaacgagtggccgaggggacccctgcggccctgcgcgcctaagggaggacctgactcctttcagaattagcatttcttccccttcgtgggtgctcttgagttccaaagaaaaggaagagaagccttcattgagcagcttcttctgccttagggactgtgctagggggtagatcgaccttaggggaaacaatccccgcttattagaggaggttttggatcagggtttgctttatttgaaatttaacaaatacagaaaagcagaaggaagaaaattgaagtaatc

SEQ ID NO: 2755 - DNA, 2059 bp, Homo sapiens
atccctcttgtcacctctgaagctggtgctgtatctttctatcccagatgctccacagaacctcgccatcagcatcttcttcagaaatggcacaggcacagccctgcggatcctgagcaatggcatgtcggtgcccatccaggagggccagtccctgttcctcgcctgcacagttgacagcaacccccctgcctcactgagctggttccgggagggaaaagccctcaatccttcccagacctcaatgtctgggaccctggagctgcctaacataggagctagagagggaggggaattcacctgccgggttcagcatccgctgggctcccagcacctgtccttcatcctttctgtgcagagtgagttgcaggacaggtgctgagggtagacagcccggtgaggtattcaggttggtgggagggactgaggcctggtaacagcaccttaccttctcctttctcccaggaagctcctcttcctgcatatgtgtaactgagaaacagcagggctcctggcccctcgtcctcaccctgatcaggggggctctcatgggggctggcttcctcctcacctatggcctcacctggatctactataccaggtgagccggactgcctgtctccaggaagctcctgagttccaggtggggctgagctgtcctgccccaggacagctcagccccacctggaattagaactgaagtggctggtgctgatctgaggcccatgttggctctgcaggtgtggaggcccccagcagagcagggctgagaggcctggctgagcccctcccgctcaagacagaactgaggtgtggacacttagccctgtgggacacatgcaggacatcactgtcagcttctttctggaagctcacatcccactgactacccctcttttccttcctgccccataccccttctacttattcccctctgcttgtgagtcttgccccaccacacctgcatccccatctgcaccccatcccctctccacctgcccttctcttccctctccatccaccatctccagccctgtgaagggaatgtactttcggtcttatacccccattacccattacccaaaagttaccttttttttttttttttttttttgagacagagtctcactctgttgcacaggctggagttcagtggcacaatctccgttcactgcaacctccacctctggggttcaagcaattctcctgcctcagcctccctagtagctgggattacaggtgcctgccaccacatccagttaattttttttttttgtatgttagtagagatggggttttaccatgttggccaggtctcgaactcctgacctcaagcaatccactgcattggcctcccaaagtgctggcattacaggtatgagccaccgtgcctggctgccaaaagttaccttcttaacacttgaatttctggtctcctcagcttccctatccatataggcacagagaggcagcatttgttttccagttaaaactctacctcattgtgattattatccaatacaattgttacaaaataagtaaaacttttatgaaacaatacaacataactgattttactctttaatgcctctgtgagagtttgtagacaaaaattatgtcttttttttttttctttgagacagagtttctatcttgttgcccaggctggagtgcaatggcaaaatctcagctcactgcaacttctgcctcccaggttcaagtgattctccttctgtccatatacaagaaggcaatacctgtattgtcaggttctgtgcatcgtataactggaaccaaacatatttgctttagggtctgctttcatttcttcagtgtggttttcccagtttatccacgttgttacacgtatcaatagctcattctcagttttggtggggttttttttgcttttaatatcgtacagtcagccttctgtatccactggttctgcattttccctttaatcacttttgctgcaccacaaaagttttgttatgttgtatttttatattagttcaaaatatttccttctttcccctgagatttcctttgaattcac

SEQ ID NO: 2756 - DNA, 2703 bp, Homo sapiens
caccacgcctggctaattttgtatttttaatagagacaggttttcaccatgttggtcaggctggtcttgaactcctgacctcaggtgatctgcccacctcagctccccaaagtgctgggattacaggcatgagccactgcacccagctgaccctaaccgtttttaagtatacagttttcagcagtattaagtatattcacattgttgtgaagcagatcccctgaactttttcatcttgcaaatctgaaactccatgccaactcgttaacttttcatttgccgtttcccccagcccctggtatccatcattctactttctgtttctgtgaaatttggctactttagattgcttatataagttggtatcatacagtgtctgtctttttgtgactggcttgtttcacttagcatacttgtcttcgagtttcatctgtattgtagcatgcgacaggatttccttactttttaaggctgaataatattccattgtgtgtgtgtatatgtacatacacacacacatatatacacacacacacacacaaaatggaatatatatacacacacacaccacattttttttttcccgagatggagtcttgctctatcgccaggctggagtgccgtggcatgatcttggctcaccacaatctccgcctcctgggttcaagcaattctcctccctcagtctcccaaatagctgggattacaggcccgccaccatgcccagctaatctttgtatttttagtagtgacggggtttcaccatgttggccaggctggtcttgaactcttgacctcgtgatcttcccgcctcagcctcccaaagtgctgggattacaggcttgagccaccacgcccggcctgaactattttataatacagaaaagctcactcgttataatacaacttgctaaatttttacaaacgaagtatatgcatgcagcccacactcagctgaggaaataaacgtttccagtaccccaggagcccctctaatgtctcttacccccataccaagggcaaacactactctgatttctaacagcatagaagaatttcacctatttacatttactttttgaaacttaaatttaggcatattttaagcattaatctattaaagcacggctttatactaggtatttttctttttcttttctttctttttttttttgaaatagggtcttgctctgttgcccaggctggagtgcagtggcccaatcatagctcattgcagcctcaaccgcctggtcttaaacaatcctcccacctcagcctcctgtgtggtaaagtgtgccaccaagcccagctaatttttttacattttgtagagatgaggtcttgccatgttgcccaggctggtctcaaacttctgggctcaagtgatcttcccaccttggcctcccagagtgctgggattacaggtgtgagccactgtacccagcctagatatttttctatacacatacatatatacataatgatgattattatttttctagagatgggtctcactctgttgcctagattagagtgcagtggcatgaatcatagctcactgaaactgaactgctgggctcaagtaatcctcctgcctcagcttcctgagtagctaggattacagggacacaccaccatgcctagcctcaattttaaattttttgtagagataggtctcactaagcaacagccccatctgatctcgaacacctggcctcaagtgatcctcctgcctcagcctcccaaagtatactgcaccaggcccatattatacataactattgacattaaaaatgttcttttgtgtgtcacctacaaacactctagaagccaccttccttaagtaccatatgatctctaagttccttctcaaattaaaattatgtggttaagtttcaagaaactaatttcttaatgatgcagaaggttttgcttgaatgactcttcaaccgagcatctattatttatcaggcactgggaactcagggataaacaaggcatgatctcagtccttgaacatagagtctcgtggagaagaatggcgtagaaaatgcagtgtcatgatgtgtaatcataaaagtagatgggtacacaccacttcaggagaatggcagagggagttaacatcttggcacttagcatttagtatttcttctgtaacacacattccattctattttaatgagcttgcaaacatttttcctgctggatttttgaggatcaggaatgtgttttgttcactatcttatctcctacagtccttggcatactgccctacaaatcagtaaatgtgtttatatgactcatatggcaaaaggcaatttttttttttttaataagtgaggaatgttccaaaagccaatgctattaacattgaccagcttcttctagtaaggagaggagacagtattttttcaaagtgcggtcctaagaccacctgcaagagaattaattacatgctgggaatgtgtagattaaaaactcattttcctgttctccatttcagacctactaaatcagcctcagagtgaaggaagcttcatttttggtgtctcaagtgattctatttgaaccaaggcctgagaacactgcagtgaggtgtttaggccagcgtcaaatcacctatttctgggcagaggtgcctatccttagcaatggggctgaggctggggtggagtaatcttgctttttgttgattttaac

SEQ ID NO: 2757 - DNA, 3628 bp, Homo sapiens
cagcagccatccccagggagccttgccagatttttctgccactatctctaataccaccaccctgagtgacacccccactgtagatgccgccagcactccgccacagctgacacctcgggggctctctcccagagtagaaatgacccctcaccttctctgctttggaaagaaaaagagaaaaaaaataaacctgcatgcatgcagatcacacacctggattccattatctctctgacttccagcccagggaaccaaggaagcccagaatctttgagtcacatcctcttcctcttctctgcggaacccagtggggctctctcaccaggaggagggggttgagttgcagagaacagcatgggtgacacacttcactggacaaaaaatggaagggcatgactgaacctttattggaacaaaatatgggctcagccagctgcggtggctcatgcctgtaatcccaacagtttgggaggcccagtcaggtggatcacctgaggtcaagagtttgagaccagcctgaccaacatgacaaagccccatctctactaaaaatacaaaattagctgggcatgttggcacatgcctgtaatccagctactccggaggctgaggcaggagaaacgcttgaactcgggaggcggaggttgcggtgagccaagatcgtgccacttcactccagcctgggcaacaggagtgaaactccatctcaaaaaaaaaaaaaaaaaaatgtgttcaaggaccttcacccaggaatgcaaactttctcctgctgcttcctatggatactatttaaaatcaaatgaagggggcttttttcctattatatatagactgaatctataaaaggctatgaaacacccaccagaaggacaacccaaaagaaatttaacaacaagtacagatctacaaggaaaagcctttgtaatgttttccaaggcaccacaatttttgaacattacatgcaggaaaatattatatggaagaaatgtcactttacaagccttcagatgaggccttttctattttaatgagtgtcatatatgaggaaatgtttgatataacagcatttcactgaactgtattgttggtataaactgcagttactttggactttcagctttaatcttgtgagaaatagatttctaaatacctttggcaagatgttcaaggtctatttctttcccagtgtggattttaattcaaaagatccagccatgctcacatttgtggtattcctcaggttcactaaaggtaaacaaattaacaaaatattgaatgaatggtaaagatgtttccgttcaattattcttaaacacggaaaatggggtacacatgaatttgctcagttttaaattacccttatcatttaaaaaccacctggatgggttcaagaagtaatgtgaggctgagaaaaatatgaattaatgaagaacacattttggtgataggcctataaataaaaattgtttctatgagtatagttggcacccacagattgaacagtaatgcaggcagacacagctttctactgtctttttatgtaaaaattggttggtttctgctttctttgctatgctaataaatgccagggaaagtgttagctgcattttaactttttgtttacatagttgcacacatactgagcaagttcccacggaatacagcttaccacacctacttaaggggttcaaactcacacaattaatcacgcctttaaaaaaatgatttggtttcccacattcgagataataggcctttgttatttttaacaattttggcatatgagatatgtaacaactgcttgaatataacagcgtaggctttgttacaatcaatcgttcaatttaataggtctggatagtaaaagactgctgattcttctagatgggaagacatttctcccgggaagaatgcagaataaaaaaacccaaaagcaaatttctttgaattttcaacaggagaagcctacttacattggtttattcaaaccaaagcatctttttcagattggaaaactgaaggcatcaaattaaaaagaaaatactaaacagttggagtgtgaagcaatagccccacttcctaaaaacagcaaccaaagacctctttaaaatgtagcagtagtagagagaaggctaacagaaagtcacctcatctatagtcaatgtgctttcacattttctcccatctgatgtccctcatgataacccatgaggaaggtgaggccagccccgacaccgagaggctgggagcaagactccaaatggaagcacaggtgtctagatatttatattttacacaagctaacaacctgtttttaaaaatatttggctgggctcagtggctcacgcctgtaatcccagcactttgggaggctgagatgtgaggctcacctgaggtcaggagtttgagagcagcctggccaacatagtgaaaccccatctctactaaaaatacaaaaattagccgggcgtggcggtggcgcatgcctgcaatcccagctactcatgaggctgaggcaaaagaatcacttgaactcaggaggcagaggttgcatgagctgagattgagccactgcactccagcctgagtgaaagtgagactttttctcaaaatagtaataataataataataataaaagatatttaatatgttctaattgaaatgtttctaagacaaagaaatgataaatccttgaggtgatggagacctaattaacctgatgtgattattataattgcatgcctgtatcagaacatcacatgtacctaatgaatataaacacttattatgtcctcaaaataattaactttttttcaaaattgaaaaatatatgtaaagctacagtttatagataactgaaagttgacaaaatagcaaagaaaactgaatttaacttttattgtgtatatctgggtgtttataaagagaactgaaaacagcagtattgttcaatttgtcctaatctctcttcagttgaaatgataacctgcgttctaatggccaaaaaaaatagtctattaaatttagtttggagactatttgtacatgaatcttttcctgtagagccaatgaaacattttcatttctccttgtaatttccatgtatttcaatggaatgttgcatatatcacgtgcagtttcttgcaatttagaaaaagcattttttctaaaggtatttatttagttatttagttatttattttaatccttttgaaaatgaagtagccacacacatttggagtggagatggtcattatcttttgttaatattattatgagcaagcaacatggatagtacatattcataattaaattcataattcattttctaataaaaaccacaatttgctttttatttgaagaatgtctcagtgtgacttttgaaatatttactttttatatgtttttcccccactttcttatccaataagttaatgatctaatttgaattctccatcccagatagaagtcgtatttttcattatttttaattcataactacattttcagccattctattaacaaattggaaattatctctactgaatctaaaaagcttttattttttaaaataaatattaatgctacaataagcctcattgtgtgtttttccaaatattatacaca

SEQ ID NO: 2758 - DNA, 294 bp, Homo sapiens
atccaatgcatcaattaatctcacaatatttgtcatattactgctactagattttttatttaatgattactcttattttgttgtctcatacataagtgtgtagaagtaactgagaatatttttaaatatactaatgtgcatcaaaaccaattgtcttgataagcaataaaagaagatgatttattaaaaattgatttataaaggaagctattgtttccaaggtacctactaaaagatgagcttcaagcaatcaaaaggtgactgaaagaacaatataaatagatggatggcttt

SEQ ID NO: 2759 - DNA, 3254 bp, Homo sapiens
gttatggccctgagtccttaaattataggctctcctgcagtttcaaaaagctaattcacactactgtgtgcattagaaaggtggtatatatgatattccactaagggaaaccctaggaacattaaactcctactagtaactggtcacgagtcagggctagaactgacactagtcatttttcttcactgacaagttttcattatgtggctttcccagaacaatttagaaattgatctgcaactgatggaagctgggatgaattgggcgcataagtgaacccaaagcatcagagcaaagtcaaagcgaacatctggctccagctttgagtacaagattaataaaggagtctctccatatcctctctgtccacgttcgttgtggacggggtcaccaggaagatggttcctgggtgatgagagtgtccaggacattgtcttcggtggactactggcacagggacctgaataagacactgggatttacaaagtggaaaagaaatcactgagggatccctcaagccactgaaaacatgtaccatttgccataaaacagcattaaacattaagtcaacagattgcacatgaatatcaacaatcctgcaaaaaaagccagtcccttaagaaacatcaagattgacagttgtcatcagagaaatgatgaggaccaggatcttcagggtaccatctggtgctgtgtttgaagaaaatgagaatgagagatatttcctcaatagatgaaactattggccccagctccaaattcacacttgttgcagcagttaattctgcaaaatcacagaaggaaaaaaagtcaggccaaggttctgccttgctctttcttgaatcacctgctctggaggaagccagttgcatgggaagacatccaagcagccatgggttgtgtagagagaaactgaggcctgccatcagtagccagcatcagcctgccagccatgcaaggagccagtgtggaagccaatattccagagccagtcaagctgacttcttgactgaaactccaggagagaccctgaaacagaaggacaaaaccactcctgagttcctgactgatagaaactggtataaaatggaaagcaattgagactttgtaatcgaggaagtaacaagttcagagctgcattgggagatgactgcaatgactgtataagataaggatgaataccgagggtgtataacaagatcagcgagaagaggattgccattgttccacctggaccaggttagtgaccacagggaggggaagcagggagacttaggagtatattgtgatatactagggaagagtatctcagtgttaggaaatgtcagctttgtaagtttttatcaagcagctcctggtatagtgtatgggttcagtaagacatggaaacagattagttgtatgaagaagggggcattaaagatgaggttaagatttaatggtatggggaatgttgggatcattaatatgaagaaattaggaggaggggtgttagtgaataggagcaccaatggtgagtttttgacagtctttgccagcttaagtttgtatctagccacatagcgagatgaggcattaacttataataaagataaatcaaaagctccccatgttccatgaatatctattctcatatcccggctgtttaagactttcaccaaaatttcttgtttatccttcatatagatctcgcatatttttcaggattaattttactcctacatatggtaatagtttctattgagatgataaatgaaatcttcgtatccattataaaatgataagtagttattacaagtctttaggaaagctctcattttttgtgtgtttcacatgaatcagtgttctgctctattgctctgagtatggctggcacagaaagagttaagttggggaggaaagctcttggtttctatgttttttgtaaaatggcattctgttctattgctgtaagagcctagcgggagaaaaacaagcagggccagggtgcaacagcggctggacagggagaaagcagcagtcaaggagcattcagggcacaaggactgtccgtaagtggaagcatctactgaggcttagacgaatataaccatgaatatcaataagatccttgatccttctcagcatagtgattccccccatggattctctcacattctcttcataaatccatgaactcctagagaatccttgaggtagagtctcgcctgcctacaatcagttcagtaatttaaaggtgatactgagggaaggtaggaagaggttggatgtgcgcatgaacttccaaaaactttgctgttgtgctggaagataacctgaagatcctggagatgtacaaagaaggaactcagacatgctgccccttcaacacaggcagcaatagataaatgggttggtttattgattccaagtctgggggttgtttggggcattagcaacatgaatagggttgtgtagaaatcagccaagggcagagcccaggagaaatggagatcttctttcaaacactgaggatgaaacatcaaccagaccatcttatctccaagatgatggaaaagatcttaggactgattgccagaagtagtaaaatctagaaaggaaagccagtattgacctaaagatgggattctctaagaaaggagggacttagaaaggatcagaaagctcagaacgcatcctggcataaaattaggggatgtactggatggaggaaaggccccatctcagaaactttacgggagttaccagaaagccatgatggattaagaaagaagttaattctcacaggtttcacaaatgaacccaatccaaaatagacatcaatctaacatgccaaaaggttggggatggaaatcagaaaatggtcatcactggccacgaatttctaagttgctggaaataaagatcttaataatcaccatgttggtcacatggctttggattcattaagaaaaccataaatccagttctggggcctagaaaacaaattcctcaagaatcaagggtgggatggacgatgaatgccattgcacgcataatataagcattttcaccatgcagcaacgaggagcaactttgtggtttccagtaattttcaaactcccccaattgataacttgctgattggctgccacccaaatgcctgtccataccagaaagcaatattagggatgagaaaaataaaggaatattaggcaaagaaacttttagcatttagaggaacaagaaatgtgaataagctgtctccaatctcc

SEQ ID NO: 2760 - DNA, 1223 bp, Homo sapiens
taggacttgatttaacagtaggtttaaaaagctgtttcaggcagacttgcaaaaacctgagagtccaagggggaagttacagagtaggggatgcaggagtgagtgcagagtgagaaggcacctgtgtgcctgtttcagaaatgaaagtaacttcctaaactctgctcatgccaagaaaagtatgggtactgtgttgctgcttattaaagacaaaataaatcactgttccaaggagacacttcttgccttttcttgctatcctatgtctacttctccatgattcaggtgctgacgaggactttcacctgggagaagagctcattcttcctatcgtttccctgggaagaacatggctgaaacaacttactgtacagaccacagaagtgagaccaaaaacactgagatgaggaagaggtgtggcaaaatggctttgttgtggtggaagatgaattgtcgtctcaagggggcagaggactgcctgtgagcttccttaacatggagcccgaaaccggtgtttgcacagtccttgaggaaagggtttgctcagcaaattaacagtgtgaacaagactgcaggagggaccatttacctacctgagaacaaactgttttctagctcttcagcagcaccacttacgcacaattttcatgtgctaatggcaagtgattattacctagttagtgaatatacgtggaagacataaaatagcctttactatcccctggttgagacaactcgctaactcagacttgccaggtgctctgaattagagaggtgctacaggaatgtcctctcggatttttggcgttgagcatgcatgcatgtgagcagggtgccatttcttcagaagaaaaataaatgacaacattctgttttggggcttgaaactgcatgactgaaaacataaaggtgacaactgtgatatgcttttttaatgagggcagagatgtcaagagaaaccagccttctaggaacaaaagaatactctgtcaggtgcagtggacttaagacctttttctctcttggaataatgtccttaaaaataaccaaattttccattcaatagaaaaatgttcatcccttcctccccatcaatatgaattgttgtcttggagcatggggcactagcaagccatattgattttggaaattaaaatgggaatgttgaagagcgttttcaaagaattatatgggattttagccatctgaatggctttcttttt

SEQ ID NO: 2761 - DNA, 338 bp, Homo sapiens
agtcatgagtgctgaaggttagctacaaaagaaatgcagatcactttcctgaccttcataatgtctgaagcctttaactttctgtgaaggactgagaataaaaattattttgcagatggggctaccagaggatatttgtcatgggcttaagattatttcatgaagattcacactgaaacacagctcttcctgggtcatgagcctgctggtcttcagattggaactacactatcagctttcctgtgtctccagcttgctgactgtgaatctttggacttgggacttgtcagcctccataatttattgagccaatttggtataataaatctctctctccc

SEQ ID NO: 2762 - DNA, 1166 bp, Homo sapiens
gatcccgcccccctcggagcgcccctgtggtctgacttcagcagcactttccggcaggagactgggcactcgctgtcacccgcgagctgcctccctcagcgagatctgagcatctttccggaggctaacagacctgggcttcggggtgaccactgtgcttgcctcagtttccttttctggagcaggggaaggcccggctccctgcccaaaggcggctgtgcgctaagtggcagacgctcggggagagccggcgcggggcggaccccagcgccagtagtgacaggggcgaacgccgccgggagactccagccggcgggcgagcaggcctgtcgttgctggtggcggcatggtcttctgtctgtcgagcgaggagccgcgccgcccgctgcgaagcgacatggtccacttccaggcctcggaagtccagcagctgctacacaacaagttcgtggtcatcttgggggactccagtgagtgcctcttctagggtgacgcttccagtcccacaccttgcagcccgttcagtgtgtctggaccatttgtttccatctcacatctcttgtctgtcttctggtctgttccgtccagtaggttttctctttttatgtcccacacatcttccacaggagtcctgacaggtgtaataacctgtgcactttttagcccatccttgctcagcatttctcgccctgacagctccccataatttccatcacgaaagcgttgcattgtgtagtgtgtctcctgggtgacttggccgacttaatttctgccaggtgatcttgggtcactgtatactgctggccaggaggcacacagaacagaggcaatgccaggactttttaacctcatcttttctcctgcgtctaagtcaaccacagagctggtgtcgggcacctcagccctgggaaaatggggtcctggacttggaaggagctggggcaggctgaggtctgcctcagccttgggatctctgtctcctcccagttcagagggctgtgtacaaggacctggtgctcttgctccagaaagactcactgctcacagctgcccagctgaaagccaaggtgagggaagcttggtggccatgtcagtggtgggtgggcacagaccctggcctggcagggttctcctccctggcatgggtctgaccagtagggtggggg

SEQ ID NO: 2763 - DNA, 2831 bp, Homo sapiens
ctggcgtgggcgaggcggggctcggggctcgcggtcgctgtagccgcgcggggatctggggtttctctgggacagcggcggcggcggtgggcggaccgtggcgcggggacgagcggccggttagcggcgtgtcggagccggtgtcacctgcgggagaggaaggcgagagagggcagcggctagtcagccttcggagagccccacggcggcaggggagacctcgccggggccgtcacctgctgggtgccttggaaagttagggtcaccgggaaggttagggtcacgtgcctttcaggttgcgggcccttcccccacatccatgaccccacacgccacaggcagcacaggtaacgtctcgcttccctcaagacataccccacctgctccctgcccggcccacgtctccccggacagcagcctccgagttggttgagggggcactcagtgggtgccaagcagggcccttgagaacccacaggagaccccacccccccaggtcccagtgcccctggtccaatgaccgagctccctcctggggcggcaggagccacccctcccttagccacgacgcctgtgccccgtccccacctgcaggggagtcggacgctgtgtccttggtgacactagccaggaactcgatccccccactcatctcctcatcatagttggggggctcctcggtgtctgaaagttccaagtctggggaagacaggttggggtgaggactggggtcactggggggctgtcctcacagcccagtcagcagtgtccatcagctctgtgcacagaggtgcaggcagtcgggacccacagagaggagggctaaaccgcagggctggaggagggaccccacttagagggcagtgtccctggaaccccatcctgggtgggtctgcagctggggccctgaccatgcctcccctgcctgggtggctggagggtccccagaggggaaggtcctgagaggggaggttcccgagccgggagggctggggctgggaggtggtggctcccagtcccagcgttcctgcagggcccccagcgcacctttctccttgatggtgaaattctgcgcagggctctccatgggcagcttcccattggggatgctgctgtttctctgcggagcaaacgtgaagctgctcacaccccgacacagccacacccagccctgactgcccccgctccaggccccagccccgccaagcctcctggtgacccagccttacccgcttctgggcacgctcccgcttgtacagcttggccgccttcttgttctggttgagccccagcttggtcgacttgaaggactccaggcgcttccgcatggtcctgtggaagatttcccggtcctgtttctcgtcctccgtgggcgtgagctcgtgtcggctgtacagatgcttgtactgcgggatcaggcacggaggtcacagctgtgcccaccgccggacattctcgccctcctgccgcaggagctgagcacggatcccccgtggtcccaggaggggacgaggaagccgccccacggggtccctgcggggtcctccagcccccagcccgcagtgcccacctcctgccgcggcttgtacaggccaggagccaccacagccctgtctgtgactctcagctcccgaggctgggctcttccccagggaagctgcatgaccatggccacatacaggaggagaccctaaaactccattggcctcatgtccagaactgaatcagccagtgccagagcctgctgcagccccgacccggcagagcaagcggctctgctacctcagccacgtagctgatggcatccttcaggttcagctcgtggaagacattcaggatccggtctcgagacttctgggccgaccgtctcatgaggaccctgctgaggaacttcctgtcgaagtgggaccacctgtagggacagaccttgggtgtgagcctcaggtgacaggcgccctagagcccgccggacgcgtggcccggccccttctctcctgaattttgtttgctatagtgaccctgtaggcgcgtttaaaatgagggaagcagcccctgccacacgcccaggccgtccgccgttctcccgcctgtcctgttggatggaggccgttagacgcatatgaaactgcatgccgcctcctccagagggtggctcaggacacggtgggtgtcaggcctggtcaggcaagggggctttggccacatggggggcaccttcaggtgcacaggaggaagggcaggggcggacagacaccctgagcccttagacttgtgggagccaagctgaccagagtgaggttttttttagcctaacggaattagagtattcgctggttatccagatcagaagggacggtggcctggccggacttagaggaaactctggggcacaaggaggtgatgcctgtcacttggacatgggtgcagccgccagagccgccctccagggcacagggtgggcccgggtgagcttgtgtgctcacacctgggcaggccccgcggcagcaatggcagctctcctgtacaggctgagtttcagccacaccaagaagtcaaagctaaccgaggctgtgccttccgagacccccgggatggcccctgggaggccaaggagtcggggactgggtacccggagcagagtcactgtggccacggagaaccgcagctgagctttatgaagccacgtggccacacctcccggtgcctccaccccaagcaaacacagatcgctcagaaaatgggaacccagggcaaattgtatgtgctccttactgggtttattataagtgtcacatgttttttataataaaacataggtgatttcaccttaa

SEQ ID NO: 2764 - DNA, 6720 bp, Homo sapiens
tgaactcacatccctggttggacctgaagcatttgggggcaggagctcccctgcagctttttgcttttggcgtttgctgctagtgggaggatcagtgcacatctaccttagggtacctgtaaaattacaactgcggaaaatatccatagtggtgttgcactgtatggtagccactagtaacttgcacctgttgaacacttaaccgttcctactctacactgagatgtgctataaccttaaaatacacactggatttcaaagacatagtacagaaaaagaggctgggcacagtggctcatgcctgaaatcacagtactttgggaggctgaggtgggaagatcgcttgagctcaagagtttgagacaaacctgggcaacatagcgagaccttgcctctacaaaaaaatacaaaaattagcctggcatggtggcacacgcctataggcctacctatttgggaggttgaggcagaaggactgcttgaacctgggaggttgaggccacagagagctgtgatcacaccaccctccagcctgggcaacagagcaagacactgtctcaaaaaaacaaagagtaccactatcacatgaaaacattttttattgatgacatgttaaaatattttggatatattgggttacacagaatatatcattacaattaatttttcctgtctcttttttctttttttctttttaaacggcgccttgctttgtcacccagactggagtgcaatgcactgcaacctctgcctcccaggctcaagtgattctaccatctcagcctctggaattatgggactacaggtgcacaccaccatgactggctaattattgtgtttttgtttgtttgtttgtacagatgagaaatctcatctctacaatcatgaggtttccatgttgcccaggctggtctcgaactcctgagctctagcaatctgtctgcctcggcctcccaaagtgctgggattacaggcatgagccaccgtgcccagccctttctatttctttttactttttgacatggctactagaaacttttaaattacagggtcttgccctgtggtagctcacgcctgtaatcccaatactttgggaggctgaggcaagtggatcccttgagcttaggaattttgagaccagcctgggcaacgtagtgaaaccccatctctaccaaaaatacgaaaaattagcttggcatagtggcgcacacctgtggacccagctacttgggaggctgaggtgggaggattgctgtagcctgggaggcggaggttgcagtgagccaagattgtgccactgcacttcagcctgggcgacagagcgagagcctgtctcaaaaaaaaaaatatgtggctcgcgttatgtttttatgggacagcgcagctctgtaggattccttatgacgcattcactatctcggtcatgagaatctttaaagcagtaaatgctttgcttttgtccgtcttgctataatcaaaactgactcaggacctgcattaaggctctttttttttttaacctcatctcttaactttttgatgcaactcatcttagtgaaattgtggtctcctcctacagcaaccctccctcaaaaaaagaccgaacacgcaattctcatctatctaactctgttaacaatcatatgaggaggaaataatcacatgataatgagtggcatgaaaccctgtgtctctaaattaagcaactcactgtacttgatgagtacatcagtcttcctgccccaagcttttgtgtgtcagactggaattaaatggaagcttacactgcagctgaattcctagaagccctggacttgtcaggggaaaagcccatggggggaaagcccatctctaggctgggcaatgaacttggagactgctcgatcacacacactcataagtaacaaaaccattaatttcttttcttttttttggtggagggacagagtctcactcttgcccaggctggagtgcagtggcatgatctcagcccactgcaatctccacctcccgggttcaagtgattctcctgcctcagcctcccgagtatgtgggactacaggcacccaccaccacacccagctaattttgtgtatttttagtagagtcggggtttcacaatgttggccaggctggtcttggactcctgacctcaacaaaaccagtgaatttctgaagtctcagcatctaggacttagaagaaggagaagcctagcatttcctgattctataaataacaacactgatagtctctagtagatgtttaacagcagttcgaaggggaggggttctgatttgtagtactggccaatttccacggtgtcagtacttgctctgtgaccaacgatgactcacaaacattgttgtaaacatttgacctacattaattcttttaccctcacaagaatcctgtgaagatctactatcattcccagattatagatgggaaaaactgaggcacaatgaggttaagcaccttggccaaagttatgcctcgtgaatggtggagctgagccatgaaccaagacctctgcctccagtctgtcctaacccctataagctaatgcctgtagatggttttttttttttttttttttttgagacagagccttgccctgtcgcccaggctggagtgcggtggcatcacagctcactgcagcctccgtctcccaggctcaagtgatcctcccacctcagcctcccaaatagccgggatttttattggacagcacagctctgtaggattccttatgacgtattcactgtctcagtcacgagaatctttaaagcagtaaatgctttgcttttgtccatcttgctataatcaaaactgaccatgcccggctaattttttattttttgtagagatccctatgttgcccaggcttgtctcgagctcttgggcacaaatgatcttccccccttgacctcccaaagttctgggattacaggcgtgagccactgtacccagcccctttggatttttaattgttcaaactggtagtcatagtcccacttcagaggagagaaccatatatgtgaccagaattcttgggggaaaagtaagaaactactcttaaaagttccttaaagggtagaattctcttttctagaaagagtagcctagggttgtccaatcttttggctttcgtgggccacactggaaggagaaattatcttgggccacacattaaatatgctaacactaacaatagctgatgagctaaaaaacaaactttttttgatcacacaaaaaaaaatctcataacgttttaagaaagtttacgaatttgtgttgggcctcattcaaagccatcctgggccgcatgcggcctgtgtgctatgggttagacaagcttagagtagagcatagtgggtgagagaagaggcttcagatgcttctggcttgagttcaaatcctgactctgccactcactagctgtgtgacctttggcaagtgacttaacctctctgtgtttccatttcctcctctgtaaaatggaaataataataatgatacctgtctcataaagtggtcaggattaaatgagttaatacatataaagagcttagatcagtgcctggtgcctataaacactccagtggtaactgttataatttgtattatctcttggtgattcccataggtcacaggcattgaaagtgctcaaagggccaggtgcagtggctcacgcctgtaatcccagcactttgggaggtcgaggtgggtggatcacctgaggtcaggagttcgagaccagcctggccaacatggtgaaaccccgtctctactaaaaatacaaaattagccaggcgtgttggcgcatgcctgtaatcccagctacttgggaagctgaggcaggagaattgcctgaacccgggaggcggaggttgcagtgagccaagatcacaccattgcactccagcttaggcaacaagagcgaaacatcgtctcaaaaaaaaaaaaagagaaaatgctcaaatgtaataaagacagtattcatcgagcgttttctctgtgccatcagtgtgctgagtgctttacctgcaccatctcatttatttcccgcaaaccctcctgtggtttaggtgctaccatccccatttggcagaagtggaaatggagtcccctagaaggtacgtagcttgtagaaagtcatgtaattagtcaacatcgtacttccagccactggccagcagaagcttccccatcaattcaaatccattgaatcctaatggcaatttaagaggcctgttttattttataggtgggtgtttgtgtgggaaaagggctaccaggaaactgactccgtggtcagctccgttacgaccaaggtcaagggcgtggctgtgaccaacacttctaaacttggattccggatctgggatgtggcggattatgtgataccagctcaggaggaaaactccctcttcgtcatgaccaacgtgatcctcaccatgaaccagacacagggcctgtgccccgagattccagatgcgaccactgtgtgtaaatcagatgccagctgtactgccggctctgccggcacccacagcaacggagtctcaacaggcaggtgcgtagctttcaacgggtctgtcaagacgtgtgaggtggcggcctggtgcccggtggaggatgacacacacgtgccacagtgagtccagccctagggaaggaagtgcctttttgttttgttttgttttagacacagtttcactctgtatcccaggttggagtgcagtggtgcgatcttggctcaccacaacctccacctcccgtgttcaagtgattttctgtgcctcagcctcccgagtagctgagattataggcacccaccaccacgcccaactaattttttgtatttttagtagagacggggttttgccatgttggccacgctggtctccaactcctgacctcaagtgatccacctgccttggcctcccaaagtgctaggattacaggcgggagccaccacacccagccagaagccaccacacccagccggaagcaccttcaactctgcgtgtcagccttgaacagagacctgcttttttaaaggctgcagaaaacttcactcttttggttaagaacaacatctggtatcccaaatttaatttcagcaagaggaatatccttcccaacatcaccactacttacctcaagtcgtgcatttatgatgctaaaacagatcccttctgccccatattccgtcttggcaaaatagtggagaacgcaggacacagtttccaggacatggccgtggagggaggcatcatgggcatccaggtcaactgggactgcaacctggacagagccgcctccctctgcttgcccaggtactccttccgccgcctcgatacacgggacgttgagcacaacgtatctcctggctacaatttcaggtttgccaagtactacagagacctggctggcaacgagcagcgcacgctcatcaaggcctatggcatccgcttcgacatcattgtgtttgggaaggcagggaaatttgacatcatccccactatgatcaacatcggctctggcctggcactgctaggcatggcgaccgtgctgtgtgacatcatagtcctctactgcatgaagaaaagactctactatcgggagaagaaatataaatatgtggaagattacgagcagggtcttgctagtgagctggaccagtgaggcctaccccacacctgggctctccacagccccatcaaagaacagagaggaggaggagggagaaatggccaccacatcaccccagagaaatttctggaatctgattgagtctccactccacaagcactcagggttccccagcagctcctgtgtgttgtgtgcaggatctgtttgcccactcggcccaggaggtcagcagtctgttcttggctgggtcaactctgcttttcccgcaacctggggttgtcgggggagcgctggcccgacgcagtggcactgctgtggctttcagggctggagctggctttgctcagaagcctcctgtctccagctctctccaggacaggcccagtcctctgaggcacggcggctctgttcaagcactttatgcggcaggggaggccgcctggctgcagtcactagacttgtagcaggcctgggctgcaggcttccccccgaccattccctgcagccatgcggcagagctggcatttctcctcagagaagcgctgtgctaaggtgatcgaggaccagacattaaagcgtgattttcttaatccctgtctgttgtctcatagcatgtgctagaactttccttcctacccttttacgacaaccagtaaatccactattccggctcactgtgctcagaaaaggtccatgggatggtctgtttctggcacttatgcacattttcccctacttctttatttatttattttatttttgaggcagagtctcactctgtcgcccaggctggagcgcagtggtgcaatctcggctcattgcaacctctgcctcccgggttcaagcgattctcctgcctcagcctcccgagtagctgggattacaggtgcatgccaccatgcccggctaatttttgtatttttagtagagacagggtttcaccacattggccagccaggctggtctcgaactcctgacctcaaatgatccatctgccttagcctctcaaagtgattggattacaggtgtgcgccaccacacctggcctatttatttttttt

SEQ ID NO: 2765 - DNA, 936 bp, Homo sapiens
gggcgatcagaagcaggtcacacagcctgtttcctgttttcaaacggggaacttagaaagtggcagcccctcggcttgtcgccggagctgagaaccaagagctcgaaggggccatatgacactcctcccggacccctggacacacacagccctggagactggagccttggagcatggcaagtccagagcaccctgggagccctggctgcatgggacccataacccagtgcacggcaaggacccagcaggaagcaccagccactggccccgacctcccgcacccaggacctgacgggcacttagacacacacagtggcctgagctccaactccagcatgaccacgcgggagcttcagcagtactggcagaaccagaaatgccgctggaagcacgtcaaactgctctttgagatcgcttcagctcgcatcgaggagagaaaagtctctaagtttgtggtaagcagagattgggaaatggtggagcctctttcactctgcttccttcctggccctgaataagtcttgtagagcctcaggtttcccaactatgaaatgggtcaacacactaactcacagctttcttctggagaaaatggccaaagagcaagatttcaggctcagcacctgctagggtctgtgaggattcgaaccatataagtcatatttcttggtcccaagaaggaaatagcccagtttaatcccatcttatcaggtgtcagtcacctgtgtcctttcttcaccaattttgccatatcactgtatctgttctaattattattacttatttttttctttaaattggatcactttttaaaaacatgaagcacatttatttcaaagagaaataccttaaatggaaaaccaatatcacatggcacaaagcaaaagtaacatactagaaaagtcgatacaaggaaagtcaatacaaggaaagcta

SEQ ID NO: 2766 - DNA, 902 bp, Homo sapiens
gggcaggggttccggcaagagctgggttccagcctgggttgccaccaacagcgaaagtgactgccaggtggcagtagggtgacttcaccagcttaagtgcttagcgggcaggcgagggggcggagcaagagaagaaaacacaaagggccggaaggaagccggggagacaggtggggtactcgggaagctggagcgggccggcggtgcagtcacgggggagcgaggcctgctgggcttggcaacgagggactcggcctcggaggcgacccagaccacacagacactgggtcaaggagtaagcagaggataaacaactggaaggagagcaagcacaaagtcatcatggcttcagcgtctgctcgtggaaaccaagataaagatgcccattttccaccaccaagcaagcagagcctgttgttttgtccaaaatcaaaactgcacatccacagagcagagatctcaaagattatgcgagaatgtcaggaagaaagtttctggaagagagctctgcctttttctcttgtaagcatgcttgtcacccagggactagtctaccaaggtgttatttggcagctaattctagatttggatcattgcccaaagttgcacttgctggtctcttgggatttggccttggaaaggtatcatacataggagtatgccagagtaaattccatttttttgaagatcagctccgtggggctggttttggtccacagcataacaggcactgcctccttacctgtgaggaatgcaaaataaagcatggattaagtgagaagggagactctcagccttcagcttcctaaattctgtgtctgtgactttcgaagttttttaaacctctgaatttgtacacatttaaaatttcaagtgtactttaaaataaaatacttctaatg

SEQ ID NO: 2767 - DNA, 2463 bp, Homo sapiens
aagctctgggctggcatgagagcccacgtggtatctgcaccctccagtttgctgctctcagcctcttgaattcttcccagtatctgctctgaatccccagagctacagctccttcgaaatggcattagtacaatcaatagaaatgagttgcatgactatggaaatgagagtgaccttgggtcatgtagctgatcatcttgtatccaagaagtatttctctcaagttctcctaattacagattcagcagcgggtctattgtgactcctgattttagagtgcattctacctgacacgcagtttctcttacagtaaccaggtacccattgtgctgtgattgtggtagtagcatggactggagaaatttgatgatgtgttgaatgctagtcatttcctcagaaaaatggccaggcgtggttccatttgcaggggtggctgtgtttcatctcacatcatccacttaccctggccaaagcgagttgaaccagagtcaccaccagacccaaagacagccatgtataggccagcagctctgcctagtgggaaccacatttatcaatggtccacccaatctgcaacacatgatgtcctgatgacttcctctctcctggcactctgtctgctcttccctctcctaacgccctcgcagccatccttcaaggtactatccaggcttgctttctctggctcccacactgtctttcacggggatatcatgaaagcccttatggtgtctttgctagaattgggaaaacacacccctctcatgtaaaatagtcttatttaatgcattaacctcattgcacacctgcacacgcagcagcctgtgaagtacatgccactctcataaccacatgtgccactcacatcgtctagaagcaaaagcccatagggtaccgtgagctgagtggctggtggtacttcctaatattactaacataacgattctctctgaaaccccagcctcgccccagcccactgtgtgttccactccaggagtcagatctgattctaggtcctggttttttcctgtgtgcgctgctctgttgtagtggctgcacccatagctgaccacatcacagatgggtcacatggagctctggacaatactcttccccagctgatctttgacaaggtccttcctttcatccctttatcaataagattggttacgtttgaagctgattgaccacctatgcctaaagaagagtgatttatgtatcacctggaaggagacacccgaggtcacgccacaggtctctcctcagccctggccatttcaacgtatttatatgcaacttggacctagagctagaaggcaggctattaaattttatgtaaggcacaaaacaagaaggtttggttatttaatgaatgagatgaatgacagaaatgtctcaaaattacttagctagacaagaacaaaagtcaatcacacataaaatgaactttaacaggaataaatcaaattttcagaaaatacacaagtgcaggatgggagagatttggcctgaagcacttcctgagacaaagaaatggacaatttagttggcgataatgctgaaacagtggaggtcattgtgcgtctgcctaggagaagtctctcccactcattcccatctgttctgggggccactgtggaggaagcgtcctccaagagcaggcaggcgaaggggagtgacaaggagggtgagaagtcttagccagcttatctaagaagaaatcattgagggagatatatttaggttggagagagaagaattgggaagctgatgcctctctcaggaggcacagagagaagttatattgggtagatcatgtctctacacatgagaacttttaaaaatttgaaatgtccccaaaatggaattaggtactttctgagcaaaaaatgaacatctttgtatgtcaacaaatatacctctacaacagaggttcataaatacatttttttgtattaatatgtacaaagcgatgtagaagacattcctccactgagggacaggttagaacttgcaaggtggcttatgccacacaacatgggccagctcagctccgctgtctctgaaactttcttttgtcagcagagcaagagtagatttatctctcaggggaaaaattacgttaattaggctcatgagtgaatgccagcttaatatagtataatgaaaaatatggcaaaagaaccataatgggaagccagataacaatcaaagttgcaggggacacccccctcttggaggttctggcagattaattggacatataataagtaaggaaaaacgtttagaatgattgaggattcagtgaagtttccagctgtaaaagaaatcttaataaaagtttcaacttttctatacattagctataccccattaaaatacaaaacagaggggaagaaatccactatgtgatgatcacaacactttactgacataaacaagaagacttgcctccatcatgct

SEQ ID NO: 2768 - DNA, 8937 bp, Homo sapiens
atttatttttattttatttaaaaaacatattgaggtgaaagccacataacataaaataaaccattctaaagtgaacaatttggtggcacttagtatgttcacgaggttgtacaactaccacctttatctagtttcaataaatttctgtcactgtaaagtaaaaccccttactcattaaggagtttcttcctgttcccccttcccacaacctctggcagccaccaattcatgtcctgtctctatgaaagacaatttatttttaactttcttatttgtaaccaattccttccctgacactagtggtctgcccttttagtgtgataatgcatctttttccgctctgtgaactaatggtcagaagcaagggaattagactttaaaaggtcagggttaatggctgaccaatgaagagaaggcagtgagtagagctattgccatgtaatgcctgagagtaacttttatttcaaaaggatgtatccaccattatgccattacgtggtgcttctatcctcatgagacagggacaatgatagggaggaagaggaagggaggaatgggtgaaggataaaaggtaacaaaataaatttgtccttgttttagtcttgtcatctcagacatgatctgccctccgcttaactggtatcactgaggcagcttagttagatgataattttctatgtaagcagcatcaagcatttgccaaaattttgacatgtatgttggttttgtgaaaggaaaataaatctgggggggttcccaaattgctaagctaaagggaaaagtcaagctgagaactgggtcatgcaagcctgcctctcctttcagttcctaaataagatggctacaagatgaaaagctatatgcctcccccatattttgcccacatggaaattcctagtgagctccaagatctgtaccctaaggtgtttctgttaaaatttcaccatagcaatgcaaattgatagcttatctttacaggtgcagtcaccccgcccccaccccccccagacacaaatgaatatctgattgttctcctgccccactctttctatattatctgctgtaaaaatgcagattccctgcattattcctctgccccatttgtctgtgtcacctgatgtaaaaaaaaatgcagattcactgagccagacaaaggcatgaatgactatttttccctaccctcctcttacatgaaaattgtgtacttctcaatagcctgccctttcccttttaaatttggagccctcaaaatcaccttcggagaaaggcatagacctgtctcctgtgtgcacatccttaactttggcaaataaacctcataaaatgatagggacttgtctcgttatttttctcgattgacagtttttaagcaaaagagccaacagtcctttctgtataatttctagagttcatgcaaattatttactgtctcttcctttgctacatttaggagtagctgctgacttttttcaggaacacagcattaatggctaatgaaaaatttaaggaagagtgaatatggactgaaaacagaataaaaattgttacacctcaaccagaccttaatcttccatttacatattttcatttctcttatatcaaacctgcttcctccaaggagctagagatacagttgagaggatatacccacatattaaagaggtatatagcaggtaggatgttactcacttagttgtagaacccccgtccctactgctaaacgaacccttaatagcggctacactgttaggatgtcctgatccaacatcgaggttgtaaactctattgtcaatactgattctagaatgggattgcgctgctatccctaaggtaacttattccgttgatcaaattattgggtcaatgtgtattaactcactaagactagtgcgatcttagtttaggttgtttggaggttgaattatgctccaagttcacccctaccaaattttttaatgcaggaatagtaggctagggcctgtaggcttgtttgagtttttatttgcattaatgaattaaagctccatagggttttctcgtcttatttgtttatatccgcctcttcacgaataggtcaatttcactgattaaaagtaagagacagctgaaccttcatatggccattcatacaagtccctatttagggaacaagtgattatgctacctttgcacggtcaggataccgcggctgttgaacatatgtcactgggcaggcagtgactctaatactggtaatgctagaggtgatgtttttggtaaacaagcggggtaagatttgctgaattccttttactttttgtaatctctccttagagcatacctgtgttgggttaacagtgtaaataatagggtgcttattatattggttattaatattaggctgttaactgtcagtgggttattctggtctgatgtaagcttatgcaatggagaatgtcttcatgttacttacattaacattattgcttctattaagtaatagattagtccaatgtgatgttaggagttcagtagactgattagaatttaagatagttagctgttgagcttaaacgctttcttaatcggtggctgcttttgggccaactatggtggtaatattttttactctctgtaggaaggttgtttcctagggtctaaagagctgtccctctttagactaacagttaaacttacagggagattaagtaattctgtgggtaagtttaaagctgaactaagattctatcttggacaaccagctatcaacaggcttggtaggcttgtgaccgctactcatgcatcttcccactattttgccacataggtgagtgtgctctttcagctgttcttgggtagttcatctggtttcgggggacttggctaaagttctctgtgtatagttatttctagttaatacattatgcagaaggtataagggcttgtctttgctttttagtgcttgatacagttctttcatctttcccttacggtgctatgtctattgtgccagggtaaaaatttctatcgcctatacttttgtctaaggtaaatggtttaagatagttgataatatttttagcaaggtttggggccagagttggctcaaagtgattaggtcatgatgaaatcttctgggtgtaagccggatgctttgggttaagctacattttggtatgtccaagtgcaatttccagtacacttaccatgttacgacttatttcctctatacttgcgtagaaagttattagtaatagtgatttctagagtaacagttgaggagggtgaccggcggtgtgtgtgtgcttcatggccttattcaaccaagcactctgctcttggtttactgctaagtccaccccccagtcaaatccaacagaccataagaccacggaggaaggatactttttgggggttctgatgcgggagctacagaaggaaaggctgcagagtggaggtaccatcaacagtgaaagcgttgaacattaagacagagatgacatttaccatcaaatccttggtggtgcctttcctttccttagtcctgtttgttgaggagccttggagaatgaagttgtggttaaatgttttaatggtagtcactgaagatgtctcaattttttcagctaaaaggaaataaatgggaaaaaatgttacccagaagatggactgattgattgttaaggaaaaaacaaggtggccagattactcagacttttgttctagacttggaatctcattcctgtactgtgtttgattgactatgggatctttttgttttgtgtttatttttatgatggacaaataagtcagggcatcattgatagctttctgtggaacgatagctcagagataacccagtacagttcataaatacttatgtgcagtcctgaaatagaaaaggttctaaaacttgcaaatttttacaactttggagccaaaagaatctgattataaaacctgacctgaactgacatgaggccatttaatgtccttgtccatctcatggagtgcaaatgtttttgtgctctgctgtaaggatattcatgtgtttgtttgattttcagatgctgcctagatgccatggggggtgtaaagaaatatacagcacgtgtactatattacctttctaatgcccaagaaattatgaagcacatagggacccaagggtttcaaataaaggactgtgaatctgtgataaattttaactgcatacagttttgtagattataaacattcaataaatgtttgttaaatgatcaatagcagaaccaaggcccaaatgcacatttttggactttctcctcctctaatttgtaaatctaaatttctagtttggtatcacccttttgtggcttctgaacctggggcatttgttgaaaatgtccattagataaaggcgacatgactggcattgccagatcatttctagattggacactgtggcagatacttttggtgttctgttcacttctctttgacagtcaccattccagcatattccaacagatcctacagcaagtaccaccactctgtcttggctcatgcatggggcaggtcagaagtaccagggagttaatacctctagaagtaactctcagccagagatggatgggagttttagaacaaatatcccatctccctgccctttgggcagaaaactctgaggtgcagccaacattgtctcccagaggtcaccaggaggacttagctttatttgcccaaagaaataactcctaattcaagtaccctgtattgactgacttaatttctttctctgaatcatttatcttcttctctagcagtgcaccttccaaacaagctactttcactcctatccttgtcccagggtttgcttctggggggacccaaatcaagatagacaagagcaattctgtgtgagaacactccattagatctaattctcaaactcaggtctctttgttacccaaagtaaatgattcaggcttaattttttggtagctttgtggttttaatttagcatacctttcaccggtggagcaggcagtttcctcctttgctgccttgatgtatctatggtttgtacctacaaacagaacacaatgagcaatatacctttgcagagccaaagatattttgtcttctaaattttccaagccatgtaacattccaacagagggagaaagggacaaacacacctgggtcctttgcttctgatcccgtcttcttgtgaagcgcacacatggtgctatgtttaatcctgcaatggtcagggctgaaatccggctctcaatatctgaaatcttaaagcaacagaaagacaagattggcagggagaaaatacggaaggggaaaatatttcttaaaagtgttaagaatttataaagacaaatctgctttgatgtatgctcattcattcattcattcattcaacttctaccaaacactcctctatctagtgtgtagcaagaaaataaaacacaggcctttctttataagtttaaatttctagtttgttagctctagagcatgtcaacaatcctgtcagagtatgcctggggataaatgaaagcctggggacacgatggggaccctggcccggggccacctggctcagcatgggggtgagaagtggtcagggaagtcataggatttatatgtcctgttatagtcatttatatgtcctgctttcttcttccataacttcatgaatccaaaaccacagcaccaggttttagaagggaggcctagcggtccctggttcaagtccatctcctccattaagaagccaaccagccttgagaaactctctcccctctctgggcatcattttcctaatttgtaacatgggaaggtcaagagagagctcagattttctttcagcagagtctgaatgcagaaatggaaagtaagaacccacttagtgcccagagagaaccctggtcctcccctgtctccagaaatgaagatattgtccctgctcttagaaaagggcattattatgtgccaggaaccatgctaagtgttttaaataattctatgaagtaagtaccattatcttggtttcacagataaggaaactggctcaaagggacaagtgatacacccatcatctcacagccaatctgggcagtgcatggaattcatgtcagtggccatgctctcgtcacattgccacagtctgagaggatgtgccaacacccggtatgggggacgctggaaaaggcagggaaaggctagcagagtcaagggaagaggtcaagattctgctgagatggtacattctgagtgttgttagggaatcagacaataagctgatggtagaccctagccaatgtgtgtgtgtgctccacacatgaggtctccattgcctctcagccctccacaattctgtgctactcaagacaaatttgaattctgctgtcatttactgagggcttctttgaacaaagtctactgtgataggagctataggaggtacacagaaagattgaagggtcagcaaatttggaagatgcatcccctacccctgaggggtggcagtcatggtcagaaaaggaggaggaggtaggtgaaggccaagtctgtggcagctggtaagagaattacaagctacccagtagccagccccagaaggcaccacttgagtccttcccttcctggtccccagatgcctttctgttcttaatcttcaaatttcacattaagaactgcattcttttggtttatgaaccaacaaattacacaagcctctgagaaaagttgcaggctaagcttttaccagtcataagcaactggtgtggattagatgctcacattcttccctggaagcagttttgatggagggccttgctcagagggccctgggaaagacaaggtcaatgggaaagcaagctgctgacctcttcatttgtggactatcaggttctggaataagaaagggctaatttttcaggtttcagtccataggacaaaggacaaagaaagaggaggctactgagggctgattttgcctgtatcttctctctctatataattatgtcccacttctagaactgcatgtccaaggagctatacatttgctagaaggggatgaccaattcagctctgagtttcctgggagccaaagccaagagctccatgtccacaagatcgaagaccaagtactcagaagaacagcttttcctgatactaggagttaagagaagctttctccaggaactctcatagagacaacttgcatgatgcagtggacagcacccttagcatgctccacaagggtcattctgcagtctctttcagcactggataacggcactctgtctcaaaagtagactctaagacccatgtgggcagagaggagagttctcacctggagttcagcatggtggacttgggctgcagccgtggccacctggtcctccagatccgccagatgggtctcatcagtgccactgtggatgcagcgggcggcatcttctagctcagtcagctgggtctccagtccatacacagtgcctgctgccaggtatacctgtagagacagtgctacatttgagttcatgtctgcagacttgggactggttgggggtcccttgaggggaccccagcaattcaggggagtgagataactggacttcacattgcaggggggatgttatttttataacatttataaacgttcttcacacttaaatgtgtgaggtcttgacacccctcactgtcaaccacaccttccctctcccacaaactttcctgtaagaaaaagcatttcaaagttgcttttgttcaaatagtacaaaatacatgacatcagctatgcgaattgtgtattggtccagtgactataaaaatgactataaagaagaaacaaagagactcatgatggagttttgccaatacaatttttggttggcatttagtaattgagaaaaaaatcagaaaacaagaaagaggggaaataatttaaaataattacaaattttgagtgaattctctctgattaattagcttctgcatgcttcaacgaggttaagggaattaaaataaacctgaagtttgtaatagaaaaatatttcttagaaaatagtgtgatgttaagagaagcatgtatctatttatctgtcaattaggacaattgttgagagctgttaaaaataagagagcaagtctgataaagaaatttaagaaaaagaaacattttttacttacaggtttataaggttattcccataaaagtgagcaaggtgaaatccttgaaataattcagactaagggatgtgggccagggtgaatgaaacaaatacccccccatcctaatcaatactgtgatgaagcaaccaacaacataagaaatgagatgtatctaaagaaagtaattacttaaagagaggttcttgaggtttaatcaacatatataaaatcctaaacctgtaatcacagcaatttagagttgatttgaatgaaacatatggccaagactttaacagtttccttaatttgagttaaaaatatagcagagttgaagatgagtcaagagctcaggtacactagtcatgcacttttttttttttttttttacacttagtgatgctgtgttggtgagggaaagaagcctgagatgttcccactctgtcaattccttggcatgattcactcatctgttttaaaactggcaattttacaaaacatttcaaggtggagcaaaggcaggtacaggtttgatgaaagcaaatttgcgcatcatcatcaggcataattacctgggctgtgggagctttcagcagtgactggtacagaagatgtcacatcaaatgattcaccagtcatacaggggccatgaatcaaatgtctgatgggaattgccacacttcagtttatcttttgttttatatttctttattatatgctgaatatgtaattctgtttcatacagagaaattctgtttctaagagatcttcacaatttaatcttag

SEQ ID NO: 2769 - DNA, 126634 bp, Homo sapiens
ctcaaaaaaaaaaaaaaaaaaaaaagtgaaaggccaggcactatggctcacaactgtagtcccagtattttgggaggctgaggcaggtggatcattgagaccatcctgggcaacacagcctctgtctctacaaaaaaataaaacaaactagctgggcatggtggcatgtacctgtggtcccagctatttgggaggctgaggtatgaggatctctgaaggccaggagattgagggggcagtgagccatgatcgggacactgcactccaacctgggcaacagagtaagaccctgtctcacacaaacaaacaaacaaacaaacaaacaaacaaaaaaaaggggttttaactctcagcctatacaaaaatgggctacagtccaaaattggcccatgggtcacaatttgccaaacactaatttagagcaaattgtatatagaaaaatgaacttttaccaaccaaaatttttatttatttactcaagtttttaacacattttatgtaagattgggctgactgtgtggacactggcaggccatgttatcctctgaacctcacttttcctcctataaaataacggaggtaccattctatgacctcttagcagctttcttttgctaatattttgtgatttaatggctctgaataacctacctctgttggagttcatctttacttatatgtgatatataaaattagcctgtgaaaaacattctcccggcaagcttttggcttctattttattttatttcactcttttatttttatttctttaaatttaaaatataatttattgtccatatttgatatatacaacatgatgttatggatacatatagatagtaacatggttcctagagcaaatcagatttacatatccatcattgcacatcgttgcccatggttttttgtttgttaatgtcaagagcagctaaaatctgcccattcagcaaatacagcacacatttattagctgtagtcctcatgttgtaccacatcctccagatctgctacctcacaacctatgacctacatcccccatttccttcccccattcccatcccgtgcccctggtaacctctgttttattctcatctctgtatatttcactttttttttttaattctacatataagtgagattaggcaatatttttctttctgtgtttggcctatttcacttactggcctccaggtttatccattttgtggcaaatggcaggatctttttcttttctaaggctgaataacacttcattgtatatacagtcctaccttagtgtctataggggtttggtttcaggacctcccaagaataccaaatccacagatgttcaattctctgacataagatctacattacttgtaatatctaatacaatgtaaattttataaaagttgtttttctgcattatatagggaataatgatgagaaaaaagcctgtacatgttcagtacagatgcagtttttgtctcaaatgtttcccatctgtggttagttgaatccacagatgtggaactcatggagggcagactgtgtataccaccgtttccttatctatttgttgatgatggacacttacattgtttccatatcttggctattgtgaataacgttacaatgaatgtggagttcagatatgtttacaaggtggtgagttcatttttgggggcgtatgcccagaggagggattgctgggtcttgtggtaattctattttgaatttatttggaaatctccatactgctttcgataatggttacgttaatccacatttccaccaatagtgtaaaaggcttctcttttcttcacatccttgtcaacgtttgctatctcttaactctttggtaatagccatcctcataggtgtgaggtgatatctcattgtggttttgagttacatttcccggattattaatgacgctgagcacctttttatatacctattggtcatttttctgtcttctttggagaaatgtctattcaagtcctctgcccgttttaaaatcaggttatttgtttttctactattgaatggtatgagttctttataaatcttggatactgatcccttatcagatgtatggtttgcaaatatttttttcccaattcataggtttccattttattttgctgattgtttcctttgtagtgcaaaagcattaaatgcagggaaagccagaagtgaatttctacatcttttagggttcagtttgccttggttcggaagtttctattaaattaggtgttttggatgtgcattaattcttcaatgcctcctgggaatcatttgggacactgccatgttattactgcacagcctagtgaatctgatccgtgggatttttcccatccaatactcccacaaatgtgggctgtaactcatgctaaatgagcacatctataaaacagagaactaatacctaccttgtgggcatgtggtgaaacttaattagttaatgcttctaaagaactttcaaatccgtggataaaatgtattattcaattgctaagagctatcattgtttattatttcctctagtatttgccagtgagtgctttactgttaggatataatggcagtaattttgaaacaagctggcatttgactttgtttgcagagtgcatgaagctacaggtaacattttaatgaaatctttccctcttccccgcagagtcattaggtacacagatactgcctccttctcttaaagctttacacaattgagtagtatttaagtaacatcatcattgctataaaaagaatcaaaagaaagaatctttttccaactaagaccaagtgatttagtaacttaatccttgtttataatttttttgtcactaaggctatgtctaatggaaggaagaacaataagttgtattcaataattcactaatagttgtaattgaccttttatgttggtcagcattatagtttagataagagtcacttgagacaggccctaagttactctgctattatttatatatgtacatatatacacacacatatatagacacacacaaacacacacacacatagctttggcaaggcttaccatttttagatgtcatgccatttaaggctcacttgcaataatgtgaaagccagccagcatgttataatatgaatagaaagaacactggcctggaggcaagccacctctttagagactcagcttttccccttcttagcaagtttcttttctttctgcatttcaggtttcttgctaaattggacgattatacttgattttcaaattgtgctttttggaatttaaggcttagaacagatgcttcaaaatttctaccaacagttaagtactttccaacaaatattaaagacttatatgcccaagaaccctcatttattattttttcttatatatattgtttccttttacacttttatctgaagatttttattacttaggaaaagaattctattctgtgactcaaaagatcccttccagttctggcgtcctataatctttactctcaaaagaagctaaacaccacaaactttgacaagacttcctaaaaatacagctcttagcacagagcctatggtccatttaacagagaaggaaaatgaagctgaatgcagagaggtctaccttctgaaaggcacatttggtaagtggcagaggtgaaatttgaacccaggcaaatgtactttagtgcctgaatgcaatgtcaatgccatattgcctatagatgtttggggcaccatgctaataactgtcaggggccacaaatatgatacaaattttgtcctcctagagcttatggtcataatttaagctgaaaggaaatatgagtgaaagcactgaaagaaatgccaggcggcctgcacgtcggtggccagaggagaggtgcagaacatggctattctgggcgtcctgagaagagggccatagaagcttggcatcactgaagtgtcattataaaaccagccaaaagcattgtcagcattccgcaagatttccattgccttatccaaagaaataggagcgagggagagacgctataaaaggaagaataaaggaaacatctatttatcagctgtgttctcagtcatccctcacttggctgagctgacagcctatgataatcaggctaaggtggattgtcaggtaattctgtgcaggcccatagctctttggcttcctatcacctcccttctcccacctccctaatcagtagttaacactctcttcattgccattgcccttctcctctcatggcctttcttagtaccctggccacactgactgtatccttgtttccatttctgcttttaatttagtatgatacacatatagcattttggaattgtcctctctgataacatcgctgttgctctcctgagtgcctgagtcatcagggagaagtcccctgaagtcacctctgctgaccagtatggctaggttacctcatggcacagaaggattcagcaggcagagtagccaatagctatgactcttcctcaaactctgcaccaattctgatacatacacatgtacccacacccattttcaggggactagacactgtcatatccttgactcatgaaggagaaaagaagtaaagatgtagcatgacaccttggaagagatttatgaaactatttgttaagaattgacttgtgcagatttcaacatgatgaaatggtggtagtttatagtggttgttgaaatttgttcagagaactttctgcagcgatggaaatgtcctctgtctgggctgtctaatatagtggccacatgtggcatttgaaccctcaaaatgtggaacttgaaataaaaccaaggaaataaatttcaacttttatttaatttcaaacatttgactagtggctaccacatagaacagggtagctatggatcaaagtatccaaatattcagaactgacaatctagggtgatctagtgtcttcctagttatataacatataaggtgagtttctatacattacatgattgtatttgagcagaaaggtctcagtacatcaaggatttctattctataaatatttattggaagaacacatatgccatttatcctccagctccctgtctcagtctcagaatcttcctcagtgcagtgtttcgggtagctagtgtcaattggttgtatttgtgaagagagagacacctgatttctatctttgaggtgcttgagacaacatatattgtgtactttgatacagacatcatcaattaagacttgatgaccaaacgatctttaaggtctgatcatgagattatatgattccatcaattaaaagagaatcagttctacatcttatccagacttctccatagaacttcagaagagaaaccacctctatagcactaacatatactaaaaggatggacctctacttccaataaactccctccccacacgtaaaaaaagaacagaaagaaaaaaatgtacagcaagattttaaaccatctattggttgaagtgatatcaaataactgattgttttctctggtttctggattaatgtatacacggtgtcaggccaagtcataagcattataaaaacttactacggtcaagcacttttaggtgctggtatagtacagggtttaatgacaagttattaagtattgtaaagtgacgtagcaaaatcaacaaagctttaccaggttgtacttaagttaaacagtaattctctgtgatatatgcaataccatatatatgtatcaattctagcatcaaaatgtacatgtgtatatgtagggatttcagtgatttttaaaacacaatcaggttggcctaaagcaagaagagttatgagtaaagaggtacttgaaaaaaattaaaacattctaaacactaacacgggggacaagtgattctaaatcatgttatagctctatcttttaaaactgtaagaatgtcttacaattattatgtgattatagtaatagatcatagtattttaaaaattattctccgtcaggcgtggtggctcatgcctgtaaccccagcactttgggaggccgaggtgggtggatcacttgaggtcaggagttcgagaccagcttggccaacatggcaaaaacccgtctccagtaaaaatacaaaaatcagccgtgtgtggtggcacgcgcctgtaatcccagctactcaggaggctgaggcgggagaatcgcttgaacctgggaggcagaggttgcagtgagtggagatcatgccactgcactccagcctgggaaacagagtgagactctgttgcaaaaaagaaaaaaaattattctcatccctattgtgaacttatacctaaaatcagttattctttttaaacactcacagttattttcttcttaaatatataaattaattaatttagctaattaattttaagtaatttaagtttctataaagtcatttaaatatataaagtaatttattcatttattagtgatttattgtacaccttcttggaacaaagtatactgcagtatacactcttgagagatagtaaggtatggggcttcctctctcagatgtcggtttcttcttttggaattaggtggatgtgaatgtgtgtgcatatatgtatatatagtcatccctcagtatccatgaggacatcctgtggataccaaaatccatggatgcgcaagtcctttatgtaaaatggtgtagtatttgcatataacctatgcacatcctccctgtataatttaaatcatgtctaagttacttttaatttctaatacaatgtaaatgctatgtagataattgttatactgtattatttttaaatttaattttattcttattgtattacattttaattttattttttggatattttcgatctgcatttggttgaatccatggatgtagaacccatgaatatgagggctgactggacgtacgtgtatgtgcgcatgtgtatatgaatctacgtgtgtaggcatcatgtgtatacaggaagaaaaagatgaaagagagaaaaaaggaaaaaagaaagaaaaaggaaggaagaataaagtatgatgaaaattacattttgtttcgtatcctttgaagcaaagaggtagtgctatggtaattgaggagacagatttatatctgcactgggcctttaggaatgaatttagacctaaatggattttgagcatgcagatatgacctgagcagacagggatttcaggagaagcaacaacgatatacagttataaaaaggtggaggagatgcaggcacctgtctaattcaccttggtttaacataaaggcgcatgaagggttgttgagatgtgagagaggttactgaaaatgatggccaggtgtccagttcgggtatcatgagcaacaaaaaccctaaactttcagctgttggctgaagggagttgagcctccatataggactgtcacagatagttaatcctgtgctgattattgtaaattaaaagaagttgaatgaagcgggggcttttgcagggtgatacggaatgactccagtgctacagcagcacatcctaacttctctgacttgggcagcataatgttatagaaaaatggagtgaattggataagggttgaatatacttttgttgtggtcttggctccacatcctattacttgtgtgatttgggggaatcttttaactcttccgtagtgatgaatcgtgttttcccaaattaatgtccgccaagaacctaaggatgcgatcttatttggaaataggatcctgaattaagatgaagccatattagcttaaagggggtcccaaatccaatgattgataagacgaggagaggccgggcgcgagggctcacacctgtaatcccaacactttgggaggcagaggcaggcggatcacttgaggtcaggaattcaaaaccagcctgaccaacatgatgaaaccttgtctctactaaaaatacaaaaactagctgggcatggtcatgtgcacctgtaatcccagctactcgggaggctgaggcaagagaactgcttgaacctgggaggtggaagttgcagtgagccgagatcatgcctctgcactccagcctgggcaacagggcgagactctgcctcaacaaacaaacacaacacaacaaaacaaaacaaagcaaaaaggagagggcacacagagaaaaatgccaaagtggggatgaaagcagaggctgaattgatgcatcgatgagccaagaacaccaagtattgcctgcaaccaccggaagctaggagagaggcatggaatagattcccccccagagcttctagaaggaaccacccctgcagcacgttgatttcagagttctggcttctataaccatgagaaaatgcatttctgttgttttaaggtgcccctttgtgctactttgttatgatgaccctaggaaacaaatacaccttcaaacctttatttacttcattgtaaaatggggatgatgatttttacctctgagagtttcgataagaattaatgaaccagaatcaaattaagaatacatttatcacatttaaagtgctctacaaatatctgcgaatttaaaactccattttctagtgttgggaaatatatctaaccattactgagcattaactgtgcatcaaccaaagcattaagcacattatgcctgctctctcacagtagaattagcaatatttagttgtcattttacctgcttggcatttgaagcttgatgtcaacaaaattttgtaagtctttacttactgggggaaaaagtgagtgcagtggttaaaatgagatgattaatgcatttttactttctggcagtggttttttttagtcaaaatcatttctttttctctacagataagcaaaattgctatgctatggtttaataagtaaaatatgtatatcaagttaaaataaaaatttcagtgggtgttgaattccatgctctggttttcaattactactcaccctctcttaggaaagtcacacttctcatttgccttggattagatggggggaaggagctccatgtaccacatcgtaagtgtaatatggaattccaggagaaaatgcatgtgtaaagctatttagctcagttcatttttagatgatttggcaactgttggctaatttgtttgcgttgctctcctgagagaactatgagttgggttcttttgtaacatggaagctgaaatggagcagttcagtgatttactaatatgtaaaaggagtagatattgctgctggagctggactcccaggagtttagggctctactcattgatgagcttcccccactagcatgtgaagaccccaggcagcacccacaaactattcctgaccatgctttaaatggccaaataatttttctaggtttatagtatatcacatattgcaaaacccatttgctctgtctttagccttccagtttccattccactgccttatatgcagaaatacaatgataactataatggggtatgccacctgccttcaatgtgtcatgtctagtaatggagagaggaagttaaatcacagtgtgtgaagtggcatgccattttttagagctccactttaaatagacaaggccacttactttcagcaagaatgtggaggaattatgtagaccaaaacatccaggtgctaaacttgcccactggtgtggtacaaggagttaggaaaattatccaggtgtggctgcaaatgagggctcaatgtggtgaacaaatgatgttagcaagattttcagttatagttaaacagttgctgtgggaagccaggagtgctatactggatgaagtgacattacgttccagtagttgggctagatgtcgtgatggatgctagaggagtgtgaggacacagttagtctcaaatatccagacactggcatcagagtcgtaggacctagtgtctagcctgaagtttaggaataggactcttctctatgaaaggggaagtgaaaagcaaattcgggccagcaaatagatggaggacactgaactctgaagcaggttagcaaaaaaagatccttctcataagaacaaaggcaaaaaaagtggcaatggctcaggaactggagaaagagataaggaataagctgctggcaaggacttgatacgtttgaactccagaatatggaaccggagacagtttagtaaattgtgttatgaggcaaaatttggggggaaagccagaattggaagtgcctgcagatgtgaaacatagctttagcctcagctgttggggggaagaagagtgaagaagtttggaaccagactaggccataatatagtttttctaagaaaaaaaaaagtgggccgggcgcggtggctcatgcctgtaatcccagcactttgggaggtcgaggcgggcagatctcgaggtcaggagattgaggccatcctggctaacatggtgaaaccccgtctctactaaaaatacaaaaaaaaaaaattagccgggcgtggtggcgggcgcctgtagtcccagctactcgggaggctgaggcaggagaatggggtgaacctgggagacagagcttgcagtgagccgagatcgcgccactgcactccagcctgggcgacagagcaagactccatctaaaaaaaaaaaaaaaaattgaatttttttatagcaacaatgtgtcacacagcgttaagagcacaggaagcgtggaagagttctagttcagcctttgttaggtatcaggggcatgaccctgggtaattttttttttttagccctgatttccgtatctataaaatgaaagcatttctctatattaataattcccaaatagcaggccatgggctgtgtgttaggctgttctcgcattgctataaagaaatacctgagacttggtaatttataaagaaaagagatttaattggctcatggttttgcaggctgtacaggaagcacgatgttggcatctgcttggcttctggggaggccccaggaaacttacaatgatggcagaagccaaagagggaccaggcgcatcacatggccagagcaggagcaagagaggcgggcagggaggtaccccacacttttaaataagcagatttcttgagcactcactcactatcacgaggacagcaccaaggggatggtgtgaaaccattcataagaaatccaccccatgatccaatcacctcccactgggccccacttctgataccggggattccagttcaacatgcgatttgggccggagctcatccagactatctcaggctggcactaagttgctaataaggattacctagggagcgtgttaaaaatacgtgttcttgtgttatatcctcgcagattgtgcttgaaatagtcgcggacagatcccagaaatctgtgctttgaacaggcactccacgtggttctgaggtaggaatggagatgagactaccttagagaccgtgaagtctctgcaacattctgtttgtagtattttctcttatcatcatttgcctttgtacttttttgtattcatgaattgggatgatgctcaaagatccaataaagaagtttattggcacactctttccagcagtcacttgaagtctgggagccaaataatgcagggaagttagtttttattgcttactcagccccagcagcacaaacaatcaaaagtccaatctagaatctgttttcatctgacttctgagcccatttttgcagatgcagaagtttgcattcttgagatcgctggtttcctttttctattttatgaggcttttctgaagcctaactagtaatatctccccaacattttaaactctttagagaaaaagttttcataaataaatataggatcagtcatggtggtgattaggtgatttctgcagtaatgcaggacaagggaaaaactttctggagtttgtctcagatgaagtaaatcaacttgctgtgttcagtgggttacttttggagaacatgatatgctctagggcccacatgttaccttgttctccaaaaatagcatttcctactcattaagcaaattaattctttgtctttcagaagataaataatttacagattcttcctagattctaaacctcatagtcagtcatgatagtctgttttatcttatattcatataaagttaaaattaaacattattagaaactttgtagtttacagaaaccatgttccagagagaggaaatggtttgctcaagatcacacagtaaattggtggcaaaaacagtctcagcctctggttcttagctctgcattcagtggccaataaaaataataagaatattctccatacctatattagtcagggttctccagagaaacggaaccgataggattgtgtatgtgtgtgtgtgtatatatattaatatctatgtagaaagtaatggtaaaaaccacaattacttttgcgtcaacttttatagtaaaaagtatatatttatgtatatatgtgtatatatgtatttatgtatatatttatgtgtatatatacataaatgtatatatacttttttaatgtatatatttgctatatatacattaaatctataatgaaatcacaggctcacagtgtcctccatctatttgctgccccgaatttactttgtatatttatgtatatatatgaaactttggttggaatgaaaaatagtatatatatatatacacacacacactaatatatatatacatatatgtctgtgtgtgtgtgtgtgtgtgtgtgtgtgtgtgtgtgtgtgtgtgtattcctttggttggaatgaaaaattgtatagcctctctggaaaaaacaatttggcagtttttatttatgttatgctcttgagttttattccagaaaaacaaaagtgtattcccacaagaacctgtatatgattgttcatagcagctttatctaaaatagctctgaagtagaaacagcctaaatatcctaaaacaggagaatggtttaacaaactgtgttacattcataccatgaaatactactcaacaataaaaagaaacaaactattgatatctaacaacatggatgaatctccagggaattatactgagtgaaaaaagccagtcaccaaaggttatttactgtataatcacgttcatgtaatgttttttaaatgacaaaattttagaagtggaaaacagattagtggtttccagaggttagagatcagttggtagggtgggaaaaggaaaggagagtatgtttataaaagggcaacataaaagatacctgtgacaaaactcattttgattgtggtggcctccacatgaacctctacatatgataaaattgtatataactaaacacacacacacacacacacacacacatgcacacacacagagtacaagtcaaactgaggtctgtgaattatataaatgttaatatcttggtagtaagactgtaatagttttgcaaaatattaccattgggggaaactacgtaaagtatacacgggttctctctacattatttcttacagttgcatgtgaatctgcaattatcttgtaaaaatttcaaataaatgatatccctactaataagcaagttagaaaactgttagtatttttcttgtgcctcaaaaggatatttgtatgcttctgttgttgtcaaggacagaggaaaatagatacttctatactgtactgatgggagtagaaattgctgtacttttaacaataatttgatatatttaatcctttggcatgataatttcacacctgtgaaattgtcctaggaaaataatcagaaaaatgaataaaatttacatataagtgtttaattatagtattcggtatagtgtattatgatagcaataaaactaaaaataacctacataataaaatatagtattttatatgttttattaaaattatattttccaactatatttgttaattggagaaatgcccctgagacaatgttaagtacaaaatataagataaaattttatttattatattacaaactatatatcaaaatagatatctgactcctatgctactagctatgtgatattgggtgaattgctaaacctctctatggacttgttatctgtgcaaaggaatacaataggaatcgttcattttcttttttaattaaatgattatagctcttccaagcatatcctagcatgtagatttttaagctgataataaatagcagttgtatttggttagtagtaatacgtctcatatttacactcttctgtattttaaaaatctttaacagtgagcatgagcatgtgatactttttgtttaaaaataattagtataggccaggcatagtgctcatgcctgtaaccccagcacttagggaggctgaggtgagaggattgcttgaggccaggagttcgacatcagcctgggcaatgcagtgagacaccacctctaccaaaatttgtttaaaaattaactggacatggtggagcacacctagctactgaggaggctgaggtgggaggaccgtttgagcccaggagttggaggctgcagggagctatgatagcaccactgcacttcagcctgggtgacagagcaaggcccattctctaaataaacaaacaacaaacaaacaaattggcatgtatatgtagcgtttaacttattccttcttactctaatgatgactaattcctgtcgatatttaatttatatccaaaatgcctacagttagtccatttctgagagaaaaagacatgcaaatgtctacccagctgaaattttccttatagattctcttggatagtgacagagtctttgaatggagtatttaatttttaattttaactatgcccaaatatagggtgtatacttaaggaatatgatttgatcctgaagagcagaaaaaaaagcgttgaaaaatatttactgttaattttggtagtagataattaattgactgcctggaaaattaatcactgatgagaccatgaaataaataacatatgctaattatttcaaaagattgagatgatacattggtgattggcattgaaacctccaaccacttactgggtcaggttatgaagcatttaatcatttacttattcttggtgagcatttaatttgtgttaaaaatggcagtcattatagcagccgtgagaaaattttgtagactttatgcattgcagcactgtcagagcaaagagcaatctgaggaaataagaagctacagaatgtgggtcaacagggactgtctcatctttctaatatcatctatttatctaattttacccaacaagctagctatcaatttacttttaaccctttaatcctaaccttgggatcttgggaaaaattgcagttcatggtattaggtttttaaagtttagaaacatgacatctaataactgttttgcccattatttgtttccatttgtatttgttcatgcccttttccttttgaatgtattttgtgtttttcttttcaatattttattacctaaataccctttgggataatctagacacctagtaacaaagtacttgaaaaaatatgactttttaaaaaaagtttattttctgaaaatagagatttttcctttatgtatttgctcagtttttaagaaaaaacctagaatctgtattgctttctgaaaagcattagtgtttgacactaatgtttcttgtttaatttttaaaaggcagtaacagcctgaacttattaggttctcatttttaaatttttaatatagaaaaataatttcaaaacagaaaacattcaagtggctattaaacatatggaaatatgctcaatctcagtcttaataagaaaaaagcaaactaaaaattaaacatcaatataccatttttaaatccacaaattttcaaagatgagaaaattttataacacactctattgactcagttgcaaggggaacaggtactcataatacaagtatgagaattggtataatatttatcaaggacaatttggcaacatctgtcaaaattacagatatacatattttgatccagcaattctacttccagaaatttacctcagatatcctgggacatgtgaaagatgattatgtaaagtaatacatcatagaatcatctataaaagcaaaagattagacacaacctaagtactaactaaatgatggcacatctataaaatgaaatcctatatatttgaaacataacaaagcttttaatgtgctatatggactatttcccaagcttgttaagtagacagagcaaaggtacaggactatgacagtagtctgtaccctatttgcttcttattaatgttttcataaagtatctctggaagaatgcagtaaaacatgacaaaatggctgctctatggaagggtactgatggatcacaaataggggatagagacttttaaaatgtatggtctcttacactttcggtttttaaactatgtgattatgctacctaatcacaaaaataaattaattttacaatcattgtatacacacataatatatagtaaatggaaatgtttaaaagcaactttctccttgctacgaagctaattttttcctaatatagtcctttaacaaggaagatgctatataattattttataatactgatgaaaaatgattttttaaagtttaaagagaagaataaagctttgcagcattgaagtcagtttattacctctacttgtattattcacatgagaaaaaatataaatgaacacctaaataagtgaatcactttcccccttctccttcctcctcttctctctgctcctcctcttcatcttcttcttgtctagtttatctgtagcattcgctggtattggaaggattttcaaaatacattcacaaaatataggtatgtgcatgacaattgtaaattaatatttagatattcatctaaattatgtttttcctatgttgatataaatagaaacaggcctaactgcctttctgcacataccagccttattttaatagggattttattagtttttcattcagtttcatgtgggatttttttttttatctaagagattgttccgcatttgctactgggttgtatgccctatgtatatttctatggaaagtattagcaaatttcactaatttttgctattaccaactctaaagaaaatatggaaaaaaggaacttaaaccacggagcctcataatgtcatgtcatctcaatctagttcaagatatggtgtgttttcacatttaattaaccttctgtcacatcctgtgataacctagtcttaaaattgattatacagtcgagcatgtttttggaggctccataaactaattactttttgaaacatgcagttttggcaactagtcatgattacttctgaggctcctgtaaggggctgtcaaagaagggctcagctctgatgcaccatgaaaaaatccaacagggaataatagccgagagagaggtgaagttggtgaagttattggacttccttggtctctggctgattttcttacagcctctcctccttctgctgaatctgcactgcagtgactcgtttatgttctttacacctaaggaggacagcattctactgtaggcaaacgtatgaaagaaactaatggaagtctggtttccttcattcatagagccttgctctttctgcaaaacaaaaccaatacatctggataaaaaacagaatacaaacaaagtaaacaccagggactatgtacaaaacaaaagagcaatcgcaatttttagggcattatatttacaggattatgaagaaattcagttgaccttgaggcatcaccccccaaatctgtattagtagcagtttacactggcattcagataccaagcatcaaaacgtgtaattttagcaaacattgtaatcccctgatcagaaatcccatccagagctgttcacaaaaagcatatttggcttgcttaaatttttactttctgttgtctcatcagaaaaaagatgatacccccctctgtgctcttgtagtccatttggtactgacttcacttttgccttgttattagttgctttcatgtcaacatgaacatgaacatgaacaaacagaggacaaagaccatgttatttctatctttatctaccataacctctagcaggggacctggcttatagctgttacatggttgatgtttatttgatttaattgaataatgagtgacactttgattatcccaacgtaaacagaggggaaaggaagggagatatgccaggtttgatatagaaattggttttatttctaatatattaagtgcttgctgcaaatgtcataatccagaaagattgttctgtggtccctggatctaggagagaagacgccactgacttgctctccttggttgtccaggaaggccaccctaagaaaacaacaaaaccttgatttctttagccacgtgtgtgtgtctgtgtctgtgtgtaagtgtgtgtgcatttgggtcctcacctgatgaagaaaagtgagaaatctgtttatttgtgggtacaaggtgtttcacagtttatgaaatgcatctgtgcttttccatgatcatatttaatgttcaaaacggtatgagaatactttgtctagtttacaattatgtaaactaagcttcagaacagttaagtgatttgcctaagttctcctagttagtaaagattggaaccaagactggggtaaacttgaattatgtggggacctgccttgaactccacagtgactcccactgactggtggtccctgacccctccttttcctagtcactgtttccatgagagaatgttgtatgtcttgggtgtcttagggtactgtgaggattggaaatatctgatccaaggattggactcctagtttagtggtttctgctcagggcattctaccaatgacttacctactgtctcatcggttcgatgataactctagaatggctccatgtgaggttgaaaggagcactcctggatgactctgttcccgcatgtctctttctttccctttggactgctccatagccttcctgtctctcagttgctacattttgcttgatacccttgggctgagggagggcatgctgtggaaatgattacatctacataccagttggcacagagaagccatgctgtgcgtatttatttgtgcccatgccatttgacaacagcaaaatttagtacttggcttgcatttgtaaagaaattggaaaagaggccttttcctcagtgggctactcaccaacaactggaaagatctgagttctcaatcctggatggctgcaactttcttcatatacatctggcattatttgacttctcgtcacagggtaaatatttgggatagaagatatgtaccaatttcccttattgcccccaaagaacttgcgttgtatcatttccactagtggcattggagcacagtaccaagcgtcttgccaagctttccagatttcttgaggccccttctggttctgagagcaacagttcttagggctggaggcaggaggatgtgtgcaagtgtatgttccttttttttttttttttttttgtatttgtatcttgcctaagatattgctgaaaacttaatttaaccctgctacttccctaaacaaaagacacaattttctcatcaataagaatatctactttttgacaggcactatgctccacgagtcgtctatattatctctactctaaaatagccctgcagagtgggtgctattattcccaatatgctatgaggaaagtgagggactccatattttctctaagatcacagtggcagaacttcaattccaaatggctcttgtcgggcttcaaagcccatgctttttctggtatgcattactgcatagctgaactacacagaaacttagttttacaaaaggtgacaattaatttcacacagtaacttttacccaacctgctacctatgggaaaaaattctggacagaaaataaattatacaagaaaaaagaatttcattgaggaagtacatttctctataaaatttttgaggaaggaaatttatttatgaaaattaaccagctaaatgcaggcaggaaaggtgagggaaaagcgcacatatcattttgggggtgggtgaaaacaaaaacaatggtttttaatggatttaaagtcaacaatggattgcttgaagagaatgtaaggttgaggggaggagatgtttgaaattttcaagtcatatagaattatattcccttaatttacctgactaaaaatatataagtagtatgttagagtcagatgatgctgggagttaattctccaactttacagatggaggcttatgacctggagctcatactggtatatacgtagacctagaacctaagcttactgagctcgagcccaggtctcctttgtgagctgccatgataggctttggtagggaagtagatatcccagctctttcaacttgcctcaaaaatgaatccagagctcactgcattgatgttggggggctcacagctgggtacatgacagttcagacattttgatcttaagaatatatctggacaattctgaaaccaaatagacctcataaagaaaataagagtgagtctagtgaatgatatactcagggaggacacagcacattaggtttcagaacgtaaaagctaaataatatggactcttgatcagcagcttgccaggcaagaagcttgggcagcaggttggtggcatgctggctagcttagacagggtggcatttttcctaccgtatagtttttatgcagagcacactccaagcaaataattctcagcagggaaggatgcagattttctctagtatgttacagccactggggtagatgaaatatgggccctggaagcctttttggcaaactctccgattactgtaaggagtgcttataaaaggaagaagaatgtgggctcttttttagtctattgaaaccttgaaatatttttcaggtttgagtgtgtgtgtgtgtgtgcgtgcgcgcgcgcgcgcgtgtgtgtgtaattgatcttgttaaactgaatcacgaattttttttgtgaattcagggccagaatgtattttcacgtccccctcgatgaggaggatgagagtgaggtcggcaaaaatggagtgttgacaggaagtggatgccaatgggagtgaacctgtgttgtgggggatttgaataagagttccagtaagctcttctcgcccactgagcacaaatgaccacagggtatcccggtctgaaacaatcaataggtttctcaataagtatttttgtcctctcaacccatctcagctacctgtccccaagggttaaggagaagctgtcaacttgttggtttgggaactgattaaactccattgctaaaatccattcttctgctccagctgaaaattcgcccagcaggagatggtttcctgattgaagatatgacaaaagaaaacataggtctaacaagtattcctaattattttttcaagatgttaagaatttatggccaaatacgtttggaatagagcaatgtatctccaatttcgcacattataggaaaatcaaacaagcaaaatcaaagaacttcccatagagagtgtcagaattgggtttactacttggattctaaaatctcatacctgagcaagatgcagaggtaacagtcctcaaattagtgccagcccaaacttgccaataaaagttctgaggtcagtaaaggccatggctatgataccaaatgtttcaaagatgtcagcaggaggtgctcgggggaagcttggctagagcgactgatgggaacgccagtcaaggcccagatgtacttcttcagccttgtcctgcaccttcctgctatacgcactagtctaatcacctttcccagttcctgcccacacttttcacttccctttgcttttcatatatgcttttgttttctgtgcctggaaatgcttgctccttctttgaggcccagctcaaacatcacctgttctgtaacatctctttcagattcccacccatcaggggaggaaggaggaataaatttctctttcatctcatctcatttgcctgatagaggttacaggcagccaattaaaaaatctaataacatgctaaccacttaaaacaggactactaaaaaatatgtatatgtaaattagcaaatgtttaccaattaaattagcctttaattagctaatttaattagcaaacatttaccaatcccttgtatatattacatatatattatatattgacatatatatattttttataggcttattttaagtggttaacatgttatatgattttttaattggctggctggaacctctatccgactgtaagccaggtcttgtctgtgcattcccagtccctagcaagtgtttctcacttagtagggattggtgaacgtttgctaatttaaggcggattcttggaactgttctcacccaaagagcaaatcctcttactgttttttttttagtattataagatagtcgaactttgatctatgaaggcagaagccacatttgtaattgaacagcgttattacctttctttttcatctgtgaatctgttctggaagacttagcagcttcaaatgagactgaaattaaaattttgaagcagtccatttctgagccagagttttagagagaatatttttagctttaattctgaggagaaatcggtcaaatttattattgatatgctgccattttaatacattaactaactcttctcatcttgtctatcatactgtaagtctcctcccttccttccttccttcttttcacctagaagtgataatttttaaaaatcaatctatttattatcttgccttacatcaaatggcactaatctgccagaacttgatggacttgagtctgaggtcatgggatacacattgagcttagagacctgtaccagtttggaatgcaattctatcagcagtagcattctctggttaacttagcggacttcagaattttttttttttttttttagttccccatgatatctctttataaaagaatgtactctttttcaccttagtgattccattataaaatcagaaaaacgtacaataagaaaggaccttggctgtcacttcaacaagccctctaccattcctgtaagggttgcttatgttcatcttgaatacttccattccaagcgatttattatcttccaagttaacgcattcctttgttagtcaacctcaattcttctttgccatcctgggtatacagatggagtcatatttatatcaataacccaaatttattttcctttcctatatatatgttcttaaaatacctaggatagctggagtactcccagcgtttctgggtatgtctggattgtgtgtggagggtatttccagagtattcataaactaccatgtgggtttcggaccctgttcagcatctacccagtttttcctctcctacttagcattttccttgtcaatttcttctcatctcaataatctctactaaaactcttctacctggtggttgttggactagcactatcaaaattacgtgatagctcatttgaaaggtggaatcttgggtcccacctcagacccactgaattggatcagcattttaataagagcctcaggttggttgtattcttatgtaagtttgagagggattggtctgtctaaatagtgccttatgatgcctgtggctttgcccattcttataacaccaatttcaagactgaaagaggtgcttctggctgatttccaaaccagaatggtcaagttggagaaggttctgcacagaaagtgggagaatgacttctccaattttatgaccccctttatcactttgtagtgtcctaggcagccatgtcctgaaccccactctctccgtggagcttttcataaaacttgatcctccaacctcccacctcccccactttccttctgagggatcctggaaatgctatctacaccattatgttttttccaatgactttttcaaacttctctttaggttcttaatatatccctagcctattctccttaagtctgaaatttaaaagcttacctagaaatcagttggtgccaagacccttgtggacccacatacatcacacacatgcaaataagcctgaattccttctggatttaactggaccagcccgtattcatttctattgtactgacataccttccaaaaacttcttcattttctaatttttgtcttccgaagccatgaaaaaatatacttttaacctctcttccatgtatctgttctttaggtatttgaaggtcatttttatgcctgtgtcccccaaactttctcatttctgcactgcacattctgacatctctcacatttttctcatgtttgatttttcagttatttgtccagaatatagcttaactctctaaagagtggatgatacaagttgatcacaaaataaattgatgatcacaagcaggagatagcagaaggcagagaataacaacacaggacattctcatatacatgagggtgtacataatgccgtagaagatttccacatgcaaccaagctggaaaagaactctcttactttactacctctcatgcatcaaacagatgagctactcatcttctcttctcaaaatatcactgcccatattactttttttcaccagtttatttatattctagattttagtttctcagcacttatgctgagaactcttcaaacaacaaaattctgagagtctatgcctcaaaggctctgtgtgtccagggctactcaaattattggatgttaaaaacaataggcttaggaatcataataaatctgatgtaagaaatgttgtgatggctgaggcttttataagttgatgaggtatatacctaaataaacaataaactaacttagattcataggcttcactgatggtattccatttctcagattgtagatcgtaagactttagagacatactacgtttatttgttttagttaaacaaataaaaataagttaaataaaccataagtgattttgaaacttctctgaggctgtgacaatgtggcacactttcttttctttgccaatgattccaataaatacaacttaagataattttttcagtaaaatttgctctattggaatttattacatgtaagtatctataaaatatattagttgttggtatattacatttgaggttatatgtgttagattttaagaaaaaaattttgtaagcataaaactaataattattgtagaatttttaatgctataattgattatatttacaaagaaattaaaatcatccataatcccattacttgtagataaatgtgatattttgatgtacttttttcatttttaatcaatgaaatatataaacatatacatgagtatggttattgactctatgcaatgtcatattctgcttttatcacctggcataaatttccatcttgttaaatattctttgtctttaattcttgcataacaaagcagcacaagaatatgccatgctttgtttattttaccattatcttcttgccaaacatttagatttcttttaacattttattgctttcactggaatgcatattcttgtatatatattttgagcacttctgtgattatttccttataatggattctgtgaattggaatcagtgagttaaaaattatggacatgtcatacatatgttttaaatgtgtaggtggtttagtttgtccattaattaaaatgccacttgggtggagtggatagtgtgtatggggtctggcggggctggtaaggggtgaggaaatggagaattggagttacatattctcaaggaaagaaaaggaaaatcatttgttagtagatgattcaagatcttagctattaagtaattctaaacactctaaaatgtgattttataatgagaaatcttaattctataattatagagaagggagaatttcgaatcttttcatcttctaatagaataaaaaaacacacacatttaaagtgtgtaattagttgtttatcttggcataacactgagattgtataatctctttaaaatttttttaaaaggtttatattattttcttcctgtcataaaaggaaagacacacaaaatcaatactgtaaactccgtgaaggcaaaagatggcggctgtcccaggggctctgcatctcagtcccccatagatctcttgacacatgaagagtacacagtagatatctggacagtgtagagaatctcttccttgtgacttctggagtattaaatagatctggtcaagatgattttattttcatcaaaattcttagagagtgatataatggagaaaaaaacccctgtaaacaaataaaacaaaaacagtatgtaaaggccattctgaaggttgaagtacttagaaggctggaagtgctcctctgtctagagattgcggtagatgggatttttttcttaaccaggaaagtccaggaactcacagaaaacctttctctctctcacttttcaaaggccagttacctgaaactctgtctctctgttcttcctttgccttattacagcataaagaatactaaataacaccttcagaaatgtttccttttaaaatgtagtctcctacgactgagaaaaaaacggattagagttttaaaaaatctaaattctaccatttgtagcaatacaaagaaaacacactattctctgttcatgtatctaaggtaataagcaaatttaaagaataatacagaaaaagctagataaattaacttgaatgaaatagtttctttttttcttgaaatggctcaagtccttttcaaactaccactgaagttttttagaagttaaaaaatccatggcaggatataggtttcttccttcttgtcccaattaaaagcattctgaatactaaaactctaattttattctcttcactttcgtctagatgtagaaatacaagggcagatgagcaaaggatctttgtagcagattgtttgaaaaaaggaggatttaaaagaaaaaaattagctttaactatagaaaatgttgacccttaggaaaaaatttgtaaatgcaattaaaggaaaaaaaaaggaaataaaaatttagaaataaaatgatctgtggtagggatatacagagtgctacattgaacacacgttttcacccctcatactcctggagcaagtatatgttcaggagagatgaataacaatgtcttcagtgggaagcaatggggaaggacaagaaatgctaggatgccaggggagagcatgctcttatgactttgattcaataagaaacccatccatcattccaaggttgatcattcttaccactgataaatgaattaatttacattcctttgtgtaatggccttattgcaattgtaaatttataagtgatgttttaggatcttatgcataattactgaaaaaaaaagtttgcatttttgagcctgtacacagggttggaattttactaatcaaagatttcattttggatgtttccaataatatgagtgtaagtaggaatgtgtcttggtagtttgcttggtgtacctaggatcattcacctttgacttctcttaactgggaaaattgatcatacctatttttttctttgaacatgccaagactcttggtaaatatttgtaaatttttataaaatatctggaaaattgtgttgaaggtctacaggtcaaatagcatttgttccacagaagagtcctttattggacgatttatttattacatgttctccgaacctagatataataatctattcagataaaggtaaatgaagtaagtcctatattgttttgctttcagtctttagtgtcatatttttatagcaaacactttctcatcgtactgttccagaaaataaaacagagcaagatatctgtggtatacctgtgagggggttgtctgttacaatttcctctatcataaaagcaattcctataaaaatgctcataaataaaatgagaaagggtttggaggcaatcaataagggagaaattatacaataaagttactaatctcttttcagagataattttcatcaaatgaattgtacaaaaagtcttcaaggaataattgacttcaacaagctttccactggtcagcaagactttttgctttgaagtaaaacaaaataaaacaaaacaaaaaacagatcagaaaaaaaatggtaaataagaagtagtgcctacagatcttcccaccaagaaaaatgagcagggaaaggtcaccagcgtgtgttttcaggattatttgtctatcccacagtttgtggttccaaagtatttttatcagcattaatttgtttttgccttaaaattgtggaaacattcaactcagaagagttatgccaatttaaatctcaaagaaaaatttgggcaaggagcatgtttcttggaacagggggtataaaggaaaactgatttctatttatttggtttccattaaaacaccacaagttattggcttaaatgtccctattttttatgttttgaaattaatacatgttcagcttagaagagttggtatgaaataagcagaatatgaaaatatatagccctaataatgttatttcatagctataatttgtaggtcatttttatatcagaagtagctttgtatcctccaccctcacatttttttcttactttatggtgaccattttcccgtgacatttcccattctgcaaagtatttcaccatctaggtttatcataatgtatttaatcagcctcccttttagtagccatttgtctatttattcttaattaagatgaatatcatcaattgaatatgaagtcaaccatgtaagccaaacacagttatgaaattcagatgtgtgttatagatcccagttcggcataataaagcaaaacttcgtttctctgtcttccaagtgattcatttactttcaaaaggctaacaaaggaaatgatatacaaacctagtcaattaagaagtgcaaaaatgtggagaaaatataaaaaaaatccaggtagataggagcacccaaagtccagggtcatagaaggaaagcagaggatacttcatccagtcactataaacctttaaaaatagagccatttctctactactgtgactggtttgttttcgtggccaagaactggccttggttgcaattctacatggctaagataaatgggtatatagagagtcatgtggtggcatgaagcccaagtagtattataatcccagagcctctgcaggcctgtttaacagggttgaactcatcaatgactctccgtagaatgtctgcctcatctccctcaactcacttgagtgcagagagattccctaaaacactgaatctccatgaaatggagaatgaataatttcccaaatttatttgaacgtggggctatttactcacctaaaatagctattaacctttcacagatgactactgtcctttggaacatagtttgaggaacatagctctgactagacagcattactctttctcgtactcctctagcacttatatctgttgctccttcagtatacatccttttaatatgacagcaggagtaaaacctggagtgaatatgacagttacgtgggaagtacttaagaattcctctgttcttctttctgaaaccaggtcccaggcagtggtttggttttgagtttcttgggcaattctattatgaagctgtgttcagaaccattgcctgacggtgcactttttctttatgtattttacagaatacattcaatacagcttcagatatccttaaggctaatgcaaggaccttgtagataatagattctcaatagatatttgttgaatgaatgaacacacccgtaaaacatgctaatgcaaacagtatcaaagtaagatctaaaatcaaaattaaaaagacaatccctgataacagcctccttttctgaccactgtgtatgtaggctttaaaagctagaaataattccaataagtagccatacatgcttttcaaggatactctgatcttcccagaggcttaaagagttttaaattctacaagcaaagcagaaagcagagcttctaggtatgtagcttccacgtatggcattgcaatggagctggccctccatcttttcttcttttctttcttctatagctgattattaagtgattaatatgtaatgaacactattgtaggctttgagattatgctagtggacaaaacagacagaagttcttgcccttacagaagttaaaatgtaattggggaaaataaagatcatgataagggctaaagaggaaagtaaaacagaaacggttatagggagtataaatgaggctgcaatttttatataaggaggctagcttaggccctgctgagaaggtgtcatttgagcaaacaatggaatgaggtgaaggaatatttgggtgacaacgttctccaggctgagggcacagcaagagcagaggttttgagacatgaccacacacctggtatattcgagaaatagccagggtattaggagtaagagatagtcaaagaagaaatggggaagccagatcttgcagggccttgcaggttctaatatggacattggctttaattcttacagagatggaaagtcattgaggcttttgaataaaggagtgacctgatctgacattttaacaggatcactctggtttccatgttgaataaactgaacaaggtaatggatgtagcaaagagaccaggcagaaagcaattgcaataatccggatgagataattgtggtttggaataaggtgttaacaacgggagataaacagtggccagattttatgtgaatcttccctttgatctgtggaccaatataacaagactggagagaacacacaatttcctccctggatatacatcatcactgttcatattttcttggagctcagtgtacacttctaatggcttcctttttataattgcagacaatgtacaataaaagggaaatttgattcacattcagtaagctctcagcttcttttgcttggattctgactgaccaatgagtgaaagaatctgaagaggagatttctgtacccagcagcgggtggaaatagatgaatgtgagcattctttctaattctgagattctgtgattctgtgatccttagtaactctggaaattgaatgttcaaagactgaaaagttatatatgatagtggcaccaattgtcacaataaattggaagcaaatactaatgatcatggatgtatttaaaatatttcacacctgtcctagcacagaccagtcagaacagatgccaactgtaaacagcaggcacagccatgcatcaggctgaatattagttgtgcttatgctcaggtacaaatcaaattatattttagctgacatggtctgacaaagttctacgtctgtttgaaccaagtcaagtgagcaagtgcagtgaacacagatgttttgcctaggtttgtgcctgatattttgagaaaaatattaaaaggggtataaaatacagttatgaccttctgagtgtttttaatctgtttcagaagacaacactttgcactcaaaacaaattaagaatgttgcaacatatgaggccataacaactattttacgggttcttggctcccagcagcttgcccctaacacggtaactgtgtctttcctgagatttcagagtagtgtaataatgaaagaagaacaagcttacttgcaagatattaggaattgttgacttcatgatgcttgctggcatcttaagaacagacatgcaatgtctcaagccagcgttcaacacactaacttaggcaacagccgtataaggcaatatatcttttccatattcatgatccctccctcctaccctggtttgggtgcttcccagcactataagaaccaacaatcataagccaaagtatatctggagagtgggagaagcagtcctgcaaatgcagccttttcacacgcttcaccccccgtttatgattggcttcaggaaaatctgtgttgtatggcatctgatcaagtatggtcaaggtctgcctatgcatcatctattcagcatgtaacacagttagctgggtagagggtgtgactaccgtccagaatcaacacaccaggcttatataacaaatatggagagtttgcagaattttagtttatttgacctgttgaacccccgtcattaagaagaatctagaggaagaagagaatgatcacagctttatccagaaggaacacagaatttccaaagttagctaactacagattctgtcccttaagctggatgcccattatagctcagccaaatgccttttttagtatcctcctctttaagcctgcctcactaagctggttaagtgccagaatatgtggaactgaccatgcacttcttctgcattaaatatttcggagctggtaaatttagaacaacctaaagagtcatgttatgtctctctctactgcttatcaaattggcataagggttagagacttaaaactgggggctggattttcccagagggctgaattatttaaccgtcagcaattttgaggttcacagtaaagtagcaataatgaaatcatctgcttctagatgtaaaagcatcttctcggaaggccagaaggagtttgcagctttttctatctgttgggtgttctgggctctgcctaatacacactgtttatctgacctgaaatatgagacgattctgccataggagaataaattccatataaatttaaaagggagggtctgcatgtgctgatggctccttataaggggatagtttgtcaaatttggtacatattcctctccttttttaatttttaatttttgtaggtatattgtaggtgtatatatacagagcacatgagatattttgatacaggcatgcaatgcataataatcatatcaaggtaaatggaatatccatcacctcaaacatttatcacttctttgtgtcacaaacattccaattatactcttttagttatttttacatgttcaataaattattgttgactgtagtcactctgctgtgctgtcaaaagctagatcctattcattctatctaattatattttttgtacccattaactgtcatcacttcccactgcccccaccacccttcccaactctggtaaccatcattctaccttctatctctatgaggttcgattgttttaatttttagctcccacaaataagcgagagcatgcgaagtttgtctttctgtgcctggcttatttcacttaacaatggcctcaatgatccagttttctcatctgtaaaatgggcacaataatggcaaggacatgttcctaactgggtttttgtgatgcggaattcagtcagaagagggactggctcaaagtaagtgctcagggaatgttaactattcttcttcttctttttttttttttttttttttaattttcagtgttctctgggtatgttaactatttttatttgctcatggtgaaacgaagagagctgacaagaaaatttccaccaacgaactttttatgtcctttttaaaaattgtcaaagttctattgaaatacatggggagcttaaataaaattaatgaatcatacatcagagtaacaagagtaataatcattgtatttttaaaacagtcaattagaaatgaagaaaaccttttactccaacaaaggaactgacatatttttgaaagcgtgctatatgtcaggcatttgtaatggcattgacatcatatttagtcttcccttcaccctggcactactatcagcatgtaataaagaaactaaagctctagttaacagaagctctagtggaaagcaggatgaaaactcaagtctgacacccctgaaactcctcctcttccactaactccaaataccaccacattcttcgttcttccttatgccaggcctcaattttctttctgtggtgttgaagcaccttctctctgtgctcctctcttctttgctcagcagaacggctttctgatactgctcctgaacacatggggtttcctggataaggtggatttcatgggaactgctgcaggatgtggcagcttcatgtgggtttttgtccaactttagtcaaatagcaagcctcttatgtccagtagtcaatggctaatgactctggttgtagctgttaaataaacaacagtgaaaacatttcaaaagttacagagaatcagtcagagcataaatggtaaaattgtgactgaatggatagtgtacctgcgtgtgtgtgtacctgcgtgtgtgttgggggagggggttgtccttgaagctgtctctgcattcttatgaagttccagtaataaacatttgtattcacctggcttattcaacatgctgctgcaattactttaagatatttcacgctgtttggaagagggggatttatacctgggagtcagggggaagactgaagtttactggaggtgtggagcagggaattcccagttggaagctgtttgatagcccagacttgagaatagaacagatccaggttcaaatccttgcactgcttttaaataactgtatgaccttggacagcttacttaaccccttaagccttgtttcttcctgtgtaacaggaaaataaccatatcaatgttacaagattctctgtgatgatcaatgaagtaatgagaatcaagtacatggcacataaattagatagtgcctagtgaacagtgattattaatgtgcactaatttattattattattttaaatttcaacttttattttagatgcagggggtgcatgtgcaggtttgttacctgggtatattgtgtgatactgaggtttggtgtacagttgatcccatcacccaagtactgaacataatacacaatggttagtttttcaacccctgcaccctctttctccctcctctttctggtagtcctcagtgtcagttacggccgtctatatgtccatgagcacccaatgtttagctcccatttgtaagcgagaacatgcagtatttggttttctgttcatgcattaatttgcttaggataatgatctccagctgcatccatgttgctgcaaaggacatgattttgttctttttttggctgcatagtattccatggcatatatgtggcacattttctttatccagtccaccattgatggacatctaggttgatttcatgtgtttgctattgtgaatagtgctgtgatgaacatatatgagtgcatgggtctttttggtagaataatttatttccttttgaatatatacccagtaatggggattgctgggttgaatggtagttctcttttaagttctttgagaaatctccaaacttctttccattgtggctatactaatttacattcccaccaacagtttataagcattcccttttctctacagctcaccaacatctattgtgttttgactttttaataatagccattctgactgctgtgagatggtatgtcattgtggtcttgattttcatttctctgataattagtgatgttgaacatttttttcatgtttgttagctgcttgtatgtcttttaagaagtgtgtgtgttcatgtcttttgcatctgtatttttctgtttttgttgggcctttttaaaatgagattatttgtttttggcttgttcaattgtttagctttctcatagattccagatattagacctttggtggatgcataagttgtgaatattttctccctttctgtaggttgtctgtttactctgttgttagttgttttgctgtgcagaagctcttaagtttcattaggttccgcttgtcaattccacttgcttttgaggacttagtaatagattctttcccaaggccaagccaatgtacaaaacagtgtttcctgggttttcttctaggatttttttttttttttttgagacggagtctccctctttccccaggctggagtgcagtggtgcgaccttggctcactgcaacctccacctcccaggttcaagagattctcctgcctgcctcagcctcccgagtagctgggactagaagtgtgtgccactatgccaagctaatttttgtatttttagtagagacagggtttcaccatgttggccaggatggtctcgatctcctgacctgatgatccgcctatctcgacctcccaaagtgctggaattaaaggtgtgagccactgcccctgaccctcttctaggattcttatagtgtgaggtattacactgaaatctttaattcagcttgagtttttgtatatcatgaaagacaggggcccagttttactgtggctagccagctatcctagcaccatgtattaaatagggaatcctttccctattacttgtttttgttgactctgctgaagatcagatgattgtaggtgtgcagctttatttctgggttctttactctgttccattggtctatatctgctttgtacccatactatgctgttttagttactatagccttatagcatagtttgaagttgggtaatgtgattcctctggctttgttctttttgcttaggattgtttttgctattcaggctcttttgtggttgcatatgaattttagaatagttttttctagttctgtaaaaaatgacatttgtagcttgataggaatagcattgaatctgtagattgctctgggcagaatgaccattttaacaatattgattcttccagtccgtgagcatggaatgctttttcatttgtttgtgtcctctatgatttatttcagcagtagttcgtagttctccttgtagaaatctttcagttccttgattggatgcattcctgttgtgggaagtcagggaccctgaacggagggaccggctggagctgaagaagaggaacataaattatgaagatttcatggacatttatcagttcccaaataatacttttataatttcttatgcctatctttactttaatctcttaatcctgttatcttcataagctgaggatgtacgtcacctcaggaccactgtgataattgtgttaactgtacaaattgattgtaaaacatgtgtgttcaaacagtatgaaatcagtgcaccttgaaaaagaacagaataacagcgatttttagggaacaagggaagacaatcataaggtctgacagcctgcacgtgcatgcaaaaagagccatatttttcttcttgcagagagactataaatgaacgtgcaagtagggaagtatcactaaattcttttcctcacaaagactattgatattaatactctgggaaaggaattcattcctggggggaggtctataaacggccgctctgggaatgtctgtcctgtgtggttgagataaggactgagatacgccctggtcttctgcagtaccctcaggcttactaggattggggaactccatcctggtaaatttttggtcagaccagttctctgctctcgaaccctgttttctgttaagatgtttatcaagacaatacgtgcaccactgagcatagacccttatcaggagttctgccttttgccctttgtcctgtttcctcagaagcatgtgatctttgttctgctttttgccctttgaggcatgtgatctttgtgacctactccctgttcagacaccccctccccttttgaaatctttaataaaaacctgctggttttgaggctcaggtgggcatcacagtcctactgatatgtgatgtcacccccagcacccccagctgtaaaattcctctctttgtactctttctctttatttctcagccggccaacacttatggaaaatagaatctatgttgaaatattgggggcaggttcccccaatacatccctagatattttactttatttttttgttgatattgtaaatggaattgtgtacttgatttggctctcagcttgaacattattggtgtacagaaatgctactgatttttgtgcattgattttgtatcctaaaactttactgaagtgattaatcagttccaggaaccttttggcagagtctttaatgttttctaggcatagaatgatactgtcagcaaagagatataatttaacttcttattttcctatttggatgcctttgatttctttctcttgtccgactgctctggctaggacttccagcactatattgaataggagtggtgagagtggacatcatgtcttgttccagttttcaaggggaatgcttccaacttttacctattcagtatgatgttgcctatagatttgtcatagaaggtcttattattttgagatatgttcctttgatgcctagtttcctgtgggtttttatcatgaggggatgttaaattttattgaaagcttttcctgtgtttattgagatggtcatatggtttttgttaattctatttatagagagaatcacatttattgattttcatatgttgaaccaacgttgcctcctaggaaagaagcttacttgatcatagtaaattgactttttgtgtgctgctggatttggtttgctagtattttgatgaggatttttgcatttatcttaatcagggatattgacctgtatttttctgtgttttttttttttttgggcctttgtgcactaatttaattagaagtgccagatactcataaacagcaacgttttcctgggtcccacagtggtatcatagatcttttccttaacaagtatctattgaaactttgctgtttagaaacagttgcatacacactgtggcagcaacttgtacatgcctgagagtggacacttcttatcagcgttaattcaactacacttcacagctctgagaggatgtgtaatcatcaacatagaatttgatggataaggtggtagaaggatttgcttagttggatccttctcattttttaggttttgcacaaataccacctcctgggaaggagcttccctgaccatgatgtctcaaatacccctcaccttacccatgacccagccagctgtaatctgtcctctttagtattatttatttgcctactaattttttacttcttaaataatagactttatgttttgagccattttaagttctcaggaaaattgagcagaaagttcctatatatcctctccctctcaccacatacacaatctccccactatcaacatcttaagccagaataagacatttgttagaattgaattggtgaacctacattgacacatcattatcatccaaagtccatagtttacattagggttctctctaggtgttgtacattctatcagtttaaacaaatgtttaatgacatgtatccacctttatagtaactaacatgcagcatacagtcagccctccatattcatgggtgctacatctgtggattcaaccaactgtgaaacaaaaatacttaaaaaaaatggacagttgtgtctatactgaatatgtacagacttcttttgttttccttattccctgaaaaatattgtataacaactatttacatagtatttgcattgtagtaggtattataaagaatctagagatgatctaaagtacatgggagaatgtttactggtgatatgcaaatactacaccattgtatgtggattttggtatccacaggggttctggaaccagtcccccaggaatactgctggatgactgtagtttcactgtgtttaaagtcctctgtgctttgccgattgatctccccatcttcactaacccctagcaaccagtgactttttttttcttttctaagctgacctataataattgtacatatctgtgggggtacattgtgattttgcaatacatgtaatgtatatgatcagagaagggtaattaagatatccattatctcaaacatttatcattttcttgtgttgggaacattcaatatcctccttgtagctatttgaaactacatattattattaactataatcacactacagtggtatggaacactagaacttactcttcctatctagctgtaatttttatgttttaacagatctctccctatttcccctgtaccctactcttcccagcctatagtattctctgttctacttttaacttctatgagatcaactttttcagcttctacatatgattgagaactttaactttctattcctggcttatttcatttaatgtaatgccctccacttccatccatgttgctgtgaatgacagattttattcttttttatggctgaatggtatttcgttgtgtatttatatcatatgttctttatccattcatcagttgttggacacctagattgactccatattttggctattgtgaatagtactgccataaacatggggtgcagatgtctctttgatattgctaatttcccttccttgggatagatgctcagtagtaggattactgggtcgtacagtagttctatttgtagttttttgaggaacctccatactgttttccatagcggtgttatgagtttacattttcatcaacagcatataagagtaaccttttttctgcatccctgccagcatttgttattttctgtatttttgattacagccattataattggggtgaggtgatacttcattgtggttttgatttgcatttccctgttgattagtgatgttgagcatttttttcatgtatttcttggccatttgcatatcttcttttgaaaaatgtcttttcagttcatttgcccatttttaaattgaattgtttgttttttgctgttgagatgtttgagtttcttgtatattctggacattaatcttctgttgtatgaatagtttgcaaatattttatttcattttataggttgccttttcactttgttggttatttaatactacccaaagcaatctacagattcagtgaaatctctatcaaaataccgatgatattcttcacaggattttttttaatcataaaatttgtatggaaccacaaaagaccccaaatagccaaaacgattctgagcaaaacaaacaaagctgaaggcatcacactaccagacttcaaaatatattacaaagctgtagtaactaaaatagcatgatgttgttataaaaacagacacatagaccaatggaacagatgacagggtccagaaattaatccacatatctacagccaacatttaatttttgacaaaggcgccaggaacagtcattgtgggaaggacaatttcttcaataattagtgctgggaaaacaggataactatatgcagaagaatggaactaggtccctgcttctcttcctacacaaaaatcaactcaaaatgaatcaaagactgaaatataagacctgaaactgtaaaactactagaagaaaacatagagaaaacaattcaggacactggcacaggaaaggattttatgaataagacctcaaaatccaggtaacaaaagtaaatataaacaaatgggattgtatcagactagccactaactttactatctccacactttttttctctataatgtcatatagttggatactttatttttaaaacatatatatcactatttgtattatttacatgttttattatttatttttttctccctctagaatgacagctgcatgaaagcacagtcattctcttactttttaaatgtcgtatcctcagtgctagactatgattgtctcagaaaagtcctcaataaatatttattagttaataaatgagtaaatcttccctccattataattactctcatccttctgctaacattagaaactggtcgttggaaatacttacatagtggcaataacaatattggttgtcatttttattatcttatagatgccaggcactgtggtatacattctaagtgcattattttattcaattctcagaactaccttctgaggtaggtaacatttaacaggtaatataggtagtatataagtagtcgagatattttttaggtacaaaaatgagattcagagaagttaacttactgaagatcacatatttagtaaattgcaaagttaaggcctaaattcaggactgtaggattccaaaggtaacagtctttattattattattattattattattattatacttcaagttctggggtacgtgtgcagaatgtacaagtttgttacataggtatacacgtgccatggtggtttgctgcacccatcaacctgtgatctacattaggtatttcttctaatgctatccatctcctagtcccccaccccctacaggctccggtgtgtgatattcccctccctgtgtccatgtgttctcattgttcaactcccacttagagtgagaatatgtggtgtttggttttctgttcttgtgttagcttgctgagaatgatggttttcaacttcatccatgtccctgcaaaggatataaactcatccttttttatggctgcatagtattccatggtgtatatgtgccacgttttctttgtccagtctatcattgatgggcatttgggttggttccaagtcttcttaaactgtatgttggaatttagagtgagaggaaagtgtatagctaatccactccactctttggatttgaaatacggttgcttaatctaagtgccttgatatttaactctagtccatttaataattacacatctactatttgctgtgccatgtgctctagggttatcacctgacttttcttagaaatgcagacttttagctgtactccaggcctactgatgcagaacctgcatttaaacaaaatctccagcagctttgtatacatgagatatgtgtgtttgagaaacactgccctctaaggaatatcaagacccaaaactcccatgtccttgactagtgagcaaacaaggatcttagcttttagaataccttgcactttaggaggggtcatagttactcatgcttatcacacttgctagcactaatacacacccagaattattataaattatacaagcaatgaactatcagccagctagtaaggcagatagtgttgctgagggtgaacaagccagcctctagcccctcgacagtataaaatattcttttccaataatgcatagacaatgcaatttctttttctcttgctgtgattcactggtggcgtgggcatttggtgtcatgttagcttttctaactgtagttgtgtagagttctgttataccagttagactgtagtacatctgcaattatgcagtaatgtgcattgccaggaagggctgatattttactacaaatcacagaagagctactgcatgtccaccagggaagttgtgggtggtcaatcttagcacatcttgaggctgctgtgttcttacaatagggaacaaagtgttgactgttttctaacatctctggtccaaacaaacccaaccttcgttacccactttacagtttatgagcatttatttacacaagggaaaatgaattttgatactccaggtatgccatctatcccagcctgtctgcatcaaaatgccagattgtcatctccagtttaggccccctctttttctgctgtaagttgtatttcagtctgaggatgaattcagcactttaatcagtgcatttgttttctgctttgtcatccacgtaactggcaagtctggccagggcactgtttgcagatgaaatctgcctgtgtctggaatgcagagtggccagtttctccgacttttcttctctttctcagtcaacacagccactctttccatttgttcccagttctatgcagactataattatgtatatttcctttcatgccacttacacttgtacatttctgcactagggtgaatgcaattattccattttctccttttttcccctttgtggctcaaactgttgccttgttctttctcattgattcctgcactgcaaaacagtcaaatggaaatacaatatgttgcacctgacattcatttaaatcacctgccatgatggtaatacatgctggtgatttcttagtgtactagtcaatggaaaactgtattagtattgcaataatatgcctatatttgctttttctggaatatactgtggtttggtgcgtgaacgattcaatagaattttgaggatgtagtgggaatgagtaataacacttcactcaatatgttctttaatgttcaaatcctaacagtcctagcacatccttttgcccttccaataagttagggtaggaattaactcttattgtgcactctcactactcaaggccctggactaggtactctgtatgtacattcttagtttcacatatatttttgcgtaatccttattagagattaaaattttaacatatacatatactttattttacaggcaagggacttaacattcatagaattaaggtgaattttttcaaggtatcatagctggtcaatgacagaatgaagatttgtttgactccagcatttatccactttctacacactatcttcctctttgcaaagttttaaattccagaaagtttagcagcctccttgctatctgatgctgattaattgggtggaatagagtctattttttaaatctcactcaaagtattcactgcaaagctgccgtgtgtaaataattgtgtgtgtgtaaaatagatgctttctgtaatttgtgagtaatgtattatgggtccaattgcattttaagaatcttttagcttatcctaaatcctcatggcatttttaatctagttttcattgtgtgtcagtaaataatcctggtgagcaagactaaagatcaagtgctagccctggctttgccatatatttgctttgtatcctagggaaagacatgtcaagcctctaaaacttagcttatttatctgtaaagtagagtaatacacataccctattcacctcacaggattgttgtatatgttgaatgagataatgaatatgaaaagcttaggaaaccacagtcatacatagaaatgtatcattgtaagtcaataggtgtttgccaggtccatagcattagcctacgttagacactgcactgaggaggctactaggatttctttgccttcaaagaagttaaaatgtagacaaacaaaaaaagtagtcattgaacagtcttgacgtttcaataaatttacaaaaattactcattgttttcaatatcatcagcagttaattctcaagtagagtaggcatcatgagaaatgctattatctaatatgttgtaattcacattttaagagtatattatattatattatattatattatattatattatattatattatatttttgagtcagggtctggctgtgtcaccaggctggagtacagtggtacaatatcggctaactgcaacccccgcctccctggctcaagccatcctcccacctcagcctcccaagtagctgggactacaggcgtgcaccaccatacctagctaatttttatatttttggtagaaacagggtttcaccatgttggtcaggctggtcttgaactttagctcaagtaatccacccacctcagcctcccaaagtactgggattataggtgtgagccactgtgcttggctttcaaagttttttaaaaataagtcttactttactatgtcttgcattcaacttgtcaaattgttacagtgaaaaatgccttctaatctaccaagaccaagttcaaagcctaccacttactacaacaatgattttccaagtgtggtccctgcactagcaacatcagcatcatctgagaaattgttagaaatgcgaattcttgagtctcaccccaggcctactgagtcagatactctggggtgtagcccagcaatctgtgttttaataagccctcctggagattttcatacatgttcaagagtaagaaccactgctctactaaaacctcaaggtataagtcagacgttaagaactcaaaggctcaccgaggccaagaaggacacatgaatgagggaaaggactggaaataagattatcaggagtgggaggaggaaactgtgttgaattggagagctgcccttgcttaatgggagcagctagtgattattctagacattggttcccatttaggaatgtgaagcaggtccaaatataattttccaaaagctgaaagaaagcatgactgtcttacaaatatacagtgaacgtgtcaaagattaatttaactcataataagaatttagtaagatgacagctggttcaaaggagaaaatgagaggctggaatatttatacagtcaacagaaataagaatactgagagaaaataaagttagttaaaaaattggttaataccctacaaggaaacaaaactgttacctatggagttatttattctattgtacaaaaataatttacaatcactcaatcttctacaagttggcatctaactttatagacttttaactctaatcagtagtacacagtaaatgtaacaatattgcatcactagagtctagggcctagacaattgtatgagtcttaggcaggtatcttagtccattttctattgctgtaacagaatatcacagattcggcaatttataaacaaatttatttcttacagttctggagactgggaagtctaagactgaggggttgcgtctggtgagaaccttcttacggcatcataacatggcagaaaatatcacatggtgaaaggacgagagcatgtcagctcaggactctcttgctcttcttataaaaccaccaatcccatcatgggggcccaactctgtttaggatcagaccttatctgatcctaattatctcacaaaggcctcatctccaaaagccatcaacgtatgaatttggggattacgtttccaacacatgaaacttgggggacatatccaaaccatagcagcagattttttagacaatattctattatgactgaatgagcatgctgtagtccctttgtctcatttttgtcttatttccaaggcctgggtgattttttcttaacaagcaagtgtggcagaccttctacttttaaaggaaaatggagatcaagatttatatgtgaaattttttctttaacaaatataggctaaataaagtgtgcttgaggactggcaactgtggattgccaccttgcaaaccaggtaaaaccattattgagtgaatgtgtggactctaaaactagcccattcatcatgtgatgacactcattctattcattttatccattgtgtccagttatgcaccccgtgtttcactatcaaagcctgttatccaacttttgaaaataggcagtctcctgttcaaatgtccttaccagacatttcaagccccagctccactacgttctttggaaaattttagcagatttgctctttttgcataactttactctaaccgacaagctgcttaccctcttaatatttaagcaattcaaggcaagactaagaatgaaagtgtctagacaaagtaagaccaaaaccatttaaatccttattacaatattctcaggcagagtaatgcaatttgaggatttttataaaaagaggaattttttttcctggtttttcctttgttccagagccttctaccgtttgagccagtatctttcaagcctcagagggagggcagaagcaacccagaacaaagaaatcaatgcctagctttgaattgaaaaatgaacttttaaaagtgcaccgcagaaaaaataattttgaaacccaatgcaggcttcttgtgagattgtttttcggttcgtttgtttgtttagttccaaagattgactttgctaataaagattcaaagtttggtgaactcccaatttagagtttgttcattcattcattcactcatcctacaaacatttattgagtatctgtaaagtgccaggcactgggtattcagtagcaaacaaaataatgtgttctcatggagtttatgttccaatgggtggaaatgagcatatatcagcaaataaacaaatagtatgtcaggtgataataagtgctgtggggaagaagaggcagagagaaggagaagagggtcacagagggcatagggttgctattctacgtatgatcatgagggaagagggtcacgcaggtgcatggcagttgaccagacctgaaggcagtcaggaaaaagatatctggagtctaagcaatggggacagcttgtgcagaggcctgaggcaaaagagcagagtgttagagaggaggcaggaagggcagataatatagggcttcctgggtcaatatcagagctttggattttattaagaatgaaggggaaaccaatgaaggattttgcggaacagaagaatgatgctatgttacttgcattttaaagggatcacatggctgctgttctgaatataggttctagagaatcaaaagaggaagcagatggaccagtgaggaggcaatcacagtagtacaggtggaggatgatggtggctcagaccattattgtaatggcaggcaggtgaggaattatcagcttctgtatgtatttatcatagtcagtcagaaacgtgtgacatcaaagcagacaattttgtgcctaatgggcaggaaatagcactagaggagctatgagtcgagctgaggtgtactgagtctccatgaaatgctcaacccctcttccctttgcttgataccaagctctggagataaagagaagatggagacccttggagaaatttgagggaattctggaaagtggttttgtttttgttttgtttttttctgcaaggacaactatgccctgtgaagtatcctgcatcctgcatgatattatgatggtagaggagcaacaactgggcgaggagcttgggaagatggacaagagtgttgcttctcaaattcctatgcatcccgcatggtgaacaactaaaagtttcccataaccctaagaaagaaacaacgataggaggggaaaaaaccagcagaaaagaaggatctgtgactaggatcaggaggacacagtttgcaaataccactttaccaggacccgtgaaagggccagagatgctggtggcagtagacaaataagattggattccaatacctagaaccaggtagtctgaaatgtgctacagtgtacaccagcaaagacaggggcaaataacgaagacataatctcttctcccaaaaaggagggtttatcccaacagagctttgtaaaatgtgtgcaatcttcatcaacaagacaatactgataaaacaacttcagacaaaatgtctgtttactctatcaggcccgagttgaatggggagcaattataattctagaattttgaactaggtaaaagtatccaggtatacagggctacttgtcctaatagagatttttttttccccctgcctaacctatttgtattgcctacacagcctgtagcaaaacagagtagcaagagtagtcacttataagtagtttttcttataatttttttttctggttaaaccactgagattatgtactgtggcaaaaaaagaaaaaaaatgcttagcttccaattttatttgtggtaggaataatctagtcccagctttccctctacccatacccttccacccatccttccccaaagtcttcagattctccatctataacgtgaagggcttgtgcagaaaataattacagttcctttaattctaaacatggtggactttctattgccacgtaagcatttccaactataccatcccctttcctgtcactcacctcagtgtctggcacaatgccttgcttatgttgggtactaaatatctttttgccttatgagtaaatgatgcatgagaaagaagacttcagcctgagcccactgtagggccttgttgaggtaaagggcttgatgggccttggcctgaactccattggaaccagattataaataagccacaaccagcttatttcctgtctctttttcctcagtgccaccacttagctactttctggtttagtcctttaggaaaaacaataagcacctttctcatttcttctcttttccttcactggcagctgttttaaggcattaaaactgggagccgagcatgtccagaagtgaaagattctctcatgatgacaaattgagtctctatttttaaaaaatgtatgtaagagtgctccaactggtcatcaaaagggctaattagaaacttccaatccccaggagcactcaagtagaagacggatagaagacacttcttagagcaacactgctgctttggtccgactgtgcctatgaaggaactgggttttgcctggtctccatagataccgccttcttcactgactttatcttagactcacactacttgtttccaatacgagatagcaaagcatatgaatagaaaatgaagagaggtgacctgattggactgaggaaggcaaggccccttgaggagacagacagtttggtgttttgttagaaagtgatatgcatgggaggaagagggagagagagaactattcagagaactgtgtgagcaagggggagcagaacaaggtttatgtcaagaacagcaagctatcaggtcatcactgtggctggagctgtttttttgtttgttttattgggacagaaacttaagttgatggtgccacttttgagaggtttaaaatctaaggccaagaagtctgtatttcacaaaatccataattcaagaaaatgtggcaaggtccatgtgattatctgctagatgtgtggtacagagaggagtggaacatgagtaattgtgatccaaacctccatctttggccttgaagcaaaaggaagtcattcgttttaaagatggatgtagaaataatttctgttgataatttttgggcagcacttgacttctatggggtttttgattcagaataaatacttacctacataatttcatttatttgttctgctgaaaaatattgttttcctgctaaaaagaaaaaccttcaagtgttcataaacctttctgattatctgcagttctactgatatgttcacaaaaaaatagggataaatgaattcgaaatgtaggaatttaatttcctgagaactatgtatgttttctgaatgaattaactatctataaagtatgacaatgtgcaatgcagtttaggctttacaaatttttttcatggtttgaaatttttctctttatctgtgttctgattttatatatttccctggttccatacatatactggttctagaatgaatcactatggtgtctagttttacactcattaatgcatgaatttgatatctgaagcctgagttttaggttaaatatggtggtagggtggaaagagcaaaggactttgagagagaagaaccaaggttgggatccccattctaccacttcagagtccagtggcccttgagcaattaaaaaaaatctcccaagatcatttttttctcatctgtgtagtagtaaaaacaataccaacctccatcttggtagagaaggaagataagagtttctctcacaggtgctgaacaatcactattcttccctcttctttttccataaaatatattacttgcttgcatagtctttctcctaaaaattgtcattttctctgaaaagtcctcctaccgtgtgaccttaagaaagtgatttgtgtcctccgagcatcagtcactctttatgtaaagtgagggactaaaggagattgccaggggaccttacttcgattagtgtcattcagtgagtttgggggatttcatctacttcttgactccactcttccttgactgtccatttcctccctccatcccatgaatcctatagggtttcagtgtgacttacataatgggtgttctatatcagacatcctggacttgctgatgagatttaagcctagaaataagttgatagaatttgatgagacctactcatggagcaggcagtgtttttcctcttgttagctaactttcttttccattccaaaacattgtgatttgcaagtctttaagaattttatatcttctgacaatttagcacaacctgctcgtataaaatggtgttatacaatccagtagcagttgttttctttttttaaaaaattttaggacttttttttttttttgagatggagtctcactctgtcaccaggctggagggcagtggtgcaatctcggcttcctgcaaacttcgcctcctgggttcaagtgattctcctgcctcagcctcccgagtagctgggactgcaggtgcgcaccaccacacccagctattttttgtgtttttagtagagatggggtttcactatgttggccaggatggtctccatctcttgaccttgtgatccacctgcctcggactgccaaagtgctgggattacaggcgtgagccaccacgccttaaaaataagcttaaaataagctaataaagtgtgaaattcttgaccatgctgatacagtttctagcgacctctgtcacacacatccctattagtctcagcacttgagtattctgttatggagctcaagaagtggtcacaaatacatacaacaggtaataaggtaagatgataatatgtttcattcttttactctctagaacaaacattataattactaatttacctctcacctaaagaaaaatcccaggaattccagcgtgctttaatgtagtggaaagtgaactcaaataagaagacctgggtataaatactgtctcccagtttctagctgtatagccttggtgagttaatttgagttaattttctgagctttaacatcttcatgtataaagtaggaataataaccctggtatcccaggatgttgcatggattaaaagagttgatatatgtaaaataacactgtaaagtctaaaacacaaaaattagcattattataaaataacttctttcttgttcctaacatcgttactattattgttttaattttatttaatttttttatccagatgctgaattctttaatatgccactgttttataaaagaatttctttcttgttcctaacatcattactgttttaattttatttaattttttatccagatgctgaattttttttttctttttttcttttttttttttttttttgagacggattgttgctctgtcgcccaggctggagtgcagtggcgcgatctcggctcactgcaagctccgcctcccgggttcacgccattctcctgcctcagcctcccgagtagctgggactacaggagcccgccaccacacccggctaattttttgtatttttttttcagtagagacggggtttcaccgtgttagccaggatggtctcggtctcctgacctggttattcacccacctcggcctcctaaagtgctgcgattacaggcgtgagctgctgcgcccggcctggattcttaaatatgcccctgttgttaaaaacttctataaaatacaaggaaatcatagatgatcaaagaaagtctatagagtgatgaaataactaaattaggtaaccaaaagtgaaggcaaaaataaaagtattatttgtctttttcacccatgttttaagaaggtggtgcccaaagttttagaattagaaattctttttcctcacattttcagatttgagagagattacgtatatatgatgagaaagagggtctccctgtgtcacccagctggaatacagcgatgcagtcatagctccctgtaaccttgaagtcctgaactcaagcgattctcctgcctcagcctttcaagtagctagggctacagctgtgtgccaccacatctggcaaatttttaaaaaattaaaaatacagtgatagggtctcactatggtgcccaggctggtctcaaatttctgggctccactgatcctcctgcctcagcctcccaaagtgctgggattacaaacatgaaccaccatgcccaacctgggagagtatcttgagttgattttcggcatgaatttatttctttgttattatatgtaaacataaggctgacatttagctgtcatgcttgttaaaatattacaatatatccatattctgctgttcaaagaccctcctactaccaccacaacctctgccaggagtgcccgctccacagcccagcaataaagtgggtccactcctagaataagtgggggcctctagaaacttgcttgatcacaaggcattcattctgattgatgaccctgcagaactaactggtaaccgttttgagtaccactcttaccaagttctacattgaggattaagtggctccattactaccagaaggtaatgtcttttcattaacagaaatgctagatggagcagttatgagcagcactttcccttcaaatgccttgctggcattaaccttagagatttaattcaattcataaattgctttaaactatagcttttatatatatatattctgagtagaccccccggggtcagtgattccaaaaaagtgtaagaattatcatgttagactctttctaaaataatacattattaggtttataatgtagagacacagggggaaatgtgtacaaatggaaaccacactaacaagaagtacagttgtcagcagtttaatagaaagaattttaacaagacttgaatgatttttttaaagagtaaaaatgagtgtggtctagtctgcagcaggacatatgcacatttccaacataaacaaatggatctctatggcgttacctagacttacatttatatttactaaagcctctctacaaaaatgagaggatgaaatttagtctttgatacccacttctggaggaaaatagagccttccttgctggcttcttccttgctatccagttcaggcaaagttatattgcaacatagactgtgtcagaggcaattaagctctttctggagacactaataccaattttccaagcactattttggaatgatttaattatattaagatcaataacaatagctgattgtataactacatttactatttgtcaggtactatactgagttctttatttacattctttcattaaatcattggtaacaaccaatgagatggatattattatggcccatatatagatatggaaattgaggtttagagaaattaacttgcgtaaatttccagagttcattaggtagctcataagcaggaatccagagccttcataagctcatgagcagaaatccagtgtagggtaatatactgtctgcttcagtatttcatttgttccaggtcttcagttttaggagatgtgatttacctgcttgttacccatgcttgtctcatctgggttatatccccacccccctgaaaaatcacaagtgcacaagaagcaaagactcatacctttttattcagtttgtgtatggtggctttcacatgtacacttggttaatttttatgtttagtaatcattataacaatgatttttttcttttatggactattccccactttccagtgtcaagttattttcttttgaaaaattttttcaatacaatattttctcttcatatattattactgctactactgtatgctttcttcactagttcttagatatgttgctagatttcaactaaatgtatgtaaacacattcgactaagtataagtaatcatggggtttcatcggtgaagctaaactcttagacataatattacattgctataaatacagttatccccttccccacctccattcaagacaattgactattggccccagtcttccacctattgttgttgttttgctggttgtgggtgttgaggggctcggggagttcatggatggcaagataaggctgagcaggaaatgtcacgcaacccctcctcagtaagtggggagaaaaaaattgggtcctggagtccccagagttctacaggcccaacctccttgggtcaagctggtgagatacctaccagcttgttaggtgtctagaagtttcagccaatcactgagcctagaatctcttatggacattagagtgggagcaggaaacttgccaccaggttgtgccaaaccacaactaagtgttggatatgatctctactgagatccctgaaactgctcccacccctcactcctgcttacagctggaaagaggcacaaagataatttattatatatggtagaacatataaagatttatagttgaagagacctgggttatatcctgttgcttccaaggtttttgtggagtctaaaataagacagtggtgagtgcaagcaggcaggaagcacagtgtccagcatttaccaggcactccatagtattgtttggacccgacctagaaagaattgacttggcatgcagtttgttccttaaatattgaattcacctatgctattgccacattactttattgaaagcagggtaactttttctcacttgatgttgaatgcagcagaataaacctgtttccagaatgagaatttttttatctgaaaataactgaaccacatcttgtctttaaccaattcactggcttcagcaaggcacctagctagggcctggcatacactattgaaaagcagatgtcatatcccagagatgtctagagatggggatggcattctttatggaggggcagagttttgttggcagctttacagtaattcatcaatagaggaaaagcaacattgcataaaagcccaagagaagcttgagacctgaggaaatgtcttagccaagcagagagagcagagaaaggaaaaaatcttagaagctgatcacaggatagcctgaggatcagacaatacagggcagcctggcacaatccggaaaggtaggagacaggagtatcagattttgtctacaaactctggtgataaggccagggatgaaggataaataaatatagaaaatgtggctgacattctggtatgcaactaaaagagccaaacctctatgtgaaatcgtctgaaagtatctagggcaacagtaggcagcacattgagaacctcaaactctgaacccatcgcagtctgcttcagggatgcctctgacttgagataaggcctcagtgtatctctggacctctctgggcctctgttttccacagggatcgctaatatactagataaaaattcttataattatgttatcatgattaaaaataagactgcaaataatattcttaattggtgcaaatttacaaggccgaagaagatcggcatacaacaaagaaaacggctatggcttttccatacttgcaagtatagagttgtgccctcaggaaatgcccagagatttcaaaggttaacaaaggtatcaaagaaacagtaattactaaggttaatctgccagtaattattcatctcttttgctccttctgaaacagagcataggcaatatcagaggaaatgaaggtgtgggatgaagccagttccacgtctcttaaatggctccttattgaatttagaaataccggaatcattaaactccatgattccatggtagatcagcttgatgttcctatgtatttctaaagaagattatgagctcagattttttttaagtcagcagaaccctattcttcacaacagctcagcaggctttgtaaagctagtcagactgaatttttttccaggatttaaattaacagagaaaaagataaaacgatcatttcagaagcagccctttaaggcctataaaacaagctaaattgaaagtcagagttaggagatagagcctttgtgaaatatgtctgtagagatagaaatctagttactgatgcctctcctagacacctgtctgagtgtggaagcaccaaggaaacaggtcagatgtcaagactgtgacgttgctcttcaattgtaggtaggatgaagtcagggggtctgaaagtcacatttttttttctgatccattttagaaagattcacatttagtattctgaaactcaaaactgcttcagtctttttctgctattatatgtgacttaatatccaagtcttgagtttttgaaactgttcttgtcaattcagaagggctgaaaagtaccactaaagcaaatcaaagataggttcactctcactgccaaaagtatttttttaggaccggtaacagtattttctctagaaaaggaagaacatcatattgtgaagatgcttgaaaagtataaactattttgtgcaataatatcattaaacgattcgcatcgctcatctgatatcctatgtaccttcaatgttttccaccctacactaggccccatggagaatataagagagcacgaagccagtgatattcaccgttgacctgcagagaaaataaaggtgtgtgttatttgaggcagtgtataattagatagcaaactggatatcatttagcaatgcataaaataaagatttggaaactggagaaatgaatgagaactaaggatctcttcatggaggagatgtgatgtgacctagctcttgaagaaaggggatggtctggaaagattgaggaacagataaaatctcatttaggccaggctatatgtgatgagggggaagggaaggaggaacaaaatgagcaaattatagagccaggaatgaaaagtgcacagtgtgcatgtttgtgttgaggctagggatgtgaggaagggaaacagagtggggtaggcctggggagtacctgccgagagctcaggtgtggtagggtcaaatgaagctgagaagctaggcacaggcatttgaactgcctcattcatcttcaccttgatcctggttcatacccagacctttatatctatgttcataatgacagtaagataaggatttttttttttcttttttttactagctgtggaagcatttcctgctccattttctaatcaccaaccaccaggactgaaattctacttagtttcaaagctattcaagtcagtttagctcctgacccttaggactgctctcacttcttacatggcatttgaagttttcttttcatttctctttgtgctggaccagatctcacagtgcttagtagctggaaggcttcatccttgtcaaacgtcagcccatcctcttcataacttgctaaactatgtattaaggtaggaaatagtaatccagtaataacaatgagtgaacgtgataaagatacaaactctaactttcagttagagttcccctcctttataggctaacaactcccatttatatttatagtatgtgctttggaagaagatatgaaataaaacataaattttttatgttaacagtctatggcagattagctacaatcctaaaaataactttatagagattctaaatacacagccacaattatttttgaaagtttaaaactatttttaaagctgccataatttagtaattctgaaataaaatgcaaagtgtaatgcaacggtgaaccaggttaacatctgtacagctatatatagctgcttaatatatcaagagtttggaaagactctactttagtgggcctagaataattttattttcccacaaatcctgaacaagtacaagtgttgcagaaatattgtcaaagagtaaaacattgagtctatcaggacatttgagtaccctgaagagagtaaggcattcattgttttaagcatttttatatgtatttataatcttttaggtaattaaagataatgatattttagagataactgtgctcagcacattgagtaattaagaattcaccatgccatgtagatttggatgcaggaaaaatttgaattacagtgtatttagataaaaaagccatcatgccatttgggttctaaagaatggaaaaatttgaagtcctctaaaatattttcatttacattttagaaatcttcaaagtccacaaagagtgatgggagttgaatatttcaatggaaggaaagagaacacttgacctcaattatagagagcatgacaaagtcaagaaattttagaatctctaattgtccagagttaatatttttgacatttttgcatgtattcttcctgtatatatatatatatatatatatacacacacacacatatatatacatatatatatacacacacatatatatacatatatatatacacacacatatatatatattttagagaggtgaggtctcatcatgttgcttaggctacagtctcaaactcctgggctcaagacatcctcctgcctcagcctcccaaagttctgggattacaggcataagccactatgcccggctgtattaagatgtgttgaaatatattttaacatgctttgagtcttataattctctacatactttatttatttagtaataaattgtgtttattggcccacatcattgaaagtcttctatataatgtttaatgataacaattatctatgaaacaatgatttcataattaaccattcccttctcactgagtatattatgtccaatttttctctattataaaaatagaacattttaatagacattttatgcatatctgattatttccttcatctcaaattgctgttcaaaatgcatggacattttaagacttttcatatgtatttcaaataaatctacttcaaattaaatcctcacaacatgtattagtgtcattaaaattctttattgaggccggaagtggtggctcatgcctgtaatccaagcactttgggaggccgaggcaggcagattgcctgagatcaggagtttgaaaccagcctggccaacatggtgaaaccctgtctctactaaaattatctgggcacagtggtgcatgcctgtaatcccagctactcaggaggctaaggcaggagaatcgcttgaacctgggaggcggaggttacagagagctgagatcgggccactgcactccagcctgggtaacagaatgagactccgtctcaaaaacaaaacaaaacaaaacaacaacaacaaaaaaatctctttattgagaaggattttttgaaaagccccacatgtgggacatagaccaattttcctctcagacataaactatgtggagctataccttaggatcccggtatctacatattatgacacatttccttagcaagctgctccacagttcagcggtcactagatgtttcctaaaaaaattattgagttggatttcagggagagcttgaagcagttttcatctctaatcattttttataagggatttcataacatttgcaaaaaaaaaaaatagaaatgttgactccatgataaattccagtagcttcttctaataccgcacattggctgtcacctttatggccagtgagatagcacacaggaacttgaatcactgcataagatcttgcataaagtgcctcagaaaaataagtaagtatataagcaaataaagagtaagctacaacgttgtatgtcttggatttctaaaaaaagaaaaaggaaagagcaagcactgaattaaaagtcaagaggaccctagtctgcctccctcccagattgtaagttatttgaggtcagggagcatggcatctgtcatcaccatttctctctactgcctatgagaatgcccaggaaacggccctcagtaaaagcacgttacctcaatgaatgagtgaatagataaaagaaataatgaatgaaggaatactgagcttgaggctcttagaagaataacatgtggggccaggtgcagtggctcacacctgtaatctgagcatttggggaggccgagatgatcggaccacctgaggtcaggagttcaacaccagcctgggcaacatggagaaaactgtctctattgaaaaatacaaaaactagctgggtgtggtggcacacacctgtagtcccagctactcgggaggctgaggcaggaaaatcacttgaatcccagaggcattgaaccccggaggcagtggttgcagtgagccaagatcatgccactgcactcgaacctgggtgacagagagagacttcgtctcaataataatgataataataacatgtggtttacagcaacatggaaacagtgcttgtgtgtcctgagcttacctaccctccaggggatattttcatggagatacaggaagtgcctaccccaacaaatacctccactccttgttcaggaatatatatgcgcaattcagtttttactctcttaaatgtatcttgagaatgagttgtctgcacaatttcatcttttctttgtgtgtgtgtatgtatgtgtgtgtgtgttttaagaattgcttttcatagtgctgtaatcaagtcttgtaccttgagaacagatagagatcttaattttctttattggaaacaggcttattaccagggtgcaaggtaaccttttcccaaataggaaaatgtttcctcaaaatgaagacacatcatagatggaaataacattgaaaccctgtattttaaagaccattgtctatttcagaaaaaccttaatgatgaacattaggtacttgaaaaagaactagtgaaaatcattaaaagaaaagagaaaaagaaattataaacttaaaggagtgttggaatgaagatttggtgatagacattttacaaaccaaggcagcgtgggaggtcttcaattggtatttttaaatgtgagcagatgggctgagcattcttatagaaagtggatgtgtgtgtctatgtggtgaaaatgtagttcatgaaggctgttcctttgcaggtgggaataatatgagctactcgctttgcaataacaggagaactaaaatcaaatccgcaaatcattttacatatggtgacccagttcttattttctcattaactgtccagggagttgtttttttcttttcatttgataatttgagtgaaaaaggtaatattatcaaaagaaatttgaatgtccagcaagtaaagatcagacacatcatagcagaagaatatctattacttggctctaaaagtactgggtgtctctgaggttaggtgggacaaaaattaaagacacacttcctacttacaaatctaatctgagaggcaaaactgccatgaaattaaggaataagagcagttaataaataagttttgaatatatgcattgttgttattgttgttgttttatcttaaaagacagtaaagggttaagaatgcagactctggagccacaagacttgggtttaaatcctggctttactaaatatttcctagctgcgtgaccttgggcaaatcactcaatcttcctttactccagtaaaaagaaaggaacaaggagaataatagtacctatcgacagggaagtttaggaagactaaattagttaatatatgtaaagtgcttagagcagtgtctggcacattgtgattgctacataaacaaagtgtttttatttactattacttacttggtattaatttgatattacacaggtaactagagtttgaaattatctttcagacaaatgtaccaaaaatattttttgttgccatagagaacacgattatctttcatgaagtgaatgtacaatgttgctattttagataccctgccccccgccaaccataacccctttcactagaccttgctatctccctgcacctttctttggagccaaatatttacccatagttactgcttgtcataaaaagagcattttcttttgttttgtttgaattgaagcatccttttagggctttatctaacacttcacattagtattttaagacttcttggataaatacatgtttattcaacctataaactacaactcaattcaggcacctgctatttgccaatactatgcatatcattgtgagattagaaagatgagtaaaacagttattattcaggagagtaaagtacagtggtattcagatattcaaatatataatgacaaattattttatgaacctcaatcatatcactttagtcttaagggatctctatttaagattcctaaattttagtgaattcctctatgccatatggcagagtttcctcttcctttgttctctgtcccagcttttttctaagtctgttctggtttcatctctccaacactgccaaaatgcacatagcattccaggtaaagttggcaggatcatgtttccactttgttacatataccctttgtgagtgttttgctgctggaaccgagtacatacaaagggccaaatatttagaagataagcacaatgactctcagaaccatttgttcatttaaaaaaagattctatttcttgcactaaggacaatatgctcacagttcaaaagtagaaaagtatagaaaagaataaacaaacacaaaatcgtttattgtctcaccaccagaaagagcatggctaccattagtattatttatttatttattttttattacactttaagttctgggatacatgtgcagaatgtgcaggtttgttacataggtatacacgtgccattgtggtttgctgcacccattaacccatcatctacattaggtatttctcctaatgctatccctcccctagtcccccacccgccgacaggccctggtgtgtgatgttccctccctgtgtcccggtgttctcattgttcaattcccacttatgagtgagacatacagtgtttggtactctgttcttgtgttagtttgccaagaatgatggttaccagcttcatcccctgtccctgcaaagaacatgaactcgtccttttttatggctgcatagtattccatggtgtctatgtgtcacattttctttgtccagtctatcactgatgggcatttgggttggttccaagtctttgctattgtgaatagtgccgcaataaacatgatgatttatttttctgccctcccctgccacctagcagatttgggactaaactgttgttctttctctgcctttcaaacttaatattaaaatatgagcattttttttccataccatcaagtattcttaaataatgtatctgatggatttaattatcatttatttaatcattctcttagtataaggagaggccatagcatgcaggtaagacattgacctgatttcccctcagtacctttctaagacattactctttactttaagtcacacaatacttccttttcttacctccttttccaatcaaactttcttcttaaacatttcagtgttatggaaaatgtgcaagatttagagtcagttgttctaaaactagcttgcgtggtatttggcaagttactttatctgacttaccttcagctctctcatctgtgtgattgggtaacattccctgcctttgttacaacatggttgctgtgcggatgaaatcatatggtgaatatgaaattgttttacatattataaagtgagagatggttctttccctgtgctgtacttttctaacccaaaggcaacattcattatttttcttcgtttgtaagcagaaaaaaaagggctgcataaatgtgctggaaaagacatcattcaattgcctgacctcccaaaggatttgttaatgtttaaccccaactcaccctttcccctcagtgacctgatttatctgatgatttaaaacaaaggttatttggatggtgaaattacaattctaaaattttcattgcaagtaaaaaatctattggtgaaagaaaaccttagttatttttttcaagtacctttttcatatttatcatagaatataaccttatagtagtaacaatatcaacataataattacaatgtattaactattcataaagtggcagctaggtgctacatatatcagtttaaagcttctcaacaccctacagattatttgttggggtgaaaagtttatcaataggccagagtcatttagagaagagatccagaatagatctttaaaaaaaaatcagtctgaattagaaagaaactaggcttaagagggaccaaaacctaaatgcaaaaaaaaagcattagcaaaccctactggctaagtggtaccaaaagaaggaaaaggaaaaacaaagaaaggacttcaatatggaagccctagtgggaggcagagaacaggagactttcctcctcctcctcctcttcctcctctttcttctcctcctcctcctcttcctcctccatgttgctgtgttagcccttcttccactgcactgtggctattagcgaagttaatgtcctttattccaaactgaagtacattaggacagggccaatgccaatgctttgatcaccatttttacttgattttttatagctctattgaggtttaattgacagattacaacaaactgtgcacaattaaaatgtacaatttgacaaattttgacatgaaactattaccatgataaaattaatgaatataacaattgcatccccagagtttcattgtacgtgtttgaactctttctctctttgcctcctctccatccttaggcaatcactacttgttttccatcataattgattagtttgtctcttctaggcttacttcactccatgtaattatttgagattttaaagcatgttatatataataatagttcacctcttgttattgcttagttgtattccattgtatggatataccatagtctgtttatccatttatctgttcatggatgtgtacattatccattattgcataaaagattatcccaaaactcagtggcttaaaataactattcattatctcacagtttctgtgggccagacatttgggagcggcttagctgggtggctctggttcagggtctctcatgagattgctgttaagcaggtgaccacttctgcatgtgcagttacctgaaagtttgactgggctggaggagtcacttccaaagatgcatttttatctactgtctcaattattgtacctagtacacagtagtattcaacaaatatgtgttgctagagtaggttaagctttgattatggaggttcttaaattttaggctaagcatttgaacatttgccctcatcccccctaagcaatggagaatcattgcaggggtttgaatggggaatgctatgataacctatgttttggaagtctggtttcattgacaggaggtggcccatttttgagtaggacgacatgaactatccaattgtgcagtgctacttagagattcagaggtttattttcttgatttgatctttaagcaaaagtttatatggtaaagggtcagaagcatagcccctcctgcagagcagacatagtggattttcatgaagctccaactacactttttaaaaattcttgcatcttaaagacatgctaagaattgaggcttcattatatagcaggctttacagatctgctaataattgctgtatggtacagataggacatttttctcctctgaggctttgtttctccatatccaaaataaacaatattgactagctaacttctgcactccttttaagttttaggatatgtactatgagaagtagattattaattgcagaaaagtcagtaaaatacaagagtcctgtatgtgatcccttcccaaagcagcatctagctttatagctcaacgataatgtttaatctggacaggaaagacactatacttcactcccatgatcctctgttagggaatggctgggcagaggcccttgcttcaagggcaccttagggtaaaagaggctgggaaaggagaaaactgggttaaacctattattgaacttttgttcctaacttaaatgaagactaaatgacacttgctgaacatgtaagaggaagggcatggataagatggcaattaaatgttgctgacacaccagcagtgttgacattttaaaactcagaccgcttttgaaatgtcttcttgctctgtttgtttcttatacccaaatttggttgggttttattttttctaataagtatcgtaaaataggtattatgttagtcaggggtctctggagaattggaaccaataggagatttttatttatttatttatttattataagaaattggctcatgtgattattgaggctggtccactgtctgcagagccagtgtcccagtttaagtccgaaggctagtaggctgctgtagaaccaggaagagttgatgctccagttcaaaggccttcaggtaggaatttctgtcttaatcaggggagagttaactttttgttctactcaggccttcaactgattggatgaggcccacccaccattacagaggtcaatttgctttactcactctactgatttaaatgttaatctcatccaaaaacaacgttgcaggaatacttagaataatatttgaacatatatctggacactctttggctggtcaagttgacacataaaattgaccatcacaggtatattgactatccttttttttttttaagctccacaaggcaccaaccatcccctttccaagattatttttaaggccagttcagaagtaggttccataagcactgagaacccctatcctacaggaagagaacaactttccaaaataacctttcctagttctgaccactgaatatagaatgagactctttagtataaagttttgctcattacttctgtcctttgctttcccaagtataaaagaaaataccttttccgaatgccatttcttcattcctagagtcatgtcatcacccttcttccctcattttctctctccctttttctaacatttactaaatatttattttatataaagtaattctaacggttggaaaaactatgaggatgaccatgaaatggctcctatttctcattgtaggcttttaaaatgttctatacattgccattgtgatgacagtgagtcccctgcattttaaattgtacataaaaacagaattcttggtgtaaattgtgaatgggtcactgtgtgctttatagctctgattaaaatagtttagtatgtaatttctaaaaatagtctaaggggtaaacttttagcattgttactgtgtatttggccccagtgagtggtatttgtctgtgcataaaactgtgcatatttaagtccttgggttcaaattaaagggctaaaatactatacatgccacctttgcattcctttgagttttgtttgttttgttctgtttgtgtcactacaaaacttatgttgcccttatatagcacatttttccttattgtgtccttttgattaattttaatgaccatttgttctcttttaaatcacctgcctgctcatcagtatcattaaaggacaaaaggtaaatggagcttgacgctgtgcatgatcatgtgaattttccccttgctacaagagttcttcaaatgggcccaaggaagatcaactgggcgctcaaggaataaatcattaaatgctaaataatcatttggaggaggctgtcagttttatgttcctggaggatggaagaagtgaaagagctcattttcttcaattaagtctctttcgagaagaaataaaaaacaaagaggaaggaaaacagaagttgtgtttattaaaagcttccatccaggatctggattactatgagaaggttcgtgatgggtcctagtttcctaagcctcaatattctgatttattcattgttcactaaattgtccattgtatactaggcactgtggataagtcagagatgtatgaggattgctaacactcgtatattacaactaaaattaaaaaaaaaaaaaaaacagcaatagtgctaaggaccactatatggaccctcagaaagttcccaggaggggcaaagactcctaagctctgggaagacctctaggaggcatgggcattgtgagatcgagatagattgaacacccagattgctgctggggctgctgctgaggaagttggtgatgtggctttgagtggggaagaagcagctgctcggaagttgctcgcgttgctgctttggcgtttgaggagcaagtgcaggatcttgcaaaagctaaattgctgccctgccctgggggagcaaccttgacacaggacagattcaaaagcacagtctgacagatttattttaagaaggcccgagaaccctatcaagatgttatcttctaataagttggatactgaaagcttttgctttctcggatggaaagtctggacccgggcagtgggtcccgtccgccccgtggcaccttctgcctgttgatgccgcgctgctcgcgcgctccgtcgctctggcagcgatcccggtactgcatgagtcagttttgcgctgaacctcggcataatggaggaaggtgctattttaggataacaggcatatgatcagggtttttttgttttggtttggtttttttgtttgtttgttttttagggggcagatttcacagaccgcgatgtttgcagaaagagcgatcctccagaattcctccctttctgctacagcacagaaaacgatttcacgaagtcattgttgcctttccaggagaaaaggtttcacatttgacattgacagtccattaactgtgttaacagcagtaattgctttagagcagtttaatggaagatgtttatgtgtggctaataaggtttgttttttccccccaacaccaatgtagaaatgaaagcagagaggaattggaaaggtgtggagaagctctgaagaatcagaaggttaatggaatcacggaaccctaaatgaatagaactccccgtctgtttcccctcccttttccattactacgtcatttactttcctagccttgctaggacggatgccagaaagtgagcttccagcttagaatagttattaaaaagggatgtgctaaggttataatcttattttttatttagttttattttttcttatacatattattactgttacagtgaactttttttggtaataagccaaaatcaataaaaatattttatgaaaagataaaacaatgtatggatgtgtgtgtgtgtgttgatttccaggattgtgaagtttggggatctgcatactactagatgtgctgtagacaatatggtgctatgaatacagcagatgttattcttatgtccacatgatgtacactctggtatgttttctgtttcataaatccagctaaccaaatttggggaaacttccagactcagtccttaattaggctgagagatcaaaggtgactatgatgaaatccccacctccagacacatcataaacctttatcttttatagtgtttgtgccagcctgtctctttttttctctttggcaatatcattaatcacatatttggactaccagatttgcatgtttttccccaagtatttatctgtaactaaaatctttttttgataagtttaacatacatatgcctaaatgtctgctggagctctctacttggatttccataggcaactcaaattcagtatgttcaaatccaaaccacctatggccctcccccccatggaaaacaaaagcaaacaaacacagctagcctgatgcttgtattacatccctgtcttggtatatggcacctctgtcttcctccttgctcaagcctggaccttgctaatcatattctgtcctcttttcttttttcttcatcctaactattcactcatttattaaaacctatagattctggttcttacttgcctttggaacttctgcctccttgcagtcatcactggcacttttacggcactggctcagtgtagggccttatcttttctcttccaaaaattgtcatagcagcgctagtatcctcacatccttagtcctgttcttccccaatcattgttttatacacatatttctaaagcataaatatgagtcgtgttttccctattgcaaccttccagtaattccctgttatcattaggataaagtccaaacttatttgtatggcacatgcgtttctcaataaagaaagtgtaagatctggaatcagacagatctgagttcaaatcctcattctgcaacttaccagttgtgtgactatgactaacttctctatatctcaatttcctcttccgtaaaatgagaataatttggtggctacctgcgataaatcttacttcagttccccaatacctgcttctcctctaattttggacattatctttccctggcctttgaagttaggtgtgtacaaatgacttgcttggcaaaagaaatgtaagcacaatagctatatgtcacttctgtgtataaatatttaattactggtactgaattctccagacgttcctttgctgaatgtgaaaacataggaatacgagggttccttagaaattaaggagatagaatgctgaggctacacacagaagacaactgtcctgaggaatgactcaaatccacagcagactatgtgtggatgagaaataaacattcattagatgaagcaactgatatttgagggttgtttgttacctcagcacagcttaacctacactgacattctaccacaaaggctgttatgagaaattatataatatacaaaggcatatgctatgatgcttggccccaaagcaagtgttcacataagattatctttgcagacaatattttttttctacctttcatcgctgtactttatccaaggcacttaaccagttggtttcacattttagcatctttagacatggtgattattccgcatgtactgttttctcctgttttgctcagctaataacatttattcaactttggagaaccaacgtaagtgtgcccttcataagttggtcttttatgaaggacacccttaagttggttctcgaaggttgaataaatgttatctcatacctgagtctacccatagcctagagtggtcacgtgggctctatgctcatgtatgcaaaggatctctccttactgcttgaacactacctcacagtgataacgttatgtatctgtctctcctactgggttatggatttcctggcagaaggactctgtcttgcccatctctatagtctcaggatttattaaatatccacaataggcagatatttaataaaacgtaaaaattaacaaaaacactctcaaaactaatgagggagataagatagctgattccactataatatgacaagtaattggcagaaaatatgaatgctttcatttctctgaagccttactgttcatttcctcttagaccaagaacgcttttgactgtgaccattggctggtctaactctcttattttacaggtgaggagacaacccaaggagaggatacagcaaaatggtgtcagattttggagcagagatcagatattattgctctatggcaactaaacacacggaagggtaggagtccataatgtgtacatgcatgagctccccactggcaggaggaagtacagtcacaagagcactacagtgggttgaatggtggccttaaaagatttccccgtgtcttaaaccctggtaactgtatatgtgatcttatttggaaaagggatctttgcagatgtagttctgcagatgaaatcaatccaaattatctaggtggaccctaaatccaatgacaagtgtccttataagaaacacatgcaaagggcggggcatggtgctcacacctgtaatctcagcactttgggaggcccaggcaggcagatcacctgaggtcaggagttcaagaccagcctggccaacatggtgaaaccccatctctattaaatatacaaaaattagccaggcatgatggctggtgcctgtaatcccagctactcgggaggctgaggcaggagaatcacttgcacctaggagggggaagttgtagtgagccaagatcgcgccactgcactccagcctggacgacaagagcaaaactctgaaaaaaagaaagaaagaaagaaaagagagagagagagagaaagaaagaaagagaaagaaagaaagaaagaaagaaagaaagaaagaaagaaagaaagaaagaaagaaagaaagaaagagacacatggagaagaccatgtaaaaatggaggcagagattggagttatgcaccacaagccaaggaaggcctggcattaacagaagctaaaaagtcaagagaggattctcacctagagcttttggaaggagcacagccctgtggacaccttgattttggacttcagacctccagaagagttgttttaagcccccaagtctgtagtgggtttttaaagccgccctagaaaatgaatgcaagcaccatttggaggatacatgcttttccccccaggcatatttctctccagttaagctttctataataatctctaagaaaatttttagcctttgttacttaaaaaaataaagccctttccctttccttatcttttccctttttttttctccaacttcggtgaggaataacttacagccccaaccccttaaaaaattcccagttctattaaaaaagccttagatttttttccccactaaagttgaaggtagagtattcccattcatattatatttccccagatcatatcctaaaagaaacaacgacaaagttttgatctttgtctcacctttgagcctctgaggtgcttctagtacctggagtaaaacttccatctttatcctccacacaaagcatgatccttttcctgttgacttctcagagtggtggtaagaagtagacgagagaaagtatctgtgggagttttgtaaagtgtgaggtgctgtgtggagataatgttactagcattacagctgctgactaatatgtatgaactcaatagagaatagacggaatctgagaattcagtgcatagcaccctctaggccgccggctcttgctgcttgtaccctatactttgctgccatcgtgtggcctttctggtagttgttagtgttgttggttcttatatttaatagttttagccataaattttataattataaattttcagggtaaaaagtaatttttattttagaaaaatactggtcatacaactgtgaaattgttcagtgtctatgttcttgtttgagggaaactaggagatggtttggaaataccatttgaaatattatgacggacaaatctagagattaaaagactgggatgggccaaagagacaacagacagtgttgtagactttagagaaacaaaagcatgtgccctatccaggggcatccataaaatacagttatttgaattctaacatttcctgcaaattttcccaggctctccacaggtagtctccaagtctttttagcttcttttctccaatatctctttcatttattctatactctccagccttatggctattgtgtatttgaggcctttgtttctttctgtctggatcattttaatacctggtcttcctatctccatgatctcttatttttcttttatcttgcacatgctgctagaatgattttcatgaagcactatagaaagagtacagagcagtgattgagagtaaagtctgaggccagattccttgagtctgaaactgagatccctcaatttggctctaactagtagagcgatttggtaaccggaggcaagttacttaaatgctctttatttcagtttccttacctatgaaatatgatactactaatgcctgcttcatatgcagtcatgcctctctcttgcttttttgagacggaacttcgttctttttgcccaggctggagtgcaatggcgcaatctcggctcaccgcaacctctgcttcccggattcaggtgattctcctgcctcagcctcccgagtagctgggtttacaggcatgtgctaccatgctcggctaattttgtattttcagtagagacagtgtttctccatgttgatcaggctggtctggaactcctgacctcaggtgatctgcctgcctcagcctcccaaagtgctgggattacaggcgtgagccaccatgcccggcccagtcatgcgtctcttaatgacagggatatgttctgagaaattcattgttaggtagttctgtctttgtgtgaaaattgtggggcatactaacacaaacctagatcatatagcctactatacaactaggctgtagtgtatagcccactatacaataggctgtatgctgttgcctgctattcaactaagctgtagggtatagcctatggctcctaggctacaaaaacctatacagcatgttactgggctgaatactacagacaactgtatttgtgtatctaaacatatgtaaacaaagaaaagatacagtaaaaatatggtattataatcttataggaccactgtactattatgcagtccattgttgactgaaacattgttacgccatgtgtaactttatttctgacacagataaaatgagcgaattcacatcagtgcctataatttagtgttcaactaatatttgctattattagcactctgatagaatgcaaattattttgaatgcaagaatttgatttgtcttagcatcttcaacttcacctatcacttttaagttgtagtaatttgataagatttttaaacatataggtgaaggatcactaagctttaagccagtttatttcttggaactctcattatattaccaaaatatgcttaaagtcatctcatgatttgtctatgcattaatcagagaattttcaaacttgctaaatttttagttaataaacagtgattaatatttattgagcattcaccaagtgaaaaagctctgttcaaaatgttttatgtagataacctcatttaatacacacagtagttttgagatcagtagtaatgtcagcattcctattttatgtagaggaaacaaaggtgtgggaaagtcccacagccagtaaatggagagtagattagaaccaatgcaatttgtctcaagagcttacattcttaagggaattctgtgctataaatacattctcctctaatctttcatttcagtcctgagatgctgtttctgaataccaaaacacagaaacatttaaaaaattccaaacccagtggaatgcagaatgtcaagctcattgctgcactgaagctacatcaacttgctatagcccattttgggaacagtgctccatgtgatcatgaactgtgatcactggtttctgttgcacttggatttctttaagtgtgcagatggtgtggagaccccaaagaccaagtattttaaagcttgtacagtaggaaagacaatgattcaattccaaaagcaattcattagacatatcacatatcacctgctgccttaaatgctggcttgtgttggaaagtcttcctgagaatactgtccccgaagcataaagtggacatgaaaaaatgtaatccctgaggtaagtggagcatctggaacttctagatgttccaataagactacacatggtcggcagggcgcagtggctcactcctgtaatcccagcactttgggaagctgaggcaggcagatcacccgaggtcaggagttcaagaccagcctgctcaacatggagaaaccccgtctctactaaaaatacacaaattagccgggcatggtggcgggcgcctgtaatcccagctactcagaaggctgaggcaggagaatcacttgaacccaagaggcggagattgcagtgagctgagatcgcgccactgcactccagcctgggctacagagggagactgtgtctcaaaaacaaacaaacaaacaaaaacaaaaaacaaacaaaaaaaaacaaaaaactacacatagtctaattttaagccttggtgcctcctaatatatggacaggttgaacactgaaaaatgtaggcataccaaatggtaatcatccattgataatagcacatacctatgtcttgcaatacacttttcttaggcttgatttgaattaatgaatttaatcctcataagaagtctatgatataggtattcttgtcatctctattttctcagattggagaactgacagagaggttaggatttcaaatcaggcaatctggatccaaagttcaagctttaactactaaggaatactacttatcattgtgtttatctattgataatagcagagttaaatatcattttattaattatgtagaatttctctctttgtttcaggacactaatgatacatctttgctgacaaagcactatgtaattgtgttcatacttttaaacttgtcagctgctaatgaaaatgccattctcaaatattatccttcctcattggatttagcttgatttttttcctctttagggagtacaattgaaactactctggctctcctcagtctccagtattaaatcattggcagcagctggtaacaaactaggaggaggatgggattgtgtgtgcaagtcttcattgtttgagcaagtggtgaatgtgtgagttgtgagcttgggggcataaagagcctggtgaaccatctgcacccagaaccattaaatcttgggatatgagagatattaaagattggattgtctagccattcatcaaatgcttaaaatttgtgtctatttacctgttttcagtttatacaactttttaataatattccattaatcttggatagatctaactttgttattttgaactgaaattgctttacttttaacttcaacggtaggtcccagttctaaagctctcaaaatcacataaaaaagtctaatcttctttcatggcatataaaagccacttatacgtccagtatgagtcttctcaagatccttggagtctttctgtgatagcactttgagtgtccttattaccctggtcatactcatgtggcaaacaatgtgtctaagagtatgtaagccaaacagtgttggtttcagtatgggaaatccgtgtgaatgcttgatagagaacgttcaggatgaacaatgacagtgtgaataagagagataattgtttgcaagagaagcttagtggatgaaacatagcttctctcatagcacagtgaaacattgcgccactgcactccagcctgggcaaaagagtgagactctggctcaaaaaaaaaaaaaaagtctcagaggtagggttagtatcacccagaatttatcttctgtacccaaatttccatactagttgccataatgaagagtatacctatttactgattacaaatatgttttattgaagataatataaattcacagcaattatttgtcccatggcgacaagatggcctatataatttttttatttattaataagagctgtatctagtacaattctacttcattgtgggttttttatttcaatcaaattttgaactttactgaagaaatcccttcatgtttttcttattatttacttcatgcatttatgaagtaaaaatacatgcattctttgtgtttctattgtctaattaaaaatttaaatgcaataaaatgcagaaagtttaaatgtgtaatttattgagttttgttaaattaacctgtataaccaacacattcatcaagacatacaacatttcacttgggaaaatttcttcacatcccttccagtcagtctcttccccacccacccacaaccaattatctaatttttctcatcatagacttgtttggcctaatcttgaattgcatataaatgaattttttcagtctatactattttgaaacttcttcctaaacaaaatttctgagatccatcatgttgttgtgtatcactagttaattatttaaaattgctgagtataaggtctattgtctaagtattccatggtgtatttatttgtttttattttggtagacatttgaattattttcagttttttactaacttgaataaagcttctggaaatattcatgtacaagtcattttcttttttttttctttctttttttctttattattattattattattttgccatgttttaacttctcttgtgtaaaaacccaggagcagaagtacggggtcatagtgtaagctcttgtttaactttataatgaactgggaaacaaatttgcaaacaatctgatactattttaagtgacatttctagaagtattattttctaatcgtttgtaacatagtacactcccaatgtatgagagttgcagttggtctgtatcctcacaaataaatagtattttccaggcacggtggctcacgcctgtaatcccagcactttgggaggccgaggcgggcggatcacaaggtcaggagatcgagactatcctggctaacacggtgaaaccccatctctactaaaaatataaaaaattagctgggcgtggtggcgggtgcctgtagtcccagctactcagaaggctgaggcaggagaatcgcttgaacccaggaggtggaggttacagtgggctgagattgcaccactgcactccagcctgggtgaaagagcgagactctgtctcaaaaaaaaaaagaaaagtgaagtttctcaccatcattttaattttcatttcgctgaagactaatgatgttgataacttttcatgtacttattggtcatttgtatgtcctctgttctgacgtgcctgttcaaatattttgcttattttaaaatttgtgttgtctttttattattgatttgcagaatgtgtgtttgtgtatatagctgtgcgtgtgtttgtgtgtgtgtatatatggcatatatatatgttggttactccccgcttcccctttcccttatagattttcctgttctgggcatatcagataaatggagtcatgtaatatgtgacctcttgtgacagtcttctttcacttagcataatgttttcaaggtttgcccatgtagcatgagtcaatactttattcctttttgtggctaaatattttgttgtatgcatgtactatattttgtttattctttttaatactctgctaggttttgtttgctagaattttattactctttcacatctatgtgtatgagaatattaatttgcctttttttcagtaataggtttgttagatttgtgacaggttttatttcttcctctaatttaggaaagagtttgttaaaattagcattcttctttctttaatatttaatatatagttcagcagttaaaccaaccaggcctccagctttctctgtgagaaggtttttaatttacaaattaaatttatttaccaggcagaattatatttattttcttcatttttcctttcaatttttaattcacgcttttcaagaaattaatccttttacctaatttgaatatactaacacaagggcatgtataatatttgcccatagaatctacaatgacatgccatcttttattcctagtattggtaattactgttttttcttttttcatcaacagtacctatgttagggtttaaccatcttattacctttttttacaaaaacactttggcttttaaattttccaatattgtttgttttatattttgatttttgctctttattatttttttatttatttgagtgtaattttctctactttttctatcttcttaaagtaatccttagattattgattttaatttttttcaaatataagaatttgaatctcatatatttctaagacttagttaaactggatcatacaaatatagagtgatttgttttcgtgaacatacattttcagaaattatctaatgtgccttgttgtttcttctttaccttgggtgatttacaaatgtgctgtttcgtttcaaaatattgaagattttcttcatcttagtgaattttaattcaatgccattgtggtcagagaacatacactgtaaaatttcaatatttttaaatttattgctacttattttatggtatatcatgaatgaatcttgaacatttttagcatttgaaagggatgtgtgttctgcaattgttgcagtagtgtcctataaatatcaattaggttaaaatggttgagatagtgctgaaatcttctacttacctactgatttttttaattcattaacgaactttagtttttagaggagttttaggttcccagtaaaattgagtggaaagtacagagagtgtctctatatgtccctgtccccagacagacacaacctccattactatcaacatctcccacctcagtggcacttttgttgcaatctattgacacatcttttttttcttctttttttagttttattattattatactttaagttttagagtacatgtgcacaatgtgcaggtttgttacatatgtatacatatgacacatcattattaatcagtgttctacattatggttcttgcttagtgttgtacattctatgaggtttgaaaaatgtataataacatatatacaccatcatagcatcgcacagaattgtttcattaccctaaaaatcctctgtgttctacctgtttacccctccctatccctacctcttgataaccactcatctttttactattcccatagtaacattgagcatgttttcatacacctattgaccatttatatgtcttctttggagaaatgtctactcaagtcctttgccaattcttaaaacattttaaaaagtgggttatctgttggttttgctattgagttgaagggggtctttatatattttggaattaactcttcctcagatatatgatttgccaatattttttctcattctttaggttggcttttacctgcagattgttttctttgctgggcagaagctttttagtttgatgtagtcccatttgtctatttttgcttttgttgtctgtattttcagcgtcaaattaatgaaatccttgtgaaaagcgatatgaagatgttccctaatgatttattataagagttctatagtttcagatcttgcatttaagtctttaatcgactttgagtttatttttgtttatggtgtaatataatggttcaatttcattattttgatgtggatattccattttcccaacactatttgttaaagagactattgtttctccattttgtagtcttggcacttatgtcaaaaatcatttaaccaatatatacatatgggtttgtttctgaactctttattctattccattgatctatatatctgtcttgatggcagtaccagattgcattgattatgttgctttgtaatatgttgaagtcaggaagtatgaagcttccagctttattcttctctctcaaatcattttggctatacagtgttttgttgttgttgttgttgtttattttttggtttcatatgaattttaggattttttttccatttccacaaaaaatgccagtgggattttgatagcaattacattaaatctttcggtcactttgggtggtctcgacattttagcaatattaatttttccaatctgtgaacatgggatgtccttccattaatttgtgtcttctttaatttctttcaacaaagttttgtagtttttagtgtacaaattttttacctcttcagttaaatttattcctaagtattttattatttttgatgctattgtaaatggaattattttcttaatttctttttcaaattatttggtattagtgtatagaaacacaaattatttttgtttgttgattttgtatcttgcagctttgctgaatttattatctctgtttttctgtttgtttattctgatatgcactttagaattttctctatatgcaatcatgttatttgagaacagagataattttacttgatcctttctgattttgttggattttatttattttttcttacctaattactctagctaagacttcaagtactatttcagttaaatagaagtggtgagactgtgcatttttgccttcttacagatctcagaggaaacatgttcaattttttaccattgaatattatgttatctgttggttttttatatatagtcttcattatgttgaggtaatttccttctattcctagttttttgagtgtttgttaaatgaaaaagtgttgaattttgtcaaatacattttctgcatctattgagttgatgatgtggttattacccttcattttgttattatggtatatcaccttgattgatttttgtaagttgaactatcatcacatctcaggaatatatgttaccacctggtaataaatacatgattctttcagtgtgctgttgaatttggtttgctagcattttgttgagaatttttacgtatgtattcattgggaatataggcctataattttctttcttttggtgtctttgtttgtctttgctatcaaggtaatggtgtcctcataaaattagttttgaagtgttcccctctcttcaattttctacaagagtttgagaaaaaatgatattaattcttctttaagtgttttgtaaatagaattcataaatgaagccatctagtcatgggctcatcctttttggaagactttttggtgctgattcaatctccttacctgtaattggtattattttatgtctgtggcatgagttgtaatgtcacctctttcatgtctttttttttagacttatctgtttttttcatactctggctaaaggtttgttgattatcttttcaaaaaaaaattcttaattttgttgatttctttctattgtttttctacttgtattttatttatttctactttaatcttgattatttcctttcttttggtgactttgggcttaatttgttcttctttttctagttatttcaggtataccattaaggtttttatttgaggttttttttcttattgcaggcatttactgacataaaactccctcttacggctgcttttgatgcatcccatacattttggtatgttgtgttttcatttttatttgtctagcaatatttttaagtttcccttttggctttttctttgactcattcgttgtttatcattcaagggtgtgttgtttagtttccacatatttgtgaatttttaagttttctttctgcttttaatttctagtttcaatccattgtgattggaaaagatacttcgtataattttaatcttccaggagctcaaacaaccctataggaaataatatccttaaatttgttaaaactccttttgcgacccaacacgtgatctatcctggagaatgttttgtgtgcacttgagaagaatgtttatcttctgctgtagaatgtttcttacatgtctgttaggtccatttgataaatagaattgctcagctcctatttccttattggtttcttctctgtatgtttggtccattattgaaagtggagtattgaaatctcctattatcattgtactactgtccatttctcccttcagttctatcagtgtttgcttcctatatttggttgcccatattttgggtgcatatatatttataattgttgtctcttcctggtaaattgacattttaatcattatataatgtccttctttgtctcttataacagttttttacttgaagtctattttgccttaaataaatatggttaccatgattctctttgcttatcatttgcatggaaaatcttttccatctcttcactttcagtctgtgtgtgtccttaaatctaaagcaagatttgtttatatcttatagttggatctttaaaacaaaaacaaacattcagccactcaatgtcttttgattgaagagtttaatctatctatatttgaagtaatttctgatagggaaggacttatgattgccattttattagttgttttctgtctatcctgttgccttttggtcctcctttcttctcttgttgtcttcccttgtgttttgttgattttttttttaatagcaacatgctttgatttattgctcactttctttggtgcatcttttatagataccttttattgtgtttaccaaagggcttacattagacattttatagttgtaacaatctctttttagctaataatttcaattgtacacaaaaactgccctttacgtctcctccccatggtatcagtgccatcagttgtaatgtctccccgtgcacacactatgctatagatgtcacaaattacatcttttttttttttccccgagatggagttttcctcttgtcatccaggctggagtgcaatggcatgatctcggctcgctgcaatctccacctcccgggttcaagcaattcccccacctcagcctcccgattagctgggattacaggcacctgccactacacctggccttttttttttttttttttttggtactttttagtaaagacagggtctcgctatgttggccaggctggtctccaactcctgacctcaggtgatccacccacctcagcctcccaaattgttggggttacaggtgtgagccactgtgcctggacaattacatctttttatattgtgtattatcatgtttttattgtcattttttgtacttttatctttcaatttctacaccagaattaaaagtgatttatgcactacttttatagtaccatactattctctgattttctatttacctttgccatctagctttaaactgatagtcttattgagcctcccttgtatgtgaaagtcactttctcttttgctgctttcaaaactctctcattgtctgacttttgacaatttgattacaatgtggcttgttatagatttcttatatactagttttatacgagttgaagtcttttggtattcttgaatatggatattcatttctttccacagatttgggaagtttgggcccattacttcttcaaataatctttccttccctttctctttctcctcatcttctgagaccctcatattgcatataatgaacaccttgatcatgtgccataagtttcttagtctttctttactctttttcattcttttattcttttctcctactggataatttcaatgacctgtctttgagtttaccaattctttgttcagctagatcaaatatgcagttgaacccctctagtaaatttttcaatttagttattgtattctttcattccaaactttctgggtgtttaaaaatattttatttttgttgatattctcattttattcatgaattcttttttttttccttagctcattgagcatctttatagtagcaatttaaaatctatttcatgtaatctccatacctttgtttctttgggttcagtttctggagatttattttgttccttttattgaaccatgtttctctgtttattatgtgccttataactttgtgttgggatctcttcatttgaaaaaatagccatatatatcagtttttatgaactggctttgtataggaaaagatctttaccaatcagcccagctagatattctagagagcttctcaaacttttcctatggatgcctcttctctggacttgtgcatataaattcattagagagatttgccagtttctttttttaagaattcatcatctctttctccctctaatgtgtctgtttgtgttctttggagctgccacaaggtgcctagctctcttttgctctcagtggcttctagtaaatgttgggacacatcagtgcactaagtccgaagacacagaaacaattccccccagagagctccctgaaaagccagaccactagaggcatactctactcttctcttctggcatgaccccacaaaggagagaccaccaaatggcataggcctctgtctgttgtatgttatcagtagcagcagcaatctgcccagctctattttgtcctctgtgccttgcaagtacatagagtattcgaggtccctcccatccatcctccaagacaggcaagacagaatctagtccttcgggcagtcccttgaaagttcagaattttggacacacactttaactctttccctccacagggataagccaggagttgaggcttctttttctccctactcattctgcactgagccagaggggaagggtatagaattttggtgagcgagtgtttgttagtctaaaccattacttttgttttcagtggtccccaacctggcccttttgtttttctgtgcttagagtcaggcaggagataaaccagttccttgggcagcaccgcaaaagtctgagttttggatgtgttttagtcttttcgtttcctccccagagagaagccaggaaatgggagttttctccggattgtacaactctgagccgggggttggggggactatggtgtatgagtgacacgaattttcttactggtttcaatgcatttggcttcatatttgcctgaggttcaggaacctcataactggtttatgggtttctaacaagggacatttgtcactgaattgctgttaaatggtgtcctatgaggggaaagaggttctgggcttcttattttgccatcttgctcttctattggctttttaagctgtgctgctttatttatttttagcagttgtatggggattaaaatatgtattcttaatttattattacttacttagagttaccattgtagtatttcatataaaatgtaagaactgtattataattatatttatacccttttccatctttgtggtattgctgttatatatttttcttctacatatgttataaaccctacaatataatttcttttttttactttgactagtaagctgcattttaatgacatttgtaaaagaaaaaatagtttctttatatagattcatatattcagcacttctaattttcttctttccttcttgcatatctgtgcttcaatctggtatcctacttcagtttgaagaaccattaataacaaattattatagcgtatttttactggtgacaaattttctcagtacgcatttattaaaaatgtttattttatcctcatttttgaagtatttccactgaccgtggaatactggcttgactttaaaaaactttcagtactttacagctgttgtttcaagatcttctggcatgtatttttttctttttttttggtttatgttttgttttgtttttgtttttgagacagagtctcaccctgtcacccaggctggggtgcagtggcatgatctcggctcactgcaacttttgctacccaggttcaagcgattttcatgcctcagcctccggagtagctggtgttacaggtgcacactactatatctgcttaatttttgtatttttagtagcgatgggatttcaccatgttggccaggctggtctggaacccccagcctcaggtgacctgccagcctcggcctcccaaaatgctgggattataggcatgagccaccatgcctggctggcctgtatttacttttctgatgaagagtccatcatctttcatcttttttcccttcatatgagggttttttttgatacattttaagattttctttttaccattatctttcagcactttgattataatatactcagtcaaggttttctatttacatggtttagggtttactaaatgtcttgaatctggagggtaatttttaaaacaaattttgaattttgaattttgttttttgcttctttttctctccctaccttttcttctctcctactttttctcctcctccgtctccttttcttcttcctctggattttcacaaatagttgaattttctgaggtaccagggctctgcttgttcttctcaatcattttcttttcattgtcttcagattggttaatttatattcacatgttttcaaattcattgaccctttattgtagtgtctaatctgctgttcagcccatctagtgaatttattcagggaaagtattttttattatagaattctcattagtcctatgttatagttttcttttctctcctgagatttcccaactcagcattgtgaatatattatttctacatttttctttaagtttatatctatatctctacatatatatctctatataaataataacatatccacctatatatctatatttatccacttttaaggtctttatctccttattccaacatctctatcatgttgggatttgtttatatcaactttttacttttgactatgggtcacatttttcctacatctttgcatgtctagtaatatttgactgtatgcttgacattatgaatggtatgttgtgggatggtatgtattgagtattttttttttctttgaggagtgtttagttttattctggcaagtggttaactactggtggcttgttttgattttgttagaatggatttatactttatttcaattttatccttagttctatggcatggccattattttaggtcacggtctttcctcctaggcatggtcattccagcatctcgaccgaatgcttttgttgctcagtgaagctttctcactctggctgcgttaggactttaacatctatgagcactgtttaatgtctccattcagatgagcactgaaggatttgtcactgctatagttgttctcttaagagtgtcacagaatactctcctgaacaaaagtagcccatcttttggccaagggcctgagggcaacctctgtgaagatttcttgcttcccctagtctgcgaagctttctctcctcagtacttggccacacaaattctagctaccttaccagcccgaaactctgatctgtgccttctcctctcagtaaaattgtcattctctatttggcctctgtctcccatgctgcccctggaaagtgaccccgggtagaaagctggagttaatacggggttaacttacattttccctttctctaaaatatgacagtcctgcaccatttgttatcaagtgcttgaaaataatgtgttaatagtttttgacccagttttataattgtttatggcagaaggataagtccaatactagttggactttgtcatggctagaagcagaagtgttgtttttatttaatattgcatacacaatctattcctagggttcctgacctaagtgactctctaaacctgacagttacatgcgttccagggagaggaagctaaaataaatggggataattttgctttttgtaaagagagagaaaaaggtattcgtatctttaaatatttgagtattttaaagtatttttaaaatttcattttaagtcttctacaaaaccttcattgaattatattctttttcttaaattagctctgaactctttggttatgtatcagaaattttcccctgtgtacctccaatctacctttttctgcttacctcctactttatctcacctgatgctctagttgtgttatactatttgttcttttaaaactataccctacctatgtaattttctctttgtctgaaacggccctcttcctttttttaaggcttagcaaacttgacatactacattctttgttacttatttctgcattactcatggttcttcagagaaccatggttcatggaactcatggttcttcaataggtgttgtatatcataatattatatctgtgtaatatataatgtaacatatgcaatatataatatgttatatatgtaatatatgtaattacattatatattatgtatacacacatataatctattatatatgtatgcacatatataggaaggaaaggaatatattatatatgtttgcacatacatatatacgtgtgtgtacaaatattatctatgcacatacatatatatacatacatatatatctgtacatatacacatatgtgtatggtctctgatacacctcacatcctgtggctcactcaagtggacacataaaattaaccatcccaatttccttttttctatatgtgtaattatatatacatatatatatacacactcacacatatacacatatataagtgtgagtgtatagatatatgtgtgtatatataatatacatatatagagagagacagagagagacagagggaggagatttattataagagattggctcacatgtttttggaggctgataagttccaaggtctgcagtctgcaaactagagacctaagaaagctgttgtgtagcttctgtccaagtctgaaggcctgaataccaggaatgctaatggtgtaagttccagtcagaaagctggcaggctcaagacccaagaaacgctgatatttcagtttgagtctgaaggctgaaaaagaccaatgtcccagctcatagcagttagacagaaggagttccctcttgctcagcctttttgtctattcaggtcttcaattgatggataaggcccacccacactatgaaaagcaatctgttttactctatctactgattcaaatgtgagtctcatctagaaacaccctatagtcatacccagaataatgtttggccaaatttctgggcattctgtggctcactcaagtagacacataaaattaacattccaaatttccttttttctattttcaaatgtgattttatcctccttttcatttgttcctatatctgacactttatacactttaccatgaataatcattattctgtcatgaataataaatgtctatttttcattttgagccccttttctacttagcacaattccaggagcttggacattattgcttcttcttctttacttccacacacaatcaattactaagttacattaattattagaatctgttcttttatttttatcatgactgcatttgccatcgtttagggttttacaatttgttgtcaggtcatattggttttctctgtctccatactagtaccagagtaatcctcctgaatcacatatatagcctactaggagttaaaatctttcaacagctttgatagcatttttaaaaatccagatttcttagcctgagcaacagttagtgtaattagcttgcctggtatggtttaggaagcataaactattacatccactttaatgcctattaagaaatgtggcagtggtttataatagagaagtgatgtagagatctatgaaagactttttttgatggaagaaacacaagtgaagtattttttcaggttataagagacagggttatattgcaatgaattattcccacaggaacaactgtagattagttatggaatcagctttcctttccattttttaggttaatattgccaggttttttttaatgctgtgtgttgttattggtgagatgaataaaaatatcagtaaatgtgttagaagggatataacactacaactgggtaaatacatgattgtctttgagtctatctgctctgaaacacaatggtggcattattagagaatagctatcactggaattaataataatgttcagaatctggctaatacataccttgattaattagttaaccccatcttagacacggtagatgagccattgtagtgtcactgaaaatacaggtgatagccacacagttgataagaatcaatctagcaaaatcctctggaaaagggatttagaagtgaaaaggcttgaagtctgctccaagttgagtaattatgttgtgagtttttctgagtgattcatttccctatgcctcagttttttccatttgtacaatgaaggcattgaactgtgtaatgtctgaaatttatatcaattctaatattgaatttgaaatttaagaaatatttctgattcgtgttttatatttttaaacatgtgtatcaatgcttcgggaattaaggactttaagttgcttaatgttatctattgtcaccaattcaactggtaacagctctaaagtctctctatgtactagacagcaaacacccttcttctctccctcagcataccctgacacttaaaaaacaggaaatgtgtatttttggatgttattcaaatttacttagaagtatttactcacttagaagcaatttactcattttgaagtatgctaagaaaggcattttcaaatcctgtagtagttggaaagttttttaaatcttggtttcattttttgacttcatttctggttctagtcatctacattctgaatgtacagaggcctccagtaaattttctagctaatacttgggaagcatttgtaagggaacagagtattatctcccagcacatgttgaagaaaatgataacagaagctatagaaaaaacagtgacagaagctatagagaagaaaatgataatttttatcgcagtgactgaaaggcaaccctggccagtgctgtgatgaggaataatactagtttcattggttaagttctagcattatatacctagagcaggtatttttaagaacaggttggagaacgcttcctgttggttttggattcagttgtgaattcagcaaactgtttagaatccagtatcatttctatgtggccaattttactgcaacataagctataatttgtatacatattgagatttgtccacaacaatataccattgtaaagataataacctgttataaattataataatcatttattagagacaaccttcctgaaataacttggtatcattgaggtgatgaaagagagacattgggggagtttattgcagaagcagagactctataaagaaaatggtgaacttgagggagttgagaactatgtatagtttgattgtggattattctattgtgatcaaactgaaaaagactaattcatagagactacttataaaaaacatttaattaatgagtcagatgctgatggatacatttacactgggagagagacgtcacctgctctactaccaatggaaattgccactctgttttctataaaggattccatacatggcttataaaaagccaaagagtcatcacaaggtttcttttgatatgtgaaattagtacagatagagttgggtaggtctaaggaacatttgtggaggctcagctagaatctggtttgtcttgccccactattgtttttttgagaccgggtctcactctgttgcccaggctggagtgcagtggtgcaatctcagctcactgcagcctcaacctcctgggctcaagcgatcctcccactgcagcctccgaagtagctaggactacaggtgtgtgccaccatgccaggctaatttttgtattttttagtagagatggggttttgctgtgttgcacaggctggtctcaaactattgggctcaagggctctgcccacctcagcctcccaaagtgtggagaattataggcataagccaccccacccagcccaccctactattttgtaaatagtcattggttattagggtactgagttagggttcactcatttgtcaataaaagtctattgagtagagactatgtgtcagaaatagttctggtctctagaaatacattggtgaatcagataaagttcctgccctcataaagcttacattctatcaggaaggaataagcattgaaccagggaactacaattaaacccttattctccagttgtggttttggtgtattctttatctgtcgaaatatccttttttttttttttttgaaaagtagcaatttctcatgacaaacatgttacagattctaaaatttgctgcgcattttaaatttctccttaatttatgaattatatatatataattgatttttccatagatgatcttaaaaagctgggatcactgtggtttgcacctaaagtattagtgatgataggtttaatttgtttagtgcctattgtaagccctgtagtgcggtagtcactatatgtataatatctcatagacttcttacaatactctataatgaggcattcttatctatatttagaggaaacaactgagactcagagaggtcatgtaaattgtctaagatgacacagctaataaatgacagaaccaggatttgaatcaaagttgtccagactcaaaagttatgttcttttccaccacaccactctgtccctcatttactaggtctttcctaaggcaataattacagctagctaattacatttcattctgaaatgaagttatgacttcttccttagtttatttgggtggaatccattcagagcatagagatccttatgcctttaatcagtcagattggactacttttcttttcaaaatctctgagatctaatttgtcttagagagtgtagccaagtggttcaacgtcctttgcccacagctcaaatgtcctctgaaagtaaaaagaagctcactatgagtagagacaggtaattccaactgtggatggatttgagaaagagaatattttttaatattgagttgagaattgtctccttaaagtaccagcatctaccacgctgaagaattacaatattttatccataaaagaaccctctggatattatgtggacaattttgttttcttctggaagctactttttctagcacctacagtttcattctcttcaccatgtgtcactcgcctcgggataggggccagctgagacaagctatagctatgggacgtaattcacagctttgctagaaggtaaacatttcacaaaagctatgcacatacttgtgaagggttttctgtgggagagaaagatcagtggttgtggaggaaagctttttcagaggtcgttgaaacatgactattcacagctgaagactgttatttgtgatgctcactgtcctttgtgataacatttatcatgtggatgcacatggtaaatgcctcctggaattcagtgccagggaaaatatgttggtaatgataaattggtacaattgtcttgataattaaggcttatacacaagtagttttgggggccagagtgcaagtgttcggttggtacctacataaaggaatatcctgtagtatttgattccccaggcagttgtagttggcacagaaatcccctataatgctatgctagagagtgctgcttctcataggtgtttctgatcattgtggggctcgcttcccttggacatggctcagttgatcttgcgtgagtctttgtaccagcttactgattattcaagttctccttaagctatctcacctgacttctcctccatctcctcttccaggaagaggaaaagtcaaagtccagacaaagtagttgcggcgattgccctgaaataggtgtctgctcttagacagacctgttgacttacagactgaatggaaatacaaaggtctgctatactcacgactgtaccctgattctgtgcccaagcttatacaacttgtgtgggctagacctggaatgagagtctaaaaagtctagctctagaatcagctctcttaaaacctacagtatagtgcttcactaataatactttaaaataataaaatgaatgtgaaatccagaccctacttctataaaaaaaaattgtaaaatttaaagtgttgtagagagaaatctatatgttttgttatgtgttaaatagctcttttggataactttaatactgagataaaataaatttacagtaaaattctcagaaggatgagataatttacatgagttcactgtccagatatcgaaacttactccttctaaaaattaaaatatcagagaggaaggcagcgcaagatggccaaatagaagccttcactgattgtcctcccagcaagaataacaaattgaacaactatccacacaaaaaagcaccttcataagaaccaaaaatcagatgagcaatcacagtacccagttttaacttcatattgcttaaagaggcactgaagagggtggaaaagagagccttgaattgccaacagtacccatccccctccccccagcagcagttctgtggcgtggagaaaaaaaaatctgtgtgcttggaagagggagagcacagtgattgtgggactttgcattggaactcagtgctgtcctgtcacagcagacagcaacaccaggcagaactcagccaaagctaatggagggagcaatgagaccagccctagcaaaggggaattgctcagaaccagtgaacttggggggcatgtgacctagtgagacatcagcttgaacagcaaagagagtgcttgcactatccgttccccagccccaggcagtgtagcttgcagctctgggagatacttcttccctccaccttaggagaggatagggaagagtaaagaggactttacttgccacttggataccagtttagccacagaaagacagggcactaggcagagtcctgagggccccatcccagaccttaattccaggatgacatttctagacacaccctgggccaaaagggaatccactgccttgaaggggagaacccagtcctggcaggattcatcatctgctgacaaaagagcccttgggccttgaactttcagcagtggtagctgggcagtactcgctgtgggccttgggtgagactcaaagacatgctggcttcaggtgagacccagtacattcccagctgtgatggctatagggagagactccgtctgcttgagaaaaggggagggaagagtaaagggagcttcgttccttagcttaggtaccagctcggccacaatggggtagagcaccaagcagactcttggagtcctcattttgggccttggttcttgaatggcatttctggacctagccctgaaccagaggggatcccattgtcctgaagagagtgtcccaggcttggcagcattcaccaacatgctgactgaagtgcccttgggctttgagtgaacatcagtggtagccaggcagtactcgccatgggtctggggcaagggtggccacaggcagaaactctgtgcttacagaaaagggagggaagagtgtgaaggacttagtcttgtggcttgggtgccagctcagccacagtagaatagagcaacaggtagattcctaaggtttctgacttaagggactggcttctgaaaaacatcgctagacgtgactggtgctggaggaaactcaccattctgaatggaaggacaaaagccagagtggctttgtcacctgatgattgtagagccctagggatttgggtgagcataggtgatagtcaggcagtggtaaccacagcccttgggtgagaccccagtaccatactagtttcaggtctgacccagcacagtcctaatagtggtgacaacaggagtatttgtgtcacctctcttctagcctagttagctcagcacagagctgagctgtttgggagaacgtaaggaaagagaacatgagtcttttcctggtaatccagacaattcttccagatctgatccaagaccaccaagaagtatctctataagtctgcaagaaccatattgttactgggcttggggtgctccctaatacagatggggctgcagtgaccagaaacttagagcacaacacccaagtgcctttgaatgcttggaaagccttccaaagaaggacaggtggaaaaaaaaaagactgtgaagactacaataaatacccaactcttcaatgcccagacactgacaaacatccacaagcatcaagattatccaggaaaatatgacctcaccaaatgaactaaataagggagcagcaattaatcctagagagacagagatatgtgatctttcattcagagaattcaaaatagctgttttgaggactcgcaatgaaattcaagataacacagagaaggatttcagaatgccatcagataaatttaacaaaggaattcaaataattaaaaaagaattatgcagaaattctggagctgaaaactgcaattgaaatactgaagaatgcatcagagtctcttatcagcagaataaatcaggtggaagagataattagtgggcttgaaggcaggctatttggaaatagccaggggagacagaaaaaaagaagaagaaaaaagaatgggccaggcatggtggctcacacctgtaatcccagcactttgggaggccaaggtaggcggatcattcaagatcaggagttcaagaccagcctggccaacatggtgaaaccccgtctccactaaaaatacaaaaaaaaaaaaaaaatgccaggcatggtgatgtgcacctatagtcccagctgcttgggaggctgaggcccccaacgtcaaagataaagaaaggatcctaaaagtggcaagagaaaagaaatgaataacgtacaatggagcttcaatatatctggtagcagtcttctcagtggaaacctaacagatcaggagaaagtggcatgacatatttaacgtgctgaaggagaaaaacttgtatcctaaaatagtagatccagtgaaattctccttcaagcatgaaggagaaataaagatttttcccagacaaataaaactaaggggttttattaacatcagacatgtcctccaagaaatgtaagggagttcttcagtctgaaagaaaagtttgtaagtgagcaaaaaaaatcatctgaaggtgcaaaactcactggtaatagtaagtatacagaaaaacacactatattttgacaccataattttgatgtgtaaactactcacatcttaagtagaaagactaaagatgaaccaatcaaaaataaactacaacaacttttcaagatacagatagtgtaataagatataaatagaaatagcaaaaagttaaaaagtgggggacacaattaaaatataaacttttaattagttttctctttgtttatgcaataggtgttaatttgtcattaatttaaaataatgggttataagatattatttgcatgttttatggtaacttcaatcagaaaatatacaacaaacacaataaaaatcaagaacttgaaacgttaaaacatatcgtcagagaaaatcacccttgctaaaaggaagacagacaaaaggaaagaaggaagagaagaccacaaacaaccagaaaacaagtaacaaaatggcaggggtaagtccttgcttatcaataacaacttgaatgtaaatggactaaactcttcaatcaaagcacatagagtagctaaatggatttaaaaaaaacaagacccaatgataagttgcacttttccataaagacacacataaactgaaaataaagggatggaaaaatatattgcatgcatgtagaaaccaaaaagagcagcaatagctatacttacatcagacaaagtagatttcaagacaaaaactatacaaagaatcaaagaaggtcattacataatgataaagaaatcaattcagcaaaatgatgtaacaactataaatatatatgtacccaatactggagcacccagatatataaaggaaatattattagagctaaagagaaagatagactccaacataatcacaggtggagacttcaacaccccactttcatcatcgacacatcatcctcacggaaaattagcaaggaaacatctggcttaatctgcacaatacaccaaatgaacctaatgtatatttacagaacattttatccaataactgcagaatacatattctcctcagtacatggatcattctcaaggatataccttatgtcaggtcacaaaacaagtcttaaaacattaaaaaaattggaagttatatcacgtatcttctgtgaccacagtggaataaaactagaaatcattaacaagaggaactttgaaaactatacaaccatgaggaaattagacagtatgttccttaatgaccaatgggccaaagaagaaatgaaaaaggaaattgaaaaaaatcttgaaacaaatgataatggagacacgacacactgaaaccaataggatatggctaaagcggtactaagagaaaagcttatagctataattacctacgtcaaaaattagagaaacttcaaataaactacctaattatgcttcttaaagaaatagaaaagcaagaataaaacaaacccgaaattagtagagaaaaaataataaagtttagagtagaaataagtgaatgtgaaattaagaaacaatacaaaaatcagtgaaagaaaatattggtttttagaaaagataaataaaattgagaaaactttggccagactaagaaagaaaagagagaaggaccccaaaaaaatcagaggtgaaaatgaagacttcacaactgatactgcagaaatccaaaggatcattagaggctactgtaaacaactctatgccaacaaattggaaattctagaagaaatgcatacattcctagatgcatataacccaccaagattgaaacatgaaaaaaaatccaaaactggaacagacaaatgacaaataagcagatcaaagcagtagtaagtcacccagcaacgaaaagcctggaacctgatggcttcaatggtgaattttaccaaacatttaaagaagaactaatatcaaccctactaaaactattcagaaaaatagggcaaaagggaatacttccaaacttatcatatgaggccagtattaccctgataccaaaaccagacaaagacacctcaaaaagaaaagaaaactataggccaatatccctgttgaacattgatgcaaaaaccatcaacaaaatactagcaaactgaattggattcaataactcattaaaaagatcattcatcatgaccaagttggatttattccagaaatacaaggatggttcagcatacacaaatcaatcaatgtgatgcattatatcaacagaacaaaatacaaaaaacacatgatcatttcaattgatgctgaaaaattatttgataaaattcaacatcatttcatgacaaaaaccctaaaaaaaatctgggtatagaagaaacatacatcaacacaataaaacccatatatgacagacccacagctagtatcatagtgaatggggaaaaatggagagcattgtttctaaaatctggaacatgacatggatgctcactttcaccattgttattcaacataatagtggaagtcctagctagggcaatcagacaagagaaagaaataaaaagcatccacgctggaaaggatgaagtcaaattatcctcgtttgcagatgatatttttgttatttggaaaaacctaaaggctgcacccaaaattattcaaattgatcaacaaattcaataaagttgcaggatacaaaattaacatacataaatcagtaacatttctatatgccaacagcaaataacctgaaaaagaaatcaagaaagcaatcccgtttgcaataactacaaataaaataaaatatctaggaattaatttaacaaaataagtgaaagatttctacaatgaaaactataaaacattgatgcaagaaattaaagagcacaacaaagaaatgaaaagatattccatgttcatggattggaagaatcaatattgttaaaatattcatactgaccaaagcaatgtacagactccatgcaagtccttcaaaataccaatgacattctattcttcacagaaatagaaaaaaaattttgaaaatttatatagaactgcaaaagacccaggaaaaagctagaattatccagctaaagctatcatgtgcaaaaagaacaaaactagaggaatctcattacttgacttcaaattgtactacagagctatagtaccaaaatagcatggtactggcataaaaccagacaaatagaccaatggaacagaatgaagaactcagaagtaaatccatatgtctacagttaacttattgcataaacaaagatgccaaggacatacattggggaaaagacaatatcttcaataagtggagctaagaaaactggatatctgtacgcagcggaatggaactagaccccctatctctagctaaccatatacaaaaacaaaaacaaaacaaaagaaaaaaaacggattaaaggcctggtgcggtggctcatgcctgtaatcccagcgctttgggaggccgaggcgggcggatcacctgaggtcaggagtttgagaccagtctggccaaaatggtgaaaccccatctttactaaaaatacaaaaaattagccgggcacagtggcacacatctgtaatctcaggtgctcaggaggctgaggcaggagaatcacttgaacctgggagtaggaggttgcagtgagccgagatcgcaccattgcactccagcctggggagcaagagtgaaactccatctcaaaaaaaaaaaaaggttaaaggcttaaatctaagaccttacactatgaaactaataaaagaaaactttgggaaaacactccacaacactattcttggcaaaaatttcttgagtaataccccacaaacacaggcaaccagaccaaaagtggacaaatgggatcacatcaagttaaaaaccttctgcaaagtgaaggatacaatcaacaaagtgaagagacaacccacagaatgggggaaaatatttgcaaactatccatctgacaaggaatcaataaccagaatatatgagaagctcaaacaactcaatagggaaaaaatccattaatctgaataaaaaatacatgaatatctgaatagacatttctcaaaagaagacatgcgaagtggtatataacaatatgctcagcatcactgattatcagagaaatgctaacaaaaactaacaatatgtcacctcaccccagttaaaatgatttttatccaaaagacaggaaatcacaaacactggccagcatgtggagaaaagggaatccttgtacactcttggtgggaatgtaaattagtacaaccactatggaaaatcgtttggaggttcttcaaaaaactaaaaatagggctaccatatgatcccacaatcccattactaggtatatacccaaaagaaaagaaatcagtgtatcaaagagatttctacaccctcatgttatagtaacactattcccaatagccaagattttgaggcaactgaaatgtccaccaacagacaaatggatgaagagaatgtagtacatatacacaatggtgtactattcacccataaaaaaagaatgagatcctgtcatttataacagcatgaataggactggaggtcattctgttaagtaaaataagccaggcacagaaagataaacttcacatgttctcactgatttgtgagagctaaaaattaaaacaattgaactcagggggatagacagtagaatgatggttaccagaggctaggaagtgtagtggcggggaatgaggatagttaatgagtacaaaaatgtagttggaaagaatgaataagatctagtattcgatagcagaatggggagactaaagttaacaataatttactatatatttaaaattaactaaaactataattggattacttgtaacaaaaagaaaggataaatgcctgaggtgatgaataccccatttaccctgatgtgattattatgcattatatgcctgtatcaaaatatcttatgtaccccataaatacacccagtatgtacccacaaaaactaaaagttaaaaaaatcaaaatatcaaaagcaaaaatcttattttatatatatatttttaaatgtcttagaaaattctcaacatattttacaatttttgttaatgtctcaggatcattattattaattttaatagttgtattgccctgtaaaatacactttcggagacttgttgacaacttgataggctttctggtgttatttgtcttcacacatgatggcaccatgtattgtgactttggagggcatgatatttgttggtttgttgtttgcttacttttttgctataaaatagttatttctcaccatatgttttaaaatctgtctatttcaacttttgcttcttgataagaggttagcagtccttttctgctaagagccagatagtaaatattttaggctttatggaccatatagcctttgtcacaatcactcgactcaggttgtagcctgaaacagtcatagacaacacagaaacaaatggctttggctgtgttccaatggaactttattttcaaaaacaggcagtttgctggatttggtgtgtgggttgtagttctagaccgttgagcgtggtgaaatagccgtgtagagtaatatgtaaaaaagtaaatagaatttttaaaaatgtaagtacatattgtattaggacataatgttaccctacaagctatgtaaaatttagtgctacaattttatgacagcatttgtgggtggttagatgtctttcttttgtcccttctttgcatcttctttcaggtttgtatctatgtggcagatatttggggttattgaatgaatgagctctagaacacttgcttcatatgaaaacgtgcatatgtatgtttatgtatctcagatacagctaaattcattgtaccaattaagacctagctaagattggtttgagctccattctatgaattttagagttcagtagtgcccaccccaaccaccagcaagttgtatgcaaattttcagtgtgagtttatattttcaaggtctcctctggctctgaattctgcttctgtcaaattatttcattttagagattgtacagctatccttgttctctgaaaaagtctcttggccatttctatacctcagactgcagcctcctaccatggtttttggttttccttagtcccttccagatggctcacaggagctccaaattcttctcacattgttctgcagattaattccatttcctccagtcttactcccaaatttctctctgactcctctgtgcatgttttgatctaccaagatgctttgctgaagaaagaagacctattctcccttaattgaactgtcttcctaagaagggagttttaattttaagtagaattttttccctatggatatatggatgaaagactaggtggatggatggctaaaaagatgttatacagtactgtatattaggatagctacttcatatggaggctagtaccaaatatgaaaaacctatttttagcttattatagttgattttgtgatctagatattattcagcattgttcttcaaatcccctgccatagccaaaacacaccttatatactatttcaggaagaatttttttcatttcttatttgtttcattttataacatatcctaataatgattttattacaaaaggagtcaggaataccacttcatatgatagtctactaaatcttaaaaatagaatataagatcataaattgtgtaaggtaaaagttagacttaaaatcaaagtatccactgaaacttacaatagtaaggtggtatttctatttggaggaatgtctccaaatctccaatattagaaaaatagttatcttattattattaaatagttctaaaatcggtaattttaaaatgattttattcaaaattagtattattcagtcatatatgaattatcagccactcttaattgtctacaaagagcactgcaaagaacatcaaataaacagatacatttttaatagactaaagagcatggtggttcatgcctgtaatcccagcactttgggaggccaaggcagggagatctcttgaggtcaggagttcggtaccagtccggccaacatcacaaaaccccatcttttctaaaaatacaaaaattaggtgtggtggcatgcacctatagtcccatctacttgggaggctgagacacgagaatctcttgaacccaggaggcggaggttgcagtgaggcaagatcataccactgtactccatcctgggcaacagagtgagactccatctaaaaaataaaaataaaaataaagagcttacatctggttttgtttctggaagtgatagaaatatgattaaatgattagaaaaaatcagaagtttaaaatataagttaattttttaaaaactcacatttcctgagcactacagtaacctaaaaccagcttctttgaagtttactcagtgtgttgaactgtaatggaaagctagcagctatactgcttatacttttttcttagaatcactagaaaatatttgaccataaaaaatagattctgagtaaaattactttttttaaacaaccaaacctgatccttttgtagttcgtaagcatgatgattgggtgttcacgtgtatgtgtgagatgtgccacccttgaaccttgtcaagacatcggcacattacccatctgatatgaaaaaaaaaaaaaccctgtcatcttataaaaattcacatttataaagaggaatagagataggacactgaatgctttgggtttgttttgtcgacatttatgttttcaagcaggcttgcttcatccaatttttatattcttttgaggaaaaatacactgccaggaatcacagtatgcaatgcaaattagacacagaactattccctatggactttctagcctatggagagagatatgcatgcagacaacagagaaaaatggggtcgcttctgatgtttggactggcccacgataaactttaataaactagaagagacatagaggacagttttggctaaggaaagaaaatgaacagaggctcaaaagttcaaaagtctatgtccaagtaaagcaagtgcaggcttacattttactgtctttaatttctaaattcaagaagctctgaagaccactgtgtgtgttgttgtttttccttaagctacagactgacctgaattgacaggaggctatttatagtctttatttgtcctacttatgagaatatttatagattttactgcagaaatatcaatgtatttcattataggtgcaggccccaacatacatggattttgctaatattttatacattaactgtattactttaaaaaaataccaccttgttccccaaaaacctgaattacaaaactcactcggccccagctgtttctggtaaaggattgtagacttgaagtaattatgggggaagtgatattatagaaactatgtccagaaagctaggtgaagattgtgccagttcttgaacataccaagttacagattttggtaatttgactatagattgtaaggaaccattatacacttttgaagaagaagtgaagtattcaaccagtttttatcaaaattggttgaatccctgagcacacgctattttaaattttttctccatgcaattacaaaaactctgagtaagatggtgtcagatgaaatgccttttgaaaatagatatttacatccatcatttgttttcttgtgatggtgtgtaggagaaataaggttagagaaaacaattctagatcatgtctgcagcttgctaagtgtcatgccacataaatatggtcagagtttgatgtccccaaatgactatgcattaaaaatacaagaattgtctcatagaagaaaaaaataaacaagcaaaaaaccataagaaatagtgatttatttcatatttgttcatgtttcttgctaaaaatacctgaaggcaaattccagaaaatttgtttctgatttggttaagaaaattgagaaattaaaaatgttattgtcattgttgtgtgtacagtgtatgtgtgtcactcatagtgagtctttaaactctgcctttaagaacaagcatcaaaagtttggtacaaaatcaatgttcacaaatcagtagcactgctatacaccaacaacgacaaagttgagaatcaaatcaagaactcaattgcttttaaaacagctacaaaaaataaaaaaaatacttagtaatatacttaagtaggtgaaagatctctacaaggagaactacaaaacaatgctgaaagaaatcatagatgacacaaagaaatggaaagacaacccatgctcataaatgggaagaatcaatatagtgaaaatgactatactgctcaaagcaatctacagattcagttcaatccccatcgaaaggtcatcagcattcttcacagagctagaaaaaaaaatcctaaaattcatatggaaccaaaaaagagcccacacagccaaagcaatactaagcaaaaacaacaaatctggaggcatcaccttgcccaacttcaaattatactacaagactatagttaccaaaacagcatggtactagtataaaaaataggcatgtagaccaatggaacagaatagaaaacccagaaataaagccaaacacttatagctaattgatcttcaacaaagcatacaaatacataaattggggaaaggacaccctattaaataaatgttgctgggaaaactagcaagctacatgtagaagaatgaaactggattttagtatatgctaatccagaatgtaggtctaatgctgagtgtctaggaagaccatggactaaaaacaactaacaaacaagaaagcactatccaaataagctgccatcagattaacacctcctaagcaaaagctacttatattcctcaactcaaggtgtcagtgacagcatcaagcgtgtggtagaaaattaaaggagggggttgatttcccaaattttatcttcacataacttcctttcaaaatataacaacccaaaatgttgttaataactttaagttttaaatttcacctttaagaaaagtattttcatttgctttaaaataattatacgttttaaaaatagggacgaccagtgggtgtttcataataggttctgaccggagaaaaagaaaaaaaaatacccaaacctcttttttcggaatgtactagtccttttgaagaagatcttctgtaaatggggagtccactaagtgctaatctctatgttaagcatttccttttctttctttcttttttctttttgccacaacaaacctcaaggcagactattagctttgttttgcaaatggggaaaatgaaattaaagttaagaaatgtgtccattaacacacagctgggacttgaactcagcaatgtgtagctctcaagtgtttcttgtgatgtcatctaagactttgacaaccaaactgatcataatctctacaatgtggagtggacaactgaaatgaaaacaggaaagaaaaaaaatcaccactctaataacgtgtgtagctgtaaactatcttgctgtccaatatttttcttatagttttaaaacattaaactgcagggctgggtgtggtgtctcatgcctgtaatcccagcactttgagaggccgaggtgggtgcatcacctgaggtcagttcgagaccagcctggccaacatggtgaaaagctatctctactaaaaatacaaaaattagctgggcatggtggcatatgcctgtaatcccagctacgtgggaggctgaggcaggagaattgctcaaacccggtaggtgaaggttgcagtgagctgagattgctccattgcatgccagcctgggtgacagaacaagactctatctaaaaaaaaaaattaaaatgcaattcagataccataaaatttacccttttaatgtgtacagttcagtggttcttagtatatgtataagtctatgcacccatcaccactctaattcctgaacactttcatcacctcagaaaaaaactccatgcccattagtattcacttcttatagaattttgatgaagcaaaatccttcaaaagctttctactaaaagtccaattttcttagatttctccttcaaacaaagacaattcttaaatattttatagatacagaagagaaattattaaaataatctcaaataacaaatgagcaatattgctgttgttgaataaatcttcaaggatgaaaggatgaaaaggattattactggtagagtttcccaaaagtcataaatgtcaataagcttctccaccatatcattaccacaatttttaaggacctacgatctggcaggcaccatattaagatattctatctcaatttattctgacaacaattctaaggaagtatgaatactcactctattgtacacatgaaaaccactgaaagaaggagcagtcgtctcatccagtaaatgtaagggttgagaggtaatcctaggtccagtttgatttcaaagctcaacctctaaacactaagctccaccaagtgagagaaagtggatcaaaagagaatgtagatgtcaaattaaaaaaaaaaacaggatggagagagaaggatgaacagaagtgggttaagggtacaaacatacaatccaataagaggaataaatgtaatggttggtagcagaataggatgaccatgcttgacaaaactgtattatcctcaggtgatggacattttagataccttcccttaattgctacccattagatatgtgtaacaacatttctcatgcacctcactgatatggtttggctgtgaccccacccaaatctcatcttgaattcccatatgttgtgggagggaccccatgggaagtagttgaatcatgagggtgggtctttcctgtgctgttcttgagatagtgaataaatctcacaagatctgatgatataagggggagtttccctgcacaagctctcttcccttgtctgccaccatgtgagatgtgcctttcaccttctgccttgattgtgatgccccccgagccaggtggaaccataagtccattaaacctctttcttttgtaaattgcccagtctccagtatgtctttatcagcagcataaaaatggactaatacagtaaattgataccagtagagtggggtgctgctgaaaagataccctaaaatgtggaagcaactttggaactgggtaacaggcagagattggaacagtttggagggctcagaagaagacaggaaaatgtgggacagtttggaactccctagagacttgtcaaatggctttgaccaaaatgctgataatgatatggacaatgaaatccaggctgaggtggtctcagatggagatgaggaaattgtgagaaactggagcaaaggtctcttgttatgtgttagcaaagagactggtggcattttgcctctgccctagagatttgtggaactttgaactttagagagatgatttagggtatctagcagaagaaatttctaagcagcaaagcattcaagatgtgacttgggtgccatcaaaggcattcagttttataagtgaaagagagcgtaaaagttgggaaaatttgcagcctgacaatgcgatagaaaagaaaatcccattttctgaggagaaattccagctgactgcatacatttgcataagtaatgagtagctgaatactgttccccaagacaatgaaaaaatgtctccagggaatgtcagaggtcttcatggcaccccttcccatctcaggcctagaggactaggaggaaaacgtggttttgtgagtggggcccagggtccccatgctatgtgcagcctaggaacttggtgccctgtgtcccagctgctccagctgtgtctgaaaggggccaatgtacagctctggccatgacttcagagggtgcaagactcaagccttggtagttccaatgtggagttcagcctgccagtgcacagaagtcaagatttggggtttgggaacctccacctagatttcagaggatgtaaggaaacgcctagatgttcaggcagacttttgctgcaggggcagggctctcatagagaacctctgctagggcagtgtggaagggaaatgtggggttggagcccccacacagggtccctactggggcactgtctagtagagctgagagggccaccatcctccagaccctagaatggtagatccactgacaggttgtaccgtgtacctagaaaagctgcagacacacaacaccagcccatgaaagcaactgagagagaggctctaccctgcaaagccacagttgccgagctgcccaagagcatggggacccacctcttgcatcagtgtgacctggacctgagacatggagtcaaaggagatcattttggagctttgagatttgactaccccactggatttcggacttacatggggcctgcacccctttgttttggccaatttcttccaatgcttgaaccctcattgtatcttggaagtaacaaacttggttttattttacaggctcataggcaaaagggacttgtctcagatgagactttggactgtggacttttgagttaatgctgaaatgagttatgactttggaggactattgggaaggcttgattggctttgatatgtgaggatatgagatttgggaggggccaggtgtggaatgatatggtttggctgtgtccccacccaaatctcatcttgaattcccacatgttgtgggagggacccagtgggaggtagttgaataatgggggtgggtctttctcctgcgctattctcctgatagtgaataagtctcaccagatctgatgattatataagggggagtttccctgcataagctgtcttctcttgtctgccgccatgtgagacatgcctttcaccttccaccatgattgtaaggcctccccagccacgtggaactataagtcattaaacctctttcttttttaaattgctcagtctctggtatatctttatcagcagcatgaaaatggactaatacacccataaatatgtacaaataaaaaaataaaaatgaaaataacagttcagtctaaatggattatttacataagcccaggatgctgaagatggttatctagtgctggctcctagaagcattattgcagtgattttcatatctacatattgaatgcttacaatgtgcacttgcataagaccatagaaaacagatctttctgatccttccatttttcattatttgttaattaacctataaaactagaaatggaaacaatggcaaaatctggaagtatacaacctttcagactaatactatgaacctcttctcccaggtctttgtctgttggtcttccaggatctttatcctaaactagtcatcatcttagtttattttctgttgttataacagaatatcacagactgtaatttataaagaaaaatacatttaatttttgcagtcctggaggcagggaaggctgctagcatctggtgagggcctttttgctgtgtcatatcatagcagaaggcaagtgtgtgctagctcaggtctctcttcctcttcttataaagccaccagtcccattgtgagggccccactctgatgatgttatctaatcctaattacctcccaaaggccccacctccaaattttatcaatatatgtttggggattgagtttctaacacatgaaattttgaggacacattcaagtcagcatcaatttaagggttccaaaggctccttttctcctggcttgcatttcttttggattttttcaagacttcctttatttttatcatacttgaaaccatgtggtaggtgtgtcattgatttttaggaaagacagaaggcatgacgcatactgcttttgttgtaactgaaatgtaaggttataataaatttgattaaggctttatcttcagtcgaaccatatggttaactctaaagaaacagaatcatataactattctgcaactcgggtaaagttttcaattcaattcagcagatatttattgaccatttcctatgttttgagtagcatctgtatattgcgaaaggcagaaatagtaatatttcatgatgaatgacttttaagacttaccatgaaagggaacaaaagtgactgtgtttgtgtctgtgtgcatgtgtgtgtgtgtgtatgcgtgtgtgtgtttataagcttgaggtgaggaactgtatataaagcatgtgcccaactaattgtgacacaaactatgatgtgataagtgcctcagcatttcctgattcctctggctaaatcaacacttctaccacctctttagacaccataaaatcatgtacttctccacttttgcagccgttacagttgtaataatatattagtttgcatgactatttggctaaattttcaagaagtactttggctttttggaaatcagagactattgtgtgaaagttctgtgctaagaaatatgcgcaggtaagctccaaagaagggcacctaatccagccagggaaggtttattgacagaggtgataatgaatccaatttttgaagggttggtgtgaactcactggaagaagaaagaaagcaggatagtctaagcaagtgaactatcatgtgcaaaaacatgtagacatgaacatggaagtgtgactcaggccaggcgcggtggctcatggctgtaatcccagcactttgggaggccaaagcaggcatatcacgaagtcaggaaatcaagaccatcctggccaacatggtgaaacccatctctactaaaaacgcaaaaattcgctgggcgtggtggcgcacacctgtagtcccagctactcaggaggctgaggcaggagcatcacttgaacctggaaggcggaggttgcagtgagccaagacggtgccactgcactccagcctggcgacagagtgagactccgactcaaaaaaaatagaaaagaaaaaaacggtgagactcaaggacatggatggagttaagttcatgtacggagataaaagaagacaagcaaatcatcgtaggttttatgtaccaaacttacactgtcgacttaatcttcaatacaatgaaaagtttctgaagagccacattctttagggacttaagttttggggtgattattttggcagtatggaggctaaattgaaggcagttggaatatttttgtaaatatgttgtagtaattaggcaagatgtgatcagggcctgaaggaaggcaagaataaagtgatggatgttagagatgttaaacaaatagtatctgtaatactctctgattggagataagttagcaagaacagtctaggatggctcacaaggctttgaatttggaaactggatagttagatgtagttgctcattaaaatatggagctcaagaagtttacagagaaagatacgtgtccagttgtagttattattattatttttttgaaatacctgtggatcctttagcagaggtttccagggaaacttggaaatggatgattaaatctatgtaggtatcttgtcagcagacacagatccaggagttatcaatagcgtaggaattttaatgtgtaagaagatgcctagtaacagtaaaaatggagaagagattgaagcttggtaaatagtaacacttagaggatggcagaaagagaactatgatgttaatagagaagtagaaggaaaaccgagagaaaaatgatgtttctgaagatgaggaagagtttcttgaaatagagtgatcaataatttcaacacatataattactgcatctttgtagcattaggacaaaatgtgtccattttatctggaatagccttgattatggtgattttataaaaagaactttggtgagattgtgcaagcaggaggcagcactcgggtttaagaaagaaaagaaatgctgaagtgaaggtagtacatatagcctcttctttaagatgtttgtatgtttgtggaagggaaaaaagagaggatagaaaaataatgcacaaaggagatttcaaaattccacatgtgccttttgcctggtatgtgagagtggcaactttggccttaacctgtgttctgcacaggcagaaagatatatacatacgtacacttgtgaatatatttgtgagcataacaatcaccttaaaggggctgaaatattcattctccaaattacttcatgtccaacaagcctttgatatggatcctaatgaacatctccagttaaccctttttctcctcctttcccacaaccatttgtattaggacagttaaaagcttgccatcaggaaagttagccaaagtcataagcttagactctttcctatgcccttttctgaaagttaacactaatagaaagctcagagtttactgtaaaggcaatgcttatttttattggtcagatctttaaatgaatggctgccttctgcttctaaaaagcagacaatttacagagaaaattcaatttccagggaaaggaaaaatgccctgaaataatttctatgcctattatcaagtaagtttgattctgatgctatcaaaaccaggggcagcatcatagtgtcttttggagaatgttgcactaggaagggggcaggggttctgagccacttagttgcagccctgctgctgggggccaggtgactttagaagtcactgtcccttttttgtattttttttttctgttaaaggatggagttagaaaataaatgtctaccatgagttgacttatgttaaaattttattccctaaaaccccaaatgaagtcattccacatatacatatcctttttctatctgcattttggaagaacctcttctttacaaatatcatgatactgctatgtggttttacatggtttgcatccctcctcggcaatcagaatcactcttctcatctgtgctatcattaccacaggcttcacatttctctatccatctcaacattgtttgtatagctatctattatttccatccctatgagatagtgagtccactgagggcagggttatatttaaacaaaatatgcactcgctaaatgtgcagtgaatagaaatgaatattgtttaattcatttaacaggtggacttaatagtatcttataaaatttgatgaaagttttatttggagagcttggataatacgaaagctaaaagaggttgggtgaatctttattatcagacttgggtagggctctttattactgttttggtgtctttaatactcaagattgttgaaattccagaagggcatgtgggaatcaaacatggtttataacaatcacatggaagtaactatttttcccaatgtcacctaaatgtaagacttcccatttaaaaatgaatatatagtttaaaagtaaaataagagtagcacctcagatttatggcactttggaaatttcttatcatttcctcatgcatcccttcatcctagaggataatgatcatcaatacttgaactccttttggtaccaacattctactgttaggctctgagaagttatgatgttcacttaggtcttctgattctcaaggcatcaagactatatcctgttgcaacttagaaataacatttctagtccctgtgtgtctccttcacattctggatttttgtattttaattaagcttagtaataaatatgttttaaaaatcaaagccaaatttatataactgatttttgttgtaatatgttatttattttgaagaatatgcatatggtacatttttaaagtataaaatggaatgcagtcaaaagtaggtctccctctctgttgtgttctgctacctaatctttctccctcagacgacaactgatgccaatttcttgtgtaccttttcagaaagagtccatgagtttataaacgtgaacgtatgcacattcttattttctagattacacaaattgtggcaaactatatttattcttttatatggttgttaaattcagtaataaatttcacagatctattcatattaaaaaaattgtagcacattactttgtgggaatataccaaaatgtaagttagttccttattgatagattagtatcactactatcaaatagtgttatcaacaatgttgtaccgactactttgtgcagttgtcactgttgtatgcttatgcaactatatctaaaataactaaataagaatttgccaaagggggaattggctttttaaagtttgaaggttagagacaaatagctatccataaaggcattaatgcttacttttaccaagaatgtatgagggttcccatttcctttatattctctctagtacaccaagttatcaaacatttttatccttgaaatcttatacggtattaatatttgattttggattatatatattatttcatgtgtgaatctgatgacttttcaaatgtttaaaagtaagttatatcttctatctaattcatatcctcactctaaattctttctgagctattgtttttaaatgtaatacagaattacaaatatttttcccaattggaaaatcacaaaaaagtcccccccgtttttttttgttttttttttttttgagacggagtctcgctctgtcgcccaggctggagtgcagtggcgcgatctcggctcattgcaagctccgcctcccgggttcacgccattctcctgcctcagcctcccgagtagctgggactacaggcgcccgccaccgcgctcggctaatatttactatttttagtagagatggggtttcactgtgttagccaggatggtctcaatctcctgacctcgtgatccgcccgcctcggcctcccaaagtaaaagtccccattgttttcatttcatcaatatttaaataaattatttcttacatattctaggtaccaagatatacaaacataaaagatatgaacatgaacaccaaaatttggaggcgaaaaggctcatagtctcttggggggaaaatatacatgtgcaagctgaataaaataaatcctataatagaggaattgcagtgtgctgtgggaactacgaggaagctgtgactgctttgggggaggcggggagataggagggaaagtttaccagagagatcgctgtggcttctatggtaggtctcaagaaatgtgtataatttatagggtcagagacgtgttcaggtgataggagaaaagggtggaaacacccattttgtattgtgcccctcctttggtaatgagttttgactaatgagcaattgctttttttccttgacattcataagtatttattatcctgaactgattgacctcatattttgcaaaataaacagctcatattttactatgatgatttaaaaacattttccttccatttgaattagataactcatctttaaagttttcttatggctaacgagctcgtgtttattcaagacaacttgttacagtgctattagaagagatggaaaacgtccaactgcagccccaaatcctggaggtatctatttgaagataagaaaaaagttctcaaacaaatgacaaaatgttcaaactcaatcataattagagatatgcaaattaaaacattacaatcacactgacataaatgaaaaagtaggacaatacattatgttggtaaggctgtgggcaaataggcaatcatatattgctggcaggaatctaaattcatacaagccttctggagtaaaattcagcaatacttagcataaatatctatacacatacttttcgacccagcatttctttttctaggaggctaccctggaggcacacagagtgtatttctcacaggagtattggttagcagtgttttctacaatatgaaaatgctacacacaaggttacttattgcagcattgtttataatagtacaatactggaaacaatcaaaagaccactacatagaagagtgtgtgtgcatttgtacaaaagaaacacaggcaagataaactaaagaaaccagttacctataggcagtgcatgggaaataagtggaaaaaaagagggaacaggaactggccaggagggataatgagggaataacgattatcaagctatactttttggtaaagctttgactctaagtaccatagtaacgtttcacgcacccaaataaaaaaaataatttaagtaaactaaatctagttaaataattaaaatcaatgtgtatggaatataagtttacaaatgaataaccaaaccacactgaagaggatgggcaagtaaagaagcaacctaagtcactttcaaaagaaaatagtattttgattggatactgtaaagttcaagacaaaaataagtgtacataaatactgtactcttgtaataagtgtttctcacaggagtatcagttagcaattctctaactaccttaagtgtatagtaggatttaataaataagtgaatatattataaataacggaagtcaggcctttcactgtcagaaagaagttacaaataaggaaaaggcaaaaaataaaatgaacctggtggtattgacttaggattgaagtattaacgatatctatctctatctctagctctacatgatatatcagaatctatctaaaaagatataccgatagaaatgtagaaataaatatgatgtacgtgtatgtgtatatagatttcctagctctctctgctgagaggacctgagagcaataacaccccagtaagaatgaggacacttagcgctcagatgttggttgctattgttctccaaagaaagaacccagactcatttggcaatcatttgaatccagggctagggtagaggggacaaaataaacttggaacattatgtgatgccaaacaattaaggaactgctaaaaaacaattggggtatgtcaaaaggacacaatagcaaatcagaaggatctcccaatggctaaagccagaacaattttagccacaaaataaataatgatagtattggattataatccttagaataaatatccttgaggccatactgatataaataaataactgaatacataaataaatgtaggagaaggaacagctcttacagaattcctattactttagacagaataaaggaaatacaaaagtcactgccgggcaaactgcacattaataattgttgcaagcaagatctgtcaatggatgctaaaatcagtggataaaagtttgaggaaaaataggacattagcacagcatcaaagttttttcctcaatatatttatcaattataaatgaaaaaaatgtaactttacaatatggaaatctagtagacataactttaaccaggcaatcaaggttaataccactaactgacatcatgtaccctcccccctgccataatgatatactaagaaggatacaacatcacttctatggcattcttgccaaatgaataaccttagactaatcattagaagacattggacaaatccaaattgaaagacattccgcaaaatatttgaccaatacctattagaaatgccaaggtactgaaagacagggagactgagggaccatcacagattgaaggagattcaagtgacatgacaatcaaatgcaatatgggtcgtagttggatctggtacagaaaaaggacatgagggtggggaagagctggtgagagctgcatagctggtgagagctgaataaagtttgtagtttagttaatcacaaggtactagtgtaaatgctctgggtttgatatttgtacactggtcatgaaagtcattaacattagggaaattgggtaaatggtatgtatgaactctcagtcttattttataacatttgcataagtggaaacttatgataaaaaagtttggaaaataatagaaggagataacgaagatgaagaagatgaagagaaggagaaggaggaagaagaggaacaggagtcagggaggggaaggaaaaagaaataaaaaagaacaaaaggaagaagagaaattttaaaataacatgtttgcttttttaaaaacagtatcaagattgtatttgaaggtattgctaagatgagagctacaggcatggttttgtgccctttcagagtcaatgggctatatgcataacatggaacaaaaatgccatgttagatatcgtactgattttcatcttttagtttatatgttggtttctttgtgaaaataaatttaatatcaattcaacagacattttgccattgatatattcaataaaagttttgcaacctggcatgattctttatatgttattaccaattcaacattctcttccaaacagataaatatactgattaattgcacagctgatgccaagagtgaacagatgcctatgtttagtcttaatagaaaaatatcttagataagtcacaatttaaatatctcaaaactcccttacacaattattaatttctacaaactcttagtaattatttttaaaaagaaaaaatttaggtactaggaattcaaacacattcatccatcattatataccagaattcctaatccttctcaaaaagtgctaacttattttattttgaagccacactggtgagtcacttgctataatttgtccaagatgtctaagtcaattagaaaacagaaagaatggctaactttaaaaaatcccaactacagacagataacataatttaaaatttgggtattaaaacaataatatatctgaatataaaattaaaaatattattgccagtaaaattttgagtttggcttatgggataatacacagaaaggagaaaagatgaatgttcttgttcaaactaaaatacatcactttcttacccttcatgtgctcctggctattttttttgttttgttttgtcttttttgggatgttatgatacatgtaaaaatgaattctgatatattgctcaagatacttcagaaagactgtactctgtgtgcctaattgtggaagtgggtgacaatcacatgaggagttgctttaaaaagcatgaacattgaaatcctgataagtgtaagagccttttttaaaaaataaaaaactgtctaagtaatacaattctactgatcaagtccctttcatacttacttacaaagtagaaacttatgttgatatatacttacaaagtacgagcttactattatcaaatgtccatactatacagtaagaaaatattttgcattaaaatgttacgtgccctctgaactcacctgaaagctcaataccaacaaaacaatctataaatgtaatacttcagtttgtttttataagtactgtgatgatccatttcctctctggtcataagaatcactgtgatagccatttaaacaatacagtacactatttgaatattaattgtactgagttgtctttcctgctttgcatcctaaaagtttacaatcctgttgtggagtaagaagactcacacataaatgcttcctataatcaaataacagagccactgtattagacgtcaatagtctaacacccagaacccagggaagttggtaataacaccttatgttgcaaagataattaaaatcttcaaagcactttcacatgttttacctaattgaactcttgccacaaccttgccaggaggcagagagggttgtgataaatataaaaactgatgctcaggaggtcatatgtgttttaaaatcacacacggacctgttcactctgctcaagtgccgtcgagggaaccacagcattgtcctgttcatttgctatttttccaggagtagcacttccctcaaagtaaggaaatagctctaggtattgggttccagaataggagagccctaccggaaaaccgtgttccgctgcagcacaaaggactatttttagatgttttccttttgctaattgtctctccctctgtggggaatttctatgggtagaatcccagatgagccaattttctcactaattctcaaagagacaggaaagatgaagaccatggctcaggttgccctggggctgcataacttcttcggtgatgtcactgcagtggttttaggaagatcttcaaggaccttggagcttaaagagcttgtgataccactgaacaacaggactaagaggcgactagaaagaaaggcctgggcatatcttcttgaatcttggaatcaccccaaatgacctttcctggagcttcagctttgaaaggagctaagagggtgtgaacccaggtggtggctgtaaactcaagcggccctccagatgttctggtttttcttccatcacctctgagagaaaaaaggaagagacttcttccaggcaacttcaaacatcatttcaagtgttagggagccagtggaaccgcgaatgtttagcctatataagagaaagagaacaggtgtgatgcaaaccatttttactcccttgcagggaagagctaaccagttagtgctaggcagccttgagacaatggatggaacaaaggtgaggtcagttgttggctcaacctcagggaaaacctaacagttttcgtgcaatgaattacctagggagctgctgagttcactgtcacctggattattcaagcagaaattcactggtatgaacactggcattcatcggaaagtgaaaatgattcacaaccctacaggtggggtctaaataataataattgcaaacactattttagcacttactttaaaacaagtgttttcttaactctcagggggtgtgtgagacagatgctatctttaactttcttttaaagatgagaaaattgagggacagagcggttaagtaatttgttcaaggtcacacacctagtaggaatttgaacttaacgctgcttgtctctagtgtctgtgctcttaatcacttgtattgctaagtgtcccctaaagtcccctcttgccctgagattccacatagggttacgtcctgtcacttcgacagcattcttcccatgcttactcattgcacttccaaaagggcattgttggcatcaggaaaagaaaaaaaaaaagagtcaagggggctgctgggaaaaaaaaatcgagatctttaaactcatggagaagctgtttggtcatcggggcgggctggcagaggcaaagcctgccagaatactggcgccaaagcgaagcgctcttttgtcttcagatttctcgcctcacctgcctcctctccctctgtcccttctagctccacttcccactgcacctatgctaagcttttctaggagcctgaaaggcacggggacaaacaagcacgccgctgccaatcctctatctcacaccctcttccccacccagattgacggggagacgcccagggtggtaagtgacttacccaaggacacagagccccgaccagaaaatccaggtgtccagactcccacatcggcactctgtccacgcctacgcacacctgacttctcatagccggcacccaggagctttctttattccacgtccccgcctccctaccccaccccctagttccctagagtcgcttctgacgctctgcagcctccggggtccagccctccctgcgggtgcttcccttccgccggattcccacaccggagtcgcccttggccgcgcgcagcccgcgggaccgctgccttccgggctggaagccgcgcagccctctcagcgcctcaagcccgggacggctgggacaccgaggtagtcgggctcccagggcacagggtccggcaccgagggcaggagcaggggaggtgccaaggaccccggtccagaaggcacctgtaaggaagcaccgacccgcagtgacgtcctccgcgtcgtcctcagaccagccaccgcctccggaaggtctcaaggggccgtgctcgagcccaccgaggggtggcagcgcctcgggctctcggagggctgcccccggcggaccggcacttccgcgtcccggcccgccccctgccggcgcccgggctccctccggctccatgtgcaaactcccctccacctgggcgcgcgcgatggactcgggacccggcttccgaagacaggccgcctgttggttggactactagcgcaggtgggcggggagttgaccaaccccacacacgcgcttctccatgaagattcttgagctttctctgaagaaaggagtgcatatgctgcagtgtctctgtggaaggagcctgaggtccagcgacagcccaagtgaaccccagctcaaagggattgtgacaaggttattcagccagcagggatacttcctgcagatgcacccagatggtaccattgatgggaccaaggacgaaaacagcgactacaaattgataaagacacctgttcttttgttcatgaagaaaagactaattatatgtaattgagtac

SEQ ID NO: 2770 - DNA, 633 bp, Homo sapiens
aaagcctcaagtctgcatagaaagcgcatttaatccttttttaactgggtgaggttgcctcttgggacccccagttgatagatgagaagcacctgactttgaaaaggaaccgaactcaagcaggctgcatcctaagcccggtgcgcagtgacccccggaccctccctcctcaggcgctcgccgatcccgggcctccccctcctcagatttgccaagttgtttctcattaaacctaaaccaactcttcagccgcgccgcctcggggaccgtaagccccgctctggtggacgcctggagtcgccgcctcccgagagtccacaccccatcttgtctccagcctgcgctgggaagaagctgaggtctggaggtcttcctctgaaggagcacagtccagggagccacagaaggctgccttgaggagtggaactgcttcagggatcaatgcaaagtgtcccctgtcaggagaaaaaccactcagaggagagatgggacctcagtatgtttgccatgctggtatccagcttctggcctcaagtgatcctcccgactcagccttctaaagtggcaggattacaggcatgaaccaacatgcccagcccagagaaatcaactcctgtgtgccaagattaggta

SEQ ID NO: 2771 - DNA, 324 bp, Homo sapiens
ggaacatggatgaagacagccatttgcgattgctctaggggaagccagctggcatgggaagtagtgcagtggagaaatgcacatggccagagactaagaccaatcatttgaatgagtttggaagcatcctacccaccactgccaccagtcaagtcttcagatgagactgcagccatagccaacagcttgactgcaacctcccaaaaaccttgatgcagattcacacaacattggacttctgacccatagacaatattatataataaatgtttgtctttgccactaagtttcaggataatttgttatataacaataaaccgtaca

SEQ ID NO: 2772 - DNA, 385 bp, Homo sapiens
gaagtatttaagcaagaaaatacagtgaagagccacttcacctggccggcctatcgttattttaagtgtatgatgcaataacctagatttgcaaggggcggctgtaaactttcttgcaatttcagtctcccgtaatagaccagatactccgtgaaaacagccttgaataacagtgccctgggacccagaactaagaagtcctgtttttcctgtcagggaatgctttattcttgatgacatggagtctttaagcctagcctttattcaggcaggaaagcagatgcccagcagcctccataaagtcaacaaaaatgaacttcgtctgctattgttcattgctccagtccttcccagaacaatgctacatatttttttctctttaaag

SEQ ID NO: 2773 - DNA, 39345 bp, Homo sapiens
gagtgcagtggtgcaatctgggctcactgcaagctccgcctcccgggttaacgccgttctcctgcctcagcctcccgagtagctgggactacaggtacctgccaccacacctggctaattttttttgcatttttagtagagacggggtttcatcgtgttagccagggtggtctcgatctcctgaagttgtgatccgcccgcctcggcctcccaaagtgctgggattacaggcgtgagccaccgtgcccagccaggtatgtttttttaaaattcctcctttggaacaatggtcttcagctctgcttgcatatcagacctttggaacaatggtcttcagctctgcttgcatatcagattctgatttgattggtctgggttgaagcataaggattagtattttaatttcattgaggtgtgatttaagccagtaaaggatgcaaatcttaagtatatggcctaataaatttttacatagaaatacatctgtctagccaccacccatatcaaaatataggacatgtggcatctgtatttactctccagatgattctaatgggcagccagggctgagaaccacagcccaagcagacggtcatccacattagatctgacactggcttttcttttgtcttcaaaacgtactgtgtgtttttatccctgtgcactcatgttctcctttaccatcatctctgtttcacaaaactcctccccgcctcacctgttgccactagcatttgcacacttctcttttgttgccctcaaccccttgtactgtacagtgagtgggtgggcatctgcctcctccacagatctatgagcttctccagcacaaagactggatttcactggaatttcatgtccccagggatgccacactaagcatgcataaaataaatgagtcaactctggtatactccagctgtcctgctgccatttgcctcatccacaagaataactgtggttggggacagggaaggagtatagctaagtcagattttttattgtggccctcaaggccaacctggggagccctactggaggaagccctgaaggatagttgccccgatgaccggttatggtggcctgcaatcccagcattttggggggccatgacaggcaggtggcttgagtacaggtgttccagaccagcctaggcaacatgacaaaaccctgtctctggggggaaaaaataaaatgtatatatatatatttgtgtgtatatatatatttgtgtgtgtgtatatatatatatatagtgtgtgtatatatatatatatatacatatacaaaaaaaaatttaaaaccttaggcaggcacggtggtacatgcctgtgatcccagctactcaggaggctgatgtgggagaattgcttgagcccagaagtggaggttgcagtgagccaagattgcaccactgtactccagcctgggtgacaaagcgagaccctgcctcaagaaacgaaacaaaccaaaaaagcgaaagttgcccctgaaaatatctctgggaagcggtcctccctctggataagctgagtgcttgttcctgcaccttggctcacacgactgctccatggcgccccccccccccttctgttaactgcatcttcccgacttcaacacccagctcatgctgtcatctcatgttcatcttccaaaaactccgaccctcacgcattccttttttattttctttttgtttcctttttgcgcttgatgtcagtattataggtcgcccagtacatggtagtcagggccatctttgtttcacatgacaagaggaactcagccttaacacctgctctgtctgccttggaaaagaaatgaagaaaatactcgtttcaaaaaacagttgggagttttaaatgtggattttatttcctttctgacttgtttttatgaaggaaaaaaaaaatcattcctcctccctatttggcaggggtagcgtcacccttgaggagagtgtcacagaaggaaaacgcgatcccccaccattgccgtccggctccaggttcctgagctgctctctctcacctctggctgagacttttttttctctttcccctagccatctttcttaactctcggggccccgtgcctaaatgacctgatctgtgaaatggagatatatagtcctttcattttaagtcctctatacatacaaataagagtgagaaaatctgctgaaactgaattttttaaaaccctcttccaaatcatgtttggttgttttccttaataaccagagatgcaaaagaactcactcattatgctgtagcttttctatttctcaccatggaaaataatcccagtacagctcttttgtgctttagttcacagggcctttaccgggctttatcttacgagagcctcacaagcgccctgtcaagccgagagacagggcaggcctgaaggctcagttgaggaatcaccttccttaagaaaacttgaaaccctgacattcccccacccctaccctctttcctttccaatactctctgtatatctgtattaatgttcccaccacactgtaggaatatctgtttgcatggctgtttcttcccctacactatgggctctttgaggatagagaccatatctagcatttctctgtaactaatgcccagcacagtaccttggtgtcaaaccgaatacgcctttgttgaataaatgtatgagtcaatgaatgaggttgcagagttatcaagtggaggagggattagaacccaggtatcttgagcccaagcaatttgaaggtgtttaagctaattcttttgtatgtttttctggctgtttatgtacttttgaagtctttatctttctgtgttaaaatatgtctatcgttattgcattttacagcatcaaaaattaagaatacttacattcttctacaaattgatgcttcaaaatagaaaatttggaatttcagaagctccagtacagtaactaatctgaaattattgatgcattttctttcgtcagggaataactttgaaagattcaaatgatttcaaaatccaactttctaacgtctgggagagaattcctcaaacacatttagcagtcaaaacaattctatagagtataaaagatgaagcatggcacttcgaagtaaaggttacagtttctataaatgagaaaaggccgaatatttgctagcaaaatatttttagcaggaaagaatttactttgggaggtacttaggcatgttatattaatactaatgtacaagttcagcaatttgtaggagtggaaagaattggattaaagtaaaaagttcttaatatctacacattaaaatggagaaaagtctgtgaatgtgaacttaatcaaatcatggtagataaacaattataagaacagaatctttgaatgatttttttttggatttacttactaacattagcagaatctttgtgccttgcaatcctggagagttttgttttaatcagatttgttggctgaggcagtttatgttaaaaaaaaaaaaaaaagtaacttttaacatccagctgcttttctgagaattacccatctatgaaaaaaaatgtagcaccattaacatttatgagaaacagacttaacattatcataaattatacagtaaactctcttggactgggattgaaaggtgtgtgtttgtctttgaagctgatgtattttgacagcacaccaggaggcagctcactctgaataatgggcaagatgagagcctcagaggaaagaaatcactcccttaagtgagcgtaaaccagatagggggtaaatgaacttccccacctggacacattgcaattttagaagcactgatcacacgagaagttagcgctagcagggacctaggagccatttagttatattttttctatttacaaatgtggaatctgaggctcagaaaaaagaaaaaaaaattctctcagcttcttccagtatttcaggggtagagccaggaacagaactcacccagcacccagttcacctctctcagagcctgaggaaagctcgtcaatgttttcagtctttgcttcttcctccgtaaaatgagcatatcatttgagcttcatgccctctccaatttgaaagtgtcacatttcaatggcatttgtaatcatctgggtaagttctttatttcactaccttgttgaatcagtcacctcaaaggaatggccgcttggtccaggaatggggtatccggtgataggtgaatatgttgtgaggtgcttaggggaagaggaaatgtgggggtctttaactgctgttctcttatttgtagggtagcaataggttgtactgtaggccagtggtatacatagccaagccctatactgttttgtctaaaaccctaaaatcctaaaactgggctgacggttgggcagtaggtctgataatttgctcaggagtcatctcttggttgagcctaatttactaatttgcattcctatattcaccgtcttcattccaatgccatctgtaccacacctgaatgattactccattttcatagctagtctccctgctgtcccaattcatcttgcccctcactgctaaaatggttcatcctgcgtcaagaacagtggtgttttttgtttgtttgtttgtttttttaagtgctgaaggatcaacagtgggttcctatgggacacctttacattgcctggtctacagtgtttcactaatggtggatctttgacactgagtcacctatccaattcatcttgtcccctagacacagctcacttttttctgccctacccacgtagctttcctctctgccagtgcgaaacacagctcatgactcacctcctaaaggaagccctctggagctgagcctcctcttgttcattacatcatggcttttgggccctttgggacctccttgtagaataattactggatcatttagttctggtgcccacattgttgatccccgcttggttcagaaaaattgtgatgctgaaatggatccttccttctcagggctttttggagacagcttgagtcccccaaaccatgtggtaccgtaactgaggcattttccttcccagggtacttctccgggaaggcagtcttttggagactggtaccttatgagggaaaatgagcctatttccaatgccatctctctctaataaagagaaacctcacttcactctaatgccacaaaaatgtgctcttggctttccttgagggagtctgttttggaaattccatggtcagaagaagcagggctgtggccggcaggctgtgtggtgcagcatgtccaggatccagtgtcctgtcttcttagtcagccaggctccctttaaagttagtggtttgctgggagacctcatgtgggttttcattttaaatggtgctcttgaatgtggctcctatttacatttttttttttttggaatatccattaccaagccttcatggtgaagcacctcccagtaaaggcagccaaattaaaggatgcgaaagccagctccctggtggactctggagatatgaaagagagcagtgtcttcactggaccagacccaagactctaaacccgtgggtgctggatccctgcagtcctctaggcttcactgggggtagaggaagccacagactcctgccaccaaatagtgcctactgtacacgcaacatgttctgctctatctttcacataaatgtagttgcttctgggatttagaaatattttttaaagcactgctaaataactagtcagcgttttaaatgaataggttaaaagcataactctaatgatgagggagtttacataatattttgatgtcgtaaatggactcttataccgtctgggccaagagccaacatacgaaggccctgggggttgtcctgaccatgtctgtgtgggcaaatatcggttgggtctctaaatcagaaggagtgcacttgcttgggctgattgaaatgacaagaacaaagtatagggataaccatccgtgatgcaaggccaattatataaccaatttcatcagagtgggttagaactcagcatcttgctaagccatttttcaggtttagcattggcctatagcatttttacttaaggaatctctgactccaaatacttgcagaaaagggacagtaagttctttcatgtaacagaggtaaatattaatccctgatttcttgcagtcacagcaacaaacattttagtaaatatggatacagtaaacaaatctgtatgagaaaccaggcctaacaacactgcatttttctgctaaagatcatattaacataggtccccactcccctgtttttcatggaataggggataaattacctggtctttttccccaccaagttttttaaagctaaaacttacctgagcattaaatgagtttggaagtgcctgctagctgaggggtaaagctgaaatttcagccgtttgtcactcactgcagagtttgcttgggtttgggggagagggatgagatgacattggataggcaaagcagtgacatcagtctcctggtgtttaaaaaaaaagtctctccagttccctctgtggtgagccaaattttcagtttcacagttaagtctaaacttaaagctttgttggctgaaataagaactttgcggagtgacatttctgttttcagggcttctgttgagaccatattgctggcgtaggaatttagcttcatgggacaggaaacagttataggctgtagtgagtaatgttcccctatttcagatggaaaaacattgaaaatcatgattttggccctcaaagaacagctattcgtggctgtcatggttaactctgtctctgactttgccttggcaacgaaggtcaatttaccacgataacaaggacgttgattttatggcacttgacatcttaaaaggtgctgaagtgcttcacaaactggtaagcagaccaaaccaaatgtgccttcttctgagcagtaatctcaagaaaaggtgaggatgtatatatccgcatgtgtgcacacgtgcgtgtgtgtgtgcatgtgtgtgtgtagaattttaaaaaaacaggctcaggaacttcctagctagacattttagggccctgtctgcaaaatgtggacttgggaataaccgcaggcactggaggcacctggtttacgaagagctgtatcattccagcctttttgttttcctcaagagaacctgacctagggccacaggagttactttgtcatttcccaccatattgtcctgctgagccaaagaatgttctttgtggaggtaaagaagctcccatatgatttttatgttccctgctgtcctcagaatcaaagttcaggtcctaagcctgggaatcagggcctccatctatgtcttggcccccacctactgttctggtcttacttcctgcatctctggaggcagttagtcctgagttcgaaacatctttacaaatcacttctcacttacttaaaagcaaatgcagcatttctgtactaactagaaagagcagaacacttaccttgtaaggttagattaaggtctgcatttaatgagccagaggcacaaaatcttacctattccagggggcaacccatagcaggagccagatgcagcacagcccagcagagctgtccccagggttgtgaagaaggtctgcagcaaggctgggctgtgctagacctggcaagccaatgctttctgtttacctgcccattcattctcgtccttgggctcacatcaccattccaaaagaacttgcaggacaatattatgcccaccacttaaagaggacattgacaagcctgactcaggcccagtaaggcaacatcctcgtctaggaggagacagacaatagagttggtgcccagctgtccctgaacggcatctgactcccgtctgcctgtgctcttgaagcccattgccccgaggggcactctcacctcctatttaatatccttcgtctgtctgggaacgattttcacaaatcagtgtccctgcaggtagttggaaggaacaaatgagataattcccaccatgttcttagcacagagcctggcttgcggtaagtgttcaataaatgttagctgctattattatcgttattactcacctgctctgtgcttcacagagcgttaaatacgcgtggcaccctgcataaaccctttacttcctggcctcaacctttctctttgcctcaaaacgtcctttctcctgtctttgcctccaaaccgtccccatcctgttaggctttgctcaaatgccactccccctgggggaggcttttcagattgctttccgcttccctttcccaggctggaaacgcgcacactctcctactctccctctttcctggcactgtgctactttcctttcctggagcaaggcttctcagactttctgtggtcaagaactggccccatgccccccagtccatgacggatcaatacttgtataaagtacaatgtaaaagaaaaaggcagttaaaaatgcaagctccattttttattattagagttaacagacacaaaattacacaatcacatatatgggcaaggtttaaaaggcttactctcagtttctgtacttctcttgccccagaccaacaatgaccaatttgaggaccggcagcagttcgtggagcacactttgaatagtgtggagtttacgttattcccatctgcactggcacagttactcaggtactgtctaattcagtgaacccaacctcccacacctggcaggaggcttatacacagggttgctcgataaattagttgaattgaatgaatgagtgaataaatgaaagcacaataaatattgaatgaatgaatagatgattgacttgctgagcatatttaaaactcatagtccttaggaagaattttcttaatgaatagcatgccaaagggattataatttttttatctttgccttttataaaattcactcatttgcattgcatattaagaccaattctttttccttagtttttaaaacatttttattttccgtctgtgatagctaaatggagataaggtttatactttcacaaaaataagggcatacttggtaatatcttcagaaataagataggtgagaatcttaagagaacccataccttatgctttagtaagaatcaggatttctgaattgaataattgcaaattagagagcagaagaaagatattatatacttatatgtatataaacttgaacagttaccactcaagagccgtattgaattaacaaaagtaaaagtttattttgtagtgttgccatcagtcaccaaatcaatgttatttgaaaagaaaatctccctacccaggttttcttcctccttggggaatacagtggtaattcccagacttgtggtaaaggaaccagtgcaccagtaagcatgccttccaataatcactgcatctgtctcaacagaagacaaaacccagccctacctcctctagaactacttaacggaggttttgagatttgagggtaagctatacacattcttctctggaaatcacatactgctattgttccttcaccttaaaaagagaaaataaaatcaaatcgagacctgcaaaccattcagcctccttcattttattgtctcactatctctggtctcacttttctgcagactttcaaactcacaacaatctctccttttttgggggaggtctacactgcacagtcattcaggccaggaacatttgtggaagtctcctatgtgtggagcaggaatacagaaggaaacaagacacaaggaaacaaacaactccacacatgtagctgacagttattgcacaagtccaggagcgccatatccatggggagagaagtgcagggcgtgcggtgtatgaggattgcgttgtgaatactgatccagttggacgacaaggagctcagggaaggttagtgcagggaagtgacatttaaggtccaacaagaaggatgagtagaaatttaccagaggaagtagtggaagagagttctagggcttatggatgactctatgaccatcaggatcatcagtatcactctcttccacacccacatcttgtccccctggcaggtcttcaagggcaataacaggcattgagctgtcctcgcctataacagcaatgcctccttctggaatatctctggaaggacctgcctgaggctgttttatagttatcatttaaaaaaaataagagtacactctaaaatgacaatatgaagcatattataataaatacacaaaccagtaacatggtcatttattatcattaccatgtattatatgctgtacataattctgtgtgtacttttttttttttttgagactgagtctcgctctgttgccaggctggagtatagaggtgtgatctcagctcactgcaacctctgtctcctgggttcaagtgattctccacctcagcctccctagtatctgggactacaggtgtgcaccaccatgccccgctaatttttgtatttttagtagaggtgggtttcaccatgttggccaggatggtcatgatctcttgacctcgtgatccgcccaccttggcctcccaaagtggtgggattacaggcgtgagccaccatgcctggccagtctgtgtgtactcttatacaactggcagtgcagtaggtttgtttacaccagcatcaccacaaatgtgtgattaactcattgccataagacattttgatggctacatcactaggcaataggaatttgttagtttcattataatcctgtgggaccgctgtcatatttggtcccttattgaccaaaatgtctttatgggacacatgactgtaataacaaatcactcacaggtacatattagtacttagaatgccataggcactgttattgtggatcaagctctcagatactataatcacacccatttacagatggggaaactgaggcactgggaaggtaaataacttgccaaggtaacatagcaaggaaataatggagttaggatgtgaacattaggcagtgtttcagagcgcatgcttttaacaagcgtactattctgcatgtgccacaggcaaaagcatcttagatttctttttaggtttgtagtttctaatacagtgctaagtaaatcaactcccaataaatgcttactatttaatcaggttagatttagttattccattgccaaagggtgtttatttaattgaaaacaagatgggctggatgagggtgtgctggctgaaccatgtgataacagaggcagtgaggtgttgactgaaaccacctggtttcaaatctctgcgtgtcactttgccagtaccaggataaatcccgtggcctttatgggagaactttcattcatttatcaaatttttgttgagtggctacaatgtgctagccactgttctaagttccaaggactcaatagtaaaccaaacagacaaaaccctacccttgtgtatcttacatcttgctcacatgacaatacacgtaacatgcttagcacagtgcttatggtactggttaatattatttatttttttgagaggaagtcttgctctgtcaccaggctggagtgtagtggcgcgatctaggctcactgcaacctctgcctcctgggttcaagctattctcgtgcctcagcctcccaagtagatgggattacaggcgtgcaccaccacacccagttaatttttgcacttttagtagagacagagttttaccatgttggccaggaagtctcagtctcctgacctcatgatctgcctgccttggcctcccaaagcgctgggattacaggtgtgagccacggtgcctgacctgttatcatcatatggtgctgctggttagtgctttttacagacagtattggcacattcctaattttttggtagggtgtgtcaaatgagatagcaaaacagggtttgtagatggtgatggcaaattagatcataaaaggtgattatcgttctttgaaggtctccagaatgaccactgttgaattaatcatacaataaaaattggctttaggttttaagatagccagcatgttttcctcaaaccttagagtagtaattttgatactgtgcattttagtggtaatggtttagtagtagcaaaggtctacagacgtttccgtaaatggccatacagtaaatgttttaggatttgcaggcaatgtggtctttcttacaactactcaactctgcctgctgctgtaagaagaaagcagccatagataatatgtcaacaaatcggtatagctgtgtttccaataaagttttatttatataaacaggcattcagcccacaggtcagtttgccaacctctgttccggaagaaagtaaaaattctgttagcagtaacattgtgcaggggatcagctttttaaaagaaaacatgaactaatattaaaaaaaatcattggctcactgcaaagtcacaagactccttagacacttaagaatctgaatttgacttctgatggtttaagtttactattttgcatgaccttattttctgactggttcaagatcaggatcggtactagggatcacttaaggaagaaatttcaagaacctggaagggacatcttctctggaatagaaccagaggagataaactatcccatggacatttgtattgggccctgaaggaattttcagcagtgagggctttgcagaattgaaatagaagggttatcgctgaacaggattttctttctctagacattttaaaatccggagaagtcctactctggcaactggtcaatacagagttattaattactcactgattaaaattttctactttttctgtatcttgtccaatatggcttgtttttgatctggtcagaaggttactggtggatggagtgaatggatagtgtattctctctgggattcggtgtccaggtttaagccagagtgaagtcttgttaaattgcaataagggagaggaaaccatctgaaagagagaaaaagaagcattttctaatgtctttcaagaaatgaaattttattcaagggccaaaagagccacagggtaatgagaccatgaccagcaaacacctatactagataaaagtaaattttaattaacatatcaatagtttgtagatcttaggtgcttccagagtgcttgaggttgtttgacaactttttcttcccttaagctcttttgctttctctttgaagatctattttaaacaaagagaacccctgttccaatctattttgatctcaaggatgtctgatttaatgtaattttctcacgttcctaccaacttgcccaaggtgaggaataatttactttgttagagcaaaagaacaaagaactttttgggaaatggagaatagtggacttcctttaaaaataaaaaaagtactgcagtttcgtacatcctggcaaaactgccacctatcatttttaaacttttgcattcttagatggtcttacttggatttaagacctttgtgagtttgttcaaataggcagtcatgcaaaaagagcctgcgttttctaatggtggtctcctgtgtgtttagctttggttgatgggcgtattagaaacaagcagagcacgggtgattccagctcattggatacagcaagtaattacctccctgcttttggaaacagttaaatatactcccactccagcaatgaatgtagccagggccaaggtgggcagatgctggctgctcagtgaccatgttcaggatgatgtgtgtaggaggagaggaaggattccaagaagactcagtaccttcttctaggattataaggatttaaataggcctgagggaaggacccagcacatagcacgtgttccataaagggcactttccatccttatcccctctttctactttgaactgctcgtaggaagacctactttaattcaaataaaaatgcatttgtgttaaacctgcggcagaagattcaagggcccttggcctcccagggtttataaatagatggaaagatgtatatactgagaaaaaaagtgaaatgagagttatgcaagtagagatgactgtatttgacagcacaggccatgcaaatgtgaggtgagtggtaaaatcagtgtgaaaaatagacaatgtttgagaagtatagatgggaggagggggagctggtccagaatggttaaggaaggcttcatgggggttgtgtgatttgaccaaggccttcatgggtgagtaggatttggatggatggaacaaaggggatcacaggtggagagagttacaagctcctaaaaagctggttgtgttttagttttttagttcattgtcctgtgtttggtaaatacttaacggatggttattaaatgaatgagtaattattttgattgctttttctcctctgaacttagtctatagcacacaattaaaactcaattctgtatggtctcacctcatcaaggcaattctttcctgtctggctatactattaataccttgtgggaaaggcccatgtgtaatatttttcatcctctctagtaataactagaatgttgaacatgtagcagatgctgcctaaactctttctcattgaacaagatggtcaaagacacaggatgctaaactttgatgagaactagtgtttctttagggccctttaagaaacaaatcattgtgaccatagattgctttgctaccaggaagagcagacctacctccagggtctgcctgacaccagtgggaatgaacccatataccacttttgagaatctccttgccagcttatgaagataaacctgtgttttcctggcaactaattttgtagatgaacttggtccatgctgcttctccattatgtcaacttttcaccatataggtttttgatggtctcacctgaagaatggaagtggagctaataattacctagtatctaccatgtgctttaacttccgcagtagccttgtagatatcacttttgttcttttaaaagagagaagctcagagcatgtaagtggcttggtcaaggtcacataatatgtcatgatagatgaatttgaacctaggactctgagctagagctgcattccttacattgtgttatggtgtccacatgcccctgcattttcatgcattactagatttgaataatcagaggggagataaaagaagctattttagatgaggggcaatcgttgaggcacagtcaaccaatgaccttggcagaagaggagagtacctttgaggggattaataataaataatcttgaattcctatgattgggtgagattccattacagatggttttggaagacttcagactttatgaaatatcatgggaaccactggaaaatgtttaactagaggtatgacatgataaaattattaattaatctaataattaaacacacttagtgagtatatatcatgttccgtgttggaacaaatcacacattcttcctgctctcatgaaacttttattctagtgggcaaacagaccttagataaataatttcataaatactatatataatacccaagtatggaacatgcttcattataaatgtaaaaggtctgtgagagtataaattttagaccatccctctcctgagaaagttacttttgagttgagatcccaagagatgagtaagggttaactagctgtattagtccactttcatgctgctgacaaagacatacccaagactgggtaatttataaagaaaaagaggtttaatggactcagagttccacgtggctgggcggtggggggggcgcctcatgatcatggcagaaaacgaaaggcacatcttacatggcagcagacaagagagagtgaggaccaagtgaaagggatttccccttataaaaccatcagatggttcagtatgggggaaactgcctccatgattcaattacctcccaatgggtccctcccacagtatgtgggaattatgggagctataattcaagatgagatttgggtgggacacagccaaaccatatcactaggtaagaagagggctccatgctaaggaacaggatatgcaaagaccctgtggcaggaggaactctacctgcttttttgaagaattccataaggtagccttcagtggagctgagtagagagtgggggagagtgggctaaaacatgaggggagaagtaggcaaaagctaaatctcatcaggaccttatagacaattgacagatgtttgtctttatccagtaaggtgtttgtatgctccttaagtggcagcggggagtgagcagagcagtgaagataaacatgaaagctggtggtaacaaattctgatacctcctctattccaaaaggaaaggcagaactcagaggcaccatcctcctgttgtgtttgcaagctgttgacacaacctggaaaggttaaaagttttcaacagacttgtcagagtttgtgttcaatggaaactgacagagcctaccggctgaggggctaattttaatagaaataacctaggtgcgtttgttaattttctccgttccctcaatgacctgtctgcatagcgtgaaggtgctttgatgtgaccaggagaacagaaggatattttgtgcatagctgaccgtgagaggaatgctggttttgcaatgaggaagcacaggaagatgacagaacaatgagcataagacatgctgggtgcattttttggaccttaccacatcttgtttgagagaagtgggaccaatgctgatgaaactctttcccatggtgtgttctatattcattggatgggcatcgcctacggctggagcagggctgagctctgtactggtgtctcttaaaacacaccagacagcaacagctgagatacctactacctggatctgcttgattagatcatacggtcatatttgattacttagaatgggtaaggaaaaataccattccaaggtcaatttaatggcctagatcttccttcctaaaactggaaggtgaatctctgcctcttaaatctataggtctttctgggggcaagacttctgactattctgatatctccttggaatctatggaaatctcattatttttgttcactcacataaaggagtagttaccccaggaatggatacctcctgatgctctatgcttaggagaaaaggctaagtctttctaatgaatatcaacatcttgacctgccaggttcaccagcatgaggctctctcctgtgcctaagtcctacaactgagacaaagccctaggccatgttgaaccttggaaaatatctctggccatcacgtgccttgaaggacttggcgacggaagcagagaagtttgtaatcctcacctgaggtcatctctgtcttctttaggtcattgacatggcagacattgtttccttttcgttcagtatgtgcctgcccaaaccccgtttcatggagttctggaaactctgtcagtgggtaacaactacttgtagaccttgtggaacaagagaaaatgtgcctgctcctttttcaccttctcagttgattagcttcagaggtggccatcgagttatgggtcatgagaacagctttgccacaccaccacttccaaagggttgatgtgaaaggtgctttcctcaagcaaagagcaattctatagaagtccagatgagcatgcttacttattgttgacccatcatctttagttactaccatatcggggtatagattactctcctgcatggttttctgcatgtcccctgtgaccgaagtaacttctgagtacagggatgagaaagtcaccagctctgtagccgcagcattgttggtctgtatctccaggcataggatctgggataatgcccagatagtccaccatgtggcctcatgcctatatcatttgtttggctggtgcccttggcagacccacacctgacacctgcttagtgcaagcccttgagctctgtcttagggaaactttgggtctagcatggtctcttgtggcacctaatgcgttcatattggtaggaacacagtaataggaaaggaagtttatctttctagttgggatttaagaaaactcttaaagatggaagaatattacctttttttgtttccttatctctttgtggaataaatgagtaaatactgtgactgcagtcacatgagataggtattagccatcagtctaactagaggatctaaggaaacacttcagaagtccaggagaacgaggcagcagtattgacagcagatagaggaagaagcagcagagtagatctggaagtggggagtgtttaaacaagagggctgggaggtgcaatgtcatactttatttatacctacttcagcattcacctactctgtcaccctggaatcccctggagtttatctggagagaggcactgtggagagcccctaaatctccagcttgaattcccttagcacttgcttcaaagcctcagatgatatctgttgactggaggggaacaaggttttgactgtggttaggactcaccattctgtgtataatgccaacaccacccagggcagttcataacattttaatttcctcataaaatgtgcttttatttcattttgcaatatgtaagcccatcagattgtagagatgtaagtaaatggggaatgttgtttaaatggaatctcatggaaggcacacccagcaatcattttcattcatatttttacatttcttttggcagcaagaatgcagtgtttctccttttcattttcatgtagtgttatggggcatattctttgtgggtttagattccagagtagcatatctgatttatacttgataaagtggtgtttgccaagtaattttgctgaaaagcagccacttaggcagaaagggaagaacctactataaaaagaacagagcagattatggagctgcaatgtcgttcattgggaccaagaaatgttggttaccgagagacctaaaaactagaagtttccttgattagacttagtttcagttttatttcacatttttttgaacatactgccagcctttaagtgagtttcatatttgcttatcaccagcacccttcgttatttcttccctgtaagaatggttataaaactaaacaatataggtgactatacattttattgtaaccatggaaactattgttgatgatttattaagcatcctttctcctgatcccaaacaatacattgtgttggcccaagttccctagaggactggcttttccattattgcatagaccaactttagctttatttatatcttggtttgttcaattgtttgactacggtgttggcttctggaaacataaaagctagtcttgggggccaccatcaagtgtttcaaagtgtttaaagaccatttttaacatatgccattgtagaaacaagtttaaaagaccactttaacatatacccttgtaggaacaaatcaggaaaaaatgaaccttactttatcttttcccttgcctatgaatacacacaagcagtacttacatttctaataatggatgggtataaaatacttagcagcccaacgcactactaggcactcagcaaaggtatgtcgagtctacctttcctgaattaattcttgttatgtgaagttgcttgtggataaataaagagcatcatgcgaatgcttcctgtagtcaatctattaaggctggctgactgaggaagtcgggtggaataatttatctagtcccaggaccttcatcccagaggtttcatggcatcttctgccggagccccacagctgaggattgcccctgggaagtgggagtgtgtgtgccaagccctggggtgcactgggcttccttcgttacacaagtgcttccatcaggcccaggcagtggcggagggagtacagcagcgcttacggacgcccattttgatggcaatttggcagggagtcaaactttggccctaaagcagaggtggtgcaattagacagctgagatgcattctctaaacacacacttttaattgatttcagcttgttcagttcacaaagatagagctctgacacatagcagccttcttagaggggcttatttttacttttcctttattcagcagcgtaattcaacggcaacagaagcaacaataatgcagagctctaaagagtgcgtatttggcatggctcggatacaaaaagtattattaagaactaatgagtgagatagttagatgttaaccggaaaagcattaatgagcagaagagaattctggcataaacatctgtttccgaagcagatgttaccttgtaaatctgctgaagaaaagcctgtgtaaatggaacagtggactgttttaggtattagcagggacagagtgagatcatgaggttttcagacactgttttcagctcttctgagactcataaatgactgcgtgtgtcgaggtggtgaattttggggggcgttttgggggtgacaaaagctatcaggcaggggtgaataacagtggcagatcacaatgagtgtggctgtgtgacatggtagctggagaccactgattcctgtttcaccgggagagatttgggattctcattaactaaacagcttgtctcttgtctcatcttgtctagagctccataatcatttcagtatagatggattttggctgctgtcatctccctgggctagagatttaagacctgttctgcctcaacaaaaattacataacctttggctgactttattgtatagctttctttacatgggtgactaaatggccgataatgagttaatgggcaagcattcccaaattacacaatgagtacattttagcagccttaatgcttgatccaagaatcactaggtggcaagattctcagggatctccaatagaggctggggtatttctttttttagagcccccaaatgacagtgtgttggcaactgcctcattcatattcacagaggggcaccttgatttgggttattttcacttagaatcataaaactgagaactggaaggtagctttgggatcatctagttgattcagatctcttagtaaacagaataaaaaatacaaggtcttgaaagtgattcatgcagcctgacccaggaattggtgaaatggttgatcctcagaacccagaccagggttcctagacaggcactatcctcactttaccccactctagagaaaaactcttgcatccttctctgcttactgaatattacgaatggagaaatgtctctgaaggaaaagtcttctgggcaaaaaccctgggcttgccccatttggtgctttgaaagttgaagtgggggctagagatagagtgaattccagcccccaggtcttatagttaaaggttgcccttggatgattcatttgcttagttttatctaccctcagaatggtcattggcctggtaattgggaatgttctaccctccatctttggaaagctgtatttgccaacagcttgatgaggtcagggcatccttggagcctgctgcttgtcactgctcggtgggctacagaggaactcaggaaaccaatcccaggacttcagagcctacggtgatggtttttgctgcagctggataggtctgttctccaccacgcacacaaaaatgtggctctgaaacctttaaaggagaatttcttgatcaaggtgatctttttcatttggggctacaccaggactgcctttctgggttcaggatcttctgtctagagaccttttagaagtgatctccaaggatggcctgtgtattcaagcaagtgaaaggcatccttttcaccttgcaccaagttcctgaaagatgcaggtctcagccatgcaggtctcagccattttctgtgtatatatatgcatgtttgtgtgcatgtatgtgcacatgtgtatatgtgtattgttcatgcaagaaaaagcaatgaacaaagctacatctgtgagaaacaggatgttttcccaagttagcaaggtctctgttcttctgtggaattccctctcacataaaactaaggcaggctttgaggaagggtggccacttatcttggacttttttctacagtagggggatttactcatattcactgggagctttttattatctctaagagaaactggaaaagcccagttaacagaaaattcattccttttgttatgcttgaggtgctgattcatttatcttgaaagaaactttgcatgtgttgtatggctcctggtatgtcagaagtgggttttgtgttacttcagggggtctgttttacactcccaatggttctgggggcacatgtagcaaacagagctggtgttgggtgtagacactggggcagatgtttaggaggctaccgttttgaacagtgtcaatcgtatttgtgattcacagtctccctagcagtgtttctcacctgcatggtgatgacatgggtgattgggagattttagaggtttggctgtgcttttcagttcctcttttaaatggcttcttccatcattattcagtgatgatggaggagactttagatagaattttttaaagaaaatggaagaccttttcttgctgtacagaatgagtgtttttcttccctggtggcttcgttgttagtttactagtttactagcccattttgctctcagacccagccatgcctcccttcaccttcgtattaatcctctgaggttctgtttactgatgaggacatgaggtttatgggatttggcaagttacttgaggttacactacctgtaggtgatagagccagaatttgaatcaagatctgcctacctctctgctaagcccacagtctttccagtctctacagctgtatgtctcctgtcgccccatcccccaccgctttttgcttctttagtaccaaactacatgtgcattctggaacaaatcatcccgtttcttgcagctgtggctttgtgcagtttttcttgcatgaacaacacatgcacacacacttagaggcaaacacaaacacagagacacacacatgcacacacttttctttgcttacatatcttgcactggcccttcaagactttgtacaggcatatggcctctcctgcgagcagacttccacaggttgtcatttcgccctctctgatgggtctgttctcgagctctgttttgacactaaccatgtcatatttcatagatgacctgtcactctggccaacatgtgagtgccttgaggtcaagggccttgtctcagagcctagcccagcacctggcacattcaggccttgataaccctctgtagatccgaattgaaccaagtcaagagtggggtttcaaactgtgtagcattgataacacagatgactggaactttaggagctggcgtaggccgtatccctgagcacatcgagaaatgacttgctaacagaagacatctgtgtctctctacttttcaagcactgtgacaatctccaaaagcaaaaggtttaaagaactataacatttatggctccctggccataaattcactgcagaacacataaaaaatgccattcccacagggttatggcagagattcagtattgcaaacatctgcacatgggcagtaaagctaacctctggtgtgcaagctcgactgttagcaacatatattaacattagtgacaattgaatgtgattatctgagatggcattttatctgccaactgcagacttatggcttctcaagacctcatttgtccccttcctcatatgttgtttttatatgactgaaatcacatgcagaaattcgtgattagtatggctctgcttttagtttttggtggatatgggtatgtataaattttcagtacttaaattgattttagcactttgaatagaataggctctcaaaagtttgttaaaacagctgagtgaatttcaaagcattatgactttgcatttgaagacactgctgagagccaggaaaaaggagtgggttctgacattggcttgacaggattgatccaacaggtttgtaattaatttatctggtaattggttggagtatacatgttatacatcacatctttaagtgtaagtgttgtcattatttcctttctgttatttaaaccagtattttttctgtgtagggctagatagtaaatattttaagcaagtcatatgctcactttttgttttgttttgtttttgttttggagacagggtcttattctgtcacccaggtgcaatcatagctcactgtgacctcaaaatcctgggctcaagcaagcctcccacctcagcctcttgagtagctaggactacaggccacactgccatggctggccaatttttaaattttttgtagagatgggacttgctgtgttgcccaagctggtctcaaactcctggactcaagccatccttccgccttggcctacaaaagcattgagattccaggcgtgaaccaccgcaccctgcccatatgctttttgtaggaactcctcagctctgctgttgtacaatagaagtgccatagataatacgtaaacaaatgagtttggctgttttccaataaaactttatttaaaaaaaataggcagtgggccatagtttgctagcccccaattcaaagaaatacagattttttaaaagctattgggaaatttagagaaaaaaaaaaaacttttttagaacttttgggaaaggaccccttatctggctcccattccatttggcaatctctaaagcggccaaatcaaattttaagttaaagagtaaaattttgactcaaaattttatttgtccctgtgcagtggttcttaatatttatttgattttagttcctctgatgcatataatattcttagtagcagtgactcaatatagcaaagattttcaaacaggtagaggggctgagaactctggcctagtgacattactctgagttcattaagttctcatttacaactatgccttagcataaactatcgcagttaaataattagaatttcagatcggtcaaaatactttggcatctgaaagcaggagcttagaaccagaattccttctcagacataatcccagcatccccagcccagtgcttttgctctttcgcaccaggccagataactctgtgatcatggacgtatgcaggaatttgtaaatatttgatggatgatagtcagattgccaaatggcagaaaggtttctggttttgcagtttgaaaaggattatagagcggggaacaaggtaaatatctgaaggtctgcatgatagtacttcttttcctattgctttggagttattttttatacctctttacacaatgtgtgagactaccaaatttacattgcactgttccaggtgacttgtgcagttgacaaactatgacccagcatagcaacctaggcaagaggagcctatataattcattcttattcctattttgctatttcaacttgtttctgttttataactgcaagtggcctcccaggggtagcaactgttggcaacttaaagttaagccagtagttctcctcactccatatctatgctgcttgtctttgcatataagtgagtggatgctgggggcatggaaaaacaaaactatttaagtgtgggagaggcctgtgacttttgtagtcctttggggaatttttcacatgaccagggccaaatagttctgactgctcttgtgccatcctgggaatagagcagtgggatgtaaggagtgaaaggggccatggatcagtggttctcaaagtgtggtcctcagacctgcagcatcagcatcaccagggagcatgttagaaatgcagatcctcaggccctggccccaacctactgaattaaaaccttttcaggcgggcccacgagtctgttataacaaggtcttcggatgatgactgtgcatagtgaaatgtgagaagtaccgcttgattcatcatccagccagatctgtccagcccatttttgtgattgtggaaattgagggcaagagtgggcaggtcactttcccaccatgaaacagctagctcagggtaggtgctggccttctgattcccagtccagacctctgctagtcacagtgcccagccaggtatgctgtggggatgtcagtggcctcagaaagagtgacgacttgggactgatgtccccacatgctggggtcacaggacaaaggaaagggtttgtgactttgagctctcttcttaccctgggcaacctctctctctgtttaaaagcctggtgaccctgctgtgaacttcctcttttaaatgaacagctccctagagcatccttggctgagcttagcaacaaggggggagggagtgaggaggggtgggaggaaaatgggctcccccgttatcatgtcagtgcaatcactgggaattatggttgaggattaagagtcacttggggataattcagccaggctggagagggaaacacacacaaatacacacacactcacaacataaacagattgctaaagctcatggcagaaaacaaacagcataggaaagaaaaaaaaaaaaaaaaaggatgggtagaactgaaagggcctgaattttgaataggtggtataggttccagaatgatctgtttcctaaacacttttggtgaagttgtatacacagtgactagagcggagcagctgcttccccggttctgtgcattgctctgtttcagaactcatagcatccctctcctccaggcatctgttactgagaacacttgaagattctgccaagagaactcaaactggcaatagaatagttgaaatttaggaaatgagacagagacatacatagagatattccttcgcttctaagaagatatagcaagtcccacaggaaagtgttaactatttcctatatttaggtacctctgaaaaaggtcaaataaattatccatctcttgtaattatctttgggcttaaacaaaagacctcagaaagtcagtggtttgcttttcctagagagggtatgcaatttgctctatcttttttgacttagaatctgtacagttgctacctaggtttttattttcctgacatggtgggtgaatgtccaggcagatggacttctcatcaagcatggttaatgggatctagaagaatcttgtgctttcccaaagaaccaaacagatgagagcactctcaaacagagagaggaaatgatttgttcaccatctctgagaggcttgacagaaaattcgagttaggggagtggcatcgatagcccctcttggagccagtctgaggtgagagagctcccttcaatattcttatgtctctcacttcacgttacctgtaagggaataatctccatggtaggaagtcccttaccaacctcttacccagctaactcttgggccttaaatgttggttcaaccctaaaggggtggagacagagctttctgcgcatgagtggctcagggtttgtttgtgctttcttcatattattctgaagccaaccagaaaggactccttttttcccctccttttatgttctccctctgttttcctcatgcttttagacttgataaacaagagaagcctacgtattccatcttctgtttgttttgcttgaagaggctgactctatttgattttttctgggaagagcaattttccgtaagggagaaggtgcttggagaagtgggtggaagtgtgagctgagggggcttttttttccctttcctaattttcccctttagtgcctgagaactacagaatcctttccagatgaacaaacacagcaacagatgtggagtcggcaacagtgtattctggggttatttgggtctgtttaaattgggcttttcctgcaccagaggattttgtgaaatatgttaggcttctgaacatggagagatttcagcctcagattcagagggactaaggaattaattaccccattccaaaaagtccataggtatagatggctttgtatgaaggaactgctacctcttggcccagatcatctaaaggaatgggtctcctcttttctctgatccctaccggaactaggcgttttgtaatcttaatcttgcactttggattctgcctggaattttaataacatggtcactattagtgaagccagtgtgacccatttggatgctttcaggctgggagagggaagccgtgtcagcctcgggacaacggaacatcagtcctgcttgcctactgtggaggcacaagagaaagaatcctgcagtgaacagtcaggcgcagcccttgtcctccaggcacagctttcacaacaattccacacctttttgagagggacgcttttgtggtctcagatgtgggcttcatgtggaaaggcgaaaaggaaggttttgtttagcatagagcactgaaggaggagtcaggagcccttccatcccagcctggttctattttttagtatgtcatcttggggaattcatccagcctctccttctttagaagctttctaagcttctactgaggacaacactctccaattctttctcagtattaaacagatcaaatcaattattcgtattttatctcttctcttagaatcctagaatgtcctagagaaaagaaatctaaagaaataaccaatttaattataaacatgatttagcatctaaaaaaacatgttgatataactctttctgtgaaagagcaaccccattggcctttctccttcagtcccaatgaagaactgcagccatctttcggtgttcatggggattgcttcgactgcctgtccacacatactcaagtgatgaagttggtgctgcagaacccacgtttacaaaatgtcactcctctgtaggggcaggttttgcatcctgcaaatactgtattattgtgtatgtggtttttttgtttgtttgtttgagatggagttttgctcttgtcacccaggctagagtgcaatggtgtgatctcagctcactgcaatctccaactcccaggttcaagcaattctcctgcctcagcctcctgagtcactgggattacatgtgcccaccaccatgcccagctaatttttgtattgttagtagagacggggcttcaccatgttggccaggctgatctccaactcctgacctcaggtgattcgcccgccgcggcctcccagagtgctgggattacaggtgtgagccactgcgcccggccaaataccgtatttttgatctgcgtttggttgactgccgtgtgtaagtggacctcggcagtcaaacctatgtcatttaaggggcaactgtagaaagacctgtcactactaagaagtacagcactttacaaaattatttttacatatgattgtcacagtaaacctgtgaggtgactgtgtagtatccccatgttttggaaatgattagtaagtagtaaagccgaaaccctaaatatgggctgtttcccagctttctagaattctagttattattatttcccagggctaatttttactaattaatggttgtaaatcctagttattcgaataatcaactaggtgtctagcacttgctgtataggttccacttagctttctttctttcttttttttttttttttgagacagagtcttgctctgttgcctaggctggagtgcggtggcgtgatctcggctcactgcaagctctgcctcccaggttcacgccatccttctgcctcactctccccagtagctgggactacaggcgcccgccaccacacccggctaatttttttgaatttttagtagagatggggtttcaccatgttagccaggatggtctcgatctcctgaccccgtgatccacccacgtcggcctcccaaagtgctgggattacaggtgtgagccaccatgcctggccccacttagttttctttgaaaagcataaagatagtagagaaaaggaataatatacacggggaaataagaccagtgtatattcaaagatctgcaaatatgtatattttttggtcccaagcttgtaaacaatttaaaaaatgactcactttcctgcctttttataagctgtatctagttcatttccctcttccaaatataaatccctaaaggttaagagtactcttatttttaaggcaataaggaacagacaaagttagccttttcaggtattttcatgtagtcagagaagctctctccaagggagggaggataaaatggcccagtgccctcaggcctttagaaaacatctcatggggataaatgctttgattcccagcggtgcaggaggtaacagatgtgaggctctccatggcgcttaccagaaatatgtatgtactgtggggcagaacgaggtactttgaagattggagaattcgtcggccctgtgacttcactttattgctttcttcctgtgcaaaatgtctctggacccagagggagaggcaccggccagacagtgagtcaaatgacaagttgacaaaatggttgtaattctagaagctgcaatcccatccttgtctctttatgtaggggtgaggatgaagccaaaatctgaaacagctcccaggagagcaagaagatactgttactaatgattgggccgacctgaattctttcctcgtttatttatgccagtcgttggtataaacatctgaactgcatccacattcacacccatatctagcaacaatgatcttattaagaaagagccagctaagccatgtaacgtactctatacccactgtgtgcaggacgagcagctgacgtcatggtagaaaggcctcaaagtgacactgcagccattcctccttcttatctggagatttaatgataccaggcacaagatggggcagcagaatttgatgccgcatttgagccatgccctttttattaaggccagatctatgcaggtttggaaatggtatctatttgcattcatccattcgccttctaaacaaatgattattgaacacctgctactgtccattattgtaccaggagctggggacatagtgctgacacatggtcctgccctctagtttctcactctggcagggggtataggcaagaaaataggaactctcaaaggcgagtgacaggtgcaaagatatgggtaagcttaggtgcttttgtgatcaggtgggaatttcaggacgaaaagggaatggaggtttagattagactaaaggatgaataaaggttaaccaggtgaaatttgcatggggtttggaggtagggaagtggggagttggcaaccaaggaaaagagcgcgaagccctgaataaataagagagggaagctctgaataactcaacagcttcctgagctacctgagaagcagctcccatgaaccagctctcttctgttcaactgtgtgctaggtccttgattcccataatccttactgtgtgctgggcacatgctggcctctttatatacaggatttgctacttcttcccatcctattatgagtattatgatctccattacaaagacagaaactgagcccttaagagcttaagtaacttgctcatggtcgcacaggaaataaagccacaaaaccaggtttcaaaccaggtctaattcaaaacacgagctcttcaccaccaccacccaagagtgcccaggcgagcaaatgtaaagctcgtgtaaaactccctagccagctcattgtggataagggcaagggttattctgctgggtatccagtgcctcagagcagagcacattataccttctcagtaaatatttgctaactgatgctctatctctgtcctttttttccatccctatcacaagagtttagaaaaaaattcaacaatgccaatggagttatgcattttttacctaattcctctgaaactgagtaggtaaatcagtaggagatgaactagtcgacgtagctactattaagagacccttgaaatccttgcacgatacttggtgatgggagtgggactgtgactggttaagagtgagagagcatatcatgccatcaggggaataaagtcaggcttatgtcatggagaaagctttataaactcaatgaatagtatagtactgtgtctacgatctggcaatgaaataagtgatttaaatctccttaattgatctattaatagtatcactgttatacatttccattttttaaatagtaagtaccttttatatgagaatttgaaggcactgtctaaatgaattggtggcatcatttctgatgctcacaaagataagatatgcaagaggatggtcttgtaatagtcgtagattagagctagtacttttttttttcttttgggaaattaggaggaggatggtaataagtctgtaattggttagtaagggagttttgggcacgtgaagctaagaaggcagagtgggaggcatgtggacttagtcatttaatcacttgtacctaccacttgtggaaaggtaggtaagttattcattcatatggactctgggttttcttatttcttaaatgaggattaaagagtggaccttgtagagctgttataaagtttagaaatagtatattagaacaatcagatcattgtccaatatgtggcagacatttaagcccctgattccatgagataggtaggcaggtaggtaggtaggtgggtgggtgggtggatggatagatagatagatagatagccataccctccttcaaattgtccctgtgtaggctgtgccctggttgtggtacagtttctggccattaatagagtataagagcttttacaccaaagtcagagaaatgtggattcaaagcatgactttaccactgttactatgacttttgcaatctccttatcctctctgagcattggttttcctctctgtgaaaggatcataatagtatctgcctagaatagttactgttggtactgaatggcagaacctgtttaaagcctttagtttgggccaggtgcagtagctcatgcctgtaatcccaacactttgggaggccaaggcaagcggatcacttgaggtcagaagttcgagaccagcctggccaacatggtgaaaccccatttctactaaaactacacacacacacacacacacacacacacacacacacacacacagagccaggtgtggtggcacgtgcctgtaatctcagctactcaggaagctgaggcaggagaatcacttgaacctgagaggcagaggttgcagtgaaccgagattgcaccactgcactgcagcctggggagagcgagactccgtcttaaaataaaaattgtttttaatttaaaaataaagcctttagtgtggacttggcacatagtaagtattaatagatgttaattactaccagctacttttttcttattatccagtggttacttcactaagaagtaggtatcaggctttttccagtacaagagtgcttgctctcttcaccgaggtttgttttgcaagcaaggttacagttcagtgtcattgaggatgtaacatagccactatgcggagaacagaagacaaaagtggtgggccttcaccctactctctgctggtacagaagaagtagaatattcaggcaagagggcaggcctgcatgtgagggtacagaaatggaagcgctacctttgtaaggtagttgaaaaaacatctaagggaagaagagatgcttctggatggagtgagatgggagacttataaagaattatgggcattagtttttattttagggacctaacagcacagagaaataaaaaggcacatttttcaaaaggaggctttccttggaaagcctgcatctttcttaggtaaacatggagagaagtgtttacaaacagcttgtagttggcagtaggcttctcagttgcaggcatctgttttctgttccctgtagccagtgccacctagacagagggtcatggctttggatggaagggcagtatgggcaaaacagtttctgcctttcacgttcataaccctatctaggtacccatagtcgagaatgaaggaaacgcttcaagtttctgaagatgtaatcatttatctggacgtgtctttcaaggtaaatggcaaatgactgaatccacaattcttcagttcccctaaacatgtcttcttcattaggagcctgaatccggtagggcacccgtaatgtgctgtccttctaaaatcatttgtttgttctctctccttatctttctcccctcactaccctttccttgcccccaccacaccccctgtattaatatattcccccttgatcacacctggtatcatctacgattaaatattactttaacagctgacaatatctcaagccgtgctttaaggaggtatcattctacttaacagcgtcctgtgcctgctgatcccactgcagtgttttctccgtttaaggcattaccgcaacaaaatcggttttagtgtttcccttgcttctccatgctgaattacagtcacagtcaacggcccacttgtgtgtagttcaagaagcaattaagggctttttttttttttactttgaacaagcaagggagagggggtagagtgaaaaatgatcattattctgatgattcctctgcttagctgaacagttcacagttctttgataccaagagtcacccacatttaaacccatttctgtaactgcctgctgcagccatgcctgctgtcagatccggttgatggcagttcaaggactcacatgccattaggttggagcagcccaatctggctttagaattgtgattaaatacagttgtaacatctgcacagtgatccacggcatgatgatggtatcactgaaaattaaaaagtgcaaactttggagacttcccagggaattttgcagtttctattgtaagccttttgttttattcagtgggatttcttataatctgaatatggtagtcttatctttctatgcatgtctacatgaattaagtctatctttagcttgcacgttcctggaaggcagggactttaacttttaccactgggtccaaaacagagctgatgatagaagttgttgaaacgttttttttttttgagatgatcaagagatgccctccttaatgtttgctcaataagtatctctgctctgtgtggagcaataagtgagatcctgggaagagacaagtcactttatgttggtggatcgccgagtgtggtccctgaaccagcagcgtcagcatcacctgggaatgtgttagaaatgcatattctttggccctaccctcggcaactctgggggtcaggccctgcgacctctgctttaacacaccttccctggcacatctgacgcatgctcctgtcagagaatcacgggtctgcatccctgcaggtccttgaacccctccacagacatttttcctgcaaagaggagagagatgacctagggtagaagcagggctagagggcggggactaagctttgaggaagtgaaggctggctttgagacagcctcccagctgcctcagcagggtaacaatgtggcagcttctctcctttggatgctttagggctgcctggcagctccaggagccaagtaattccacaagcccgtatggggagggtgtgatatgggacagttcttgccttgaggggaatgactgcttgcttctccactgcgtgtgtgtgttgaagcagggaagggcactaattcttgctcaaaatctaagcagctgtggtataacgcgaggaggtttagacatggaagacttgggtcaaggcacagctctgctctagtagctttgagactctgggaaaatccattaacctcattagactcagatggacctgagttttctcatctcaaaaactgagataattatacctgccctgtctctttcataggatgttctgctcagttgagataggggttgggatgggattttgctcaacccaaacccttacttctccactcaaacagattcctgactgaaggtgccctaccaatgagaagcacagactaatggggggagcaaagttctttactgattaattaagctgatggatctgcacagacgcacacccactgcaggccttccctaggaaggcatggtcgaacacaaggctgagtcatggcaactcccttcaaggtgaccttggagagcagggatgcccttttgcctgttgcttgaggacattgaagtctgatggagagagcctcctccctccagattcctaaagctcccggactttctcaattcatggtgcttttgtgtctgggaactttttcacagtgcccctgtaacaagagaaatacctactagctccatttgttagtagtttcaaataatagtagtagtccatgctgaatctgaacgtgccgctgttactctctggaaacttttttttttttttttgagatagagtctcactctgtcacccaggctggagtgcagtgccacgatccctgctcactgcaagctccgcctcccgggttcaagtgattctcatgcctcagcctcccgagtagctggtattacaggtgtgcaccaccacacctggctaatttttgtatttttagtagagacgggatttcatcatgttggccaggctggactcaaactcgtgaccccaagtgatacacctgcctcagcctcccaaattgctgggattacaggtgctagccaccacacccgacttctccaaggaaactttaaaacatcccatggctttcctgtgagttagttgcagtccacagtttggcctgtacctcacctgaagcaaaagatgggagctagaacattgagaaatattcccaggagtctaccaccctcatgaactttcccttggaatagtccagtagaataatgattttttaaaaattattcctataagaaggaaggataagcattgacagatatgacttattcccttaccagcatttcaaagtcagaatcaatttcaagccaactctaaacccatttgtagatatactgcctgtggcttagttaagaagaaatggtttctttctgaagtaacagaataattgccatatccagtatctatgtctgtgtctgtatcactgagtggattgttggctactgcggggcagggtctgggacagagtaggtgcttgtatgtttttaaattatataactcctttatggatgacttatgggttctcaaatggcttctctaatgggcaccagtcttattttcctttgatcttgttcttttaggcttgcaaagggtaacgtaaatatatccagcactgcagctaaggcttcatatacagggacaggcttatcctctcaagcgttcacaaggggaagtgagatcaaagtgtgttggcatgatggtggggggcctggaggagcttttttgctcttcatgataatagcaagcacaccctgtggatttgtatctaacccccattctgtagttgacattgttcttgagtagaaaaccactgaagcccaccagtggttctgagccaccccacattttatcattaagctcagttatgagtggtaagatgaaggaaatagtatcttatgttcattaaaatggactgcttgttattccagaaaattaatgtatctgaagccagggcatgccttttgaaatttagcaattgattcagcgatgcttggcatttagggtgccaaaacattgtggagaaattgagtaactccagaaaaccccaacatctttttttcttttaaagtagatctaacatggattgcctgcctctcatctaaagatggacgaagcataattacattgatgtaggaagtagcttgggaaggcaagatatgcattcctatttaatggttaccttactttaagtcgggtacgtgattcattgagatgcgaatttgaattctgaggttttctcaactctgcacaagtctatttccctgtattccctaagcccatatcactgaaactcccttaggtggaggcaagtcacagccctacagtaaaaacagtggcactattgctaggcagttcatgccatttgcgaatttgaaccccgatgacagggctgtgaagaaatgtgcctagataagcttcactgcccattccaaccctgaatgagtgcaagcttttgagatgtgtgctactaaggatcccacatggtggattgagtgttttggttttaaataaaacaggagcggagttttaaataaaacaggagtggtaaggaagcttgttgtgacaaatggtatacctgcgccctgccctctaccttgcctcacaatctaacaaaagcctttggcttacgaatctcaaggaactgctcagaggagccgtttacagcacagaagcaagagaagagagaccatgtccggcccttggccagttgtacttcagtgcagacatgcactgtctgctctttctcagcttcttttctacagagagttaagaaaagatgcaattgatggtggcgaaaagtggacaggaaaccctccgttttcaaagtcttcttttggtgcaaaactaccttaggtctacccaaacataaattcctggaattcacttttcctggaactccattggaatgcaaacactgattttgaacacctaacatgcttccaacacttttattatgggccatgccctgttctgagcactgtacatgggctttactcatttaatccttaaaacaatatttcaaacaatgaggcagtcctaatactgcattccttgggttcttcttagggtcatatggtagcctcagatatatgtcttgacccccattagttcacaaaaatattttttctgggagtagggctgtgttttataaaataagaatggtttataataaaataaaaacagtgtagctcacagcagctttttgtcattcaaaatgtatagaaaaaaagacaccaacttatacaaaacttcatttgggttcttttaaagttttgttgttgctgttgttgttaaatggtaggccttttgagatagatttattggaaagtcatatgggtgtagttcttgggacagatgatttctccattcagcatttagagttataacttctgcactctagtgattcttgaagtagtttggaatatggaaatgtgaatagttttacctccatcactctggatattatcccatgttctaaaatcattacataaaaatataaactcactattgtccttgtaggcttatcatgtacttatgggctcatcaatgccaatgtccattgagggaactgagaagagggggcatatacaggtaatgatgtcttctcataaaaagaaaaaaaaaaggaaatgttttggcttttctttagtaacatataatttgtaatgttctttgcctcattcacaatcctgtccgtgtataaacagtaatttgctcttgtaaacacatactgtagttagagttctattgggagcaattggtgttctttatctgtgacatcatgagcatttaaaaaacaataattataaatatcctccagggtgaaaaaatagtaaaaagaatcagaggatctgtctagagactttagtggttgtttcttactgtcctgtctttgagtatcctccctctaccccatctctactcattcactataccctgtcccacccaacacatccttcaaaactcagtagggagggtacctattgcaaatctccaggaatgttattactatttggagaacagtatttagt

SEQ ID NO: 2774 - DNA, 1765 bp, Homo sapiens
tggcaggaaattagtgagaaagccgttggacttcaagaggtctggaggctgggaatgaggagcatttcagtggctaactgcatggatctttgggaaccaaataaaacaatgaccgtttcagagactgttgcatggctggtaacccaaggctatctttcatcaaatgtctttagtacactctcaagaacttagacctaatgcccatggaaattgtaggagaaaggaggccaaaattgcctgaaattaagtattgttctcttggtttttaaaagggaaattagattaattgtggttagaagtaaaatttaaattccctagagagtagcttaattcttaacatacaggaaaaattgccagaggaatctttacacatagatactcagaggatcatctatcaatcagttgtacttcttgggacttctagtgtgatgcacaaggtggatctcttagaattgacagatattttgcctctttctctgtgtaaattagggctggaatgggaggagcagccaagagatttcatcagccacagtgtgcatgatggatgagaacacgggacacataccagtgaagggcaggtcgtataataatgttatgctaacagagattgggaatgcaaataatcagggagttcatgtgctatctttttcaccatgactctactttgcgctatttattgaatgtactattacttatgagtggatgtctgagccaaaaatacgccattttctatagacacaggttttaaaaattgtggaaaattaaattatcaatatattaagagttgcagtattcagaccatatattatattcttgttcaaacaagctaaaaatattaaagatgatacatgtaagcttatgccaaaaatgccaaagtgtaatgaacaaattcctgttagactgagtttagtaaacaaaaaggcacttcttttttgatgttaccacagaaacccagtaagggagaaatgtgatctaactggcttaaataaaagataatgatgaaacctattttcataaatttgcatcagtcaaatattttgatgattaataagcaagccaaactattatacttataaagaaagtctataaatgatcaaatgccttttatcaacatcaaagtatctgatttttctatttccttaccttcacagcctatttaaataaaaaatgagaacattattttaagctattatgatctaattgtgtgctatatgaaagcataaaaagacattcggatcaaatggagtttgcattaaaagaaatcaactgttttccagaaaatggggggaagttctatatatattatataaaagaacaaagtaataaatcaggtttcttacatgctttatagaaaatgttacttatcgacactggactaaaaaaagactgtgcgtaacccatagataagccaactcttattgtgataaaacatcagacaaatccaaattgagaacattctacaaaatacctgaccagcactcctgaaaactaccaagcctctcaatccatggatgttcttttacttggtcatcctcaccccatggttcaagggtatatgacttattaagagtgaaaatgagaagaggaggtggagcaagatggtcaaatagaaccattcactgatcatcctccctgcaggaacaccaaattgaaaaactatctacataataaagcaccttcataagaagcaaaaatcaggtgagtggtcacagtacctgattttaacttatatccactgacagaggcactgaatggggtaggaaag

SEQ ID NO: 2775 - DNA, 12482 bp, Homo sapiens
gcgagttggggcagctcctcgcgctcggccctgctcggcggcgagagctccgcctgggcgccgcgttcctacagccgccggagccgccaggcgccgagggaacggacagacctccgcgcacccttgccgaccggggcgggcagaggcgggcaagcggcgaacgcctgggagcgcggagagccaggccagcccggagcgcgccggggacaccctgtgcgccccgagtcccggcaccatgcgacccgccgcgcgtcctcgcgggcccggggcttcgctcttcgctcgctgagcccctgcgctcgccaccacggaaactcggaaagaggaggcgaggctgtggggagcggcgcggagacggactagacttcccctccgcccccaagaggctgccggtccccggttccctgggcttctccagctttatcatgaacctggcgcaaggttggctttaggaaaaattctggagccagagggagagtcaaggcaattctttggttgctaagtgtgagtgaagacactcaggatggctcaaggatccggggatcaaagagcagtgggggttgctgacccagaggagagttctccaaacatgatcgtttactgcaaaagtggcatctccaaggaatagctctgcctggaaggtgtttgtggctgtccacttaaaagctgaaattaggtcagtgttattttgtcttgagataacaaaaataagaccccaagggagtagtgacttgggatttcatttaagtacttaatttacaggaaaaaaaatacagtttccgatactgaataattattacactactgaataattatatattttttcttctcccggtgttcttatactttagaggcaattttttttttttttttgtaaagatcacaaaaggtctgattagtcaaagaatgaaagaaatgcactgtggctccaaagtcccttatccaaaacctctgggacagatgtattttggaatttaagatttttgtgctgagaatgatggtttccagcttcatccatgtccctgcaaaggacatgaactcattcttttttatggctgcatagttttccatggtgtatatgtgccacattttctttatccagtctatcattcatgggcatttgggttggttccaagtctttgctattgtaaatagtgctgcaataaacatacgtgtgcatgtgtctttatagcagcatgatttataatccttggggtacatagccagtaatgcgtcattcccagcaaactaacacaggaacagaaaaccaaacactgcatgttctcattcataagtgggagtcgaacaatgagaacacgtggatgcagggaggggaacatcacacaccaaggcctgtcggggaggtggaggacaaggggagagagagcattaggaaatatacctaatgcatgcggggcttaaaacctagataataggttgatgggtgcagcaaaacgccctggcacatgtatacctatgtaacaaacctgcacgttctgcacatgtatcccagaacttaaagtaaaatttaaaaaaagattttttggagtttagaaaaataatacatttggatttagcagggtttagtgcggcactttttaatcacacacactaatatttctgtagtgaaactgaatattcacactgagataaagactatgaataacttcacatcagttcaggtaaggttttgcctcctattaagtcttgataacaaactttaaaaacttaaaaaaataaaataaaataaagtttattttcaaaacttttgaagtttgcgcgtacagctagcttgtaggtctggccttgcttttctttagattatatttcccttattagtcttctaaacacattaaatctgtgtttaccaacgctgtaatattttgccaccgtgaggatggtctagaggccagcaccatccacatcccttgggagctggctagacatgcagaatcacaggtgctaccacgaagctgctgaatcacaatctgcattttaatagaatccccaggtgattcatgtgtgcgttaaagatcaagaagcattgctgtagtattatattggctttaatttagattccaagtcttaaagggaaatgctgatggggggatactttagttgtttaaatcctgggaaagtgagcccagattacactaatatcatttatttaattatgtatgtatgtattttttttttttttgagacaagatctgacggtatcacccaggctggagtgcagtggtacaatcttgactcactgcaacctctgccttgtggggttcaagccatcctcccacctcagcctccagagtagctgggactacaggcatgcaccaccacacctagctaatttttgtattttttgcagagagggggttttgccatgttggccaggctggtcttgaacttgtgagctcaggccatctgtccacctcagccccccaaagtgctgagattacaggcgtgagccactgcatctggccgaatatcagttctttttaattttttattcaatatttcctccgtctctccctcccactcttcctatttttttttttttttttgagacagagtctcgctttgtcgcccaggctggagtgcagtggcgcaatcttggctagctgtaacctctgcgtcccaggttcaagcaattctctgcctcagcctcctgagtagctgggattacaggcgcctgccaccacacccggctaatttttgcatttttaccagagatgggatttcaccatcttggctaggctggtcttgaactccccacctgttgatatatgtgccttggcctcccaaagtgctgggattacaggtgtgagccactgcgcccggcccactcttcctttctctcctccttccttttctttttctttctttttaaaaataagtctcataatacttgactttaaatggatcatttagtctatttatttacatttattatattcttgatatatttggatttcttctcttttatactttctgtttattctacttttgtttctttctcttgttttatttatttttttgagatggagtcttggtctgtcactcaggctggagtgcagtggcgcaatcttggctcactgcaacctctggcctcctggcttcaagtgattctcccacctaagcctccgagtagctgggattacaggtgcatgccaccacgcctggctaatattttgtatttttagtagagatggggtttcaccacgttggccaggctggtcttgaactcctaatatcaaatgatccacctgcctcagcctcccaaagtgctaggattacaggcgtgagccactgcacctggctctttttcttttaggttgatattttttttctcatcctattccttcctctgctagtttgttatataccctatttctctcttttagcagtaatcctagaaattgtagcatgcatactttatttataaaagtctaaattcagtcagtatcttttcttcctcctaaacaatagctcagaatgttttaactcccgttttcctctcttgtgctgtatactattcttgttgtgtgtttattctatttttaaaaattattaatcatagatgattttttaaaacttatttttttcaagacagggtcacattccataagccaggctggagtgcagtggtgcagtcacaatgattgcagcctcgacctccctgggctcagatgatcctcctacctcagcctccagagtaactgggactacaggcacacaccaccatgcccagctaatttttgtatttttagtagagacggggtttcaccatgttggccaggctggtcttgaactcctgggctccagcaatctgcccgccttggcctcccaaagtgctgggattacaggtgtgggccactgcgcccagccaatcacatatgatttggttgtttaatagtggtgtttatctacatttattcacatatttgccacattagttgcttactacgtatttttgcattttagaccttctacttggaatcaccttcttcaacttggattctttagaccttccttaactgagagtctcttcatggcaaactgtcttggattttgtctaaaaatgtctttattttgcccttattctaaactgttactaaactatacattttgttttttgttagtgtatctgatttgctggctgtcattcattgtgctttatttctctctctctctctctgtctctctctgtgtgtgtgtgtaagggagagaatttgctaattagttgattaattttccactgtgagctgttcatttttcttacagctttgttatgaggattcttccaggtctgagttacagaaggattctcctagaaagtatttaaggttgcttctgctatgtgcctgggttattaccaactgtgactcttcacattaaatttttggcttcagggttttgggactctaagagctgtatgaactcgcactgcaaactcatatgagttttcacttattatagtaaattctcaggtttgatttttttcttcttccatccatggccaagatttgagacaggcaagtttccttgcactccaggaatgtagcttgacttactgttcctggtgttggtggtggtgctgctggagatgagatccttttagccatcctatctttggcaggccctgggctttgtttcaccctgaactctgaaccctgaatcctgtgggcagggcttctgctagcccatgtggctccactctaaattgatgcaggcactcagcttgttaaagggagcactggatggatttcagcaagcttcctgttccttatggttctgtctggtaggccttaaacctaggctcaagtactctggagttaaacaagtggcccaaggcaaaagccagcttcagtgcttaacttacttcgcagggattgtatgtatgtatgcatgtgtatgaatatatgttatgtatacatatgtatgttttgtgcgtgtgtatttcaccgttgagtgttaattactcccttgttacaactcattgatgcatttaaataaaacatttaaaatattttattcatctcctctcatggttttcagcaaaaatgtaggtcagggtaaattaccagatatattggaccagctggatgtagtcgcctttgatttttttttagttctaccacctatgtatgtatcaataaacaatgtattctttagtgcttccttatttttaaacattatgtgaattgaataacttatgtaatcttttgcaatttggtttcccgcaacatttctatatggagtatggttcgttcatatttactttataccaatatatgaatttctttagctattcaacacaatttaactattcagattccactgttgatggacttttggattctttccaatttttgctattggagttttccagttttgctgctaagaacactctcgtacatgtcttctggtgcattgtccaggattttctctagaatatattcctgggggtagaattgatgattcattgagtaagcatgtgttgtaccttactaggtaattacaaatggctttccaaagtagttgtaacaaattatgcttccattagcggtacacaagagtttctgtggctccatgtccttaccaattcttagtattgtcaggtttcttaattcttgcctattaggtgggtggacttaatacttcttagtttagttgttataacttgttttttaaaattaacatatctatgtgcatattcgtagtcatacatgtttgtctggtcatttaggtacttatgcaatactctagtagactcagaatagaaattagccatggcaacatatatattacattcttcatattgctacatttgaaaataatcataattatttgcagaaatatgaacagaacatatagaattaaatgttttcacgatgtcttgtattatctttcatgtttcatagcaatctctgtgttataggccacatcaactgcttttgcattgttctgacttacaggaattgcagatttattgttctcagtgccatatttaagttccttctctgtaacaatcaggtgtaatacttgtaaatttttttaaccttagtacaaatttaaaaagcagaaatttctcttgcagcttcctgtgtttcaggcccagtgctaagcacatggcaagcattgtcccatttagttctctccaccatgcttcgggcaggtgctgttgttaagcccctttcatggaggagtgaactaaagcatggagaggttaagggtcttgatcaaggtcccacaatcttattctcaatggaccttctccttctctaatctaaaaccctcattttattttgggaagtggatgtaggtctaggaagcttgtttgtgtgtgtgtagtttgtttgttttttttttttttgagatggagtctcgctctgtcgccaggctggagtgcggtggcgcaatctcggctcactgcaacctctgcctcttgggttcaagcaattctcctgcctcagccttctgagtgctgggactacaggtgtgtgccaccatgcccggctaattttttgtatttttagtacagacggggtatcaccgtgttagccaggatggtgtcgatctcctgacctcaggtgatccacctgccccggcctcccaaagtgctgggattacaggtgtgagccactgttcttggctgtttgtgttttatattaggaggcagagagcacttaggggaagcagaagctctggtctgaggaggcagtggtttacttattagttcacaggccttttaggtaatcactggtccttcacttaattaagcaacttaatatatgtcttacggattaagttaattttaaatcaatgctaatttttatgtcaaaatatattaagcagcatcacattaaagtcaaaggtagtcttgtaattattagagcaataggtatcgtgctgtcgttctccaatgtggctgcacattggacaacctgaggagctttaaaaaatactgctgcctggggatcactcccataagctctgatttatctcgtctggggcaccaggagttttaaaatttctccaggtgatctaatgtgtagccaagcttgaagattactcgatagtcattgattatgtgcgtgccacattcagattggtggggttcaaatcctccttctgccactcactagatgtgtggccttagttaagttttgttaacgtttctttatgtcttcatctgtaaaatggggatgaatgataaaaatactgtctgcatctcagagcattgttatgaggattaaaggggtacagtaagtccttatttaacgttgtctataggttattggaaactgcaacttttaagtgaaacgatgtataacaaaaccggtattaccatagattaattgacataaatgagagttaagttcctgcagcatatttttggtcctaaaagtattatcagacttctacataaagaccaaaacatttctaatattaaacactgagagaaatctaggttatacatacatttaagaaagattaattcaatcatttactcaattattcgactccagaatagtgggtggtccgagcctgtcctggcagctcagggtgcaaggtgggaccagccaaggacaggacaccatcccatcacagggcacactcacgctcatccacactcacactgggaccacttagacatgccagttcacctaatgggcacagctttgggaagtggagaatgtgaagaaaatccatgcagatgtggtgagaacatgcaacctccacacagacaatggccttggctggaataaatttttttttctcacaaattttataatgaaacaatgttactgtaggacctgctgtataatatatacatattaataaaatgcttggaatagtgactggcacaaaatagtcctttactgtgagctattttaagtagactaagaaaaaattattactattattggatattctctcaaaagtatcttgggggctaagattttaaattaaatcaaattttgcctagtactaagcccactttggtgttttcttggctttgtttaatttttttctccatggttttatttaaaagttatttctaatcaccctgtcaacttagcagatatctgttggaatcatttaaggtgtttgtttccaaaagactgcagaaattaaatcaagatatttgcagaggaatgactgacagcttgcaggtagactggagaaagtgcttcctaccataacagacagaaaaaatggtagtacaagagtcagcatttcttatttatttttctatgaggcagggtctcgctctgccgctcagactggaatgcagtggtgtgatcatagcgcactgcagcctcaaacttctagactcaagggatctcctgcctcagcttcctgagtagctgggactataggtgcttgccaccatacctagctgattttttgtaggggtgggtagagacagggtctagctctgttgctcaggctggtcttgaactcctggcctcaagcaattctcttgccttgacctcccaaaatgttgggattacagacatgagccaccatgcctggccaattgagcatttctttaaactggaaactagcacctttataataatttcacacataccattattgttgaaaatagtcagattttcagaggaaatctctattaacctaagttgtataaccttttgaggttgtaccagtgtagagcctgtttttccgagcatctacatgctcaatgctattttttcagttatccagcatccccccacttgtttctatcctatctcatatgcaagagggtgtaaatgtttttgtgcattgcttttacatttttatttatctctcaagtgggcaagtaagacagtcatcaacagaggttgcatttggagatcatattctgttttttctttaaactatttgatcatttcagagaaactttattctcagttctgttttgtcttcagctgtcaatatccctgactccaggccctttatttagcttccattcttactgatgtggaaacatacttttaaatgaactgcctttaaaaagaaatattttagtaaagtgaaggatctttttgtaatgcaaataatgttttgttcaggattttcttgagaaatctgccatgttctctaagcctttgcctccatactggatgtggctttgccttttttgttgtgttgaagggcatgcacagatatagtttctgattatttttctcagtctgatttctccaattaggcatattatcattagaaaactcgcccattttcccatggtgtttaaaagtaaaccaggacttgtgacactatgctactcggcatttatgaaatgtaatttaattactttgtttccattgtgaagactcggtttccttatttcctatattcatttatttattcattattggtatacccaacaagataagtaaatacgatacagccttgcatttgacaattttatggtgtgtatgtatttatcatgcctgaactgtgactagacttaagatgaagatggtacctaaatcaagctcttttatattttgtctttcccataatctagtctgtcttttctttcccacaaaatagaatgggatactttttattataaatatatgacatgttcactataaaagagaggcagtaaaggaccagagaaaatgacctgtgatgccaccacctagaagtaatcactcttgttaacatcttgttatttacttgtacagtttttttctgtgttcataggctgacatttttccttgcagatgttctctctctatattcatacaaagctgcagttgttcaagtcccaccccagcctctggaggtccaggatgaatgcctccctctttctgtcctggtaccttacgtgacctccggacggcagtgtcagtgttggaaatggcaggctgctgcaaatatgctaaaacctcatcagttgtctctattcgtctgaccaaagtccgtgggaagagcaagatgctggtgatatcctggagctcttctgacacaaggctctggctagccttgatacattcctcaaattcttccttccaattctgaaaccttttgttttccagacaataaaaccctcccaaactcctacctagacattctctctaagcagtcctgggagaccacatgtgacttgacttttaactatctttacagcgtttacattttgctccttctttttgtcatgccattactagagggaggatgggccatccagagcagcgtgcgccctccacaggcaccttagcctgttcttcactccgccatgattgaaagaggagaaaatattctatagctgttccttttctgttcttggctttttcactcttactgaccttacaagttttatttttccatttctgaatctcaattattttcatttctcctattcagtatagtttttaatagatagcattgcattacatggatgtcccttatttaatcaactgtttggtatttcttttctgtttttcaaaatctaatgaacactccagtgaatatccttttgttcgggatttatctctagaaggaagattactggctaaaaatatatgtacatttaacattcatatacatatctatacacacttttttttgagacagcgtttcactctgtcacccagactgaaatgcagtggcatgatcattgttcactgcagcctctacctcctgggctcaagcaatcctcccacctaaacctcctgagtagctgggactatagacacgtgccatcatgccagctgagtttaaaatctcgttttgtagagacatggtcttactatgttgcccaggctggtttcagactccttgggctcaagtaatcctcccacctcagcctcccaaagtattgggattataggtgtgaaccactgggcctggcctatgtatacataattaggctatactgtctataaaatttggctatctatagtcaaattattttatatgcatatatccaaatatacctataaatagccaaattatacatatacagccaaattttatatatatatatatataaatgttatatatatatagccaaattatataaagctgtatatatagtcacattatcctacaggaaatgatgtaaatgtaccaatttacattcctgtaacagggcattagaattccctttttccagagccttgccaacactggttatttataaccctttcaaactttgtatgaaagttgtatgtattttaagataaatgaaaacttatattgatttgtaattatttattggtataattgaacacctttccatatctttattgtactaatgtgtatgaattccatcttaatagttttgctaacttgtccattgaggggtttcctactgatttgtaatggctctctatataaaaaggatgttaatttttgcctattttacagtaatagtacaaatattctctcatgttttctattagtcttttaacctttgtttagttttttttcgttccttcataaatgctaaattttatgtcatcatatctttcagtccttttctatattatttctggctttgatggcatgcattgaaagcccttttccaccccagagttatcaactcgttggaaaatgatgttgaaatgtcacttttaatatttactaaacactcttgcctaatttgttctattttgaagccctttaattctgtttctttaatctgcctgtcttttttttgtgcctgttccttactgtcttgactactgcaggcaacatacttacatctaaagaacaagcacacctattctgcccttttgctaaacaaattttcagcctctttttcaatgattattttttcaaatcaatgttaaacatcacgtaaagtttcaagaaaacccctaggggtattagtatttagagtgcattaaatttttagctaattcatgggagaatttgaagtattatatcttctaatttaagttagagtacaggaattgtctgtctttatccctctaagtacattcagattctcaagaatagtaccaaaattctcagatccccctctaccagtatttttctcccactgatggctcttcaaccctaaaatgtcttagtggtatggtttggatctctgtccccaccaaatctcatgtccgatcgtggtccccactgctggcagtagggcctggtgggaggtgattagatcatggggaggcttcttatgaatggcttagcaccctccactttgtgctgttcttatgatagtgagttctcatgggatctggttgttaaaaagtgtgtggcacctccccaaaccccttgctcttgcaccggccatgtaaggtgaggatgcttcccctttgtcttttgccataattctaagtttcctgaggcctctccagaagcagaagccaccatacttcctgtacagcctgcagaaccatgagtcaattaaatcttcctttataaattacccagtctcaggtatttcttttcttttattcttttctttctttcttttttttttaaga

SEQ ID NO: 2776 - DNA, 1771 bp, Homo sapiens
ggcctccgtgtttccgtgggagagagagagagcgcacaggtcacccacccccggggcactgcaagtgttaaccgccctcccccacccccactggctgcaggccccagtcctgcgggtgtgaggagagctcagactttggaaactgaataatgctgctctcgccttcctgcatgggggtagggaaaggaaatgctttagtgagattgcaaagcaggaaaaaaaaaaaaggtcaatcagtaactcttttctctgtatccattagagattgctggtgagacagcagccactgctcccaggcccgacaacaggggcagcaccaaagctggtcagtgtttcctccttacaggtctgaaggtgctgcagaggagggtgcttcccagagatcacccctgtgacagacagatcgattgaaggacccctgaatggctgaattgagaagaacaagcatattaggaggccatacaatgggagcctctcaggcagacagacaaagccgtggaaactgcagacttatttgtatgttctggtaaacacctttgcttcattttccccgtctccgcctggactgagggtcacctcacctctcctggtgtccagagcctccttcaggacagatgttgcaaacctgagttctcacaaacagcggggtccagcccttctcaacactggaaagcccttgagccatctttgatttgtgtgttttgatctaattgcactactgcttgcaatgcttgtttttagcggtgagtgctggtttaatttgtttctttctggtctcccagccccactccagaattttggctcctggagaggaggggccctgaactggcattttcagtgaagcatcccagtgccttgaatccagtaagcagccaggtgtctgttggcttcatggtttaacaacctaccatttgaagaatcgcagagatgaattaaaaagagccccggagaggctccccgatccagttgcacttcctgcttaagcaaagtaaagaaaaacaggaatgaaaacataacccaatgggttagttccatgctggccattgatgaggttgcagccaccatcagaagaaggccaaacggttagaaagacacggcggtgaggaagatgagcctcattatcgactgtcacctgcagccctgcacaggtgctcagaatctaacacttgatggctggttgagattcccggagtcctaattaggaatgaggagtcaggctggcaggacccagggaaagcaaaaagagaaggcagagaagctccaagtctgcctgtcttcgtgatccagaacacgtagtcctgctgcacaagtaactcacaatcttcctgtgtccagctgtcattagacccttggctgatagaaaaatgcaagttagcacactgcagcctcggtgtcgtcagtactgcacgtcactctctccagcacaccgcggcctcggcgtcatcagcactgcacgtcgctctctccagcacaccgcggcctcggcgtcgtcagcactgcacgtcgctctctccagcacaccgcggcctcagcgtcatcagcactgcacgtcgctctctccagcacaccgcggcctcggcgtcgtcagcactgcacgtcgctctctccagcacaccgcggcctcggtgttgtcagtactgcacgtcgctctctccagcacacagcacaagcaccatcctatcaagtccccagcaagcctttgtctccttgcagtcagctcctctcttgctggcctgcctgttgcctccttgctgtgtattttcctactttc

SEQ ID NO: 2777 - DNA, 1102 bp, Homo sapiens
gaaccacttgaatccgggaggcggaggttgcagtgaaccgagattgcgccattgcactccagcctgggcgccaagaatgaaactctgtctcagaaataaaagtcttataaaaacagtccaatatttcaccattggcagaagtgaagtggtaattgtttgttattcacatttctcttgaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctcta

SEQ ID NO: 2778 - DNA, 896 bp, Homo sapiens
tttatattaagtaatgaatgatattgaaaagatcagaaccttattagagcatgtcttcctatggaaaaatcagatttccttctctgctgtttgcgcttagcctttaccagagggtcatgtgaccagcagtaactgtgaggcccggttttctgccacgatattccctccagagtacgtgctctcgggttgtctgaatccctggaatgctgggccagttgcctcagcgggggctgccgttctaacccccagggcagggttgtttctttagctggctggtggcttttggtaccaaacaagtaactttcctttcccgtgaacttgtctgcagtcccaaacgacttagggtaactctgctgaccctgttacctgctttattccagcttttgttccagctaaggtggggagcctatagattcctggggtcccacagaggtgacatagcaatgagagagctggtgatgtctcatattcatgacacaactttgcctggattcacaagtgtggctacatagggagcacagagaccaagggttgaggagccaaggttcttggcctccctcctgccatctgactatctgagcttgaacaagcctttctgaagctctctgccacctgtctacaagtgtaaactgtgatccagggaaacaatatctcagataccttttctgacctaaattgtctctcctattcattccatagtgtgtgcctaataataagagcaaacccctgccacatgccagatgcagttctaaacacttcatacaaatggactcctttaatcttcaaaacaagactgagagggtctggctgcagacagtggcacaattacagcttactgcaacctctatttcctgggctcaagcaatcctcctgactcagcctcccaagtagctggg

SEQ ID NO: 2779 - DNA, 649 bp, Homo sapiens
cttagtactgcggccgtgtgggtgagttggctgccggtgagttgggtgccggtggagtcgtgttggtcctcagaatccccgcgtagccgctgcctcctcctaccctcgccatgtttcttacccggtctgagtacgacaggggcgtgaatactttttctcccgaaggaagattatttcaagtggaatatgccattgaggctatcaagcttggttctacagccattgggatccagacatcagagggtgtgtgcctagctgtggagaagagaattacttccccactgatggagcccagcagcattgagaaaattgtagagattgatgctcacatagaaccactggttcacctacaatgagacaatgacagtggagagtgtgacccaagctgtgtccaatctggctttgcagtttggagaagaagatgcagatccaggtgccatgtctcgtccctttggagtagcattattatttggaggagttgatgagaaaggaccccagctgtttcatatggacccatctgggacctttgtacagtgtgatgctcgagcaattggctctgcttcagagggtgcccagagctccttgcaagaagtttaccacaagtgagataaagggaaaatctttgaaggaaggacggattgtgcataat

SEQ ID NO: 2780 - DNA, 814 bp, Homo sapiens
gagagacttgataggactttgccgttctgcctgccacagctgttcacttctcaggaagggagtccagaagctatgtggctgcctgtgtggtcagacgtgggtgagaagatgaggatggatgcttgctcctctcatggaaacagataacttccgtacctgccaaaccaatggcagaggagctgggaagctcacaggcattgctgaggcctttgaagatgttagctgagaaaggcagaccagccagcatggagctgccctccctcccactcagcgcctttcctaggccaaggaccaggtgaagccgccttgaccctgatccagccgcctgggttgctgctgccggggaaggcaggcctggtgtggacggaccccctgacttttcaagacacactggaggtcactgagccatgttttgagtcagttctgcatctcatcaagacacaggtaatcagaagaggggtttggaaactcaagagcacataagtgaacaaaacatcaagcttgctcttaaaagtttttcaatcttacgcatgttggtaagatatatatgtggtatttatagtgtaaagagggtgttatatgttctaatatatatgttacaacacaagtataaacaatgtgctgtgaatacaagagagatatatatgagagaaataattctgcggaggagcagtggcaagagcttccttgaaaaataatatgcttacagggccttggggtatggatatgagggcaacaggtgaatgcaacaaaaataaattccagaaggaacagcaattatttattcaaaaaacatttgttcattgcccagaat

SEQ ID NO: 2781 - DNA, 10800 bp, Homo sapiens
cctaatgctaaatgacgagttaatgggtgcagcacaacaacatggcacatgtatacatatgtaacaaacctgcacattgtgcacatgtaccccaaaacttaaagtataataataataaaattttaaaaagaagaaaaagaaagcaacaaagaatacataaaacaattaacaatatgacaggaataaaacctcatatatcaataatgaccttaaatgtaaagggattatattctccatttaaaacatatggaatggctgaatgcattgaaaattgtgatccaaaaatatgctacttacaagaaactcatctcatctgtaaagacacatatagactgaaggtaaaggaatagaaagatattacaggcaaatgaaagatattacatgcaaatggaaatcaaaagtgaacagaagtaggtatacttatatcaggtaatacagactaagtcaagaacaataaaaaaaagacaaagaaggtcattacataataaaaagtgatcaatccagaaagagggtataacaattctaaatatatatgcaccaacactgcaacattcagattcatacacaaatgttattagatctaaaaagagagatagacttcaatacaataatagtgagggactttaatacttcactctctgcatttgacagtgcatctagaagaaaattaaataataaaaaaaaacactgaattttagaccaaatggacctaacggacatttacagcacattctatccaacagctgcagatgatacattcttatcaccagcacatagaacatgtatcccagaacttaaagtaaaaaataaaaaatacaaaaataaataaataaataggcaaaacaaaaagatgttggtgaggaagaggagcaaagataactctcgtatactgctggtgggaatgtaaactagtatagccatcatagaaaactgtatggaggttgctcaaaaaaactaaaaatagaattactcttcaatctagcaatgccactaccatgtatctacccacagaaaaatcaatatatcatagagatatttgtactcacatgtttattgcagcactattcagaatagcaaaaatattgaatcaacttaaatgttcatcaactgatgaatggataaagaaaatgtagcatgtgtacacagtgaaatacttttcaggcatataaaagaatgaaatcatgtcatttaaagtaacatggatggaagtagaggtcattatcttaagtaaaataagccaggcacaaaaagatatcacatattctcgcttatatgaggaagctaaaaagtttggacacatggaggtagaaggtggaaagataaataacagagactgggaagggtgagtgaggggacagggaagaatgaagagaagtaggttaaagggtataaatgtgtaatatgatagaaaaaataaatccaatgctagatagcagagtaggatgactatagttaaaaaaaatgcattatgctcaagtgatggacaccctgaataccctgatttgattattacacattatatacatgtaaaaaatttcccatgtaccctgtaaatatgcacaaataaaaaactatttaaattaaatttattttcctaaaaatgtttatctaaagaaaattcttagataacagcacagccattatttagagcagactaaggttataaaggtggtatgtgaataactgaaatactcatcctgttaaacaatattcaagattgtattactatccctcaaaaaggaaatatacatgtttcaagctcacttacaattaaattaattagacaatttgtttatagaggaataattactgtttctcctatgtttcaccttgagggctaggtactagagaaataatagtgaaaagtgcatagtctatatccttatcaaactttcagtcaaaagaaaacttcaagaagatgagtaggtgatttgtgagtcaatagagaagtaaaaacatggtcatattaggggaggtaacgcattctttaagtactagccaaagcttcctaaaggagccaacatctaaactgaaggatgtataagaataagccaaggccaggcatggtggctcacgccttaatcccagcactttaggaggccaaggcaggcggatcacgaggtcaggagatcgagaccatcctggctaacacggtgaaaccctgtctctactaaaaatacacaaaattagccaggcgtggtggcgggcgcctgtagtcccagctactcaggaggctgaggcaggagaatgatgtgaagcttgcagtgagccaagatcgcgccactgcactccagcctgggcaacacagcaagactccatctcaaaaaaaaaaaaaaaaaaagaataagccaagacaggccgggcgaggtggctcacgcctgtaatcccagcactttgggaggcccaggcgggtggatcaggaggtcaggagatcaagaccatcctggctaacacagtgaaaccccctctccactaaaaatacaaaaaaaaaattagccgggcatggtagcaggagcctatagtcccggctactcaggaggctgaggcaggagaatggcatgaatcctggaggcagagcttacagtgagccgagattgtgccactgcactccagccttggtgacagagcgagactctgtctcaaaaaaataaaaaaaaaaaaaaagaagaagccaagacaaggggtattctgggaggaagaaagagcatgttcatatacctggagaacagagaacataaggcattcagtgggctccaagtagattggaaagacaggtctaaacatagagagggagttgggggtgccaggaaacgagcctcaagagaaaacgcaagtaacagatcatgaagggacttgtccctgtagatcagagcatttgctggaaagcaacagaaaagaacctggattacacaaaagattttttggaagactatcagagggaggcagtgcattgtatcccactggtagcatttactggtgaatttcccaaaataaaatagatcagatgtagatataaataaacaagacaaaaattaataagaatagaatattctaaggaatttgaattttattttgtgggcaactaatagtaataaggagaatcgacatgttcagatttgcattttagatagatgagttttgcagtagtgggagtaaattgaagttagggagaggatatcgagagctgttacagtgacataattgacagatgatggtgacctaagtaaggatagtgcagtggagaaataagagaatgggaaagaatacatttgagagccaggtttgatcacaatggtagcagatttgcatttctggacattaaaaagccatggctttagtggcttggctttcatgagcaggagaagaaaaatctcaaaagcgggtggagatagggagtggagaggtagctcttccctcctcctgaatatttctgtgtggtcccagagtccacaaaacagaattatccattacccccactttaaatactgtaaaagctgcctgttttattttcaaacacctcctgtttggccataacacctaaccttgactgtccccataatgggatgtaaatttattaacaccctttagtcagttgcctgcaactatatgttttggctgcctcccaagtctttaattcctttattgaagcatttcatgatggttgttgcttctccttaaaagcttttttgcaatcgctgagtttttaaaatcctatctgtttttctcctatcctgtctttcattaaaattgattttctcagcttctcacatatttctatatgaggcaaagaattttagatagataccacaacctaagcatcagaggtagagatggaggacaactaagatctaagtaatgttattttaattgcaatttaaagccaaaaggcaaagacttagtaaagagctgttttcattacagttgttccatgcatgaaatgaaccattacacattggaaaagaagaaattattccagagtggcttagttataacaaacaaaatgagttccaacaagctgtttttagtcccatggccaaaaaatgcattctgttggtattttttctaatgtgacattatattttgaaatgttatttcatgttatactctctttatataacatatttgcattgaataatgagagaaatgaccagctggtctctagcaattataaaaacctttattggaggcagcaggatgatggcagatggcaattttaggttgaagtctcactaagaatagatttgtagcatcttgttgatgtggaatatagtacaacctttctctgagtctataagcaggatggtagggtggtttattgagatactaatttgcattttgatctcactgtatttttttcttccctcattaaaatagtaaaagcttttgggttcagtgtatttgagttccaaagccgaagaaagatgtgttcaaagataatgcctcttatcaacttttggttttgaaagcctgaattgattaaggaggtaataggccaatgagaggaggaaaggagaaagaaggtctttggggttgaacagcaggaagaacaattccatatctttaataaggcaaattctgcaagcctggggaaaggaaggtggtacttgatggagtagcaagattgaccctggctcatttgcaagctgtgtcatgcatcttgaaagactgtaccaaccatcaagaccctcactctgcccctaggtttggtacaggtatagccacaccacctagatctatggggccatcaactaaaagtagacattttgaggtgaaaaaaagaaaaaagaaaaaagaaagggaccattgataaggtgagtcatctgttttcataatgatcataaacatttgagtaataaactctgtgatcatattgaagacaagaaactctaatctttcagagactatatagacccctattctctcatgtgacctcggaagtacagggccttgaccatccccttctcagctccatattctatgatgggtaataaatttccctcaagaatggagatttggaatctgttttaaaatgatatagaatgataatgtaatatatcttgcattggcaagtaacgaagtaaaatgtaaaccctttgcaaatgtaagatgccacgttatttaaggtagaataatataaaagaaagggtcttgaagatataattccagatcactctgtactttattataatatgtattagaagataagagcagtagaaaagcacagactttggtggggggaagggaaaagaactgattcctgaaacatagatttatgtctttaattggcaacccagcactatattacaatcagtgttcctgaaatcaaggggttaatttgatcaggtccacctgccctgcttgcttttggtcacttaacttttttcctttttccatgaagacgaaggtcctggtagctgaaggctactgctaaacactgaaacttaaccttcactggctactttatagataacattcatgtgtcatcatggtaatggtcatttcagtagtttttcaggaactggacccaactcctgtccggttcaaacctgttgagaccactaactcttcaaatgggcctgaacaagtgcccaagaagggggcttttgacatcagagagccaaaaactccaccctcagatcatgctaatgctgccattttctgtacatgtattttatggaatgccatgaaccctgattgtgcctgcacagaagggacctgttatttcactgttcctcactgccagtcacctttccccataccttagaccactccacttccctaacccataaatatctgtaagacttatatttggagaggtggacatgagagttgttctcccacctcctcacttggcagccttgcgaataaaacttttctcttttgtaaaacctgtgtcacagtgattgattactcagaatggactcagacctggctggtacattcctaggaacgttttcatttctgtcctgcgtccttcatctggagataagggtaaaccccagtgcttcagagcccagggtcattgtctttcaccactcaagcttgcacctaatcttccccttcaccagactaaatgatcccagttccaatagtttaagctcccaaagtctagttccaagggttttgttctcctctttgcactcattaaaggcatttctgctttcatatttcatcatctatttgtgcctaagatcattaaaggtcatgtggtataagggcaaaaaccaggcggctgtctaaaagtcaaagccatacaggattttcagaggcagcttgagctggttcatgtccaggctctgctacatcctatctgtgtgattctgggccagttctctaaacttttcatatctcagtgtcctcatttatattaatcatactgtctattttctttatcttatgatgttttgacatcttgaggtggggatagggcaggacttacagatgtgggagagatggcccctaccagggctagttaatccctaaaaatagtaaacaactcacttgggagcacacctttcacatgcaaagcaactaacgcagagtctgcctccccacccactctcttcatctaactcccagacactaagccaatattcctcctgtgctaaatcatcccagggccagatactaggcagcaaaaaattactcctacagcccagaacccaccagaattattcaaactaaccaagcttacactcttgactctgccctgccttgcctttcttgcagaaacccagttaagactctggtaggctttctcctcactcctgcctctgcctcctcatccagtctggctcttctcctgtggccctgtgtagtgaggcatgcccccttctcttgagaaatgagaaattcaagccagctgcagaaatttgcttgagtagcaaggagcccaatgttaatcctcaagaccatagggaaaatgtctccaggccatgtcagagaccttcatggcagcccctcccaccataggcccagaggcccaggaggaaaaagtggtttcatgggccaggtccagggtccttgtgctgtgtgcagccttaggacttggtgccctgtgtcccagccattccagccgtggctgaaggggccaatgtagagctcaggccatggcttcagagggtggaagccccaaaccttgacagcttccacgtggtgttgagccttaggttgcacagaagtcaagaattgaggtttgggaaactccaactggatttcagaaaatgtatggatgcccaggcaaaagtttgctgcaggggcagggccctcatggagaacctttgctagagcaaactggaaggaaggaaaatgtgggtttggagcccccacacagagttcctagtgggcactgcctagtgcagctatgagaagagggccaccatctttcagaccccagaatggtagatccactgacagcttgcactgtgttgctggaaaagctgcagacactcaatgccagcctgtgaaagcagctgggtgagggctgaatcctacaaagccataggggcagagctgcccaagaccatgggaacccatctcttgcatcagtgtgatgtggctgtgagacctggagtcaaaggagatcattttggagctttaaaatttgactgcctcactgaacttcagacttgcatgggccctataacccctttgttttggcctatctctctttcggaatggctgtatttacccaatacctgtacttccattgtatctaggaagtaactagctttcttttgattttacaggctcataggtagaagggacttgccttgtctcagatgagacttttgactggatttttgggttaatgctgaaatgagttaagattttgggggactgttgggaaggcatgattagttttgaaaagtgaggacacgagatttggaggggccaggggcagaatgatgtggtttggctgtgtccccacccaaatctcaacttgaattttatctcccagaattcccacatgttgtgggaggggtccagggggaggtaattgaatcatgggggccaggccttcccatgctattcttgtgatagtgaataagtctcacgagatctaatgggtttatcaggggtttccgcttttgcttcttcctcatttttctcttgccaccaccatataaaaagtgcctttcacctcctgccatgattctgacacctccccagccatgtggaactgtaagtgcaattaaacctcttttggttcccagttttgagtgtgtctttatcagcagtgtgaaaatgaactaatataccaagctatcacatcactgagtgtgatgggccatcagcactgctgtgatgtcctgcaaaagtggaattatttcttgacttgacctcactcttatgtacttgagaagctgagttctcttctcgcatgttctaataaacaagtcttataagtctggctctggttagcccacatgttgaacctcttacttgcaaccccactgatgtgtctcccctatgcctggacataagagcctctcaatctcacattcatccaacagcatctctaggtgtatactcacttgtagccaaagtaaattttacaccatgataaaaattagtgtaaagactttacagggaaccaaagtgcctgggaattctgatgagtaactactgagtggttttttttaatctctttattcaatagacgtaaaagtttaacaattgaagattttaggtgcctcgcttttacattatgatttttaactagtgcatgcacaaatatgctttggcacacaataccctttccagagccatcaagatttaagtcatatttttaaggacagtgttaaaatgtttacaggtttatgacccataagtatctggtttaactactctgtgctgcaaccatttttataattattttctctttcacaacttttacagtaattttatattcatccttggagatgccacattgtgttttcttttggcttactaagtggacatcacaatcggttaaaaatttgccatttgtgtgtatcagggcatagaaggtggaggataatagtgggggttgtaaatgtattggataaattatatggtacaatatgttagtgttcatttatatccatctaatatgagcttatatgtcacccaaaggtagccccagttaggctgtgaatactgtggcccagtatcaaagtgatcgtaagttattcctagaagagcgtgtccctgccaaacacatatcagggcttcacagttttgaccttatttcatgtggtccctcttgcagctagagtctggcacagaaggcaggacttccagctggtactttaggtacattggggcactagagataatgaatgcacttgacatttacagttgggtctaaattcacaactgtgtcagataacaagagctggattaacgagtggccagtatgcagagatacagaccatctcaatggagacctccctggagtatcaagacttacaaagagagatgaacacattggaagccaagaatggtttatggattatatttgctaaatgtgtgcaatcctcaacaggaaaaccacagccaggtatccaaagcagaactggagtgtgcttatatgtgtcaggggaagaggtttttatgtctaataggcacagctagtttaatatgaaacttgcactgacagtttatacctaactcgactcaagactttcatagttatctgtaaagccaaatactagatttgactggctattaaataagcatggcagaattgtgaagacagtattatacgactatgaagcgaattaaacccttcttatcacccctctccaaaatcagaagaaaaaatattctttcactcctttttttaaaaatcatgagatacatttttttgttaaaaaattaaaaatgcaaaagtgcaaaaaggaggatataaaaatcttcacaacctcagataaaccccattagtattttggttaatatccttccagtctcttttcaatgtatgtgtgtgggatcaattttaaaatatataatatgaagtataaagcataaaaatatactttttcacaacctgattttagtctgactcaccaaaactttgcgattatctttccatgatattgttcttcagctgcttcaggtttagtagcacatgatattccattgtataatcttattttaatttacttaagcagcctcgtactgttggacatttgttatgtccaagtattttgttactacaagcaatgctgtaatgcacactaagaagaaacatatcccttgaaactggttctacttttaatattttcaagcgttctttctgccattcccatcattataaattaagtttcacccactcacttgctgagcatctagttttcctctttgtctggaactttatgtatgtccccaaatggaaatgacaagaaatatttaaaccccaattggtttaaaaattaggtatctaccttatttagggacagttttatttataataattctaaatgtctgtgaaatttttaaaaggattgtatctgcatgatccagtttcttgatgtatgtattgccgtagtttatgcagtgatgcatctatttacagagtgtgtaacactcaggacatatatgtagagcattgttgatcagtgtgtggccttgggatcaagaggaagctggagtaagttagcactggttctcaaaaaaagagttcaagctaaaagcatgtggcatgaggaactagtctactcaggctacatggttgaaaatcctgagatagcaaacactgaaatccagttcatgggtattgatgccagggaaggataccagcaagtaaaaaagtag

SEQ ID NO: 2782 - DNA, 8351 bp, Homo sapiens
actccccgaagcctccgggactcggcggtgggcgtggcgggcggtcgccgtggtcaccacggcttttctcagaggttttaacgcccctagacttcatttcccgacagggactgcgggtctggatattccgtcgtggactacgtttcccactgacgacggagaaaacttggtcctttggctccgcgctgcgcgtgacctgcagtcacctgagcaagagggcggcgtgggtcgctgcgggagcccctacagccccagcccgcagcccacgtggcaccctacagggctgtgagagtggggctgctggaggcgttcagagcgcggaggccccaggcgcgggccgggctctctcccgcctcctcaggcccgggggtgctggagctgccgaggtgggggctcatctttgggagacagtgtctttgctcagttcaaaagccacagaagaagttctggacgatgtgggccttcaatcttctaagatgggaatagaaagaagaggatctacccagaccaggaccctgctgcccaatctcagctctggctttctggatctgtgcttctctggtagaggaaccctgaggactgatctactcttgcagttctaaaaccatggcccatgcctcgctattccctgggacacaacaatattgaacgtaggctagttaatagccctacaatctcctctaagtgttcgagtgaaaggaagagtcacatgtgtctcactttaaaccaaaagctagaaatgattaaacttagtgaggaaagcatgttgaaagtccagacaggctggaagcgaggtctcctgtgccaaacagcaggccaagttgcacatgcaaaggaaatgttctcgaagcaaattaaaagtattactccagtgaacacacaatgacaagaaagcgaaacagttttattgctgatgtggagaaagttttagtggtctggatagaagatcaaaccagccacaacgttctgttaagcctaaacctaatccagagcaaggccctaatgctcttcaattctatggaggctgagagttgaggaagctgtggaagaaaagtttgaagctagcagagaataattcatgaggttgaaagaaagaagctgtctccagaacataaaagtgcaaggtgaagcagcaagtgctgatggagaacctccagcatgtgatccagaagacctagctgaaataactgatgagggtgactgcattaaataacaaattttcattgtagacaaaacagccttctattcaaagaagatgccatctaggactttcatggctagagaggagtcaatggccggcttcaaagcttcaaaggaaatgccatgtctcctgttaggggctaatgcacctagtaactttaagtcaaagctcatgtgtatttaccgtaatgaaagtcctaggatcctaaagaagggtgctaaatctactctgcttgtgctctataagtagaagaacaaagcctagatgacagcacatctctttatagcatagttcactgaagattttaagcccaatattgagacccactgccaagaaagatagatcattttcaaaatattactgctcactgacaatgtgcctcatcacccaagagatgtgatggagatgtataaggagattaatgtggttttcatgcctattaacacaacatccattcttcagccaatgaatcaaggattaattttgactttcaagtcttatttaagaaacacattttgtatggcaatagctgccatagatagcagttcttctcatggatctagggaaagtaaactgaaaaccttgtggaaaagattcagcattctagatgcaattaagaatacctgtgattcatgggaagaagtcaggtatcaacatgaacagaagtttggaagaagttaattccaaccctcacggatgactttcagaggttcaagacttcagtggaggaagtaactgctgcagttacttgtggtggaaataacaagagaaatagaattagaagtggagcttgatgatgtgactgaattgctgcaacctcatgatcaaacttgaatggattaagaatctactcctggtgaagatgctttgaacattgctgaaaggacaaggatattaaaatattacattaatttagttgatacagcagtggcagggtttgagaagattgactctagttttgaaagaagttctatttgagtaaaatgctatcaaacagcaccacatgctacagagacatctttcatgaaagggagagtgaactgatgcagcaaacttctttgtcttattttaataaaatgttatacccacctcaacctttagcacccaccagtcagcagctatcaatatcaaggcaagaccattcaccaacaacaaaaaaaatgacaactcgctgaaggctcagatgatcattagcaattttcagcaataaagtgtttttaattaaggtatctgcattgatttttttttaagatgaaattttgctcttgtcacccaggctggagtgcagtgctgcaatctcagctcactgcagcctccgcctcccgggttcaagtgattcttctgcctcagcctccttagtggctgggattacaggtgcctagcaccacgcccagctaatttttatatttttggtagagacggggtttcaccatgttggccaggctggtcttgaactcctgacctcaggtgatatgcccgcctcggcctcccaaagtgctgggattacaagtgtgagccaccacgcccagcctgtgcattgattttttagatataatgctactgcacacttaatagactacagtcgagggtaaatataacttttatatgcactgggaaactaaaaaatccatgtaacttgctttactgcagtattcactttattgcagtggtctggaaccaaacccacaatatctccaaaatatgcctgtagtcagtgggacacatgatgcttctttggttgggagatttgtggacatgagtcttgaggaatcttgagaaattgaagaaatgatggaaagacaggctagtcagtggtcagaaggaaaggggtaggtgctgggtaaaagagcaaattgaaacaaagaacaaagagggaggaagagaatttatttatttttatttttatttttttgagactgagtctcactctgttgcccaggttagagtgcagtggcaccatctcagcttgccgcaacatccgcctcccgggttcaagcgattcttgggcctcagcctcccaagtagctgggactacaggcatgcaccaccacacccggctaatttttgtatttttaataaagacagggtttcactatgttggccaggctggtctcgaactcctgacctcgggtgacctgcccgccttggcctcccaaagtgctgggattacaggcatgagccactgtgcctggaaggaatagaatttaaaaagcatttttgaaatgggaagaaacagattttggaggataggagatggaaggaaccagaagaggagaaggtcaccatccaacttactgcattttctggagagtttcgtgtttcttcagcaggtgtaccagcctggtcttggtttggatgcctgtgactcttaccataaggtataaggccttagcctgcacattctcatcactgtccatcaatcccatagccagtggaatagcaaaatgatggttcatgaggcctagcctatccagcgcctcccagggtagttcacggatacgtggattggaatggattgtgtcttgtaggaggcgatgggcagtcttagaaaccaactctgaagatatctggcaagtggcaaaaatacgtttaagtaccctaaaatatctcttgtattcctctacagagcagtaaattgtgaggttgaggatggcctctattaaatcatccataagccttccactatattttcttctcatccaattttggtttgccatgctttcaagaatatcaagggaagttccttttcgcaccttggatttatccttttgttgactccttgaaattttctcttctactagagtcatagatgacaagtcccagtccttaacttggtaggatgaatacagatcacagcataggaagactggggtaccctcaggccaagggcgagcacggatcactgagttggggatggccatcaggagcaaagggccattgccgcccttgaccaaagaagcactgtggcatttggtaggcattgaatccatcccagccagccagctgcaacggagcaggaacctcatgtcggggacgattatacttggaatcaagagtagagaaatcaatatccttatcctccaaaagaggaaatttggtcttttgaatcacaagggacatgcttctctcttcttctacaacatgaggcacagtattgtcaaaagcaatgaaccgtttgttgacaagggtctctagcccctgtaattcctgccgcccttttccaaggtagacaaatctgggtacaaatactgtttcaaacataaagaagaagctaggaaggaagggtttagggacttcttgtatttcatctgcattttttaggatacgcaggtgaaccagctgagctggagggagcagctttaagcaagatactatgtagatacgctggttgaaagtcaacaacaggtcacttcgattactggcaaagcagagtggtccaaaatgcagggctgagtcgaactcggttacaagtctaccgtggaagtcccagatccggactgagccatcaatgccacctgtgacaaaaagtttcaggggaaggcagacatcaaatgaagtgatgtcacactcatgcaggcattttgtctctctccacacaaagctctgttttgattctgaagatgtcagaaagccttcatagtgccagagacaccagcagtagctttcagtgatggcacccacagaacctggcaagagtatcacacgttttagggggcagccacagaggattttgctgacaggctgaaggactaccttgttcacctgaagcacggcctctgtcaagtgtatgatgttatccgtgccataggaacagagcaaggcgtttccctgagggccttccagggtagacaatgccaatactgccccagagtgaacagtcttctctattcgggcacaactatagtgggaaagggttctcacaatgccactctcatgcccacagaacatcaatcctcctaggcctttttgcagatgggacctcccataggccaagcatcttactgtatccttacggtctgctgaagtgcacacaagatacttggctgtacaaggagagcgtgttgcatcaaacaccagcacctctgaactgcctattgccacaaagagttcctctctctctgagtcataggcccaagccaaagccttatccataacaagtagaggccaagtgataaccaggagatcccctgttactggagacaagaagcgcaataaaccatcctcagtggcacatagaatccgagtccagttatggccgcagcagacccgctgcacttgctggggagcagaaccacagacattgaagaggctataaaagtagggcaggtgatgcaatgaaaaactgtaggtggtctggcagaaaaaagtggtattatcaataaactgcagtctctgaagatcctcgtcaatattcagctgccgcagcaagttcccataagtgagattccattccctcactatgccttcactgcctgctgttagtaaggtgtggatctctggccggctatggatacatatcactgatgaggaatgggcttgaaagctgtggaggaagttaccttggtctaaaccccaagcgtggatctctccagccctgtttccagcatagaaattgccctgagagacacaagtaaaggagcaagtgatggaagagccactggcgacaggagtgaacttcacttcttccagctggccctgaccccggtgaatgaagaccctcactgtatcctcacacagagccaacagggatccctgggggccattcagggaaaatccctgtacaagctcatgatcagccataggtactatttgagccatctcgatgcccatgccatttggtaagataaaccaggtaaccacagcccccagggtaccagagagcagcaactcagcttctggatcatagaagaggcagctggtggagaaatgacagggcactgtacccagaaatctgaacgttcgacggtgatctccaaaaagcctcaggcgcatgtcaccacagtaagcaattaacatgtggtaggaacctgtgtggaccattgcttgaatgggcggccactgatccatcatgcgaagcctcatcttctctaccattcctttcatttctgtaccctttttttgtatccaaagtactgcctagaagaggatgagagatgaaagcctgactgtggaggtggatcattttccaaagtgtggggtagggaaggctgaatattcagatccctgttccctctggtgtgactaaggaaagactagacagcttgactttaggaatctcctagtacagcagctcccacttacccatggtttccctttctgtggtttcaactacctgtgtggtcaactgcagtccaaaaatatcaaaagaaaaattccagaaataaacaattcataagttttaaatggcatgctgttctgagtagcaggatgaaatctcaggcagtcccattccatcctgcctgggacttgaattatccctctgtccagcctatctacactacataccctatctgcctgttacgtcacttagtagccattgcagttatcagattaactgtcgcagtatcgctgtgcatgtgttcaagaaaccctcattttatttcataatggtcccaaagcacaagaatagtaatactggcaattcagatatgccacagagatgccacaaaatgcttcctttaagtgaaaaggtgaaggttcttgacttaataaggaaagcaattgtatgctgaggttgctaccatctatagtaagaatgaatcttcttggccgggtgcagtggctcacgcctgtaatcccagcactttgggaggccaaggcgggcggatcacgaggtcaggagttcgagaccagcctgaataacatggtgaaaccctgtctctactaaaaatacaaaaattaatcgggcatggtggtgcgtgcctgtaatcccagctactcaggaggctgaggcaggagaatcactggaacctgggaggcggaggttgcagtgagccaagatcgtgccactgcactccagcctgggcagcagagtgagactctgtctcaaaaataaaaaaaaaaaaaagaatgaatcttctgtgaaattgtgaaggaggaaagacaaattcatgctagttttgctgttgcacctcaagtgcacgcattatggacatagtgcatgatagcacttagttatgagggaaaaagcacaaaatttgtaggtgagccacatgaacacaaacatgttccaattgatggcagtcaggtttggtactatctgcaatttccgatgtccactgggggcttggaatgtatcccccatgaattcgtggggactattatactaggaattgggtatgtgatagaagcaccatgttcaaggcccttttcttggccttcagtctacttgatggagaatatgaattctgagggcctgataacatgaggtgaagaaggatcactgcatccagtcaaactgggatatggagatgggtactaaaatgagctaattcacagtcactaccatcattctaaaatgagggcagttcaggtgtgatgcatgtaaattgaattaagaaggagagggggaaaaacgaggtggctttacctgcatttttccacagggttccatccagtttaaggagacaaaacagttgaccttgatggagtagtagaagcagacaaaaggcttgttctgtggatggtgagactcccggtatagagtctcaggccagtcactcagtagaaccacatcattctttggttcttcatcattctgagagagaagaatgacctgagttaagagttctgagtccccactcattcactcatttcagaaatatttactggccaggtgtggtggcttgcacctgtaatctcaacactttgggaggccaaggcaagcagatagcttgagcctaggagtttgagaccaatctgggcaacacagcaaagccccatctctacaaaaaatacaaaaattagctgggcatggtggtgcatgactgtagtcccagctactcggaaggctaagtaagacaggaggatcgcttgagcccaggaggtcaggccacagtgagccatgactgtagcactgcacgccagcatgggtgacacagcgagaccctgtctcaataagtttaataaataaataaatatttactgagag

SEQ ID NO: 2783 - DNA, 5263 bp, Homo sapiens
gtctcggctcactgcaggctctgcctcccaggttcacacaattctcctgcctcagcctccgaagtagctgggactacaggtgcccgccaccacgcccggctaatttttttgtatttttagtagagatggggtttcaccgtgttaagccaggatggtctcaatctcctgacctcgtgatccgcccacctcggcctcccaaagtgctgagattacaggtgtgagccactgcgcccggccgaattactgcttctttctaaagttatgcctgcttgagtctgaatataaccattttaaagaaaatcaaagaacatccccctccctcccacaaatgcataaatataggtttctctaaaagcctgggtcgcactgactacggctttttggaaatttgtcctctgtccctccatggaagacaaatctagcattttgtaaaaaattaaacagtaacaacaaacaactccctattggctgcttttcacaggatgcctctcccttgaagcagccaccctctttccctaagcgcttattttccctcccctcccctccccttccttccggttgttaaaactttcaccagtgagaggatggtgtactgcagtaaggcaagcacttgcagtgtgtcaggcatttgagatatagggaggagacagtaactatggggcaatgagggtggatggctattgctaagtgccactgatgcctcaagaaggataatgaacatcagagagcaagtaccaggcaactggaagccagatgtggaagcccgaggaccactagttgcatacagagaatctctcatctgcagtggaagggaagagaaagtgaggactaagcccagggcttaatagagtggcagaatttcagacagttaaaacacccaaccaaggcaggtctgatatgtaaggtcaaggacccaattgggaaaacctaacacatgagatggcaatatctgcttggatcccccccaaagacttttacttcctgaacccctcagaacattctgaacctatacatatgcctcccccattccttgctagcactctccattcccaatattacactggcccttcttgtgcaagacaatgtatgcacctttcagagtcctctatgactcagctggggacatgctgggcttgctaagggagaatagggactatactgaactgtaagatgtagtcagcatggactgacaggagctggaggagattctgagagcacttgaagagggggaccagaacataaggtagaagagaggacaatttttgacttgaaagggtttttctaagatacagaatttaactccctagcataagtatcccaggtgttggtgtaaacttgctgctagcatggcttctagaaagctggaaaaagtgatggcccatgttgaacaaagttaaaattccagaatttctatgggagacaatggaggaagggaaggaaaggagaggaaaggagggagggagaccatattgtggggagacagaggaatatagactattgccacatcctatgcctcttctctccactcttgtttaattgaccacttgggcccctgaagaaactggatgggttagggagggtcattgtagaccatcacaagctcaatcaagtataatcccaattgcatgctgccagatgtatcttcattagaccagatctatactgccttaagtatatgggtatacagctgttgatttagtgcaggcattcttttctcttccagtcagaatcagaaacagttcacattttcatggaaatgataatacacattaacagttttgctccaaggccatgctaagtccaaagaagtgtggaccagctggacatccacagaacatcacattgatccattacaacaatgccaccatgttgattgggctggatgagcaagaagtggctagcacactgcagaccttggaaagctatgaacaagaggaacatggtttggaaatgtttgtcccagccaccatgtccagatgaggaaacagaattccatggaagtggaatgaccagcacttggtcccacagctggatgtggcccagccagggctgaagccagacggtggagtctcagcctggactgttcagacttgggtctttccctccatccttcacccaccacacaccttgatttaacccaggaaaaaactttccagtgggccacagaaatggagcagattctgctcggatagagactgcttctgaggttcatctgtgtcttcagcagaatcccccaggctggtggacgcaggagggagcgaggaggcaggagtccccacggacatggctgcacagcctggggccacagggcttccaagagggagccagtctgcagcagaaaagcccagagggcagcttccgcacacacacaagcacagcccccacccccgacactgcagacagggcctcttccggaaggcgctcccccaagctcatgtcccacagcctgggcttgttggaggccatctggcctgcagatgctggtgagcctccatggtgtctgtccccactgtggcagggacaaagtccccaagaggaagagaggacctgactgctcttcagagcttgacacacagcacccccagccagaagctgacctcccacttgtttgaggcagtgttcaaggggctgtccacagcaagagagatgggactgggctccatctccaaagaggcctccctgagccagcacagaggaaggacaaagaaaagattgaaaaaagcagagttggggctctctggtgccattgcgctgcctccattcagctaagatgccctgcctctccttccacctaaagcagcttctgccacttaggagacccccctctccccaaacactgaatggcacgggttggccagcttaggaactccgttgactaagccagaccttcctcctttccgcctgcccctagagtgtgagagggcacagcaagcagctgtcctccctgctggtggtcaccacctccagcactggctctgtttccctttgaacattaattagcaggtgggttctgatttgagagtgaagcattctttgggggtgcccagctgagagcagtggtctggtggagcagcgtgcaggactctctggaaggctcacccgttatagcagagctggaaatgtgatttccaggcctgagtcggatggtgggggagggtcgccctccagcctggtgactggaggtgaattcccggatctcctgggtcttggcttcttcctctgtgaactctgacttgggggttgttgggaggtgatttagtgctgttctaacatatgctggtatctgcccttcacaacgcggggacagaggcggatggcagtgttttcactgctgtccctgtggacatggagggtgctatgtggggagaagtgccacaacccaaaatctcagcacattagtcctgagtggaaaacctcctctgacagtttcttcagcaagcaaagtgcatttctactgtgctgatcaccctcatcccacttgatcatgttcatacccagacctgagctagaccctcaaccaaattagtccccagccaatctgggacctcttggagaccgtagggtaaggaaaagtggtgagggacatagcttacttgagcttaggattcctttggttcctgaaggtaaggagggaaacacttgggctgatggagggcctatttcaggtctcaccaacaaagaagggacaggtgaaataagaatacatgaggccaggcacagtggctcacacctgtaatcccagcattttgggaggccaaggtgggcggatcacttgaggtcaggagttcaagaccagcctggccaacgtggtgaaaccccgtctctactaaaaatacaaaaattagccgggcggtagtgacatgcacctgtaatcccagctactcaggaggctgaggcatgagaattgcaccactgcacttttgagacagagctagaccctgtctcaaaaaaaaaaaaaaaatacatgggccacatgaacaaacaggctctcttcaaatagaagctggttggtcacatcaccccattgacaagatccctgtctagctagagatagccttccgagacacatgaccagcctttgaatcctgggaccgccacttacaactgggggaccttgggcaaaatagttggcctctctaagccccagtttacccatctataaaatagggatgataaaatcaactcttagcgttgccttgtgaatcaggctaagtggtgtaggcagtgttggcccaattccaaaagctcaaggctgtaaccaatgaaaagagcttatggactcatgaaagagacaaagaaacccacccgtcaggagttgcaggcagtgagtgctgttggaacatcagaaatgggtacttcactctggctgggggtgatccgaagcgccccccaggtggggaaggagggaaccatccaggtacgggctgcacatgtgttcatggaactgcaagcagggtgggggatgaaaaggaagcgtgaggtatatacagaatgtgggaggaggtggattgagaagggctcaatgccctgagccaaagctgtgaaccacatttcagtgatcacaagggctacaagctgggaaggcacgatcacctttgggttttagaaaggttatttcgccagctgtaagagaaggaggcagggcaccctgaaggcagggaggccaggtagtaggtggttctgttctgtggtggaggatcctgggctcggaactgaggtagaggcagtggagaggtggctccaagagctgggacttgggcggtgtcactgtggaggctgaaggagagggaatcactcaagttgctggcatgggtggttgatggtaccattcactgggagaggattcagagaagggaaaggtgacccgttcagttcccaacatgtcaaaattgaagtgcccaaacaaatagagatactcagttacacagcacatagtaggaactttataaatacctgttgaatgaatatggttggggtctaggctgcagctcagcagggatggcagcccaaggtgacaaagtacgagtcttcacacacgaggatggacagcgtggagctcttgggttcagaagacgctccttggccaggtgcagtggctcacacctgtaatcccagcactttaggaggccgaggtgggaggattgcttgagcccaggagcttaagaccagtcttgggcaacatggaataaaccctacgtctacaaaaaatacaaaaaaattatctgggtgtggtggcatgcgcctgtagtcccagctactcaag

SEQ ID NO: 2784 - DNA, 3383 bp, Homo sapiens
gccccctcctctgcccacctcacaaggcttaatgatgttctttgtgcttgctgcccatagttcccgtgcatgtgtggaatgcttcattcaaaaaccatgatgctggatggaagctacagtgagtctgaggccaacagcctggctgggtaccccagaagccatatcctgacagaagaagaaagtgttttcctaggggctccaaggctgttcctagaagagggcatagacatcgagggggcctggccagtcattgacagacggacttgttgaccacacgcccctcaccaaacaatgcagcagctactggaccaccctgagcagcactcatctctcagagaagcccaggagccttccagctgccctgaccccagaccccgtggggctgctccatgttcatgctgtctcgcgtcacacttcacatctctctgggaccttctgttcttgtgtgtgaactaattcacaagaactcccctcctataaacaaggattcaaatgcctcctagacattcttagaccctcagattgcctaggagtcagttgtggagggaaaaggaaaaactgaagtacaagcttaggggcattctggataggagataggaaattaagaacaaaaaacaccctgtaaacccattgaacttgattaagtgcctacctagaagggaaaagagctgagatcccagacaggaaatgatttggcctgtgggagtatggcaacccacaggattctgcaatattagaggagattattcatttatccatccattcaaccattcattaaatattgaggtcccactctgtgccaggtacggtagaaatgagaaaatagtctctttccttagagatcttctctaagttgtgctcattctacatatggcatgatgtacttctgctctttcccctccttcaaccccgcttaccccacagacccattctgtttgctgttgcttttactcttaggcatataaggcagggtccaggagaggccaggtccagaactttcaactatcctcctccagtgaagttacacagatagcactaattttgcccagcaatgacatgtagcaatgtgcatggagtattgccagccagagaaacttacccaggctcaccacggtgtacagtttttttattggggtcggtcatggatttatagctgattgcccacatggctgactttagtcttttgcccctccagaggttaagctggtaccttgaggtccagggcacctatcataaatcacattgttggcatagactatctggtgtggcccaaggccccagtagacaaagacccttctatctcacaggacattccaagggcatagaggttgcttcctagtaaaggttagtcctttactacacagcaactcttgtcaattccctattgttaatgttaattgcggtgttactattatatattcaggcaataaacattttaaagtatctctgcactaggtacattggggtccaaattaagaataagagtagtcgaagctctcagagaaggaactagtaaaggaaataccacacaaatatctataatataagattaagagtgtttagtgcctcagtaatagttcagtgtgagatgggaattccaagggaggaaaaacagtcccaccagggagacagacctcatggagaaagcagccctgagatgccccttgaaggtcaggattttaagaagaagaaatggagcagaatgcatcctagatctgggctgtctcatatggtagccactagccacatgtctatttaaatttaaattagtaaaaattaaaaatattagccaggtgtggtggtgtgtgcctggggttctagctactcaggaggctgaggcgggaggattgcttgagcccaggaattccaggctgccgtgagctgtgatcaagccactgcagtccagcctgagtgacagagcgagaccctatctctaaaataataattattattatttaaattagttgaagttaaataaaattgaaaactcagttccttggttacaccatccacactcaagtgggcttagtaagcacagttgctagtagctactgcactgggctgggcagcctaaagaccaggaagctctaccagccaagagaccagcttgagcggacgcatggggagaatgggaaggtttgccattgcagagaacagggtttgtgggcaagtcattcattttggcaggatcctaggctgtgataagaggaggtgagcgactagctttttccacaacactagggatcaaggcaggtccccaccatgccggtgcttatgaggacagcttccccactatggagttgctggacccaagactactagatttcccagtctcacagaccaatgaagaacaaaaatgcataaatatgggtaattgggtggtacagggcatctggacttgtttagaaacctttttttcttttctgagacagagtttcactcttgttgctcaggctggagtgcaatggcttgatcttggctcaccacaacctctgcctcccgggttcaagcaattctcctgcctcagccctggagtagctgggattacaggcatgcgccaccatgcctggctaacttttgtattttttagtagagatggggtttctccatgttagtcagcctggtcttgaactcctgacctcaggtgatccgcctgcctcagcctcccaaagtgctgtgattacaggcgtgagccaccacacccggccagaaaccttttatctatagagactctcccaggccacagtgctgctcgaagaatgataattctattgtcattaaatatatcatattgctttgcttgtaagtcttatttaattccaacccttctctgcttctgactgcattgttttcatgcattatggctcatataacatagttgcctgttcacaaattaaaacaaatatttatttttgctagcttctatgttaaactggagttaattctatagcagacatatttagaatcataaacagtgttttatcatgcagggccatgatacaatgacaccattgtatttagcattgccttattacagtatactagtctgacactacttgagaaaagtaggaaatttaaagaggtaaagtggagacaacattggtaggagtagaaaacaggaactaaggaaatagtgagaacatgggatgattcaccctggaggcaggaagacagagaagcaaacacaattgttatcaggaatgcatgaatgatactttacttcactgaatctaagacatggtgaaatgtaagatgcacccatattttatgtactgagaaaaaatactaacaatcaaattctggaatgccaatgattataatatgaatcctgatttcaccaatatgaaactgtgaaaaaatgttaatgttacaataaaagaaat

SEQ ID NO: 2785 - DNA, 3525 bp, Homo sapiens
agaactgcagatagtacagcttccacaggagcaagggatgtctgagcacaagtggctgagttccgagtgactttatgaagcactttctaccttcctctccggcatgaaaacagggattctgcacctgcatcatggacagtctggcaaaagcctctgctctgcctccggggacaagaaactagagcaaataaccgttttgaaattagatcctggcaaaattaccaacaatcaatgatggaaactgaagggagattgatttaaatcttcaatgacagttgtacagaagttgaagaaacacgtcatctttccaaagaagagtgagtagcttggttggtggtaccctaaaattagggcatgattaaggtacgtcatttcttttagttcaatcaaagtgctttgctgtttccatttcagagaatttcttattctttttttcaatttctctctcttcctcttcttcctctcattagtagatgtcttttataattgatgtcatttactgtcctttcatcaaatgtatgccacatcacttaggcgaaccagcagacagggcaccaaaatacacattagaggagactggcttccatgagacgcttcgactgtctcatcggggcacttgtaataagcatcttggtgccactgaatgcaatgctgtattcaaataatagctttcatcttcactctttttaaatataaaagtaaaccttgaagccctttgaaggacctaaccaaacaacatacctatgaaaatagatcagtaaggctttgagaaacattcttaagtaaaatctgtaaagcatctttgcattttttttcaagaaagacctccaggtaaatgatggcttttaataagacacatgacaatctcaattacaagaatcattagtgtgtgtcctgtgcgccattttatgttcccagcaggatatatcttttctcgtctagggtttccagggctgtctactgttctctatgtgtaaaacgtatttaagtgttcccccaatgctgcactaatgttgaaacaaaacaaaacaaaaacgaagaaacctttgtcaagtggtcagacagactggaactagaggattataggtaagagagataaaatgaagggttgaaagctataatttctatttatgtggtggcaaccaaatcagctgttggagtcaggcaatttaaagatgtggctactggagctcagagtctgggaagaagacacttctgcgtctgacagtgaatcaggctcccagttttgaagatgtgctgtaggtagttctcgctgaatccatttcccagttggtttctattccccgccccattcctgtgtccccacactttccacttgattttacctctttgacaattctatattttactttccttcctctcattccccttttcccaccccctttttttactgtagttcttggcctctgactactgttccatgctggatgtccccagaaaatagagtatgtttagaaaggagacagtgcatctcagaagggcctccccagtccactagtccattttttaatgtgttgtgctctatgggtgtcaggaatatttgtagatgaagtaatttgtggcatgaattttgatagaagcaggatcaccaacaaaatgataaatgtaggtacctgtctaccttgcataatattcactatgatcttgagaatttcaatgtataatttgtctttattcttatttttcattagaattaacagaatctcagagctggtagaaagtatagaaactgtatatacaactctcatattcagatgaagaaaatgatgcacaaaaaatcaactgtcctaagccattcagcttgtctataagtgctgttggcttaattatagttttgcatatatttaggcaaagaaaatactttctcagaaactggttaggactgtttgagaagaaatataatcatcaaaatatatacacagtaaaatgtaaccgtccatcattcaacataggcaagaatatatattgaattgcctgagtgtattattcgtatagcaaaacttacttgaatttctaataaatcttctgacctctgtatatgtataaaatatataaaccaaccaaattctgtacataaatatatttttggataccagtacaatccctatttcacttttgtgtattccagttatttattactcacagttctgtagttttaaccagaacaaagggattacccagaagaaaagaagacccagcattgttcactgaggatagatgtgggatcagttcctttcaggtattaattgtaatgttgctaaacatattaccatgaatctgtagtatcaaaattcagatattaaacttgggaggatttatagtccaacttgtagtaactaaataataaaatggtggcatgattatagttcaatttttttctttatgaagagcttagggtaacaatgctttgttcctgtatgttgcacttttaaattacagtaaagtgtttccctgaaaacaaataatatggcatgcaataaaggggaaaagtggatatgagaacttatccttgccagtatatttgaaatgtgactaaacatttttacagtgaatatgttcatattgaaaagaaattacaatttcctttaaccaagtactgggtcactatttcttccaacttagttattgaagaaacactcagctaccatagatttgctaggccgaagtttctcaaactttagctgtgtcagcattacttggggggttaattggaatgcatattgctgggcttgatgatcagagtttctgagaacttgtgttcctaacaagttctccggcgatgcagtagtatagagaggcattgttctggagacatgcttaattttaggtacaacttattttgacttgagaactttctctttattaaaatagcaaaggcggtgtagatgaaaataaataaattgtattcatttgggttttctcatttgcaacagaccacatcagcattaccactggaaagaatgacttaggagagtggttgttttaatgagagattctttacatgccattgaaagacaggaaaccttaaaagaaaaacaaaactgataatcaactcctaaatggggatttgaattagctaaaatcttttttttttcaaatgcctactacaaagtcaaagttcattctcctagactagcaaatacttttttatcaatatttgtttatattttcccataattatccttatttcacctgccacaaaagaattaatcattttatgtcctcagtcttcagccctccctaaagtacccaatagctcttgtccttctataagtcatcacctacgtgtactttaagaccccgctaattcaataattttatttaaacgttgataggattctattaaatttaaggtatattattaattaaactagaggacatctgctgtagtgaataaattatccatgatttaaaagcaaaattcaaaggtagacaaggccacctgcggccatagaggctgtgtaacttcagaaagaacacttatgagttaatgataggaatggc

SEQ ID NO: 2786 - DNA, 5802 bp, Homo sapiens
caaatgtctttagtcccaaatgtcttcctcgctacacaatgaaccagttcccctccagctcgccgccaacccaggacgcagcccggctcagagtgacccccagtgggcagtgaagatgagatcctctacatccttagggcagctcagagggccactcagcggccaagtccggccggggagggccgagggctctgtttgaggtcaccctggagaccggcctcagagtccagggagagtgcgcgggcggccgccggctgaatgaagcctgggacgcgggagccgcgccgcgcgcagtgtctgcagtgccggaggtctgggaggctccgggcgaagcctccctgctgcaggttatgatgatgtcagacaatgctaaaggcagagcagctcattcatggaagaaaagagggagtatttcttctctaagtaatcatgaattttggcgaaaggaaattcatgggcgcatcaaagattctatgagtactgtgtcttatatggaagaacccagtcagcgtgatgatatctctcgccttacagttcagatggaaaacacctatcagttgggtgtgttcttttatctctcactcctattttaaacttctaaattggtgactgattctcttaaaaatgatatttgataacctggcattgtcttcaattctagcacaatataagggactttaatgaattgagtgatttgatgttgctttagtttcttcctcagcaaaaaggtaacaacacttgctgtcttacttttctttactaatgtttcccaaatgccaaacaattcactgggtggcactgatgcatacagtatactactgacttaacaaattcactgagtatttctgggtacatagatatgacttaaatgaaagagataagtattgatattttatccaacaaaaccaatcagtgttgttaggtgaaggaaaaaaaaaaactcaaagcaaaggcaaatgactcatagtcccctgttgacagagacgtttatccattaccactgaggttttgagtctttgaaaacaaagatctttgcacctgccgctatactcccaggtggagtccgtggcaaatatcttttcccatccatgtttcctcatagacccacttgttttctctaaaagcgtacctgcccactattacctgaattcatacataattactgctatatggaaattccacagagatttaccaaggggcaaagaaagactctatgggccaaggtgattccatctgtggccagttaaccccaagaaaattatagaccatcagcctgtcccctctggccttgtagccagttttctacaggagtccccaagactacatggattacacggctccataattagccaatctactggtattttcacagtgcctgtggtggacagctaatattcctgccatccaatatacttttatacttctctggtaacctcactaaatttcctttgaaattccaccaacatcaccacttttgatcctagcattctaatgaagctggcactggctttatagatagagcagtgactgattctaggatggcatataaccatggtgaatccaatcaaagactttgagattaaattcagaaaatgttgtttggcctgttgcagaagaacataaagccctgaaacttgaaggaatgtaggggctctggcaggatctgccaccttgccctgacttgaaactgagagaaaacaacagaatcctggtgtcatcatttgagtcctaaatccaattggctaccctttaacttttcagttaggcaagctaagtttgggtcaggttttccctcacttgcaactaaaagttcttagccatggggtgtctatgactttgaactgtgcatgctggaagggtttgaatcagatttgaacaagacagggccagtgaaatgtgaatctctgtgtttctacataaggatattttttgcaacttgttttctcaaataaagcatcttatcagttttagaagtactgagtatgaaccacattagaaaagtaattttagaaaaagcttagtatagatgaaatatacctgtattttcctacaatagtctatgtgaattttttaataattaaaatattttatgcttgacaattccctttttatagcattcaaccagccattttattaatacttaatcaaaactgtgtttccacttctacttgtttctgggtttatttcacatatgaaaggtattttgtgagtgtattagtccgtttttgcattgctataaagaaatacctgagactgtaatttataaagaaaacaggtttatttggctcatggttctagagactatacaggaaacgtggtgccaacatctgcttctggtaagacctcagtaagcttttaggcatggcagaagggaaggagagttggcatgtcacatggcaagagagggaacaagagaggtgccaggctgttttaaacacccagctctcatgtgaactaatagaggaagaactatagagcaagaactcagtaattaccgctgggacagcaccaagccattcatgagggatccaccttcctggccccaacacctcccaccaggccccacctccaacactggggatcacatttcaatatgagatttgaaggggacaaatatccaaactatatcagtgggactttggtaaatagtttatcatatctttacaatgtaatactggccagaaaagtagagggaaatatcagccaatcaccagcactattatgtttaattaatttttcattccattcaataatgtttgcctcatctaaacacatcttaaatgagagcatttacataaataattacagctacaaaaaatgagatgaaacatgagtatcattcatgagaggagaaaagggaatagaaaaggaaagtgtgtttcttttaataaaataccatttatatatttctcattaattactaaaacaaatataaaagaaaatgcaggctgtggcatctgtcgtatctgaatttgaatactaattttgctaattccttgagcaaggtatttagcatcattgaatctcagtgtcttcacttgtaaatagggataatagtctatacatcacatggatgctatgagactcaaatgatgttatatgtttaaatctctccattcatcatgttactactcctgaaagtgactgactcaaggaccttactatagatcactaagaataaaagccttccatgatattcattgtaacttcatattaattatggaataagttttccacaggactttttctggaactgagtatagtggcacctggttgtttgcaaacatggactgcgagcaccgagccaaactagattggcggccatctttgctaccacatcaagacagcctgccttgagaatgaagccagcacagtagaaagtagatccaaaatattgagagagaaagagagagattatttgagttcagcttccatgaagtgctcaggccctgtctctatgtcaggttttcttagagcctgtcaatctctcagcattgattttacaccaccacatggggtccttcctaatcccacaggcctcactgtctccagacttacgtcctctttcatcttgctgccttctcagcaaggtaaatccccaattcttccttcagcatgcaataactacaataacagcaataacactaataagatcacatatctaaggagtgttttattgtgtgacaagcactgttctaaacatattcaatttattgtctcatttaattctaacaaaaaaaaatgtagtaattattattattaccccaatgtggggtagtggaggcccacatacattaagtaaacttatctttatctactttttaaggacaagttttgtttgtttttaaaattttttttgtcttgatccttcaggtctttgccttttgatttctaaaacacgttttttctcctaaggaaaaaaaaaatctcgagaaagaagaaaagctttgccattcacatcagtttactctgaaactagttttaggagcttatttcagaagtcagaaactgaacattgatggatgattctggatgtttaggggaaaggtaacaaagaagtaagaaaagaatacttcattaccatatttcaaagtattttcaaaacaggatctggttaatgactttttttttaatctaagcgaagtatggaaaggacattggtagcactgtacaacgggaactactggaaacagactcaagtgccaccaggaccctctttccagcactaacctatgtgcactttcttctcttttggtggcctggcctccttaccaccatgaaaaacatgtcctccagcaggtcctcagagtcacatggtaacttttgccaccagaaagaggctgactcttttttcctacttgcagtttaaaataaaaattccaaaaaaagactctcattgtcctggcctagagcattgtcaccctgggttaatcaaccatgccctaggcttgggttcgcaggagatgatggggagatctttaagaaccactttctagattcaatctccacccccacccttccacgatttaagtggaattcaacaatttctatattatcatcaaaataaaaataacgatttatagaacctcaagaggctcacctaactgaactgcagtcagaggctgtaaccttctggttaagttcagccagtgggaaacctcagctgagaggcagagggagtgagaagtgtgaggtggagctgtttatttccctggctcctgcctgtgagttcatcacagcctggttacattcttcaaccaaaggacagaaactgctcccaagggagccctctccacatgacccttctgggatctattaaaagctcttcctctattccccaatcttggggtgggaggggtgggctgacaaccttactttcactggctgaggggtgctgcactatcccttgtgattttctacagcccactcagaacttcctcctggaattattttaactatagggtgccatatgtttcatttgaccctgacagatacagtcatcacaaacaaacacttattactagatattgacatatattaaaagagaattgaatagaattcttgatctcattccttcatctttatcaattcaacaaataatgactgggcttctgtatgccaggccctgggcacatgttcatgtcatgcaatgacattagtatatgaccaaagtgatgatatggctaatattcctgggatgcaggaggaagaagattcatttgaagcttctcctctgaacgtggatgaaatgtggtcgagaatataagctctagcatcagataaacctgggtgtgcaccccagctctgcctctctgtgtgattctgggcaggttactcaatgtatataaatctctgtttccccacctgccaaatggagataacagtgagattcacctcagagatctattggaagactatataaggtaatatgaagtgcttatcgcactgcctgacatgtagcaacggcttaataaaaagtattcattattatatatgtatacaatatacagtcatatatcatatataatgattatctataaaatttaattctatttaaattcagaaatcatacattaaaaatttcttatgcctttagcattgtattagactctgaggaggataaaatccgagcttgcttaccatttcactggaaacgcaggtcctcccaaacattttcctgtggtcaccgtcaatcatattttgaaagatgtagtaaccagctatctacaagtagaagaatatgaaccagagctctgtagacagatgactaaaaccatttctgaggtacgtgtgtgatttgcc

SEQ ID NO: 2787 - DNA, 15929 bp, Homo sapiens
agggtggctaatctgatggtgagatcctgaaaaaagagaataaatgttttcatcctgctttctttaacccatgaaggtgcaggaagagattgacttcattctccatagaaggcctagctggctctgtggcacaatggaaagtgcattgtctataggaggccttgtgtacatacacatgtgcactcacacatgggggagagcctataatctttgctgacaacagcatgcagtgtataaatctctgtagctcagacccagaacctgaaaaatttagacctaacattactttggcccagtaagaatgttagctggaaattagtttatagcccaggagctattttttaaagatctgtaggcttactagccatgacaatgatgacaataatgatgatgaaaatgacatcatcattaccaatagctactgccatctattgatcccataacatgtgatcatatctctgtcctcagaacaatccatttcacagatgaagaaacagactcagtgagcacgtgatcacttctcacaactaatggagccaagattctgtccttatggctccagagacctcttttttttcccactgtaccacaacactcaccaggactggagtgccacctatgacctcattgcataatggatggcttgtcctcaaatgggcccgggtccaaaaaagccccaggctcagccagagcagggcagaggacagatgacggaggacagatggcctgctgcagtgaggaactactctctcttctgagagcttcagagacctgcagagacatagggactaccagctgcagagagaagtaactttctcgagggcctcctttctggtgagagcagcagatgtcaggatgatgaccaatagcagagaggagctaccctctccagggcctcctctctgcttgagagctgagcactcaatgggaagatctgcttacagagaagatgatctgcctacagagaggagctatgcactaagggtttcctctgagctgttctaacacttagtaaagctttctttgtcttgttcacccttcacttgtttgcatacctcattcttctagaggcaagacaggaactaaggcaaagatgccaccagccacagaggtttctggccagaaaatcaataccccaaagatcctgtaacagtgcaagaaggagaaaagtgttctatagttttatatctcagtcttttagtgagcctgtgtctctaaactgtgaacttcaaacagagcttctcgacccccccaacactccccttaggcaggacaagatggctagaatgaactgaagttgagtatttctcttcccctatgtagaaggctaaggcatgctggagcatgctatttcctttcttccaggttggttaggctctgataaaatcccaatagtttaggctctgataaaatagtttctcctgaggccaggcctttttgactagaagagaatgatctgacttacttcaaatagttcctcctccctctcctcaccagaagaacaagatcttttttttttttttctgatattcactgtgagaacctagttgaactcctgaaaccagaactcacaaaagtgggaggccctcctttgaatgggtccccctggactgtttaactctcatacttatttactgtgaatgcccagcaattcatcaattacagttcaggtttttctaccccatactggttcccacaaaggtttctgctcaagggtttctgctgcagtaatttgtgattctaagtattttcttgtcagtctttccaatttaaggggcagtaaacctcacttctctgatggatctaagagttgttaattaatcagtttgttcagccttttatttgttgttaggatgtagtgacaacttccaagctccttacgtactggattgcaaaccagaagtcaaactattccttagaaatgaaggggaagtaaagtcattttcagatgacaggatactaaaagaatatgtcaccagaagacttgcccttaaggaatgactaaagcaagtgctcagaacagaaaggaaataataacaaaagacttcaggacctcaggaagaaagaaagaaaagtggatatgaccataaaatgtaatcaattatttaaacaaaagtaataacaatgtagcgtgatgttaacatgtatgtaagtaaaatgaatgacaacaataatataaaggtcagaaggggagaaatggaagtatcctgttgtaagtttcttatgctatacgcgaactggtataatatcatttgaaggtaggctataataagttaaagatgtgttctgttaatcctaagaaatatgaaaataacacaataacaaagagttacagcaaataagacaacaaaagagataaagttggatcataaaaataatcaatttgaaaaaagtcagggaaaaacagaaaaaagagcaaaaacatatgggataaattgagaaaaacagtgagatgacaggaattaaacctaactatatgaataattacattaaatgtaaatggcctaaacaacaccagtaaaaggcaatttgtcaaattagattttttaaaatgctaatccaactatgtgctttttaccaacacaaaaaggcactttaaatgtaaagacataactatgttaaagaaaaaggatgggaaaaagatacaatgtaaagactaacaaagaatctagagtggctatattaatataaaagtggatttcaagcaaagaatattatcaagcataaagaagaacatttaaaaatgttaaagggatcaacttgtcaagagaccataataatcctaaatgtttatgcacctaataacagagctccaaagtacataaaacagaaatcaataaaactataaggagaaattaacaaatacagatataaattagatattttaatacctctctctcaataattgatagaatgagtaaagaaaaagatcaccaaggatatagatgacttgaacaacactactaataaaatatacctacttggcatttatagaacacgtcatgcagaaatagcagaatacacattgtttacaagggcacgtgaaacatttttcaagatatattctatattctgagccataaacaatgcataatacatttaaaaggattcaagtcaaacaaagtatgttttcggagcaatctgtaattaaaatagaattctttagcagaaatctatctggaaaattcccaaaggtttggaaacaaagtaatgtgtttgtcaataaccaggggtaaaataagaaatcaaaaggaaaattagaaaatatcttgaaaaataatcaaatgagaacacaatatatcaacaatagtggaatgccacttcagcaatatgtagaaggaaatatacagcactggatttctactttagaaaaaagaaaacatctcaagccaatgacctcatcttccactttaaaaattagaaaagaagagcaaattaagccaaagtaagcattaaaagggaaataataaagatcagaatgaaaaatcaataaaatagcagacagaaaaaaatagaaaaaatcaataaaaccaaaagctagttctttgaatagatcaataaaatttaaaaacctctaggtgtattgatttaaaaaattacttaagacacaaattcatcaatattaggatttataaaggtgggatcactcagattctacagatattaaaaggataataaggaagtattgtaaacttttatgcctataaattttaaaacttagataaaatggataaattcctggcaaggcacaatctaccagagcccactcaaaaagaaagaaagaacccagacaatcctctatttacggaataaattgaatgtttagtttaaaatgtatgcatgaagaaaattcccggttgacatggcttcactagtgaactctaccaaacattaagagaaggaaaaataacaatccttacaaacgttttctgaaaattgaagagatgagaataattccaaattattttatgagcctattattgctctgattttaaagtgaaacaaagaaaactatagatgaataactaactctcatgaacataaatgcaacatttctaaagaaatttagcaaatctaatccaacaatatgtaaaaaggataaaacatggtgaacaagaagggtttatcccgggaatacattgattgggttttgatgttcaaaacccaatcaatgtaaatcactattaactacaaaataaaagcaatatgatcatctaaatagatgtagaaaaaaaatctgaaaaaaacccaacacccattcctgattaaaaactattagaaaactaggaatagaaaagcattttctcaaccaattgaacaattgaagggtagctatgaaaaacctacagctaatatcatatttcatgataaaagatggagttttcttactctaaattcaagaatcagggaaaagtgtctgctctcaccactctatttaacagtgctggaaatattagccagcaaaacagataaagaaaaataaataaatggcatagactggaaagattcatagttggcacaattatgtatatataaaatcctcaggaatgtacactttacatactagaatttaaaagtaagtttagcaactgtgttagttcgttttcatgctgctgataaagacatacctgagactggacaatttacaaaagaaaggtttattggacctatagttccacatgtctggggaggcctcacaatcatggcggcaggcaaggaggggcaagtcacatcttatgtggatggcaacaggcaaagagagagcttgtgcagggaaactcctgtttttaaaaccaccagatctcatgacacccattcactgtcaggagaacagcatgggaaagacccacccccatgattcaattgtctcccacaaggcccctcccataccacatgggaattatgggagctacaagatgagatttgggtggggacacagagccaaaccacatcagcaacatgtcagaacacagaaaaaatgtaaaatatcactgtatttctatgtactagtagtgaactgtcagatgttaaaattcaattgcttagaatggcatcaaaaatatgaaatactggccaggcgttatggctcttgcctgtactcccattgctttggaaggctgaggcgggtggatacctttgaggccaggagttcaagaccatcctgagcaacagggcaaaaccttgtctctactaaaaatacaaaaaattagctgggcatggtggcctgtacctataatcccagctacttgggaggctgagacacaacaatcacttgaacctgggatgcagaggttgcagggagctgagattgaaccactgtactccagcctggggaacaaactgagactctgtctcaaaaaaaaagaaagaaatacttatgggtaaatctgacaaaataagtgtaagacctgtacactaaaaactacaaaacattgctgaaataaattaaagaagacctaaataatcggagagatatactttgtttaaaggtcagaagtctcagtattgctaaaatgagaactcttcccaatgcagtgctaatcaaatttctagcaggctttttgtagaaattgaaaagcagatttgaaattcatatggaagtgcgaacaaaaccaaaagagccaatataactttaaaaaagagaaaagatgaagttctaaaactatctgctttcaagatttattataaagctacaagtgatcaaaatattctagtactagcagcaagatagaggaaaagatcaatgaaccaaatagaaagtccagaaatagacacactcaaaaatatggacaactgattttggacaatattgcaaaagcaattcaatgaagaaaggatagccttttcaacaaacagtactggaagagttagattcctgtatgcagaaacagacaaaaacaatgaacttggatgcaaacgtgcattatataaaaagaagtgattcaaatggattgcagatctcaatgtaaaatctaaaactataaacctttagaagaaaacataaaagaaaatcttcatgaccttgggttaggcagagtttttaggtatgacaccaaacacacagtccataaaaaataaattgataaattagactttatcaaaatttaaaattttcattctttgaaagatactctgaagagattgaaaaaataagccacagattgggagaaaatgtttgccaagaatacacatctgataatgcacttatatccagaatatatgaagaattcttaaaactcaataataagaaaatagccccattaaaaataaaataggcaaaggatttcaacagacatttccccaaagaagatatatggatggtaataagcacatgagaagatgtcagcatcattagggaagttcaaattaaaaccaccatgtgataccactacatgtattttagaattgctaaaattaagaagactgaccatatggggtgaggatatggaggaaatgaaattctcatacaatgctattggtaatgtaaaatcaaactaccactttggaaaacagattaaagtttcgtgaaaagttaaacatgcacctaccacatgtcccagcctctcagttctaccagaaaagaaagcagatatccatacagagatttgtacaccaatgttcatggtacatttattggtaaatagccccaaactggagacaactcaaaagttcatcaacagatgaatggataaacaaattgtgatatatccatacaatggactattactcagtaaaaaagaaaaaaaagaaaataatagtaatggataatcacaacatgcataaatctcaaaaataattatattaagtaaaacaaaccagtcaaaaaagaccatatactctttattccattttaataaaactatagaaaatgaaaatctttggtgatataaaacaaactagtagtgaggaagagaggcttgggagggaaattataaattacatgaagcaacttttgggagtgatagaaatatttactatattgattgttatgatggtttcatggatatatacatatgcaaaaacatatctacacttcaaatatgtggaatttttgtaggttatttatacagcaataagcctgctcaaaaaagtaaatcgagcaatggagggtaccaagattttacttgcatatgactgttctctatctagcctgcaaacaggtgcacacaaaatctgcaactttaactggagcttgccaggcaacacctctgcaacattatgcaaatcactgtgagaaagagacaataattatgtcaaaaaccaccaaaatatgtttgtttccacacactttttttaaaattcccagatctgggctgtctacagtatgtgcctgccagttaacctaacttggggcttttcactttggtttaaagaatctgaaattgagctctgctcaagttaagtgcatgtggtgattcatgtgcatggaaagtaccttgggctgaccacaaactagagttccctacaactacatcaatgtcaaaactaaccactgtctcctagcttgtttgtttaaaaaaaaaaatcccatggtcttcaatttggtcatttaaaaataatctacaaggtatactgtttttctgttcttgttatttcctaacttttaaggtttctatttttccaccctgtagatcttgttctcactagagaataatttctacattatgcccaggttcttctgagctatgaaggggcccagatttaagggctatttttgacaccctaaatgtgctgagacaagtcattaaggtggtcctgccaggacacagccatctaaagcagcaatctgcttcttgccagaaaatctcgtgcctctgcagagccttttccagaatgaaccacaccatgctgaggtagggtagaaggggcagtacaccaataggcctgggtattctagaacaataggcctagaacttctcatcagctcctgtttcttttcatctctaggaaaggagaaagagactacctactgcatttctgtcactcgctgaaaaggacactctgtcagaaaatcttctagcaaacttcaaagggcaaaatcaccccttgttactgataaagcccagagagcttcagcagctaacattccctggacagggcacagcaaggatttgaacctaggtcagtctggccagaacacccacaagctttccttaactcagtgtgctatctccccacgactaggtcactactgctttataatcacctttgtagccaccagtggattttgctcatcagtatttttcaggcaattgatactttagatattcagctgcaagacgtatgcagttttcattgacatcttttggagaaactgacaaacctggacttgacttaatgcctttggaaccttccaagatgttatataactctagatagaaggctgggcctccatgatgtcaggaatgttgcattcttatttccccatagataaacccatttgtccacaaagtcaaggagtcaggcagaggcccttgccatggggctttttaggataaagcaacaagcctggactttgctctacaacagggttttgcatagggagtggtatgaccagatccctcaagaaagaaagcttagagaccaggccagagtccactgcagtagcccagtcaagagaggatggtgacttggacttgtagtagagccagttagaatgaaagaaattgacacattcagaaatggttttagagatagagtcaaactggacctgataaagaactagagaagcggagtgaggataaagagaagagccatgactgactcggaagattttgtcttgaaaaacttgagaactcaagacagagtgaaataaaatcacatgtgggaaaaatctcctgctttgttttggactactttgaagtgaaatgcctgttaagcctaagtggggtaggtcatggcgtacatgactgtgggctcaggatggatacaggcattcaggagttgtgagcaaatagaacttaaagccatgagagaagaagggatcaccaagagagacagtgtggcatagagaagaaaaggggtggaagacgatccctgggcagaaaagtccttagagcagaggcaacaggcatgaccaagaagactaagaaagaacattcagtacagcaggaggagagcaaaaaatgtgtggtattctagaagcaaagagaataaagggcttcaggaaggagcagtcaagtgtgtcaaataagataaagacagacaagtcccctggattgggtaggaataaaataacaacagactgccatacaaatggttctatctacaccatctaaaagaatatagtttattctccatacatttaagaaacacctgccatatgccaggtatcctttcaagcactgaaatgcagattcataaaacatggtctctgctctcaaggagctcacagtggtaaggaggaaacaggcaatagcgagtgttctcattgcattcgtgaccccattgatcttgcaacagccccatgcatcagttattgccattataccattttaccgataaggaaactgtggcagggaggggtcaagcaccttgggtatttgacagcaaaaccaaggcttggtggtatcataaaacttccaagtagtaattcacaaaggtgactgggaaatggaagtgaccagaaatctttgcactatgaggacaagttcatgaccctgatacattcttgtccaggtagtatagctccagaccaaatgtctgcggccacccacccaaaaacttgttggataaaaatgactacacctatagtcaaatgatttttgacaaaggtgccaaacagttagataggaaaaagaaagttattttcaataaatgttgctggagcaaccagatatccatatggaaaaaaaatcttgaccacctacctcacaccaaacactaatattaacttgagatggatcataaacctaagtctgaaaactaatagtaaagttcttgagaagagaacatgggagaatgtcttcatgatgttcaggtaggcaaagatattttaagacacaaaaaagcaataagcataaaatttgtaaagaggtgactggggctttatcaaaattaaaatttatgtgtattaaaagacatcatgaataaagggaaaagggcagccacagactgggagaaactctttactatacatatacctaactgaggctcatatccagattatatgaagaactccttcatactgatacctagggtcttgattgcatgccccgaaatcagttgattcttcccttttgaaatgcattcccacaaggatccagcctttgggaagccatgcaagtagaggcagaagttgtttcagcttcggaaagggccactctgctgaggagtgtccttgaccggcagagagaagatgttcctgcagccatgctgattccagggggatatagaatttggggcctgggaatgtttaaaaatgaaagccagttaatagttttatttttcttttaacatgacagacaggagaacaaccagcaggactccaggcttaccctgacatttttgtcaagtatatgcgggttctccagagagccagaatcaaaagatgtgtgtatatacagccatgtgttgcataacaacaaagatacattctgtgaaatgtgtccttaggcaatttcatcgttgtgcaaacatcatagggtgtatttgcacacacctagatggcatagcctaccacacacctggactatgtggtatagcttgtcactcctaggctttgtacagcatgctactatactgaatactgtaggcaattataacacaatggtaggtatatatgtctatgtagacatatctaacatagaaaaggtacagtaacaatacagtataaaaagtgaaaattgcacacttatatagggcacttccaatcaatggagcttgtagaactggaagttgctctgggcgagtccgtgagcaactaagacattacactgtgcgcttaggctacactaaatttctaaaaatattttttaaaatatataagttagccttagcttactgtaacttttttacttcataaactttaaacttctttttaacattttgactcttttgtaataacacttagcttaaaacaaaatcacactgtaaagctctacgaaaatattgtctttctctatatccctattctataagcttttttctatttagaaattttttatttttaaattttaaacctttttgttgaaaactaagacataaacacacattagcataggcctacacagggtcaggatcatcagtatcagtatcttccgcctccacatctcgtcccactggagggtcttcagggatgataacatgcacggagctgtcatctcctatgatagcaacgcctttttctggaacaccgcctgaaggacctgactgaggatcttcttgaggaggtgtcactcttttcagaaatatgtccatagcatcttgcttagttgtttctttttttcatcacagatttgtttgtaaacagataatgcaccacgaacattcctctctattaataaaaacctttcagtgtcgggggtcactttcaaactttttaaagaaaaagttgaggtctgcaaaagcttctgccaaatgcttcactgtgaattttctcaggggttcttcttttcttctcctgcagtttcttttctcttgcctctcttcagctatggattctggttccagttcctacaactcattagtcagtttctcaggaaccgttgtttgctgtctcaaccacagccttgttgagtaatatgctgtcctgtgatattgtgatggctatgaaatcactaggtgataggaattttattatattataataatatattatatattataattataatatataatttatatatagaatatataatatattatgctattataatctcatgagaccaccatcagatatgtgatcctttattgaccaaaacattgttatgcagtgtgtgactgtatatataggtatatgaagaaatttatattaaggaatcggttcacatgattatggaggctgacaagtccaaaatctgcagggtgggctggcaacctggagacccaggaagagtcaatgttgcagttcaagtctgaaggccataggctgcagaatcccctcttgcttaatcttctgttttattcagtctttcaactgattggatgaggcccatcctcattatgagggtgatctgctttactcaaagcccatccatttcaatgtaaaaatctcatccaaaaacacctacagaaacatctggaataatgtttggccacatgtctagacactgtagcccagccaaagtgacgcttaaaatgaaccatcacaccaattgtgctattgacctgtacccactgaggtgagacatgatcagagactgggcaattttcacagtttggacacagctatgagcaacatagcagtgattcagcaagctcacaatagctttaccaggcagcaaattgaagcagattacagctactaggaaagacgcttctcattttgtgagatgtgctcccgtggctgaaagattgtgtgaattaggtagattgagggaagggccaattgatttagagtactgcaatcaagacaactggatagcctagtgatgccagctcagaaaaagaatagtaaagtatagtgaaaacaaaaattcaatttaacctggttctagcagaacaccagcaaataaggaaaacaaacaaacaaacaaacaaacaaacaaaaaacagctgcagagaaaactcaagaagccccatagagagggtactttgggatctgatgcatgcttgctgatggtgcccatccatcctgtctctgctggacgcctaacagtgttcctcacctgcactgtaggtgtccaatgcatgctaagtaaaagtgatattaagagctgcgtgccaaatttcatttcacattatatctcagaatttcttttagtttttctggaaatgtaactactataatggaccttacaaatgcacaaatggggccgggtgctgtggctcatgcctgtaatcccagcattttgggaggccgaggtgggtggatcacttgaagtcagaagtttgagaccagcctggccaacatgaagaaactgtgtctctactaaaactacaaaaattagccggacttggtggtaggcacctgtaatcccagctactcaggatgctgaagcaggagaatcacttgaacctgggaggcagaggctgaggtgagctgagatcacaccaatgcactccagcccaggcaacagagagactctgtctcaaaaaaaaaaaaaaaaaaagcacaaatggtattctgtatctgaaaattgtttggattaacttttgattcttgcctggttaaagaattacaattcttacctcagatcatgcttaaactatcttatttcttctcatcacaataaaataaattagtgtcatttttatacttgattgcctcaaggatattttaacacaattttgtttcttatcttttgtaccactcatttgaaaacttatggtcttaatgcaaataatctgaaagtaataaaagtataactcctagtaatttccatattgctgcctgtagaaaagttataaacatcccaatttattctggcaagaaaaaaatttttagtaagcaaaagccttgactgaccaagtgcttcacaaaagaggatatctaaatggccaataagcacatgaaaatgttctcaaaccattatttatcaaggaaatgcaaattaaaaccacaacaagataccataacacacccacttaagtgtctaaagagactgaccataccaaatgttggcaagtagacaaagcaattggagctctcactgctggtagaaatgcaaaatgatacagtaacattggacaaatgtttgggattttctagcaaaattaaacattcacctctcagatcacccaggaattctactcctaggtttttctcaaggagaagttaagtgcaaatatccatcaaaatgctcataaattttatttgtaatagctaaaaacaagacacaactcaaatacctattaaatgtttatctagacacaatccaaatgtaatacagtcatgctctgcacaatcatggtcccatgaaattataatggaaggaaaaattcctatcacccaagtgcacactgtttataaagtccacagcggtgtacaataacatcctaggctttcacattcactcaccactcactcactgactcaccagagcaacttccagtcctgcaagctccattcatggtaagtgccctgtacaggcgtgccatttttatcttttataccatatttttaccataccttttttaatttttaggtatgtttggatacatgaatatttaccattgtgttacaattgccaacagtattcagtacaataacatgcagcaaacgtttgtagcctaggagcaataggccttacagcctgggtatgcagtaggctgcaaagtgtagaattgtgtaagtacactctatgatgttcacacaacacaaaattacctaatgacgcatttctcagaatgtatccttgtgactgtcactgtctagacatacatacaatgaaaaactactcagcaatgaaaaagaataaactgctgacacacaaacttggatgaatctcaaaaacattctggatgaaagaaactactcaaaaagaatgtttactgtatgattccatttttatgtttaagaacaggtaaaattaacctgtgatgacagacatcagagtcatggttactcctgaggagaggggtttactagatgggacaggaggggactctctccttctctagggtggcagaaatgctctggatcctggagtgggtgatggttgcatggggtcatacataaataaaacttgctttttacatatagattttattctatgtaatttatatctcaatttttaaactgcagaacaaaataaagatggagagcagggagctgtgctttttccattttactcccaggtgccagaaaggagcacttctggaggggctgaggctacaggaggttagagaacttctgcaggtccagagacagcttagaaccaagctctggctggtcttccctccagcagctgggaggagggcctctctccacttgacagagcagcccagccccaacttggcagcctgcaagtgaaaacagcttctctgtagaaagtactagaacatccaccccctttcacagtgcggctggcttcctccatcagtctctacaggtgtcagaaggcattgatagcaccctaaccacagccccggggactctccatgcccagtcataattcaacggcaccagggtgacccctcagtggagaggcaggctttctttgagactgtgaacattgaaccaggaccacttgcccctgacggtctttccaggcagactgggagacagtggcattgggaccattctttcttgggctactctgggccagacatctaatcaaatgctctctttcccatccactgattccataagccccagagtgagtcaggtttctcaccccaagtggaggggccactcacgctagggggctatgttcctgcgttcagatccctcctttcttcctctgtcctctcccccatctcttcagctgtactttctcctgtgctcactttattctctagattaatttcttgcctcatccttacactcttgagttcagaataacttctgaacttctctctcccagggttcacaccagttgcccaaagaggactgtaattgggccactccaggaccaatcactgtggcaggggcacagactctctgattggccaaccaggtgatgggatcacccttggctgacagtcccactccctgcagccagggaagagcagagtcaaaaagaaagcaaagccacgcatgcagagaggttaccagtgtccatccagacgcccacttcacagacaggtagccaagcgccagagcc

SEQ ID NO: 2788 - DNA, 2217 bp, Homo sapiens
gagcccaggactgaggtaggggttacttcgggctgaggggattagcaaaggcttgtgaagtggctaaagccgtgacctggatatttcaggactcaaatccacccgcattggaattctctgggtgactgcccagcccctttggcaggacagccagccacaggccctgattgtgcaggacttcctgcctctgcaaaggcagtcgggggctgagcagggttctacccggctgggtccaggcagaagtttttcctccccacctccgggtttgtcctcatcatcggtcactcccattcacagctttaagattctggaggccaagaatttgactccccccggatccatggtctgtggataccaatgttccgactggagacggggagcccgcgagacccgggtctccagggtctgcccaaggaagttgctcatgggagcagacctctagagcaggatttgaggccaggccaaagagaaccccagagatgaaaggcctcctcccactggcttggttcctggcttgtagtgtgcctgctgtgcaaggaggcttgctggacctaaaatcaatgatcgagaaggtgacagggaagaacgccctgacaaactacggcttctacggctgttactgcggctggggcggccgaggaacccccaaggatggcaccgattgagcccgggcccttctgccatgtgaacctctgtgcctgtgaccggaagctcgtctactgcctcaagagaaacctacggagctacaacccacagtaccaatactttcccaacatcctctgctcctaggcctccccagcgagctcctcccagaccaagacttttgttctgtttttctacaacacagagtactgactctgcctggttcctgagagaggctcctaagtcacagacctcagtctttctcgaagcttggcggacccccagggccacactgtaccctccagcgagtcccaggagagtgactctggtcataggacttggtagggtcccagggtccctaggcctccacttctgagggcagcccctctggtgccaagagctctcctccaactcagggttggctgtgtctcttttcttctctgaagacagcgtcctggctccagttggaacactttcctgagatgcacttacttctcagcttctgcgatcagattatcatcaccaccaccctccagagaatttttacgcaagaagagccaaattgactctctaaatctggtgtatgggtattaaataaaattcattctcaaggctaataaaaaccacattggcattttcctctgctgtgggggatcgctggtgcctctttctctgccactggggcaataaacccaaagatgtctacattatctccgaaacagaagggaagattagtaaatgcagggttttctgggatgagcttcaggctttctcttgggctaattttcttacaccttggggtcctctccagtattgggtctcattcttcctcgatggggtcagggaaagataactggtgattatgccagcttcagcttccaggccagagagggtggcattcaaatcccagtgctggcttcttcagctgtgtggtcttggacccgttactgaacctctttgactttcagtctctttgagaaataaactgtcttgttccttgcaatgtaaaatgagacttctaaagcccaccttgatgctgatatggagaatgctgaggttctaggatttcacacagcaggaatttttttttaataggtgtcagctgtggggtttattttttacaaagtaaggacattaaaaaaaccaacccgtctatcaattcataaaagaaaggatgttctgataccaagactgaaagaagaaaggatgtattccaaaacaaaggaacatccttccaagaaaggacctatggcttctttattccgacataccccaaaataactgcatgataaataggtctatatttaaaaagctctagtgtcgaatgttttcaaaataaaatttaattttatgagattaccctgaatgcaccagtgctttagaaaagtttgatttagactcggtgtctatatttgacaatgccacacagggagggacttaaatgctgaatttgctcatgaaatatttaaaatcaaagccatttcccagatccaattttgaatgggtatgtgggggaaattgaagtcttcactctaatcccattttccttcaattgtgatattctggatgacagag

SEQ ID NO: 2789 - DNA, 9496 bp, Homo sapiens
ctgacctcaggtgatccacccacctccgcctcccaaagtgctgggattagaggcgtgagtcaccgtgcctggcccgttagagagttttaaacagttctccagggcgttttcctctgactaaagtcaccctgtgatcttaccatctgttaagtgacatggaatccctgtgctgagagacacactggggaagagatgtccccaaatgaccgacctgggattccagattagctggcctctaagccaggggcatggttcacccagcccaaaggatctcgtcttaggaatagctctggatgcccacttctgtcacctgagagatttttgtgtgaggaatctctgatcccagaaagcagcacagtttgcagttgtaagagcaattctgtctacactgacccagacatccctttccccaatctgggaccttctgagaccagcaggatgagaagcagtgttggcccagatgctaggggtgggtcaggtgtgacagtgaatggctggcaagcatcccaacagctggaaacagctgcaacttctgaatggcagggaaacttaatttggtgatgtcagtttctctgggcagttggatgaagacttgaacccgtattgtcaggagtttcaaaggtgaccaagcaaaatgaacacgtattccttactctctcttctacactcaccatgtactatatgtgaggcccgtctaaactctagggatcagctgggagccagacagaaagagtattccccttttaaaggatgccacattccagtgctggagctggacaggacacctggacagggtaattgcatgtcctggtcagtgctggagttatgtaatacacagcacatacccagggtcttgcaaactccagttggtcctagagttggacagcacatgtgtgatcccaggggactgaactctggtaattattcaaggcagatgtagcacactatgatcacagggtcagtgcacactgtggccagggctgcagtaaacaacccaaacccattgttcgtgtgcatgaaacaacacaaacccactgcgtcttttgagatgcaaaattggtaatgatgttttcatgaagtttggtttatcagtgagttattttatggatcttatttttggtatcttactcaagaaatctttgcctaatctaagcatgcaatgactttctcctttgttttcttctagtgtttctacaagttttacttcttcaatttagatctgttactaagattaactttgagttaatctaattgcatggtgtgaggtaatgttctcaattcatctttttgcatgtggatgttgggttgttctagagacactattgaggccaggtgcagtgggcctgtaatcccagcactttgggaggccaaggtgcgcagatcacttgaggtcaggaggtcaagaccagcctggccaacatggtggaacccagtctctaccaaaaatacaaaaattagctgggtgtggtggtgcacgcctgtagtcccagctactctggaggctgaggcagaagaatcccttgaacctgggaggtggagggtacagtgagctgagatcacaccactgcactccagcctgggcaacagagcaagactcagtctcaattaaaaataaataaataaataaataaaaataaaaaaagaaaatattgaaatgaaaatgtctcctaatctcattgcatggtccagtttccccctttaccctcttttcttctgatttccatcattctacatggttgcaattgtggtgcctttgctataatgctcttggtgattgtggggacactgtaagcatttcatgaggttacagggcctttgtaattttccatggaaggctgcagatactgggagacaggagctcaggtggggaggacctgggccctcaggtcaggtcccctaagggcacctcagtgccctcttctgcctggctgtgtgatctggtgcatgttcctattcttctgaagcatcaacttcccatggggaaactgggggtaatgcctcccttccagaggtgacttcatagtcaatcagaagattttaggaaagagaggcctgctttgattccattgttttcagagctctttttgtttgaggccctatggtttgttttcagggtttgttcttaaaatgaatgttgcaaagaagccctttgcttctttttatcaggttttggagtctgaccgcctgagttagaatcctggtctgtcactgttgcggctggtgacttgacttctctggggtttcctttctgactttctaaatggggctgatgtcagcacttctcacggtggtgggggacggggtgcaccgtgaggatgaagtgggatcctgccggttacctggcttgtggaggagagtatttcagacagtgggcatgacatgtgcaaaggtcctgggccagaagggccaggcgtggtggatcacacctctaatcccagaactttgggaggctgaggagggtggatcatttgaggtcaggagtttgagatcatcctggccaacatggcaaaaccctgcctctactaaaaagacaaaaattagccggccgtggtggcaggcacctataatcccagctacttgggaggctaaggcacgagaatcccttgaacccgggaggtggaggttgtagtgagccgagatcatgccactgcactccagcctgggggacagagcaacactctgtctccaggaaaagaaaaaaaaaaaaaggtcctggggcagaaggaagtagctgagtcaacaggctggaggccggaatagagagagtaagaggggttgtgcaatgctgaaaaatccagtgaggccagattcttacccagcatggggacttcacaggtgaaagagccaatccatggactcaagaactgatgggggggcacagactcctagagcatcaatgccagccaggtgtggtcagcaaaaggcaggagtctgctgcgaggagagccctgacctagctgtggtggcagcgagaccaggggtctggggtgagaacttcacctcggatctcctttcctgcaggggttacttgattgcagctccctctgtttttcgcgcgggcgtggaggaagtcatcagcgtgaccatctttaactctccaagggaagtcacggtccaggctcagctggtggcccagggtgagccggtggtgcagagccagggagccatcctggataaagggacaatcaaactcaaggtaagccgttgatttttaaaatcataaacctgaccttggaaataaagaattgaattgggccaggcgtggtggctcacacatgtaatcccagcactttggaaggccgaggtgggtggatcacctgaggtcaggagttcgagatcagcctgggcaacatggtgaaaccgcatctctactaaaaatacaaaattagccaggcgtggtggcacatgcctgtaatcccagctactcgggaggctgaggcaggagaatcgcttgaacctgggaggcggaggatgctgtgagccgagattgcaccattgcactccagcctgggcaacaagagtaaatctccgtctcaccaaaaaaaaaaaaaaaaagaaaagaaaaaaaaaaaagaattgaattgggatggaataagagaaattgcatgtgttgtgagaaaaatcatttttaaaaaagagatgtaaaaaatgaataatgaggctgggtgccatgctcacatctgtaatcccagcactttgcgaggctgaggtgggttgatctctggagcccaggaattcaaggccagcctggaaaacatggtaaaatcctgtctctacaaaaaaaaaaaatacaaaaattatccattagctaggcatggtggttcacgcctgttctcacaaccacttgggaggctgaggtaggaggatcgcttgagactgggaggttgaggctgcagtgaactatgatcgcaccactgcactccagcctgggcaacagagtgaggccctatttaaaaaaaaatgagagaataatgaaatttagaaaaggagaaatccaccgataatccagttttcatacttttcactttttcatgttttccacacattcttgttcatgcacatacattttcttttcatagtttcagttaaaggacacacaccactggccgggcgcagtggctcatgcctgtaatcctagcactctgggaggccgaggagggtggatcacctgaggtcaggaatttgagaccagcctggtcaacatggcaaaaccccatctctactaaaaatacaaaagttaactgggcatggtggcgcacacctgtaatcccagctactcgggggctgaggcaggagaattgcctcaacccatgggacggaggttgcagtgagccaagatctcaccacttcactccagcctgggcaacagagtgaaactccgtctcaaaaaacaaaacaaaacaaaacataacaaaagaaaacaaaacaccgtggtgtttcctagtccctcttatcacactgttgtaaacaacttccatgtttccaagtctctgtaattggaatttccatttcattgtaagcagcatcctattgcacccctcttaaatatcagtttgctaagcccccagctagattttttctagattgtttcagtggttttttttttcttttttttttttgagatgaagtctcactctgtctcccaggctggagtgcaatggtacaatctcagctcactgcaacctctgaccctggtttcaagcgattctcgtgccccagcctcccaagtagctgggacctcaggcatgcaccatcaagactggctaattttgtgtgtgtgtgtgtgtgtgtgtgtgtgtgtgtgtgtgtatttttagtagagatggggttttaccatgttggccagactggtctgaaactcctgacctcaagtgatccacccaccttggcctcccaaagtgctgagattacaggcatgagccaccctgcctgggctgttttcagtgttttgatactgtaatccttaagtcgccagaatgtttgtatgtaaagccatattagcattctggatgccttctttaggctaaacagccaaattgaagaattaccagcaggacccaagcctctcactgggtcttgctgtgtcctggaatacacagcagtacctgttcatggaaccacctgcagtacattagggatcagatttctccactgcctctcagacattgaatattgttatttttaaattattatatgtaccaaactatgtaaataattttatgacatgggttttcaaactggagtccttggatttcagatattatgtaagccctggaattgcggcatttggggggttagctattccttaacttttaccacatgctcaaaggagtctacgaatgaatgggctaaattgagaattattttaaattataaggcgcccatctccattgatcagaatggaggctgagatagttccttttgtatgaggtataccactagtgcctatttgctgcaggacagtggtcttcctgccttactttttttttttttttttaagcagtcttgctttttctcccaggctggagtgcagtgatgcaatcttggctcactgcaacctccgcttcctgggttcaagtgattctcctgcctcagcctccccagtagctgggattacaggtgtgcaccaccgtgcccagctaatttttttgtatttttaatagagatggggtttcatcatgttggccaggctggtctcaaactcctgacctcagttgatctgcccacctcagccctcccaaagtgttgggattacaggcgtgagccacagcacctggcccctccattacatttgatgatagaaccctttctctaaggcagcagttctcactcaagggggcttttgccctacagggcacatttcgtaaagtttggagacatttttggttgtcacagctgggttggggctgggcggtgccaggtgctactggcatctggtgggtggaggccacagctgcaactcaacatcttacaatgcgcaggatcccttacagcaaagaaggatgtggccccagaagtccacattcaggaaaccctgaaccaaaaccctagagcagcagtccccaacctttttggcaccagggaccagtttcatggaagacagttttttccacggaccagggagcagaagaaatggtttcaggatgattcaagggcattccatttattgtgtgctttatttctattattattacactgtaatatataacgaaataatgatataactcaccataactgaagaaacagtgcaagccctgagcttgttttccttcaactagatggtcccacctgggggtgatgtgagacagtaacagatcatcaggcattagattgtcataaagagcatgcaatctagacccctcccatgcacagttcacaatagggttcacactcctatgagaatctaatgccaccactgatctgatgggaggcggagcttaggcagtaatgtgagtgatggggagcggctgtaaatacagatgaaggttcatttgctcacccactgctcacctcctgctgtgtagccccattcctaacaggccattgactggtaccagtctgtggcccaggggttgagggtccctgccctagggcttcaatgcctacagaagcataaggaaaaaagaaaaaaaaaaaaagaccctagaactccctttcctggcttcctgtgattggatttcttttcctccctcctcccttccttcctctctctctctcctgcctttcctttgtgtgattagatttttctctctctttctctctttttggagacagagtcttgctctgtcgcccagggtggagtgcagtggcacgatctcagctcactgcaacctctgcctcctgggttcaagtgattttcctgcctcagcctcctgagtagctgggactgcagacgcccccaccatgcccagctaatttttgtattttcaatagaggtggggtttcaccatgttggctactgtggtctcaaactcctgacctcaagtgatccacctgcctcagcctcccaaagtgctggcattacaggtgtgagccactgcacccagcctagatctgctttcttatgagtcaggaagccatttccctggagcaggtgttaagatgatgtgcagtccctggccaccacacgttagaagacactcttcacagcacagatgctgggaatttgtaagagagactaacaaagggttgtataattctgggagaggggccaagggctcttaagactagacttgagattcccaagaaagatgcttaagatccttagcatttggccaggcacagtgactggtgcctgtaatcctagctacttgggaggctgaaactggaggatcgcttgaggccaggagttggagaccagcctgggcaacatagttgagagcctgtcccctgtctctacaaactgaaaataaaaaattagccgggcatggtggcctgcacctgtagtcccagccactcagtaggccaaggtaggaggattgcttgagtccaggagatcgaggttgcagtgagacgtgatcgcaccacagcactctagtctgggcaacagagcaagagcctgtctttaaacacggaaagaaggctggaggtccttcttgccttctctccctgtgggaggcatcctcttccctgggaaggtgtgaagctctaggggctgccgtttggggtcggccccctttatgtgctcagcatagtctcttgcccgccagcctccctgtccctccagcatacggtcctcagcacctccggtatctccctcctgcccatccttgccctgctcttgggtggccgggacctttcctccctcttcagcctctggccagtgttgagatatttccagaaacagggccaggtgaggattttgggattggagtagtgggtgaggtttattgctttggttggtcttgacggggaaactgcagtcagaagagacctcacaggtccagaaggctggtcctgcgggtggcaggtaggagaggtccctctgaggctgttcagagcagacaggaggtgggtggctggagagagggctgggacggaccccgtgtggcttcagagagcgggggtcctagtgcaccccgacctcacccacacaatggtcatgacagtgcagaactgtgatgatcagtcagataatctggtagattgttccccgtgatggtcaccagggtccatccaccccttgagggaccacatgagtagatgctgacataggggtcctcagaagaggaacaccccacagttggatagttttatttttacattttttttattttttattttttgagatggagtctcactctgtcacctaggctggagtgcagctgtaccatctcagctcactgcaacctctgccttctgggttcaagcgattctgctgcctcagcctcctgagtcgctgggactataggcgcctgccatcacacctggctaatttttgtattttcagtagagacggggcttcgccatgttggccaggctggtcccgaactcctgacctcaggtgatctgcccacctcagcctcccaaagtgctgggatgacaggcgtgagccactgtgcccagccatttgggtggttttaggaacaggtgggtgcacatagctccccaggtgatctgcttggaggtaatgtccacctgctgggtgcccagggatggctgagagggtaactatcatcaaataccggtcacatagagggaggtaatatggtttggttgtgtccccacctaaatctcatcttgaattgtagctcccataatttccacacgttgtgggagggacccagagggagataattgaatcatggggtggtttcccccatactgttctcatggtaatgaataagtctcacaagagctgatgattttataaggggaaacccctttttgcttggctctcattctctcttgcctgccaccatgtaagacgtgcctttcacctttcgccatgattgtgagacctccccagccacgtgaaactgtgagtccattaaacctctttttctttataaattacccagtctcgggtatgtctttatcaccagtgtgaaaacagactaatacaggaggcattacttttgtttgttttaagcatgaaaggagcttttatagtgcatgactcacatgccagggcgttctgcccatctgcttaaaaaaaaataagaggacggccaggtgccatggctcacacctgtaatcccagcactttgggaggctgagtcgggaggatcacatgagcccaggagtttgagcccagcctgggcaacatagtgagaccccatctctaccaaaaaataaaataaaataaattagctgggcatggtggtgcatgcctgcagtcctggcttctcagtaggctgaggcaggaggatcgcatgagcccaggagtttgaggctgtagtgagctctgatcgcaccattggactccagtctggcgacagagcaagatattgtctctaaaaacaaaagaaagaaagagaaagagaaagaaagaaag

SEQ ID NO: 2790 - DNA, 4097 bp, Homo sapiens
ctttgttttctgtcctgcctctgccgcccacagcttgaattcggagtgatttaccactgcacagaggagcggctgtacacgggccggcggggtcggggcgccttctgcaatggccagcggctccgggtctccggggagacagatctctcaaaggccttggttctgacagaaattggccccaaacgtgaccctgcgaccctgaagctgttcctgagtaacatggagcggctgctgcatgccaaggcgcatgggtaggaggttcagttcggggaacaccctgcagcccgaggaggaagaacggaacacggacttgctaaaactcccctgggatttgaggaggaagcctgacgtggaaagagtgggaggggcacatgaacatcagactcagggaagccctgtgaggggcccgcctgcagtagatactcctatagccaggcctctggagatgcgtgggcacctgtgttgcttctgatcagaatccatggaactgacctcatgctgctcaaccagcgaatggtgcaaatacttacagtccttcccgagggggcctggcgtcagacaggtttatcaaagcccagtgaatcctctttgtctcttgccttcccagtagggctgtgctgtgagccctagccatgtgagaccactgacacttaatgtcacgttcagtagaggaggattcaattctctggttgctgcatctcaggtgctcagtagctaggtcagctgggagctgtcatggcacaaggcatttgcgtctggcggaggcctgttggttggtggctccaggccctatattcagcctccagagctttggcagaagtgctgtgcttcatttttcactagggaaaatgcccagccggggtacctggctgaagtcggcttgcacaccacagaaaaggctccactcccgcctgcatctgtcctcccttccctctccccagggtccgagtgattggaagctccacattggcactctgccacctggcctcaggggccgcggatgcctattaccagtttggcctgcactgctgggatctggcggctgccacagtcatcatcagagaagcaggcggcatcgtgatagacacttcgggtggacccctcgacctcatggcttgcagagtggttgcggccagcacccgggagatggcgatgctcatagctcaggccttacagacgattaactatgggcgggatgatgagaagtgactgcggctgaggcaaagctgctcccaaggcctccctgggctgctgtgggctcctggggaggtggccctcgtggcccacgctccatgccagtggctcacgctctgctcctggctaccccagagggagttgtcacgctacagtgagtggctggccttttaaatcgacgtctctctcaccaggatttggtgtttagctgtttctctctttaatctcacgtagcctttttcaggttagtacgtgttcttctgtcagggccaaaactcaaatctcctgtgaaatacgtattgataatccaatcttgatttttccccccagaatataaatctcaggtaataaggctttagaactgctgataaagcggatcgttctcaggccctccccccggagtacttcagaatgcaataaatcaaaataatggccctgtgtgtatctgtttcctctataagcatgtcgcctgattcccaaacaactctgtggctctcatccactgctgtggatctatgctctcaggaagctttgcgaatgaaacccaaagtccatgcgaatgaaacccaaagtccatgcgaatgaaacccaaagtccagtgtgtgccagctgctgcctctgatgaataccctgaaggcgaccccagtaatatcatgtgagtgttcagaagccaagacatgggacagacagaaggaaactaatctctgaaagctgttgtttctgtgatcagcttttttgtttttgtttgagttggggtcttgctctgtctcccagcctggagtgcagtggtgtgatcacagctcactgtagccttgacctcaggactcaagtgatcttcctgccttagccttctgagttgggaccacaggcatgcactagcatgccaggctaatttttaaaaattttttggtagagatggggtctcactgtgttgcccaggctggtctcaaactcctggactcaagtgatcctctcacctcagccttccaaagtgctgggattgaatcaccacacctggccaatctgtgatcagtttaaagaggagaaactgggccttacttgtttctctttaggaggcggaatggtatgtaagaataattctaatgaggctattaactggctggccagacatctttcctgaagtttaagaatgagaaagtcttggctgggtgcggtggctcatgcctgtaattccagcactttggggagccgaggcaggtggatcacttgaggccaggagtttgagaccagcctggacaacataatgaaaccctatctctactaaaaatacaaaaattagctgggtatggtggcgcatgcctgtaattccagctacttgtgaggctgaggcccgagaatcatttgaacccgggaggtggaggttgcagtgagctgagatcgcacccctgcactccagcctgggcgacaggagactctgtctcaaaaaaaaaaagaagaaagattaactgaatttaaaaaataacatattcccagaggttcactgtagggtgagcactgtgtcctgccacgtttggaatcgttttgtctttgaagaagtggagcctctcccagggctggctcggtgcccttgtctttccagcaacagcgttagttatagtcatctttgagactggcttttctttcatctctggagagagcttgattcgtcatcttattgctttgtctgaactaattttgtttagtagagcttttcaataaatagtttggattttttaaatgagtttaaaatatgctcatgtttctccaaattgctgattattcctttaggccttcgttagcccatcttaattttctcagaatctactcaaaacagatctgagtatttatacagatgtgcaagaaatttcttacattctcatggattttgagatgtagtgcttattagtcaaataatatctggaagttttcttcaacaaaataactctcgcagcacgttgagaggctgaggcaggattgaggccaggcattccagatcagcctgggcagcatagcaagaccccatctctacaaaaaaaaacccaaaactagatggatgtggtgcacagctacttggaaggttgaagtgggaggatcctttgagcccaggagtttgaggttacagtgagctatgattgcaccactgcatttccagcctaagccacagaatgagaccctgtctctataataaaagtttttaattagccaggtgtggtggtgcgtgcctgtagtcctagctgcttgggaggctcaggcaggaggatggctggaacccaggaggtcgaggctgcagtgagccattattgttccactgcactccagcctgggtgacagagcgagaccctgtctcaacaaacaaaacaaacaaaaaaacaaaaagaaagaactgctcccctccccaacctcaggaaaggccctcccagcccttgggtcaggacagcaggaggccctgagggagcttgagctgactcctgcttctgcttctgcttctgctctgtccggagtctcaggctgcctttagcaagtattccgcatgagcgtcatccctgcggcttcaggagaagcagagtgaaccttggagaaaagagaggcacccaaggtggggacctgcgggcttgcctcattcatccctggacaagcctcccagaaacgaaatgggctgctcacctctgtgatcctcagagttagcaaaactgcttgctatgtcatttagacctcttacaaaatgatattcatctatcactggtgatgacattcattctgaattccactcataggcttcaggatacttgccctcatttttttttcccttcatttcaacagttttcactgagtgtcttgtggacatgagtcatcaaatgttttgctgcctttatgatccaatcccaaataaaaagtaaaacatt

SEQ ID NO: 2791 - DNA, 52623 bp, Homo sapiens
tgtgcacatgtaccctaaaacttaaaatataataataaaaaaagaaaaaaaaaagaatgatcaaaagaaaaaaaaaagactgggcaatttataaaggaaagaagtttaattgactcacagttccatgtggctggggaggcctcatgatcatggcggaaggcaaatgaggagcaaagtcacatcttacgtggaggtgggcaggaaagcatgtgcaagggaactaccctttagaaaaccatcagatctcctgagacttattcactatcacaagaacagcatggggaagacccgcccccatgattcagttccctcccactggatccctctcatgacatgtgggaattatgggagctacataaaattcaagatgagatttgggtagggacacagccaaaccatatcacacataaagctatatttcaataattttctttcctccttaggcctccaagcaactttgaaggttgttttatacacgatcttgtgagtggcatttctaggaaagccccagtcattcttataagctccccctcttctcaccctgcatactagagccaaacttgagggaagctgctttgcctgggtgaggtttgggtttagtgccttcaatttccataagatgtgtattcttataagaagttctggctggatgcagtggctcacacctgtaatcacgacactttgggaggccaaggtgggaggatctcttgaagctaggagttcaagacctgcctacacaacatagcaaggccttggctctacaaaaaaccttttttttttttttttttttttttttttgagacgaagtcttgctctgtcgccaggctggagtgcagtggcgcaatcttggctcactgcaacctccgcctcccgggttcaagcgactccccctacctcagcctcccgagtacctggcactacaggctcatgccaccatgcccagctaattttttgcattttagtacagacgaggtttcacgatgttggccaggatattctcaatctcctgacctcgtgatctgccctcctcggcctcccaaagtgctgggattacaggcgtgagccaccatgcccagcctacaaaaaaagttaaaaaaaattagctgtgtgatgccatgtacctgtagtcccagatgctcaggaggctgaggcgggaggatggcttgagcccagaagatcaaagttgccatgtgccatgatggcgccacttcacttcagcctgggcaactgaacaagaccctgtacccctgcaacccaccccccaccacaagaaattcctactttcattcaaactaatttgtgcatttcttgcaaccaaacaaactttcactagaattacttggatattctgctactcctatgtgaaacagaaattataaactgtgccctggtattcaagagggatgtttggatgtgataagtacaacttgtcacagaagctgagcatacacatatgtgggcaggacacagttaaagagcagcaaggggcagccagcgaattgctgagggagataaataaagaacgctagtgcctagaatagatattttttttcctgctggaaaccaggtgtaattgtccattcatgagatcacagcaatgtgctttctaaaacctggaggaaaggctgctctcagtgcttagtaaaatccacatacagtgggtatgattgatgtctcccagagtaaagcaagaaactgcctgtaaacgaggacttgaagaatttgtgaacagctaaaatgccaacctgaatgcaatttgtcattagaaagaggaaatcaaatccttccttttccaaatcaaattgacacaagtcaaactgtgtcctttttggataaacagtagttaaacagaaaaagcagggtcaccttggagcattcaaagttggtagtgccaacctggcactgtctggatgagcgatgctactctggaaatcaccagctttctatgcctggagagtggctctgctgagacagggatagtgacctggatgaacacctctacaactctacaactgtccaccaccctcctttgctctaatgctacactcccatcactttttttttaagacagggtcttgctctgttgcccaggctggggtgcagtggtgtgatcatggctcattgaagcctcgacctcctgggcttaagctatccttccacctcagcctccagagtagctgagaccacaggcacatgccaccatgtccggctaactttctgattttttgtagagatggggtttcaccatgttgcccaggctggtctctaatttctagccccaagtgatccacctgcctcggcctcccaaagtgctgggattacaggcgtgagccactgtccctggccaatttgataatatatcttcttcagtattttgctcgttagaagacaatgtctcagaaaggagtaggggtattttagccactagaaagaaatatcctttactgaaaagtaacatattttctgtctggtttgtacatttcaatgagcttgaatggcaaaagttcagcattcctgttttcagccaactctggtgcactaataaagctaagtgtaagatcctggctggtagcctaccacaaatcaacttcacggttgctcctaagtcatctatattaccatagaagtttattttaaaaaccatctctccattgccataggaataatcttgggggccataatttctaaaggcatttacacaaactttgcagaaggtacttaagaaatgtgtttacattggaagcattcatatcttcagaatttccagcatttcacttgtgatagagcacacaggaacagaaatagaacgtgagaaataaggttgtgtattaggttgctagggctgccatcacaaaataccacagcctcagtggcttaaacaacaggcatttattttctcacagtttttgttgcaggaaggtcttgaattcagaggtttccaaacttttggctttcctgggccacattggaagaagaagaattatcttgggccacacataaaatacactaacgatagctgatgagctaaaaaaaaaaaaatctcaaaaaaatgtcctaatgttttaagaaagtttatcaatttgtgtttggccacattcaaagccatcctgggccacatgcagccagtgggctgtgggttggacaagcttgttgtagatcaaggtgccagcagggttggcttcctctgaggcttctatcctggattctgtagatggctacccttgatttacagatggctcgcctcttgctgcctcttcacatggtcttccctctgtgcatgcaggactcttcttcttctaaggatgccagtcatattgggtttgccccccttcctatttaaaaaacagatttacggggtacaagtgcaattttgttacatggatatactgtggagtggtgaagtctgggcttttagtgtaaccatcacctgaatagtgtacattgtatccattaggtaacttctcattcctcacctctctcccactttcccacttttggagtctccagtgtttgttattccactctgtaggtccatgtggacccattgtttagctcctgcttataaatgacaacatgtagtatttgactctctgtttctaagttttttcacttaatatagtggcctccatttccatccattttgctgtaaaagacatgatttcattcttttttatggctgagtcgtattcatataaatatatatacacacaccacattttctttatccagtcatccattaatagacacttaggctgattccatatctttgctattataaatggtgctatcataaacacatgagtgcagatatctttttaaacttttaaaagtttttaaattttcttcatgtcagacaggtaatattccaacattgccacaaggttcgagggtgacacatctcacacatgtacgtgaacaaccaatcatcatgctcatgaactacaaaaggatcagatcggaaagaaatacagcacttttgcatttccacaaatgacaacatctaagtcacaccaccacttcccagacggccttctgtgagtcagcctatgccaattcgtttgtttatgtgggcatcttacaaaggttgtggtatcgaagttctttttctctttcagttccttaacatacttatgtgattatttatagtttctttcttgctaatttttttgtgatgtaaaaattctaaacaggggtgtgtttaccaaccacctggttccagctctcagggcctttgctgcttcaacagagcctgcccttttgtctcccagtctccctctttcctcttctctctctccccatggtctcttccctcatgggttcatcgctcctaagataaaggagtccccagggttccagatgaagaaaaacaatctttccctagaacagtgtttccaaaccacgagacatgattctaggtgattttaggtgacacacagatgtgccattaaatgacattttgctacatactgaaaaagccatttccttttaattctcttctagtcctttagatttcatgaaagggaaagttttgatttagtactattatgcttttaatgcttctctaacactcaatcttcatttttaacaaagaaagagcagatctcagagtcagagtctccagcacacaagaatttcataacaaagtttagtttttacagtttttaatttttactaacattttcaatgtatgccagctgatatatcattttccatttacaataataaacaattgtgttccctttcaaaaataaatttctcattagtagtaataaacggaaatctcctaatgctaaatgacgagttaatgggtgcagcacaccagcattgcacatgtatacatatgtaactaacctgcacattgtgcacatgtaccctaaaacttaaagtataataataataataataataaaaaaaataacattccttgaattcaaaaagtaggtgacttgaagaagcaaataatagtacgggtagtacatgaatatgttaaaactgtgagggtggtacttagatggctaaagtttgtccattagttcaaagccattgagacgtaaaatgtggcagggaggcagataggtgctactcagaacaggctggtttctctaagcaaacataggagccatttattcctcttcttcttccaccgataccaccactgtcatcatcatcaccatggccatcaccagtccctcgatcatcacctccataactgccaccactatcatctacatacaactatgtactgtgttaacatcttaccaccttcatcaccatccctctgtccacactggtatagcccaggtctttaccaccacaggcctctgttactgcagcaacctcctgcctggggtctatacttccagtctttcttacttccagttcacctatacatacatacaaaccccctttcattccactagtttcttactgtagaactgacagtccttcctactgaattacttgatcaaatctaaattcttctacctacctttcacgactcccccttctctcctctttctctcctcttttctgttttctctctagaatgaccccccttctcatttaggttgccataattttcttgtgaatgtttttctatgccattaaatgtttctctaaaagcacaatttttaatagctctgaagtatgaatgttctacaatctatttaaccctttattattggatattttagttattttcattttctcactataatgaacaatgctgccatgaaaattcttgtatgtaaacgaggatcacaccttttatctctttcttacttcttcatcttgcaggaagccaaacaaataatcactgatcaagtaaagcttaagggaaaacaaggacattctgaaatgtccctttaaacaagaatcttgaattgttgaaaataaaaaatgtatttggatctgatgaccttgtttcattttctgagcaaagagaagtagaacagcagcaagatgacatggctttgccctttcagaagccaacagagatatttattacccaagtctcacaaatgctgaaattgtgattggaagcctttcagcttcctgcataaccccaggagcctcaggttgcaggtcaatggcctgatgaagtgacagcctctagccccaactatctgtacaccagtggagattagaagcatgtcctgggactggtttggagaaataagttatttttctttggtaggaaacaggggcaaggctggtgagaagacactgccctaaatatgatataatccagctgtccaaacatggacaactgagttcagccagtcatccattcccccaaatccagatgtttgccattacacaatctcagactatcttttcttctactgagtgtaacttgtactaattatgtttgtcagagtagcatttgtttttaattagaagacatctattttgaatcagctgggactccttagctgtatcacagagacacagcctatgttattaataatctttaaatcataactgccttttgctttgtggcaaattgttgaggttttcattccatctcagagttcaaatataagaaacatcgagactgcactaaaattggagtcgattattattaatagtatttgttaaaatgcaggtaattctattctatctaaacattctgcaaacacaaaattcccacgatggcagtgggcttttaatatttgcacatctttgtgtgtggaagtctccaactattatgtttcatagttagacctgctttcaaattccatcctaacatgtggtcttgctaaggtcacgaacaatgtctatgagcttaacttcctcatctgaaaattagaggattataaatgtcattgtaagaattaaatatcataaaatattttaaacacacagcagagtgcttaaaatgtagtctatgtgtaaatatatgctgattccttccattcctttaaaaatctatagacaggagtctgacttttctaaatggccatctggtcttacctccaggagactgaagcacattttccacgggtttagatgtagagctttagttcttccacctgagagacagttagcaagaaaagtaagggagaaatgctataggaacactcttgagtatgctggaagcaagtgaggactgttttgtaatctcactatgcttccttatgaaacacaattctagaccattctctgacctgatgttttgcttgctgagagcattctctgatgggaaacaccaagagagacacaaggcctgctgagataacagagagcctgttctccttcttgtccactgtcctgtcagtgcctactgccttccctgtcttctggttcttttccttcctctcttggctcttttcaggttctctgctttgctctgatctgctttgcatggctcctgctttcccctcaccatcaccaccttgcaccacctccttgcttcaacttccagtggttttgtctagtctatgagtccaacttaaggcagcatcaaggtgagacacacagcaaatatttgcaggacagaatatgagaggtccagcagtgggtatcgttctccagagcatgcctgaggactccccgagaccacccgaaggctggccaccacccagaagctggccctcacctggaggctggccctcacttgcaggccagccctcacctggagcctggcccttacccggaggctggggctcacctgcaggctgactctcacctggaggctgcccctcacccagaggctggccctcacctggaggctgaccctcacctggagggtcctcacctggaacctagacctcacctggatactggccctcacctggtttctggcctgcacaggtgcagcgtatcccccacttggtttcctgacccttctcaggccaggcagaagccaaacctagtctctgctttctctagtccctactggctctgctgtcatattctgttcctaagagctccaagcatgtatattcacatgaacagaaagtagcttgcaaaaacagttaacaggtactgaccctgtacaccaggtattctgccaactgccctacgtccattatgcactgagggtttgtgtttcctcaggactcatatgttgaagctctggtgcctagtgtggctatatttggaggtggggcttctgaggaagtaattaaggttaaatgaggccataaggaggaggattctgatccaacaggattagtgtccttataagaagagacagcaaagcgctcacacaccacgaaaagcaagcaggtggctatctgcaaacctaggccagaacactcaccaagcacccactctactgccaccttaagtttggaattccactctccagaactgtgagaaaataaatttctattgtttaagccatccagtcttttttttgttatgatattttttatggcatcctcagaagactaatacatgcactagttaatttaatctgctcaataatcacattaggtgttatgttatttccatttaaaagactgagaaaatggaggcacagggagggcaagtcatctacccccaaacacccaattattaaatggtaaaaggatttgaacccagataatctcagtcaagaacccaagttcttagcaactccagctttgcttgggcctataccatcaaaccaaaaaaaaatacaccctgcttaagttatggaggaagcaaacttctttcaaagtgtaaacgtggcaaagataattttgcaaaaaaaattgttttccattcagaagtattgaatttgacttaagacacaatgacagtgaaaatgaatgaattaatagtgggttaaatcatcggcatttatgtaatttttattgaactcaaaatctttttgatttacataattacatttaatattcactaattttcaatttcacaaatgtattttcaaattgtcattcattgctagtaagccttaaatcactctgccatgcagtctcggctgaaaagacacaggccctgctttgaggaggtcactcatggtgggaaaacaaacatgtacacaagggcatggcctgacacatttacacaataaatattttttcaaggctctaccatgggccaagtgctataagaatgatggtaagaggactaggagtttgcaagagtgtatgtgtgtgtgagtgtgtgtgtgagagagtatgtgtgtgagagtctggtgaacatgggtgtgagagggccctcagagagggaaaacagtgtgaaaagccttggaagtgtgaacagatcgaatgtgtgtgtatgtgagtgtgtgtgtgtaagagtgtgtgtgtgtctggtgggcatgggtgtgagaaggccctcagagagggaaaacgtgaaaaggcttggaagggtgaacagattgtgtgtgtgtgtgtgtgtgtctgaggtagtggaggtggtggggttgggtgtggatagaagaggacattcagtagaggaaaggacttgtgatgcatgatgaagaggttgaacaagattaattttttctattttattttttggtgtcttctctctcaatagaaaccaatattttacagaatgtgggactgaagttataagtgtaaaatcctgacagctagaaaattgtttttgtgctgtgcatttaaacttaagcaaggcttgcatatgtgagggcatgcacaatatctcagctccagtccttgtggctggctcagtgggaagatgctgagccaggtgcctagtgccagcctagagtgaggaggatacaaatatctatcaaagcaatatgagcacattgttttataaaaattatatacaaggggctgggtgcagtgactcacacctgtattctcagcactttgggaggcctaggcgggtggattacttgagcgcaggaatttgagatcagcctgggcaacatagtgagattctgtctctataaaaatacaaaaattagccaggcctggtggcatgtgcctgtagtcccagctactcaggaggctggggtgggagaatcacttaagcctgggaggttgaggctgcagtcagctgtgatagcaccactgcactccagcctgggtgacagagcaaaactctgtctcaagaaaaaaaaaaaaaaaaaaaagaaagaaagaaagaaaaagaaaaagaaagtaccatatacaaggacttggaacacaatgcatcagtctctggccaaaaatcttcccaagttcagcttgggaagaggagatgattatttgtaattcatttaatagtatctgttttgaattcttctcatggttcctccatgtcagtaagtatataactatactccttatcaattttagaaattatctactaatttcctgctctgacagatgagggattagctcacctgaagcagttcttctgccattcattcccaaatagttacaacattcttttttctttcctatgttggttacctttgaaactttaaatatttacatcagtatttcttgaattatcaaatacaggaattgtttctcaactttgctttttataagatgaaaatattagtctccttactcttactgcagggtttatctctcactttatcccctactttaccatttgtagttttccactaacatcatcatggcagaaatatttagattgctttctgtgtgcataatgaagatttgtttaggggttcagtctaactgtacaaagttagtaaatcacggttacattgttaagagtacatacagattgctcattacagggtcaaatagttcactttgattacatttttctaccatatgtaggtttgttttttttctgttgttttgattgccttgtctcccctgctttttgtgtttattgcctttttaagcctcacacatagtatcatatctctggaaacaaccttgccccttgttttccagtttcctgtgtcccaagtcatcctgacttttcgtttactctttcatttttccagatcacatcctcaagtatcttctgacaatgaatgtggaggaggtaaactttaaggatccttgcaaacctgacaataattttattatgtcactttactaatattttggtaacgtatagaattttaggttgcgaataattttctttcagttctttggaggcatttcttatttgtcttttagcctcagttgcagttaatgagaagccttttgcgtaattcttgtttatttgtaagcgaactctttcatctttctgaaagcattacaatttttcctttatctctaatgttctgacattccacaatgatgtgcctgggaattgtcatgtcaataactgctcagatgcaatgtagccttcaaacatacttcctggcagagaaagcatcagtgtacttcttcctgcacggctgacagaaaagacagactcgcagaccaaataaaaatgtggggatcacacagcttattaaatcaattaaaaatgtaatgcataaagacaaaagctaagggaaatcaattatgtaagttaacccttaagtaaggttgcaagcagggtagaagaaccacactactggtcctgggtacacaacctgtatgtgtctctctcttctctctccctctctctgccacatcagccttccccactgatggtagcttagtaggaccaaagttggatagtgtttaggccagggagcccagagatggaagccccccagggccatggcacagacttgccctgttggagagatgcagggcaggtatgtctggccatagctatagctagccaattagcctgcttagtagctgtgggtttcagtactgtttcttgagcagaggacatgtgaagccaaaatggtgttgctaatgggtagttggattaggcctctgaatactaaatacatcttgtcttatgtatattcagcaatttctgagtattcactgagcatggtgaatattcaatatatcatgactattttgtatccaggtgccttatgtatatttaatgcctcatgaatattaattatcttttggttcttccatcccttctatgtataacacagacatattccacttactacataatctgtacttaagatatcttaagtgtttcattcccatcccatttgttttcttttctccgatagcagaattgcatcttttcaaacaatgcaactggacattctggttattaatcttttttcatttatcctgatatatatatatatatatatatatatatatatatacacacacacacatatatatacccatatatatatatatggatagactttcactttgaatactcatgtcttatttcataaatgttcgtgcactctttctctgacaatttcttcccatcaatttttccttatttttgctttctagaacctatattagtagaaaggtcaatcaactaaattaatcatttctattgcttaccttttcactgctatctccctattcttcatcttcttgtaccactgtttggaaaaatttctcagctttctctttcagtttgtctattaactttctgaattctgtaaccacatttttaaaacagactttattttttgaacagttttagatttaccaaaacattgaaaagaccatacaaagagttcccatataccatgtaccccatttctcctattagtaacatcttacattagtaagtgacagtggtcacagttgataaacctatattatattgatacattattattaaccaaagctcatagcttatttagatgtccttagcttttaactactgttctttttcttgaccaggaccctatgcaagctaccacattacatgtaattgcattgtctcttcaggctcctcttgactatagcagtttctcagactttccttgcttttgatgacttgactgttttgaggaatactgatcagatattttgtaggatggcccactatttgaatttatctaatgtttttctcatgatattactgggtcagtgagttactgggaggaggatcacagtggtaaagtgccatttgcatcacgccatgtcaatagaacattctatcaacatgatttatgatgtttgatgttgaccttgatcacctggctgagactgtgtttgttaagtttctccacttcagagttacgcttttcttgctcttaccctttccacactgtactcttcggtaggaagtgactatgcacagtccacactcaaggaatgggaatttatgttccccaacttgagggtgaagcatctacataatttatctgaaattcttctccatgggagatttgtctcagtaaccacattttaaatttccaaaattccattcttgttctttgattgtctctttctcacagcatcctattcatacatgctgtatcttctctaatttttctgacaatatcattgtaggattttggcagcaaggacctctttggttctctaaatttctgtttccttgacagtttgcttctcttagtctttccctgacattacagtttgttttcaaatttctggagacccttgcttacttattcatattcatgtcaaaatcaataaacagcagggctcagagctctgcctaggggagtagagcttattggccaacgggcttcactttaggatgagtgggaagggagctgtcccttctgctggtagcccctcttaacatcagaatgcagtttattggagacattaacactcacactaactatcctggttaatcttagacagcatgtttggtctcattagagaataaccttcttcatgttagtggggttagggatgctgaatgcctggctgctggccattctgagcactggattggaggggttgctgtgggtcattttgttccacagactgaccattaaataacactccaattttatacctcactcctcactcttgttctccattgaaccacgtgcagtttccaagtctggagtgtccctgggactctagcaggtagaaccctaaagacactccagtctctctccacacagggcaatgggtctggatgtggcatgctccaccctgcttcagtggtcagtgctctttcatctgcttcctccctcctgggaacctgctgagcactctcctactctgattggccccctcctgtccttgctgttatttcttggcatcattttagtgagggagaggagagaagcattatgccatttgtcaccttgaacacggctctacttgttttaattataaaagtatggtgaattaattaaggtaggctaaataactgtaacaaattaaccctaaaacatataagatatagtagcagcttctttcatattagtgtaatggtccaaagtttctggcagtggcctccctcaatgcagggattcaggcacccagactctacctttcctgtgactttgccatttcccagtgtctcgctgctatctgcacctggccagcagaagaggagacagagcagggaggtgacatgcctactttttaaaagctttgggccagtggcatatagatcacatccgctcacactggactgctgagaaccagtcttgtacccacggttagactcaaggaggttggagacccagtccctgcctgggcagccacttgctagctgcacctgtgtgtgacgaaagggaggatggatctggttgtgcatttctctggtctcctttgccacacatgtatgggtcgaggatggggtgacaggctatggtaagaattgggcagaagacacttttctcagtgacaatagccagtcttaatcatagcagtcttaatcataccttcatccctgcatgtgccgtaaggctgtgccatgcttctcattgagctaccctagctgctttgaagggaagctgaaaggaaacaatgctcatttaataaatccatgtgtcaggcattgtgctaggagatttacatgcaaccccgacaacacacattttctttgagtcacaacaaaagctgttgctctctgtttatgaaatttatgctccctgtgggaaaggcatagtatgtggggatcattttaaagaagtaagttggcagaaaattatcattcacctactaagtgctagacatgatgccaggtcttaggaagacaaagatgggaaagactccatgcctaatttccagaagctcagatttctctaaaatgcaaacaaatcatcacaataaaatgtgataagtgctatcgtgggagacagaggagagggagaatcttctctgcctacaagggcagggaggttgggaagaggggttcagagaaggtgtcacaatggagatgtctagcatttgagtagggtcttaagagatagttaggatttttccaaagagaaaggggcagtgggatattcaggcagagggaccaacatacagaggtcaagagtcatggattttccaggcaagtaatgtggtgcctgatacaagggcatcccaggaaggtgaggcaggagtggtgatgtgatagtgaggaggaggatggtagcaatcgccagcccataatccacttcctgccagaacttgcagtctctggctgtctcccccttctgtccaatacattccagagtcagctgtcctcaccagcaattttagcttcctcagagaatggagtggacagcttacttgagaccagggcttctcaacctccttagcacaattgacatttggggccagataatgccttgtggtgggggctgtgttgtgcatgatagaagggttacagagtccctgcctctactcattagatgccagaagcacttcctaaggtgtgacaactaaaaatgtctccagacattgcccagtgtgccctggaaagcagaatggccctgcttgagaaccaccgttttagacaaatatcacctttctctcatctaccatagaataaagcatagtgttgatatggtttcgctgtgtccccatccaaatctcatcttgaattcccacatgttgtgggagggactgggtgggagataatcgaatcatggagacgggtctttcctgtgctgttcttgtgatagtgaataagtctcaggatatctgatggttttaaaaacaggagtttccctgcacaagctctctttttccactgccatccatgtaagatgtgacttgctcctccttgccttctgccataattgtgaggtttccccagccacgtggaactgtaagtccattgaacttctttttcttcccagtctcgaatatatcttcatcagcagcatgaaaacggactaatacaagtgttttgcagacagtgggtccatgtgtaagctgaggacacatctcctttgagccagagggtctatttcatcagccaacagttctgacttgcttcagagtagtgctctgaggagcagccaatatacaatagttaccctctattttacattttgcttactttaaacatgtctgtcttttatttttaatattaaagccaggaagacatttagtagataattattttctcaaattgaaggtcaagtcactttttaaaaataaactgattgagacccaggcagattaaaaattatttttgaatgctctttctatcttttcaggacaaagtgacctcttttgtgctttatgacctaaccctcccaaaataatacttcatttacttgcagatcccccagcagtctatctggggcaaatatcagtcaggctcccacattttgtcaactacatgttgactttgcttgctcgcacatctggcatctaaaacatatggattaggctttaatcaacagcccagaatattatcattttaggcacctgtcagagaattcatcccagaattgactgtagcccagcatttgccaaaattgcagttgagacatctgattttcagagagaccatctaaagggcacatcaactcctgattctctcagttctctaagctctgcccccgcgcaaagtcagctcatcagagaacagtaggtccagactctgttattaatcaaacttttcacagaagtgcatttggtgggaaaaagttgttatttcattttttttcttggtagagggaaataaaagaaatacccatctgtggaaaaaaatatgtattttgcaaaatcatggtcaaagttgctgccaattataatccgagtccatttgctaagaatgaatcgagttctggctctggtagccaggtaggagggccaagcatgtgctttcagacagcaaacaaactggttccaagcacagcaccagggaaggccagagagaaagtttcaggtcttaccaggctgccaggatgttggggaggactagaggcaaagcaatgaagcacgttctgggctgacaagagtatgcctgggggctggggtggggatgggggcatctgccatactcaggagggctatgcctatgttttggctctctggagactttcaaaattaaccctttagacacaagtgggtcctatggtgagctccagggagaaaaaatgacattttccctccaagtgagatggaggatgcagggcatttaatttaacttgagagagtgaatatataaatggacaatggccagaccatacataaaaataggactccttcataatctgcagcaacctgcacaggaagccaactgattatctatagtaaccagcccaggaagccaactgattatccatagtaaccagcccagaaaaccagccgattatctacactaaccagcccagaaaaccaactgattatctgtagtaaccagcccaagaaaccaactgtctacagtaaccagcccaggaagccaactggttatctacagtaaccagtccaggaaaccaactgatagtaaccagcccaggaaaccaactgatagtaaccagcccaggaaaccaatggattatctatagtaaccagccccaggaagccagcctgctacgtcagacttataggaagtcagactactatctctagcaataatccaggaagccaaacagtaaccccaaagtagacttgattaaaactgacagcttccctaatttttgtcctcaccccaacttaggaccaactacagaaacccaaatatacacacctaaccaacctcctagtgagaggtgacagagtgctggcagtcctcatagcccttgctcactgtcggcacctcctctgcctgggctcccaatttggtggcacttgaggagcccttcagcccgccgctgcattgtgggagcccctttctgggctggccaaggccagagccggctccctcagcttgcagggaggtgtggagggagaggcgccagcgggaaccagggctgcacaccgcacttgcaggctagctggagttccgggtgggcataggcttggcggccccgcactcggagcagccagccagccctgccagccctgggcaatgaggggcttagcatccggaccagcagctgcagagggtgtactgggtcccccagcagtgccagcccactggcgctgcgctcgatttctcactgggccttagctgccttcccgtggggcagggcttgggacctgcagaccaccatgcctgagcctcccaccccctccatgggctcctgtgtggcccgagcctccccgacgagcaccaccccctgctccagggcgcccagtcccatcgaccacccaagggctgaggagtgcgggtgcacggcactgggactggcaagcagctccacctgcagccctggtgcgggatccactgggtgaagccagctgggctcctgagtcttgtggggacgttgagaatctttatatctagctcagggattgtaaatacaccaatcggcactctgtatctagctcaaggtttgtaaacaaaccaatcagcaccctgtgtctagctcagggtttgtgaatgcaccaatggacactctgtatctagctactctggtggggccttggagaacctttatgtctagctcagggattgtaaatacaccaattggcactctgtatctagctcaaggtttgtaaacacaccaatcagcactctgtgtctagctcagggtttgtgaatgcaccaatcccacactctgtatctagctgctctggtggggccttggagaacctttgtgtccatactctgtatctaactaatctgatggggccttggagaacccatatgtctagctcagggattgtaaactcaccaatcagcgccctgtcaaaacagaccactgggctttaccaatcagcaggacatgggtgggcccagataagagaataaaagcaggctgcccgagctagcagtggcaacccgcttgggtccccttccacactctggaagctttgttctttcgctctttgcaataaatcttgctactgctcactctttgggtccacgctgcttttatgagctgtaacactcaccacgaaggtctgcagcttcactcctgagtcagcgagaccacgaacccaccagaaggaagaaactctgaacacatctgaacatcagaaggaacaaactccggacacgccgcctttaagaactctaacattcacgcgagggtccgcggcttcattcttgaagtaagtgagaccaagaacccaccaattccggacacactaggatgccctgcttctaattagctcaactgcagcttcccgatgccaacagcctctgatcaggggacacctgaagccttctctttcttccatgataaagtttttccattcagagctgcgcagcgcaagcgtcctgggcccataaagttttcccactcctctgcctgcctttgattttctgccaaatacgagtcatggtggctgactgtcttgcaattgcaaattttgaataagtagtttttgctcattttcatttgattggtctctttttattctcacagaatgttgaaagtaatgtaacctaatcttgaactccaagcaagtaaagcatgctagagcaatacccatggaggggcatgcatgtagcatggtcccaccccgtccatacatgtgcacccagtttcttcagtctggaatggccttgtcccctctcttccccctggaggaatcctacccatcctcccaggcttggcgtgaacatttctgcttctgaggacccttccctgcctgtcatcagcaaaatccctggagttcccttattcctccatgttagagtgatgacagcagctcagcataaaatgtcaacaggaaagaaagacacatttcctgagtcattatctatttcctgaaggctttttacatgtgacatttcactaaatcctcccttaactttgtgaagtaggaactccttcctccatttcccaaatggtgaaagcaagactgtaactcattttacaaaattgaagatgtatttctctttcccagttcccttttgagcttcttattaagattatttctgatgcatcttacttctttaatgcagagcaaattctggacaaatgaaagctgtttcatccaggcttggggactgaatgaataaataaatgaatgggttatcatggggcagaaaaaatgaatttgtttacaagcttagtctggcttaaatgactcattactcaaaagcatagaccatatggttcccttaggtaaagggatctaactcaaactttttcatccacccagaccccgtttctatggacaggagatgagtcataaaattccaggtggaggcgtcaagtgtttccaactctggctgtgttggtttggaggctttgatgcctgtgggtcacgttctgaagacttaccagggagcagcaagtgagaagacaaatgtcagcaggtgatatataatctgtgcttaagcaacaggggaagaaaacacttggtaagcagtgtatgagagaatgcatcattttgcccagccttagggagtccgcatctttggtacttttaattattttaaacatttttatggaaaagttgtcatagcaacaacatcaacaaatattttgaagtgaaaaattctatttccagcaccttcaagtaataattttcattttttgctcattttccacccatgtctaaccacacataagcattttatatacttgtgaccacaaagcaatgtctattttgtgtcctgcttttttgcgtaacatcatgccaaaaatattttctatgtttctgaaggcttcatatttaaaatgttcctctgcctaatatttcatatgttactaaactattcccacattgttaggtaatttgttcacttctcaaatttttaccattttttaggacatgttgccaaaagcatcttcttgcatataactatttattctcattattgccttagaatgaatgcaaaggaatagtgtttctgacatctttgtggcttctgctacattaataccatgttgctttgcagaagcactctgctaatttagaaaaccagcagtttgaggaggatgccttgttatgaagcctgtgcagacttatccttatggtggagggctagacagtcaatggatgcagcaactccttaaaaagaattaaaaggcatttgctgaggtagccatgtgggctgcacacgtgggaaaaattaactccaaggctgccttgattagaatttttctgaagcaaaacaattttgctctggatatgtgaactcttataatggtaatagagggttttccttttctctcttctgagttttgcatctcttaggcctaggtgtgactacaaaaccagagactggcttttacaagcacactggagttcttacctgcaaacaggagcccatctttcaaagatctttccataggaacctctcatataattgcttaaacatgaaaactttcttagggaattgcattcatggccagtttttaaactacaaaaggaaacttagactcattttattatttatttattatttttgtttgtttgtttgtttttttgagacagagtttcgctcttgttgcccaggctggagtgcaatggtgtgatctcggctcactgcaacctccgcctcccaggttcaagagattctcctgccttagcctcccgagtagctaggatgacaggcatgcaccaccacgcctggctaattttgtatttttagtagagatggggtttctccatgctggtcaggctggtctcgaactcctgatctcaggtgatccacctgcctcagcctcccaaagtggtgggattacaggcatgagccaccacacccagcccaatttatctttttatttccacaagagatactcaccagtttggtgagcaagcagtgaaaagtaagccaggctggtatgtcaagttcataatgataattatagttgccatcctaggagcactcactgtgtgacaggttcagtgctgagtctcatctggatcattccactggccttctccctgtggccctgctttcactctgacccctactatctaatccccacacatcaaccagagtgatcatctcagaacacaagtcagatagatcactcctctactcaaaatccttcagtggtttccatctcacttggagtgcaaacccaagtcctcacaggagcctgcccctcacccttcttatctcccactgcaccccctcactgcctgtattagtcagttctcatgctgctagtaaagacatacccaagacagggtaatttataaaggaaagaggcttaagggactcacagttccacatggctagggaggccttacaatcatggcagaagacaaagaaagagcaaagggatctcttacatggcatgaggcaagagagagcatgggcaggggaactcccatttataaaaccatcagatcttgtgagacttattcactactgtgagaatagtatggggaaaccaccccaagtttcaattatctccacctggccccacccttgacatgtgggaattgttacatttcaaggtgagatttgggtggagacacagccaaaccatatcactctcttccagccatgttgaacccctggctgttccttaaacattccaaacatgctctgacttcaaggtcaatggaatgtgagctgtatattgcatgtgcctagacataaagtattccccactactaagtgatggagcccaaacaattgtcctgaatgctgactgcagaccacctttggttgtctccattctgtgagtttaaatgcagatagaacacattgcaataaaactatgggctttgattagcagtgagtgatatgtgatctgaagattttggggggtggcaaatgcttatattttgtctattaatttaatatcccccaataaaattgactgcaagtgttggctaaaggattgagccatgaccttgtctgtttgacactgcaggtatttccaggcaagcagagggtatatccacatgatattctgcaatttgtgatttagggcagggattggtaaaattttcctatacagagagagagattaagtattttaagcattgcaggtcattgtagcatgaacaaaactttatttacaaaagaaggaagtggtcaggttttccagtccctgatctaggggcacatgtgggagctcaagccaatatttgggagcacaggtctgacatgagagttcctcattggaaaataaatcacattcttttttttcttatactttcagtgtctggcacctcacctggcacataggagacattcagtaaaaacctttcaaaataaatgactgaatgaatgaatgtatagagtttggagtgcatagatctttttctatatgtacagagagatcttgttcattcacaaatttattagacaaaacatttattaagtgtcccctatgtgccagacactggggctcagtaaaaaagatgggatttgcatcagacctcacagaacacagggtcaatatggggagacagatgttcaagggggactatcagcaaaatgtgaaaattgttaacacagaggaagttcagggggttttagaagcactttggtttggagggcactctatgttatggtccaggagagtccactagtctctgcgcttgtcaatcaagaagcagcaatggcacaaacccacaaatgcagggaacagagcttatgtaagtgaaggacgtggtcatctttgtaaacatgaataaattgtttagttgtaagcactgtattcaataagggaggttcaaactgcttgcataagagggctttctagctattaatcaagtggaaagcactgttgtgaaggctgtattgggaattttgaacaccatttgatttctcttcaagcctctttgagggagtattatgttcagagccagccttttaacaatgcactatatttaatctttttaccacttttgacctttttctctaaaaattatttccattattccaaatttcattttgcctttgctatacctcttttgtaaatttttctttaggagataaagaacccattaaatgctgtgaagtccctgcctgcctttaatatgggagggatatgggagctctaatagaaggtcactggattgtgagaaaaatagattcacagtgggcacagatttctttttgtatatatgctggcagcagtgcctggctgtaactataagaaaaatggtaaactccatccttgcactttattagaatgacgtttcttacattaaaactggtcaaactataacaaaaggcctaacattcacgtcatcagagttctgaagagagatgaaaaagatggggctgaaaaattacttgaagaaatagtggctgaacacttcctaaatttgacaaaatatataatttaacagttgcaagaagctcagtgaaccccaaacagggtaagttaaaaaaaaaaatcacaccaagacacatcatatcaaacttctaaaaattaaagacaaagaaggataccttgaaagtagtgagagggaaacaaaaccttacctgaggggaaaacaaatcaaatgacgatgtatttctcatcagaaaccatggaggctagaagaaagtggcacaacgttttccaaatgctgaaagaaaaaaactgtcgaccgagactcatagtcccagcaaaaatatcctcaggaatgaaacagaaatcaaaacattctcaaagtaaaatgaagataatttgtcattagcatacctgccctaaaaggatagcaaactgaacttctctgagcagaaagggaaccataaaagaagaaaccctgaatcatcaagaaggaagaaaaaaacacagtaagcatgatactgtgatacaataaagcatacagtagttctcccttatctttgggtgatattctctgagacccctggtggaggcctaaaactgtggacagtactgaaccctatatatatatactgtgtatatactgtgtttttttcatatacaaacatacaggctgggtgcagtggctcacacctgtaatcctagcacttagggaggccgaggcaggaggatcacatgagcccaggagtttgagaccagcctgggcaacatacagagatctctctataaaaaatgctaaacaaatttttaaaaatttaaaaaagaaaacatttaataaatatgtataataaagtttaagttataaattaagcatagtaagagatcaacaataacttatgataaaatgaaacaattataacatatactgtgtaaaagtcatgtgaatgtggtctctctctctctaaatatcttatcatatgtagcattttcagactgcggtcgaccactggtaactgaaaccttggaaagtgaaactgcagataagggggactactgtatataatttggtttttatttacagttcctggctcagagctcctaaaacatttgtaaaatcctgagtaactgaagcaataggagtattcttgttaaagtatttggccttttgtcacttgttcctgaaacaactcccaagcaggtaaaagatgtattttttgttattcataacaaactcctttcaaccacacctgaatttatgttaacaaggtgatttttggaaagcctgcagaaaacagaaaatgtggggctcactgctgggaaaactagtcatgagattggagggttggaacttttagccccaccccccaacctccagggaagggagaggaggggttgaaggttgacttggtaaccaaaggccaatgatgtaatcaatcatatctatgtaataaagtctccatgtacatacgaaaggacaggccgggtgcggtggctcagcctgtaatcccagcactttgggaggccgaggcctgcggatcacgaggtcaggagatcgagaccatcctggctaacaaggtgaaaccccgtctctactaaaaatacaaaaaattagccaggcgtggtgacatgcgcctgtagtcctagccactcgggagcctgaggcaggagaatctcttgaacccaagaggcagaggttgcagtgagcagagattgtgccaatgcactacagcctgggcgacagagcaagactccatctcaaaaaaaaaaaaaaaaaaaaaaaaggaagaaaatacaaaaggacagttggaggcggtggctcagcctgtaatctcagtctcagcactttgtgaggctgaggcctgcggatcacgaggtcaggagattgagaccatcctggctaacacagtgaaaccccgtctctactaaaaatacaaaaaattagccgggcgtggtggctcacacctgtaatctcagcactttggaaggctaaggcctgcggatcacgaggtcaagagatcgagaccaacctggccaacatggtgaaaccccgtctctattaaaaatgcagaaattagctgggcatagtggcacataatcccagctactcgggaggctgaggcaggagaatcacttgagatagcgccactgcactccagactggagatagagcttcttctcttcttcttcttcccttgagctttctaaaatatatttggtggtgaaagcaaaagcataatgttgtctactgtggttttaaatgtagaggaaattgttacaataattatactataaaggaggaaggataaaggaatataaagagaagtaagtttctatacctcattcggactgataaaacgacaacacctgtagaatgtcttctgtatatatattacctattattctacctattaatataaggtaatacatagagcaaccactaaaaaagcaatatttagataaaagtaaaaaattctataggcacatcaaatttgaattctaaaatatgtttaactcacacgaaagcaggaaagagaaagagacatgaaaaatagacatcacaggctgggtgtggcggctcatgcctgtaataccagcactttgggaggccgaggtgggcagatcgtctgaggtcaagaccagcctgggcaacatggtgaaaccccgtctctactaaaaatacaaaaattagccagggatggtggcgggtgcctgtaatcccagttacttgggaggctgaggcaggagaatggcttgggcccaggaggcagaggctgcagtgagccaagattgcgccactgcactccagcctgggcgactgagcaggactctgcctcaaaaaaaaaaaaaaaaaaaaggaaaagaaaagtgacatcacaattacctaatacctgtgggacttaaaacctagatgacaggttgatgggtgcagcaaaccaccatggcgcatgtatacctatgtaacaaacctgcatgttcagcacatgtatcccagaacttaaagtaaaataaaaaagaaagaaaaatagacatcaaacaaaacaaaagttaaaatggcacacttatgcataaacattaattaccttaaacgtaaatggtcctaatagaccaaataaaagagagatcggtggagtgaattaaataaggctcagctacagatggtcccaacttataatggttcgacttataattttttcactctacaatggtgtgaagcagtagtaattcagtggaaaccatactttgagtacctatacaatcattctgtttttcactttcagtacagattacatgacctattgagcactttattataaatagacttcgtgttagatgattttgcccaactgtgggcaaatgtaagtgttctgagcatgtttaaggtaggctaggataagctatgatgttcagtaggttacatttattaaagtatttttgacctggaatattttcaacttatgatgggtttatcagaacataataagctgaggagcatcaacatatgccaagaagctaaaagaaactcactttaaatataaagatataggccagtggaaagcaaaaagatggaaacagttatatcatgtacacactaattaaaggaaagcagaagtggctattttaacatcatataaagtggacttcagagcaaagaaaattattggagacataaaggaacattatataatgacaaaagggccaatccacgcacaattcatagcctaaatgtgtatgcaacagagttataaaacatgtgaagagaaaggtgaaatagataagtccatagttatggttggtgacttcaacactctcaacaatttatataacaactagacataaaattagcaaggatattgaagaactcaacaccagcatcaactaacaacatctattgagtgtttataatacattccacctatctatagcagaatgcctcttgttttaaagtgctcatgggatatataccaagatcaacaatatcctgggccataaaacaaacctcaaaaaatttaagcaaattgtaattatacagtgtgttctatgaccacaaaagaatcacactagaaaagataaaaaaatctccaaacacttggaaacaacacacttctaaataattcgtggatcaaaaaagaagtctcaagggaaataaaatacattgaactgaatgaaaatagaaacaacacaccagaatttataggacacagttaagcagtgctgggggggaaacttatagcactaaatgcatatattagaaaataacaaacgtgttaaataaataatataagctatcatctcaagaacctaggtaaagaagagaaaactaaatccaaagcaaggagagggaaagaaataataaaaagaagagcagaaattgatgaaattgaaaacagaaaaaaatgtagaaaaccaatgaaagaaattgctgggccttagcaaaggtcaagcatgtttacaaactgctagcaagactgacaacgaaaaaaagaagatacaaattaccaacatcaggaatgaaacaaaatatcactacagaccttacggacctgaaaagaataataagagaatacttggagcatctctacaaacataaacttgatgttggttggtggcagatttgacattatgttgatataacttggtaaatttagataaaatggaccaactcctcaaaaaacaccaactaccataagtcatccaatatgaaatagataatttgaacagctctataactattaaggaaattgaatttgtaatttaaaattttccccaaagaaatctctaggcctagcagggctcagtggcttatgccaataatcccagcactttgggaggccaaggtgggtggatcacaaggtcaagagatagagaccattctggccaacgtgatgaaaccccatctctactaaaaatacaaaaattagctgggtgtggtggcacgcacctgcagtcccagctacttgggaggctgaggcaggagaatcgcttgaacctgggaggtggaggttgcagtgagccaagatcacgtcactgcactccagcctcacagcagagtgagactctgactcaaaaaaaaaaaaaaaaaaaaaaaaaagaaatctctaggcccagattgtttcactggagaattctaccaaactttaaaggaaaatcaataccaattctgtaaaatctctccacacaatagaagaggaaggattacttcccagttcattttatgaagctggtgttatcttgatatccaaagcagaaaaatatcatacatgaaaagaaaactacagactaatattcctcattgatatacagttgcaaaacttatttaataaaggaagtccactctcactactctaataaaacttaatgttggaggttgtagccagtgcaataaagcaaggaaaggaaacagacatacagaccatagggaaggaataaaactgttcttatttgcaaatgatatgtctgtctacatagaaatgccaagatatttaccaaaaaaaacttccaaaaataacaggtgaattcatcaatgtcacaaaacttaagataatatgcaaaacatattaaagaacataaaaatgttcaaaatgtaatattcaaaaatgtaataccatttaaaatcaaagagaaaggcagaggaacttttaggtataaatataacaaaatgtatacagggcttgtatgctgaaaactatagaactctgaaagaaatctaagaagatctaaataaacaagagttgtgacatgtttatggactataagactcaacatagcaaagatgtcaattctccccaaattgatacacagatttaatgcaattcctatgaaaatatcagcaagatttttaatagacatagacaacattattctaaaattcatgtggaaaggcaaaagaaatacaatagctaaaaccatttctaaaaaataagagcacaatgggaggaggtataatagccatacttgatttcaagacttattatatagctacagtaatcaagactgtgtggtattgtggagggatagacacacagatggcgggaacagaatagcgcagtggtttcccagcctttttggtaccagggatgggttttgtggaagacagtttttctatggaccatgggggtgaggtacagggatggttttggggtgattcaagcacattacatttattgtgcactttatttctattattattacattgtaatagataatgaagtaattatacaactcaccataatgtagaatcagcgggagacctaagcttgtttccctgcagctagacgttcctatctgagtgtgatgggagacaatgacagaccatcaggcattagattctcataaggagcatgcaacctagatccctcacatgcacagttcacaatagggttcgtgctcctttgagaatctaatgccttggctgatctgataggaggtggagctcaggtggtaatgcaagcaagcgatggggagtggctgtaaatacagatgaagcttcacttgttggcctgctgctcacctcctgctgtgtggctgggttcctaatgggctgtggggcggggaaccttggaatagagaacccagaagtagaccccccccaaaaaatattcggttgatatttacaaaggtctaaaagaaattcaatgcaggaaagagctttctcagcaaatggtgctagagcaattggacatccataagcaaaaaaagtgaatcttgacctaagtctcacaccttataaaaaaattatgtcaaaatggatcatgggcttaaatgtaaaactataaaaattatagaaaaaaagaatataggagaaaacctccaggatctagagctacaaagagttcttagatggaagaccaaaagcataattcataaaaggagaattgataaattggactttatcaataaaaacttttgctctgtggaagaccctatcaagtagaggagatgagctaaaaacgtttgcaaaccacatattcaagaaaaggctagtatttcaaatatacaaggaactctgataattcaacagtaaaaaaaaaaaacaaaaaaaaacccaaacagtttaattagaaaataagaaaaagacataaatatttcatccaagtggatatacagacagaaaataaacacatggaaagatgctgaacaacattagcttttagagaaatgcaagttaaaaccgcaatgagctatcaccacacacttatcagaataactaaaattaaaaatagtgaaaatataacatgctggacaggatgcagagaaaatgaagcatttatacattgctggtaggaatgtaaagtggtatgccactctggaaaacaatttgagtttccaaaaagaattaaacacagaattactattcaacgaagtaattgtagttttgggcgttttatccaagataaatgaagacttacatttatacagacacatgtacacaaatatttatagcacctttatttgaaatagcccaaactggaacacagcttacacatgaaatcggtaagtccaagagatatctgcactcccatgttccctgcagcgctatttacagtagtcacaaatggaattaacctaatgttcatggatggatggatgaatatattttttacaaaatgttattcagtcttaaaaaagaaaaccctgccatttgtgactacgtggataaacctagaggacctgtccttcagtggctgaatggttaaacagacagatgttatcattgggagaaactgtaatgggcacattgggttcctctgtgttattatttttttttacaactgcaagtgaatctaaaattatctcaaaataataaatctattcattattctccagctttaataaggtataattgacaaaaaactatatatttatggtgtccaatgtgatgttttgatatatgtatacattgtgaaatggttggcgaattaacatatctatcacctcacatatttgtcatacttcgtggtgagtacatttaagatttactctttcagcaattttcaagtacattattaactttagttactatgctgtgtattagatttccagaactacctattgatcttaactgaactttgtaccctttgaccactatctctccatcttctcccctcctgccattccacagcccctggcatccactattctactctctgcttctatgagtttgactttttttttttttgagacggagtctcactctgtctcccccaagctggagtgcagtagcgcgatcttggctcactgcaagctccgcctcccgggttcaagctattctcctgcctcagcctgccgagtagctgggactacaggcacctgccaccatgcctggctaattttttgtatttttagtagagacgtggtttccccgtgttagctcctgacctcgtgatccgcccgactccgcctcccaaagtgctgggattgcaggcgtgagacaccgctcccggccatgagtttgactttttaaaatttaatttgatttgattttattattattatactttaacttttagggtacatgtgcacaatatgcaggttagtaacatatgtacacatgtgccatgctggtgtgctgcacccattaactcgtcgtttagcattaggtatatctcctaatgctatccctctcccctccccctaccccacaacagtccccaaagtgtgatgttccccttcctgtgtccatgtgttctcattgttcaattcccacctatgagtgagaatatgtggtgtttggttttttgttcttgtgatagtttactgagaatgatgatttccaatttcatccatgtccctacaaaggacatgaactcatcattttttatggctgcatagtattccatggtgtatatgtgccacattttattaatccagtctatcattgttggacattcaggttggttccaagtctttgctattgtgaatagtgccacaataaacatacgtgtgcatgtatctttatagcagcatgatttatagtcctttgggtatatacccagtaatgggatggctgggtcaaatggtatttctagttctagatccctgaggaatcaccacactgacttccacaatggttgaactagtttacggtcccaccaacagtgtaaaagtgttcctatttctctacatcctctccagcacctgttgtctcctgactttttaatgatttccattctaactggtgtgagatggtatctcattgtggttttgattttcatttctctgatagccagtaatggtgagcattttttcatgtgttctttggctgcataaatgtcttcttttgagaagtgtctgttcatgtccttcacccactttttgatggggttgtttgtttttttcttgtaaacttgtttgagttcattgtagattctggatattagccctttgtcagatgagtaggttgtgaaaattttctcccattttgtaggttgcctgattcactctgatggtagtttcttttgctgtgcagaagctctttagtttaatgagatcccatttgtcaattttggcttttgttgccattgcttttggtgttttagacatgaagtccttgcccatgcctatgtcctggaagagtttgactttttaagattccacatataagtgagatcatgcaatatttgtctttctgtgcctgggttatttcacttagatagtgtcctccaggtttatccacgttgttaaaaatggcaaggaaatctgaatgccaatggaagactgaatagtactttaaaaaattattcatccatccatccataaacattaggttaattccatttgtgactgttgtatatagtgctgcaatgaacatgggagtgtgagtgtctcttagacatactgatttcacttcctttggttatatatccagaagtgggattgctgaatcatatggtagttgtatttttaatattttgaggaccctccatactattttccataatggctatactagtttatattcctgccaatattacacaagagttccttttctccatatctttgccaatacttattttatgtctttttgataatagccattgcaacaagcatgagttgatatttcattgtggttttaatttacatttccccaattagtgatgttgagcactttttcatctgttggccatttgtatgtcatcttttgagaaatgtcttttcatctcctttgcccattcttacaattttaattgggttatttgtcttcttgctgttgagttgtttgagttctctaaatattttggatattaacctcttatcaggtgtgtaatttgcagatattttctctcattccataatttgtctctactctgttggttgttttctttactatgcagaagcttttcagtttgatgcaatcccatctatttttggttttattacctgggctccaaaattgtaagtttaatttttaaaatctagtaatgagaagcttaaaaaaatcagaatcaggaagtatttattgagcccttactttggccagagaccattttaggagctgaggatacatcaaggaatgcaagaatctaaatccctgtcctcacagggcatctattttagagcaatagagagaattaacaaagacgaaaattcataatataatgttgagtattaggaaatactgttaccaaaaataaaacaacctaaggagatagagaatgtttgggggaaagggtagaaggcttttatagataaattgttcaagggaagcgttttaggagaagatcacatcaaaattgctcaagggaagtctcaggagaagatggcatctctgtggagatttaagatgattagtttgatttgggacatgtttcactgagacactacctgggtatagatagccaggtaaagctgtcccgaaggtaggaatagagacagagtttggagtaattttcatgaggatgaatgtttaatggacatagggctaaatgagataagtaagagtgggagcatgcagagaggataggaaaaaccaaggacacaatctttaggagtcagtaggaatgttctactcctcccagtgaaggctgctttgaatgagactgagccagacttccttagttttctttgtgagttgctccttttcttctcaccatcctaatactggagcttatcagtctatagccttgaggctcttttcttctttatctctaccactcccttggagctctcatccagcctgaacccttctcctgagctctagactcttatatccaactgcctatcttcacttcatttgggtatctacctaattttcttgaattaaatttgggaatataggtattgatagagtaaaaatgcagtttttaaatatatattatatatatattatatatatatttatatacatgcatacagagagagagagagagattgagagagagaaagagatgggatcttgccatgttgcccaggcttgtcttaagctcttgagctcaagcaatccatctgctttggcctcctaaagtgctgggaattacaggcatgaaccactgtgcccagccttagaaatgcagggagtttctaacagatcctaaaatttatgaatgtattttgatttcataggatttggtgcatcctggccccaaattttaacaaggccctttcttttaagtttccttcaaatactttctattttattgacatacatctttttgtatactttatttatagtccatgttttgcagctactaaagaggaaaaaatataatactgggtgaaaatgaagaaagcagaaatggaatggatgaaatgaccttattacctctttttctgattttttaaaatggtggttccatcaatataaatgagttttgcagagggagatatcatattgtgaaataattcctatttcaagctccaaacatattttattctgagatgtatgcatattctctagtccatagcgaaccatttccaagcagtcagaaatatctcatgtaattaaaagtcattccaaatcaccttaaagtttggtcagttttgttaatcctatgtatttaagataaaaagggaagacacatccttacttatgttatcaccacatttagaacagaggtgcaatgaggccatttgccaattcctgtggaaattgttttcatgtcttgagacaacagcacattctgcctctgctctcaatatataatattatatataatatattaatatcatattacatatataatatataatataacttcagtgccagtaaagatgtattagttatctatctctgtgttacaaattagcccacaacttggtggcataaaacaacaacatggattatctctgtttccatgggtcagaaatcttaactggtcttctgactcaagagctatcacaagcaggatgaagatatcagccttaagcattccatttgaaaactggcacaagacaaggatgccctttctcaccactcctattcaacatagtattggaaattctggccagggcaatcaggcaagagaaagaaataaagcgtattcaaatagaaagagaagaagtcaaattgtctctgtttgcaggtgacatgattgtatatttagaaaaccccattgtctcagcctagaatctccttaagctgataagcagcttcagcaatgtctcagtatcgggggaaattcagccagatatcaggtgaaattcacccctgatatttcatgtaggtttttttctattttctctaagtgttggctggtctgagaaataaagggacagagtacaaaagagagaaattttaaagctgggtgtccaggggagacatcacatgttggcaggttctgtgatgccccctgagctgtaaaaccagcaagtttttattagtgattttcaaaaggggagggagtgtacgaatagggtgtgagtcacagagatcacatgcttcacaaggtaataagatatcacaaggtaaatggaggcagggtgagatcacaggaccacaggaccacggtgaaattaaaattgctaatgaagtttagggcatgcattgccattgataacatctcatcaggagacagagtttgagagcagacaagcggtctgaccaaaatttattaggtgggaatttcctcatcctaataagtctgggagcactatgggagactggaatttatttcatccctacagctgcaaccatagaagatagactttcccaaagcagccatttcatttcccaaagaggcctaccatcagggatgcattctctttctcagggacgttccttgctgagaaaaagaattcagtgatatttctcccatttgcttttgaaagaagagaaatatggctctgttctgcccagctcaccggcagtcagagtttaaggttatctctcttgttccctgaatattgctgttatcctgttcttttttcaaggtgcccaaatttcatattgttcaaacacacatgctctacaaacaatttgtgcagttaacacaatcatcacagggtcctgaggcgacatacatcctcctcagcttacgaagatgatggtactaagagattaaaataaagacaggcataggatatcacaagggtattgattggggaagtgataagtgtccatgaaatcttcacaatttatgttcagagattgcggtaaagacaggcataagaaattataaaagtattaatttggggaactaataagtgtccatgaaatcttcacaatttatgtttttctgccatggcttcagccagtccctctgttcggggtccctgatttcccccaacatctcaggatacaaaatcaacgtgcaaaaatcaaaagcatccctgtacaccaacaacagacaaacagagagccaaatcatgagtgaactcccattcacaattgctacaaagagactaaaatacctaggaataccacttacaaggggtgtgacgtacctcttcaaggagaactccaaaccactgctcaaggaaataagagaggacacaaacaaatggaaaaacattccatgcttgtggacaggaagaatcaatattgtgaaaatggccatactgcccaaagtaatttatagattcactgctgtttccattaaattaccattgacattcttcacagaattagaaaaacctactttaaaattaatatgaaactaaaaaagagcctgcatagccaagacaaccctaagcaaagagaataaagctggaggcatcaggctacctgacttgaaactatactacaaagctacagtaaccaaaacagcatggtactggtatcaaaacaggtatacagactaatggaacagaacagaggcctcagaagtaatgtcacacatctacaaccatctgatttttgacaaacctgacaaaaaaaagcaatggggaaaggattccctatttaataaatggtcttgggaaaactggctagccatatgcaggaaactgaaactggactccttccttacaccttatacaaaaattaactcaagatggattaaagacttaaacataacacctgaaaccataaaaaccctagaagaaaacctaggcaataccattcaggtcataggcgtgggcaaagacttcatgaaaaaaacaccaaaagcaatggcaacaaaagccaaaattgactaatgggatctaactaaattaaagagcttctgcacagcaaaagaaacgatcattagagtgaacaggcaacctacagaatgggagaaaatttttgcaatctatccatctgacaaagggctaatatccagaatctataaataacttatacaaatttacaagaaaaaaaaaccccatcaaaaagtgggcaaaagatatgaacagacacttttcataagaagacatttatgtggccaacaaacatatgaaaaaaagctcatcattactggtcattagagaaatgcaaatcaaaaccacaatgagataccatctcatgccagttagaatggtgatcattaaaaagtcaggagacaacagatgctggagaggatgtggagaaataggaatgcttttatgctattggtgggagtgtaaattggttcaaccattgtggaagacagtatggcgattcctaaaggatctagaaccaaaaataccacttgacccagcaatccctttactgggtatataccgaaaggattataaatcattctactataaagacacatgcataccatatgtttattgcagcactgttcacaatagcaaagatttggaaccaagccaaatgcccatcaatgatagactggataaagaaaatgtggcacatatacaccatatgcagccataaaaagggatgagttcatgtcttttgcagggacgtggatgaagctggaaagcatcattctcagcaaactaacacaagaacagaaaaccaaacactgcatgttctcactcataagtgggaggtgaacaatgagaacacatggacgcagggggaggggtacatcacacactggagactgtcgaggggtggggtggggggctaggggagggatagcattaggagaaatacctaatataggtgacgggttcatgggaccagcaaatcaccatggcacgtgtatacttatgtaacaaacctgcacattctgcacatgtatcccagaacttaaagtatgggaaaaaaaaaaaaaaacaaaaccaggaaaaccgtttttttttaaaaaagataccagcttgggctgcagtgaactcaaggctagactggggtaggagagtcttccaagctcactgactggatcggcaggattctgtctcttttctcatgagcctttccatagggcagcccacaacgtgactacttactgcatcagagaaagcaagcaagaagatacagagaaagacagacagagagagagagagagagagagagagaatgcgaacagtagagaagttagtcttttataagctaccaatcttgtaagtgacatgccatcactttagctgcactcttgttgccaaaagcaagtcactaggcccagcctacactcaagtgtaggagaatatataagtaccaggaggcagagatggttgggggacattttagaggcagtcctgccacttgatgcatggatatttgttgaatgaatgaataattgcataaatgaggttatatagtttgatgctaatcataatgaaggatcaaactatggcatcccagacaaagtcaatatgtatcattgtatacttacaggtgaaagtacatttcagtggaggtccactttcaaaaggatctggctgctacagtcagatatttttgtagctttgttgagtcagtgggacaagaagggcacttccttaaaatgtttatttgtgtctggttgggttctgccaacctggatgtggaaggcaaatattaccagtgaactgtcactggctcactcaagaagattcaggcttacaaaattcttaggcatatacaaaatctttccttgattaaacaaaaaaaggttattagcaccctcccaatgtgctttttgaagtaatacatttatccaatagacataaaataaagacttctggctgctaaatgaatgaatgccaatggcaaatatgaaataacttttgcagttatctacctcaatgtagacactgcattcagaaagtatgctgtgaaaccatgctaagtatcatgcctgagccagcctcaaagtgagagtcactgaaacaaatgttcctataaaaagcctgcatcaggaagtcctagccagggcaactaggcaagagaacaaaaaaaggcatccaaattggaaaagaagatgaactatctttctttactgatgatatgattctatatatagaaaaacctaaggactctgccaaaagtctcctggaactgatacgaattcaataaagtttcaggatacaaaatcaatgtacaaaaataagtcgcatttctatacactaataatgttctagctgaaaaccaaatcaagaacacaacaacatttacaatagccacacaaaaaagaaatatctaggaattcatctaacaggaagatgaaagatctgtacaaggacagccacaaaacactgctgaaagaaatagacaacacaaataaatggaaagctattccatgctcatggattggaagaatcaatactgttaaaatggccatattgcccaaagcaattgcagattcaatgctatccctatgaaaataccaatatcatttttcacagaattagaaaaaaatctgttctaaaattcatttgaaaccaaaaaagagccctagcctgaatagtaaaagcaatcctaagcaaaaagaacaaagttggagacatcacattacctgacttcaaaatctactacagggatacagtaaccaaaacagcatggtactggcacaaaaacaaacacatagactcatggaacaaaatagagaacccagaaataaaactgcacacctacaaccatctgttctttgacaaaattgacaaaaataagcaatgggaaaaggacttcttattcaatgaatggtgctgggataaccgggtagctatatgcagaatgatactagatccctatctcttatcttacaaaaattaactcaagatggattaaaggtttaaatgtaagacttcaaatgataaaaatattagaaaaaaacctaggaaatgcacttcttgatattaactttggaaaataatttatggctaagtccccaaaagcaattgcaacaaaaacaaatattaacaaataggacctaattaaactaaagagcttctgcacagcaaattactaatggagtaaacagacagcctacagaatgggagaaaatatttgcaaactatgtgtctgacaaagatctaatatccagaagctacaaggaacttaaatcaacaagcaaaaaccaaataatccaatttaaaaatgggcaaaggacatgaagagacacttctcaaaagaagccatacaagtgatgaacaaaaattgagaaagtgctcaccagataaatgcaaatcaaaaccacaatgagaagccatctcacaccagtcagaatgatgattatttagaagtaaaacataacagatgctggcaaggttgagaagaaaagggaatggttgtacactgttgaggggaatgcaaactaactcagcctatgtggaaaacggtttggagatctttcaaagaaattaaaatagaactgccatctgacctagaaatctcattattgggtgtatatccaaaagaaaacaaatcattctaccaaaaaaaccacatgcactcatgtgttcactatgtcattatttacaatagcaaagacatggaatcaacctaagtgcccatcagcggtggattggagaaagaagatgtggtacatatacaccacggaatactatgcagccataaaaaagaatgaaatcatgtcctttgcagcaacatggatgcagctggaggccattatcctaagcaaattaactcaagaatagaaaatcaaatactgaatgttgtcacttataagtaggggctaaacattgaatacagatagacataaagatgggaacagaagacactggggactactggatgggggagagaggggagtgtgagctgaaaaaacacctattgggtactatgcccactatcttggtgatgggatcatttggaacccaaacctcagtgtcacacaatatacccatgtagcaaacctgcacatgtaccctttaatctataataaaagctgaaattatatatatataaatcaagttggaaaaaaactttaaaagaagttttttaattaaaaaattctgcagcacagctctctcaatgtcccatcttcttcccaggatttgtggttgttgattatgccagatttccaaaacaatccttgctacagccagcactggccctaccagtagtgaggttaggtgtgtgaaaggaaaacaaatctcgagaccccaaactcactaagccaaagggaaaagtcaagctgagaactgcatcagggaaacctacctcccattttagtcctaaataagatagctacaaagataaaaatgctacattcctccctcacggtggtcaccactggatgtcatctgagggctgaggaatcactgtcttgctcaaaagcatcccctttctgtcattggtcttgagttggggaaatgtgtggaatgccccgtgagggctgggtaggtcccttggggctgtgaacaggcaaagagcctcctccaccacagctcagctggcttttccactggaccactgttgtacatcaactgcattaagcatataatctcagattcatctcccaatcccattaggggtgatgctgcctaccatttcacagacgagaaagccaaggcttagggagaccaagtaacaggatttgagtgcagcatcatctagcttgattgccacaacatgattcctgttcagggtctgttctgtcctgggttgaatagtgacccctcacccccaaattcacatctatctggaacctcagaatgtttcttgaattggaaacagggtatttgcagatgtaaatagttaaaatgagggcatactggattatggtgggccctcaatccagggactgatatctttatcagagaaaggagatggagatttagacacagatgcatacacagggaaaaagccatgccaagagggaggcagtgactggagtgatgagtctgctacccaagaaggccatggactgctgggatccaccaggtgctgggaagagaaaaggaaggtgatatgtttttgttctgtgtcccacccaaatctcatgttgaattgtaacccccacgtgtcaggggaggaacctggtgggaggtgattgggtcatggggaggacttccctcatgctattcttgtgatagtgagtgagttctcatgagatctgatggtataaaagtgtgtggcacttccccctttgctctctctctcttgctccacatggtaagacatgctttcttccccttcaccttcgccgtgattgtaagtttcctgagacctcctagacatgcttcctttacagcctggggaactatgagtcaattaaacctcttttcttctcaaattacccagtctcagatagttcttttttttttttttaagaagttccaggatacatgtgcagaacatgtgcaggtttgttacataggtatatgtgtgccatggtggcttgctgcacctactgacctgtcctctaagttccctcccctcactccccatcctccaacaggccctggtctgttttatcctcttccctgtgtccatgtgttctcattgttcaactccaacttatgagtgagaacatgtggtgtttggttgtctgttcctgtgttagtttgctgaggatgatggcttccagcttcatccatgtccctgaaaaggacatgatctcattcctttatatggctttgtagtatttcatggtgtatatgtgccacattttttttatccaatctatcactgatggacatttgagctggttccatgactttgctattgtaagcaatgcttcaataaaaatacgtgtgcatgtgtctttatagtagaataatttataatccactgggtacataccctgtgatgggattgctgggtcaaatgatatttctggttctagatccttgaggaattgccatactgtcttccacaatggttgaactaatttacactcccaccaacagtgtaaaagcgttcctgtttctccacagccttgacagcatctattgtttcttgaattttaataactgtcattctgactggcatgagatggtatctcattgtggttttgatttgcatttctctaatgattagtgaggttgagcttctttaataggtttgttggccacacaaatgtcttcttttgagaagtgtctgttcatatcttttgcccactttttgatggggttgtttgcttttttcttgtaaatttgtttaaattccctgtaaattctggatactatacctttgtcagatgggtgtagattgcaaaaattttctcccattctgtaggttgcctgttcactgtgatgatagtttcttttgctgtgcagaaagtctttagtttaattagatcccattcatcaattttggcttttgttgcaattgcttttggtgtttttgtcatgaagtctttgcccatacctatgttttgaatggtgttgcctaggttttcttctagggtttttatggtttcaggtgttacgtttaagtctttaatccatcttgagttaatttttgtataaggtggaagggagggttccagtttctgttttctgtttgaaagtaatatctgctctgtttgctcagaagtgcctcttttttgtataaggtgtaaggaaggggtccagttttagttttaggcatattgctagccagttttcacagcacaatttattgaataggagatcctttccccatttctagtttttggttgtacatgtgtgatgttatttctgaggtccctgttcagttccattggtctatatgtctgttttcgtacaagtaccatgctgtcgtggttactgtagccttgtagaatagtttcaagtcaggtagcatgatgcctccagttttgtttttttttgcttaggattgtctttggttatatggggtcttctttgattccatatgaaatttaaagtagtttttttctaattatttgaagaatatcagttgtagtttgatgggaatagcattgaatctataaattactttggacagtatgaccattttcatgatattgattcttcctatccatgatgatgggattttttccattagtttgtgtccttcttatttcttggagcagtggtttgtagttctccttgaagaggtccttcacatctcttgttagctgtattcctagtattttattctctttgtagtcattgtgaatgggaattcattcatgatttggctctctgcttgtctattgttggtgtaaagtaatgcttgtgatttttgcacactgattttgtatcctgaaactttgctgaagttgcttatcagtttaaggagtttttgagctgagattatgttttttttttttaaatatacaatcatgtcatctgcaaacagagacaatttgatttcctctcttcctatttgaatatcctttatttctttctcttgcctgatttccctggccagatcttccaatactatgttgaataggagaggtgagagtgggcttccttgtcttgcaccagttttcaaagggaatgcttccagcttttgcccattcaatatattggctatgggtttgtcataaatggctcttattattttgagataagttccatcaatatctagtttactgagcgtttttaacatgaaacaatgttgaattttatcaaagaccttttatgcatctattgagataatcatgtggtttttgtctttggttctgtttatgtgatggattatgtttattgatttgtgtacattgaaccagctttgcatcaaggaaagaagcccacttgttcatggtggataagttttttgaggtgctgctggattcagtttgccagtgttttattgaagatttttgcatcaatgttcatcagggatattggtccgaagttttcttttttagttgtgtcacttccaggctttggtatcaggatgatactggcttcatagaatttgttagggaggagtctctccttttcaattgtttggaatactttcagaaggaatggtaccagctcctctttttacttctggtagaattcagctgtgaatccatttaatcctgggctttttttttttttggttggtagagtattaattactgcctcaatttcagaacttgttattggtctagtcagggatttgacttcttcctggtttagtcttgggagggtgtatgtgtccaggaatttatcagtttcttctagatttcctagtttatttgcgtggaggtgtttgtagtcttctctgatggtagtttgtatttctgcggtgttggtggtgatatcccctttatcatttttattgtgtctatttgattattctctcttttcttctttattcatctatctagcattctatctattttgttaattttaaaaaaaacaactcctgaattcattgatttttttggagcggggtttatgtctctatctccttcagttcttctctgatcttagttattttctgtcttctgctggcttttggattagtttgctcttgctcctctagctcttttacttgtaatattagggtgttgatttgagatctttctagctttctgatgtaggtatttagtgatataaatttccctcttaacactgctttagctgtgtcccagagattctggtatgttgtctcttcattgtcactggtttcaaagaacttattgatttctgtcttattttcatcatttacccaggagtcattgaggaataggttgttcaatttccatgtaattgtgtggttgagtgagtttcttaatcctgagttctaatttgattgcactgtagtctgagagactgttatgatttcagttcttttgcatttgctgaggagtgttttacttacaactatgtggtcggttttataataagtgccatgtggcacttagaagaatgtatattcttttgatttggggtgtagtgttctgtagatgtctattaggtctacttgagccagagctgagttcaagtcctgaatatccctcttaatattctgtcttgttgatatgtctaatattgacagtggggtgttaaagtctcccaatattattgtgtgggagtctaagaacttgttttatgaatctaggtggtcctgtattgggtgcatatatatttagaatagttagttcttcttgttgaattgttccctttaccattatgtaatgcccttctttgtcttttttgatctttgtcattttaaagtctgttttgtcagagactaggattgcaacccctgttttttttttttttttttgctttccatttgcttggtaaattttcctccatccctttattttgagcctatgtgtgtctttgcacatgagttgggtctcctgaatacagcacaccaatgggtcctgaatctttatccaatttgccactctgtgtctttttattggggcatttagcccatttacatttaaggtcagtatttttatgtgtgaatttgattctgttatcatgatgctatctggttattttgcacactagttgatgcagtttcttcatagtgtcattggtcttcatatttttgtgtgtttttgcagtggttggtaccagtttttcctttccagattaagtgcttctttgaggagctcttacaaggcaggcctggtggtaacaaaattccacagtatttgcttgtctggagaggattttatttatccttcacttatgaagcttagtttgtctagatatgaaattctgagttgaaaattcttttatctaagaatgctgaatattggcccccattgtcctctggctgtaaagtttctgctgaaaggtcttctgttagtctgatgggcttccctttgtaggtaaagcatagtgacctggcctttctctctggctgcccttaatattttttccttcatttcaaccttggagaatctgatgattatgtgtcttgaagttgaccttctcatgaagtatcttagtcgtgttctctgtatttcccgaatttgaattttggcctctcttgctaggtttaggaagttctcttggataatatccagaagtgtgttttccagcttgtttctgttctccccatctctttcaggtactccagtcaattgtagatttggttttttttataaagtcccatatttcttggaggcttttttcattccttttcattctcttttctctggtcttgtctgcatgccttatttcagcaagatggtgttcaaactctgatatcctttcttctgctcggttgatacttgcgtatgcttcacgaagttcttgtgccatgtttttcagctccatcaggtcgtttatgttcctctcttaactgattattctggttagcaattcctctttttatcaaggttcttagctgctttgcattgggttagaacgtgctcctttatctcagcgtagttttttattacccatcttctgaagcctacttctgtcaatttgtccatctcatcctctgtccagttctgtgcccttgctggagagacattgcaatcatttggaggagaagaggcactcttgccttttgggttttcagcgttttttttgttgattcttttgcatcttcatgagtttgtctagttttgatctttgaggctgctgatccttggatggggtttttatgggttttttttttttgttattgttgttgatgctgctgttgttgctttctgtttgtttctttttctttcaatggtcaggtccctcttctgtacggctgctgttgtttgctgggggttcacttcaggccctattggtctggttcacttccacacctagagatgtcactcaagaggctggagaacagcaaagatgcatgtctgctccttctgctggcatctctgaccttgaagggcactgacctgatgccaataggatcgctcctgtatagggtgtctgacatcccttttttagaatgtcaccagttgggttgcatggggaacaagacccatttaatgaagcactttgactatcccttggtggaaggggtgtgcttcgctggggggaaacccattcatctgggctgcctggatccttcagaactaccaggaggaaaggctaagtctgctggtccacagagactgcagccaccccttccgctaggggctcaggcccagggagatctaggttctgtccctgagtctttggctggagttattggagttcctgcagggaacccccacccagtgaggaaggatgagtcagggtcaggcctgaagaaacctctggccacagtctgccacagctgatgtgttgggctgtgggggatacatcttgggaccaagctgtccagcctccctggctccagcaggagaaaagcacagcctggagctatagagatggaggctgtccttccccagcgcaggaaggttagcgtgttaggctgttgtgagtcccagtgctggctgctgcccctcccccgaggagctcaaagggcttagacagcaggtagccacagctgtggtgctggtcactcctccgcaccaccaccccccgaccgccgagctccaaactccgtaggcttaagcagattccagctgagaggctgatgagaatctgcgagggtctgaggtggggatgctaggccctagtggtgtgggttcccaagtgggatcttccgatccatgagttgggcagttccatggaaaaatcactgtttccccagccgggtagcagctcactcactgcctcccttggctggcgggggtgggcactccccggccctgggaggctcttaagtgggccaccacacaacactgctcttccttcctctccgtggatcactccagccgcctagtcagttctgatgagagaacctggataccctggttgccagtgaagcactcacacacttattatatttctttttgatggaacctccgatcagggctgtttctagtcacccacccatcctggccccgcgccctcaggtagtactttatatcagtttgaaaacagactaatacagaataatttttctttaggggctttggaggaacgtggtctgccaacacactggttttggacttctctcctccagaacgtgagagaataattttttgttgtcacatgccaccctgttggtagtacttttgttatggcagccctaggaaactaatacagagtccctgtaataggcacaagctcacgtgtcctgaaggctacaggacttttaattccaccatttcagccaaggaccccaaataaacatttcccatgaggaagcctcccacgaccacaatttccttctctgtgtcctcttactctcttccttagggtccacgtttctttgtatcagggttgacattttaatacacattaaggattcatcaggaagtaagagattccatccaggaccacaaggcccacccatctttcttcccagagtcttccacttctcctcacctggtcaggtgggtcctgagatgcccagggctggatgccagacaccccagctgcccaggtactcctgccccgtagtgagacccacattttcaattcacggtggggtgaattttcaaagggaaccactttctttcatctttatctataggatatttcccaaataacatgtatgttactgagttcgtggacatcgtcaaagacagccagattctctttaaatatctgctgggcggccttcttccatagaattcaagaaaaaaaaaaatgactgtctggctatcgtcctctgtaaatcttgttctagcaagttctgcatccacttaactttatgaatttggattctgtggtttggattccatccccactcctccaccatccttttcccaatttaaaccattctaatctagaatttcaggcaaagttgggggctggggaagctaaatcgattgttttatttttgtctcttgctgccccctgctggtcaaattattgctttctttttctttttctttttcttttttctttttcctgtttaactcaggagatcaatggacaagtttctagggatgggtgggtgagggagaagcaagtgtcctagatgacaagacaatgtcagacaagtttcactacttgaggttctcggttttttttttaatgaagaaatggcaattgtgatatttaaaacatgtttagcttattggtctttttttttattttttaatttttaacactttttaagggacagggtcttgccctgttgcccaggctggaatgcagttgtgtgatcatagctcactgcagcctccacctactgggctcaagccatcctcccactcagcctcctgagtacctgggaccacaggcatgcaacaccacgtccagcttaattggtctttttaacacacacaaatacaatatactataatggtgcttccccagatcatttgatttctgaaattatcaacatgcactgctggtggtatggactagtgatgggtcacaatcttccttcaatctccttagcatgtcagggtctgcgactgcatccagcactgcacttagcactgaatttggggtgacagcgaggcactttgcaaccctctgatgggtttcctaccatagagctagggtgtggcctggactggtcctcagagagc

SEQ ID NO: 2792 - DNA, 11590 bp, Homo sapiens
ctacgttggtgaggctagtctcgaactcctgacctcaggtgatctgcccgccttggcctcccaaagtgctgggattacagacgtgagccaccgcgcccggcctgcttgtcattagttttatcacccaaccgtgactctcctggcattttagcctagtctttgccacttagaaaaagaaaaaattgacgcatcttgtaagttgctttaactctacaagttcaccttacgtgtctttctttttgttaaccttatttttttgaaagaacctaggacatttgacttacagtgtttctcactgtttggaacttgctgatttcatcctcagagtgcagtttgacatgttctctgtcccttttattccttgcaaattggttgctgaattcagaagttttatctgcctaggtctaatctttttggcaggattgcacacaatgttatattctctcattgagaagcacgtaatgcctgattgtctctctttttgtggcgtgagcagtgattactgttccatgtgtagattcatcaattcactagatgttgcaaaacagtaatcttctatcatttcttttttattaatttgtgggaatacttttcaaagaggtacctctcttcagcaagtatctgattcctcactattgtggtcgatatgggaaagcaagaacaaatgcttgattcatttcctttatttgactgttttcaatagaataaattagtttctgaacaactgaaaagaccattgaaggtaactgatcaattgttgtttttaaaatctaatctcacattttaaaattgagataaatgagagccagagatgttaagcacttaagatcacacagcactttggtggcagagctagggttagggtagtactcttctgcctcccaacttcattctaatcttctccttttggagcagaaccccagacctggaactctagtgtcaaaaatcattcatgagaaaatctgaaatgggtgataaaaattcaaagcattactcaacttcgtctgctgtttcatggccttcactgcgcagccttgcaggcaagtcgatactcatcgttaagagacaaacgcagcctgcagcttttgcagtgctcatgagaggggctcagctgccaaccttagaaattccgcctgttgtcagggggtcgtgggaatgtgcccaggttgctgtagggaggttttcagccctggctaccacaaagcactctcttgccaaatcctgtcttgctgattttcagcaggaaaatgggaagtcagagaagaaagcttcaacctgtcagtcagaagggaaatagccaagaaactgtcttctcaccatattaactatgttagcaagagacagagagagagagagagggagagaatttggtagaagttgggggaagagatggtggagaaaattatcaaacagttaaaaagaagggagagtatgttgtaatcatgtgtgcatgtgtgtgtgtgtgtgtgtgtgtgtgtgaaagagagagagagagagactgcctacagccttaagactgtctagcagtccatctgttcacacctacttatgtagctggtgacctcagacccaaccacttgtcctgctctgacccttctctgctcttcatctggctgccaccatcctcccccctcgaaggctcccagggtaaggggagagtgacggcagtggagaggggccagcgggagataaagacttgctattttatgtagagatgcaaatccctgctaacttgtgggttagagaaccagtcaaggacgggcacaaggctgctgcggataacttgggtctgtgtttgagatgcactgttgtggttaccctggctggaaatgagagttgcttggactggactcttgcaagttagatgaaacttgacagtgggagatacggcctgtaccaagtcagagaattaggaactttgggccaacaggtccccaaaagctgatcactctcgttctctttatgggcagaagattctggaggactttagccctgtacaaggggagagggcatagtaggcaagatgctatagtgaagtgttttgaaatttaaggatgtaaaatgaatttagggagttatgagcacaatattatgaaaaattaaatagaatatactgtacatcagaccaggttgctttacatggagaagcccttgagccagagggtgttgtccataggaaagactgaagaagtttggcaagactacctatgtgcttaggcactcatgggtagtgagcattcagacataagtggaattcactaggatgtactgggactctggtaggacaatttgaattatctctaaattgcgctaagcatgaattcatgcaggataactctgcctcctaacgctgatgctgacccagcctgtcaatatttacatttttgtgtttttctaagctagacctctgaagctgaaagcagaatgctgcttctaccctccagataaagtacaatatctattgtttcagaagactagatgccataggacaagaattgagctgttgtattacacttgccctcttttttatgttattattatttacccagagacaacgctgattaatctttaccaagaacaataggaaaagaaatatgattacatagtttgtttttttaggtagtaaaaagactttgacctggaattaaggagacttagattctcaacgcagttctttgttttatcacataactgctgtgccagtgcttttgataattatggtaatttggaaggagcacacctggctggaaatcctgcctttgcctcttactatgcgactcatgcaaattgtataatttctctggtcctcttttctcatctacaaagtagcatcccacctatcccacttcccttattgagtgttatatgtgtagcagtgttttaatctcaaagggctgtgtacatacagacgttggcgtttatgttggtaactgtgccgcagtcatctcatctgatctctaaaatgccccactcttgctcccctgacactgctgagaacttgcatatcttagctgggacacttctggtgtctgtctttcctgcccttcgctgtcttgaagcccaaacagaagtttctgagaacgagactgcaattgtcaattattcgtctttggtttttaaaatgtgcccaccatccagtcccctgggtgctcgttaccacagcacagcctaattacctgtagacagatgagacatgcttgaaactctgcgacttctgcctgcagccagcatgggttcctgcaaacaagggcctgtgaaaaataaagaagggctttatttctgctttcaaagtctgtgacttaggtgcctgaaaatatagttcaaacaaactaacaacaaaacccacaacaagcagctcaaagcaagaggctttagaacatttaaagaaagtgttctttctccaaaggtgtagtgagtgctcgcctcacgctttcctttagtggcgaacaatagttccgtaacttagcctcactgaggtccaattagtccaaattgtggtggagttggacttatggagtcacaagatcagattttggaaatgtgttctccatctctgccttgtgcctttccctttctgaccccctgtgccagacaggctgatcctaatcagcacagggaggcctgcaggcggctgagactatgaggtttatgattatgaggtcagggaccagcaactcaggactcatagaagagaagattttgggacaagaaaaaaggagcttataaaagcaaaaacaaaaacaaaaacaaaaaaacagaaacaaaaacaaacaaaaaacaaacaaacaaaaaaaccagatgccaaaaaaaaaagtgtgtgtgttggggaatcttactgagaagagagagaaagaaacagaggaggaaggggaagtgaaaatgttatgatggggtggaagggaggaagataggatctggagagaagcagaagatttcttgccccaaactcctgagagagagcaaaaacaaatacttttgagcaaaatcagttgtccccagatgtccttagatgctccatcggtgactccgatactgccagggagtcccacctgcagaatcacggttctctgcctacacaagaccctggaaccagtccccttctgtttgtccctgctccacccgccagtagcacctgcagaccacatcccctaagagcagtgcagccatgtcttcttcttgagagctggaagagcacatgcttcctgagggtttgaggaaagacaaagaagatctagaaagaagatgctggcaaagagaacttccagatcactttacgtagggagaggctgtgctagagtgaagagagcagacagtgtgtcattagaagacatgagatcaggcccacactctgccacttaattaccaagtgacttctaggcaagctttattttatttatttatatttacctgtaagacacctctccatcttcatgcctacctaatggtttgagaaaatggatgaaacccccaaagtgccttgtatacctctgatagcacatctcactgcctcatggttaaatatttgaataacttatcttctttttttttttttaagacggagtcttgctctgtcacccaggctggagtgcagtggcatgatctcggctcactgcaagctccacctcccgggttcatgccattctcctgcctcagcctcccgagtagctgggactataggcgcccgccaccacacccggctaattttttgtatatttagtagagacggtatttcaccgtgttagccaggatggtctcgatctcctgatctcgtgatccgcccccctcagcctcccaaagtgctgggattacaggtgtgagccaccgcacccggcaacttatcttctttagtaggttatgtgttcattgagggcaggatgcttacagatttatcacctaccatggtgcctggcatatagcaggtataataaatatctgcaacagatagctaataattaaataaatgaggaagatgatggctttgggaatcctggtaggtagagctctcgaaatcataatgtcagctctggaacaaatctggtattatttaggtttgatgtagcagttgtgggcttggtattattggcttaagttacattcccccagagatttagaaatacccaatgaccacttgcacattcctgattttttcattttcaattaaggaattaatttaattttgccattttatcattattattttttgaggcagggtcttgctctgtcacacaggctggagtgcagaacatggctcactgcagccttgacttccagggcttcagtgatcctcccacctcagcctctctactagctgggactacaggtgtgcaccaccatgcttgggtaatttttgtatttttttggtagagatggggttttgccatattgtcaggctggtcttgaactcctgggctcaagcaatccgcctgcctcaccctccaattttgatgttttttaggttaaaaatattttattattttgaaaacaattattatgaacaagtgaaatctataatgatactacttaatacaacatagaaaattatgttatatataaatacatgtgttgtatatatatgtaatacatatacatacacagagatacataatgtggtaagtgtatgtgtatttttattccacttccagcaaatgtatgcaaaagttatcataaactagttaatatacagtggatatatgtttatatttgtaattagttgcatttcttttttagtggaaatataacaatttccttagtcattttgttatttggtgttttgattgttgtcaacttttcacttaaataaacattttctcttgcagaataaataataattattgctgttaaagaaaaactaaagccatttgttgtgtgcctatcatgtgcaaggcactgtacttgacactttacctgtggtgtatcagttaatgttcacaatgcatgatgtgcatattatttttcctctttcatgcagaaagagactaagcccagagaagtcagtagttcagctaaatcacacaagccagtgaatacagagtacagagccaggattcatgctcaggtctgcctaactccaatgcccccactcctccaaactacaacactcttaggagcaggattgtaaggtcaaaagatatcactagttttatggttctaactacattttcccacattgctttccaaaaatgttgtgctgatatagaaaacccagccctgaaaacataacattttctccataattttgtctgatttcatattttaagctaagaaaccctaaagacccatatgccctctcttcattttttaataaaaaaaaactaaagtttttatttttgagatggagttttgctcttgtggcccaggctggagtgcagtggcgcgatctcggcttactgcaacgtctacctcctgggttcaagtgattctcctgtctcagcctcccgagtagctgggaatacaggcacatgtcatcacgcccggctaatttttgtatttttagtagcgatggggtttcatcatattggtcaggctggtctcgaactcctgacttcaggaaatccatccacctcggcctcccaaagtgctgggattacaggcgtgagccaccgcacccagcctgcactctcttttttactttacaagtgctgcacttagagccaaattcatcttgagcttgagtattacctccctggaatggacctcgattatatcacagtctgccctgagctcacctggtcctggactctccctcttattcaaaggtggatttcctgctctccaaaccaacaatgaaatttccacccctgccttccctcttatcattccctttatctctctgagaaatggagcaaagcatattctgtccatgggagagattaggggctctctgctttctttgacctctttgtatttccttcattgcattaatggcagtgctggggtaacgtgtatcggagagagaactgatcaataaacatcaggaagtgtaattatggggtaaggaggcattgggaaacgtctgtaaaaattcagggtccatttgcccatattttttttttaatggaggcatgaatttaatgttccacatgggaaggaaccagaggaactacatggggtttacttctatttgttccctctctgaagagctgcaggatacatgaggtaccttcaaatccttcaacccataggtcttcgcctgaggagtaggcagatcctgcacagataaatgttcagaggtcatccaggaccgcagtcccacccccaccccagcttccaagaagaggggctgcacagagcaagctcccgatgggaggcagttctctgaccttcactgactcatgcttttcaattgcatcttctgtagcccttgcgcaagaatgaccttgggtggcttagtagtcagataggactgtatctgcagaaccaagtcagaaaaaagtggttgttctgagaagacgcagctcaagtcatcatttattcaaggttgtctaatgaaaacacgtggctattatctgtacagtggatgatctcagaaggacttagaagaaactgttagtggtcttagaaatccatcatcatcatcatttttttttttttttgagacagagtcttgctctgttgcccaggctgcaatgaagtggcaggatcttggctcactgcaacctccgcctcccaggttcaaacaattctcctgcctcagcttcctgagtagctgggactacaggtgcgtaccaccatgcctggctaatttttgtatttttagtagagacagggttttgccatgttagccaggctggtgttgaactcctgacctcaggtgatccacccgctttggcctcccaaagtgttgggattacaggcatgagccacctagtccagcccaatcatcatcatcattataataataattattattcttactagtatttattgagcacttattgtgtgccagggacagtgttacgtactctgcaccacatctcacttaattcttccaacaaccttctgtgatagtaccagtattattatgtttttatagatgaatgcttagctccctctcttattgatatgctttgttcaaatgtaattttccttatggggcttactctgactaccctatgtcatccctatcccccttgtctttgcatagctctcgccaccttccaacctgtttttttatttacttaatcattatgtccattgcttagctcccaccctctacccatgagaatgtttgctccccaaggagaaagattttgctgtgttttgttcagaacagtgtctgattcatataactactcagtaaacttattctaaggataaatgaacagatgagtaaaccacgattgagataatgagcaaatctcttaatgtccctcaataactggatagtggagcagggatggagatgagtctcgctctagagccttggggtttcgccaccccacaacattgactctctttcagaagatattctcacctacacacatgccctttgaaaggtagttcatatttgctaaaacacattcagaatggcctactggcgtcttggagaagcaggtttgtatgaaaggcccctaaggctgccaggctgccttttcttttttttcttttttcttttctttttctttcttttttttttttttttttttttttttgagacagagtctggctctgtcgccaggctggagtgcagtggcgcgatcttggatcactgcaacctccgccaaccaggttcaagcgattctcttgccttagcttcccgagtagctgggactacaggtgtgcaccaccacacccagctaatttttgtattttcagtagagacagggtttcaccgtgtttgccaggatggtctcgatttcttgatctcatgatccgcctgcctcggcctcccaaagtgctgggattacaggcgtgagccaccgtgaccagccaaggctgccttttctttgggccccatttatctgaaattccaaaggcttgtctaggtcttgtggtgacattgctatcttttcagtcaatgcacagcagagccagggggtgcttggtcttgggatgaagctctgtattctcggtggccttcaggacgccttaggtcttggtcaggtgaagatcatttttatcattaaggtctttgatctgggtagcatgcaattctctgccagggtaaataaatgtcgttaggttctcagacactcttttccaagccactcacttctttctgcaattctttgtgtgttaaaaagatttaatagcgactctcctgttagtctactgtttaatggactaactttgtcattatgcctcataggcaaaatggtgactttgaaacttgctattagtgttttctattaaaatatagtcactattactttttggaccaatatgcatcttgggagttctaggtatcatgcacatacacacagccttttttcaaaaaccacatatctgccattgcagtagctcagccaacagttaaattggtatcttattactgaggtttctttagtttttgtctattgcatcaggctcttgtaggttttagaaataaataaaaatggttttagcttgggttgaaagaggattttcccctagaactgatttcactataatgtatagcttaatacaaaacctagcatgctgaatacagttagtcttcaaagtggattagggttggtgtgctttgggcatttccaaggcattagttacagtacattgaattagctataccagttgcttctcctgtaatgaaaggtgtagaaagatcccctgcttgaatagaaggccaaaatgccatcttttaacttctattgggtgtgatggagatgataactgaatgggcaaaaccactcctgttgtaaaggagcaatgaagcattctctagttcctttagaaaaggcaagtacagaaatctgagatgctgaccagcccaagagttctattcatactagtgataataatgatatgataaagataatgatcataattataccaattgttaccattttctactccccgctactccacaggtcttaaaataaataaacctctattttaagctattaacttgacctcagtctttattcatgtttttctgtgtgtatgagtagggagctactgaaatgataattggatttcataaatgcagcctgtgtggcactgtttagaaaaggtagagttttatagtgccctatggtggctgtgtgatgagtccctgtagccaggcataacttgttgcctgaatggatgtcattacattagtgatgaaagtgtgatgactatacacatgattgcagacataaaaatgaagtaaccatggactttttttttagcatgtgctatgtgctagtgactgagctaagtgctttatgtgtattatctgtttatcttccacaataagcccttgagatgggcactattattattaatctgatttttcacattggttaactgaggcactgagagatgaatgaacttgctaataagtggtgaatccaggatttgaactcagattttctaaatccagaacccttgtaattcacttatgggagacgaagtaactatcaatgaagtgcaagggtacattaatctcaaacaggtcatgtgacggatattaagaatgtgtaggcagggtgcagtggcttaagcctgtaatcccagcactttcggaggccgagatgggcggaccacgaggtcgggagttcaagaccattctggccaacatggtgaaaccccgtctctactaaaaatacaaaaattagctggacgtggtggtgtgtgcctgtaatcccagctactcaggggactgaggcaggagaatcactttaacctgggaggcagaggttgcggtgagctgagatcgcgccattgcactctagcctggctgacagagtgagactccgtttcaaagaaaaaagaaaaaaagaatgtgtaatggtattttgtacaggcacatgcaatcattgtgtagtataggtgcattcaggacttatcaaatcaggtactaacttaggactgagatgttgacatgaaagtctgaaatcactccacactgggggagaccaagcaaatcacgtgagaacataagctctggcatcagcattgatgtttacaaattatacaaatgtagtaaatgatcacacatacccccaaaatatgcacacctatcatatttcaatgaaacaaacaggctgggcgcaatggcccatgcctgtaatcccagcactttgggaggccaagaggggcgggtcacttgaggtcaggagttcgagaccagcctggacaacatggagaaaccctgtctgcacgaaaaatataaaaatgagtctggtgtggtagtgtgtgcctataattccagctactcgggaggctgagtataagatcacttgaacataggaggtggaggttgcagtgagcaacctgtagctgtggctacaggcacatgcctctatgcctggctaatttttaaaattattttttgtagagatcaggtcttgctatgttgcccaggctggtctcaaactcctgtcctcaagcagccctcccaccttggcctcccgaagtgctgggattataggaatgaaccactatgccc

SEQ ID NO: 2793 - DNA, 929 bp, Homo sapiens
cttttataaaattgcagagatcaacttgcttcaaaatagaaatgatgggagggaattaaactacttttcttgccttctgtttattgcattccatgtggtttgcttattacatgccctggttataacttggctgattttgccctttcttttctgtttttccatgcggctgtcattttgtgtgtaatgcgactgtcttgcccttttcttggtctgtggattgcagtggcaccctgtgctgcgcacactaaagaaccgcattgaagagaacactggccacaccttcaactccttactctgcaatctttatcgcaatgagaaggacagcgtggactggcacagtgatgatgaaccctcactagggaggtgccccattattgcttcactaagttttggtgccacacgcacatttgagatgagaaagaagccaccaccagaagagaatggagactacacatatgtggaaagagtgaagatacccttggatcatgggaccttgttaatcatggaaggagcgacacaagctgactggcagcatcgagtgcccaaagaataccactctagagaaccgagagtgaacctgacctttcggacagtctatccagaccctcgaggggcaccctggtgacgtcagagctttgagagagaagcttcactgaaacggagcaaaccttccactgagaagccacttcaagaggctggtgctgctagatctcatgatgtggctgttgggaagatggtggggtttgtttgccagcttggagtcctattaaatgaaagccagcaactcatgttggtaataggtctactgtgggaacagttatccctaaccacagctcaaaatcgctatcatctttaggcaaattaaaatctatgtggcagtgctcatggatgattttgttctaagcagttttcctcctgccctcccccgc

SEQ ID NO: 2794 - DNA, 4064 bp, Homo sapiens
actgaggctcagaggaaggacgcctacctgctggattacctgggcagctaatttcccacccaaacacagcatttctcccacgactttatgttggcgtgaaatattcgctgacggcatcttgtcacatcgttcaagtgtcatgctgtgacagaagactctgagacgtaatcttcgctgacgatagcagggaaagaaaaacttgacgtgtggaatacagagggaggagattttaacattatggcagggaggcatcagaatcgtagttttcctcttccaggagttcagtcaagtggtcaagtacatgcatttggaaattgttcagacagtgatattttggaggaggatgctgaagtgtatgaacttcgatccagaggaaaagagaaagtccgaagaagtacatcaagagatagacttgacgacattatagtattaacaaaagatatacaagaaggagatacattaaatgcaatagcccttcagtactgttgtacggtctatcaaaattccagtaaaaaagttcagttccttgaccgaaacactttgtcctccaaaaggaagacagacttcacgtcattcatctgttcaatactcttccgaacaacaggaaattttgccagctaatgattctcttgcttacagtgactcagctggtagctttttaaaagaagtagaccgagacatagaacaaatagtaaagtgtacagacaataagagagagaacctcaatgaggtagtatcggccttaacagcacaacaaatgcgttttgaacctgataacaaaaacactcaacgtaaagacccctattatggagcagactggggaatagggtggtggacagctgtagtgataatgttgatagtaggtataataacaccagtgttttatttgttgtattatgaaattttagctaaggtggatgttagtcatcattcaacagtggactcttcacatttacattcaaaaatcacacccccatcacagcagagagaaatggaaaatggaattgtgccaactaaaggaatacatttcagccaacaagatgatcataaactgtatagtcaagattctcagtcacctgctgctcaacaggaaacatagcaattagctcataatcaaatgttagtggtcacatgtgcatctggaatgtggtgaatcagttatatccaataatagcttcaaaggcagaatttagagagattgaggatgcttttgtttttaacaaaagggtttcacactttgaaaattttttgagcaactagttgttgatgttgagagcagttgatccataaatctggtgtgtgaatgtttcaagcagaaattaatttaaatgtgtgtttaggaagtacttaacttggaagatgtatcatttttcttaaaatgcatgtttaaattttatttttttaagtaatttttaaaaagtttattaatgttaaatttatgatgcagaatgatagcatcagatgtctgcagctgaaaaaaatttactactatgaacccccaaaatattcagttgcaagaaaatttgattctaaaattattcatggtaggatacgtaacacaccccttcaaaacttttaaaaaatacatttagcacatgtgctatgaaagcatacgtacaaagagaaaggggaaagtgatttataattcctacaacagaggccaagaaatagattaaaatattttcaagaccccaaaataatgtattatggttgggaagtcagtagaacactggaataggtgaagacctgacagtaatttttgtcttaagaatgctttctttaggacagaccctttaacctcacctctgtgcatctgtttttaaaatgattatatttgcctctgatatttgaaagcacttttgtagttttgatgatgaaaaatatattaaacgtgcatattaccattatttaggaaataattccttatatactgtgataaatcattgctgttacatacagtaacatgccttaattacatttaatgccttactgctttatgtaagtaaatccaagtttcagaattaaaaataagcattatttcatatggtccaatcagattcgttacataggctatataaatttgtctccattttcaccatcaagcacaaataattgggtcaaaactgcctttgaggtctgttgaagaaaatggttcattaagcaaaaaagagtagaggtattttatattagcagtaacagacaaattatttagtaatcccttaacctctgtttttcaaagagaaaatatccaatttagacttttttcctgatctctatatatagcatcaaattgggaaacaaaggccaaaggtgtatagattgcttgaaagggggtggtagtgcctctttttaagatctgttgagtcggctacagtctggctaagtaagaagcatttgcatactgattccatcatttaatctttaaaagtatgtgttttaaaaatgtaaccagaatgattcttcaatagaaatgagatttggtggagtctggattgcctgttttgtatataatatatacttaagatatataataccacctcattttctgggcattatttcctaattgttgatgtttcaggcttttgataagtcattttatatatttcaaatttaactcagaataagtaaatatttatggcaaatgcagttttatgtactttcaggagaagaccatcaggaaaagacaggacaaagaagtcaaacattaaagcccttgcaaatattagaggaccttagacaattaccaaaaagtgtttaatagggaagttgcaaatgattctcttagtaaattaaacatttaaaaagtagttttaatgtgccttgggcatcttgaaaagaagagtgtgatataatttatgcttagtgttaactggtcattttacattgtatttattaagtctgctgaaaaatgaggttttaaggaagaaaatgcagattattttagggtaaacaggccaggtgtcctttgaagaactttgtttacatcaaattgatgaaattacagtcagtgattccttactttttttgctagttgtactttgaaattgttatgggttcgatttccaaaatatgtaacttattttttaaaggaataaggtgtgctgtgtatttgttgattaaaaatcatttgtcttgcagagtatccttttttgaaggaaatatacatccttataacacatcaggtagttttcttttttctgtatttaaattatatatttgaattaattgaatataatttgagttacatataattctatataaaggttacatattgaattatggttctaatctgtttaggaaagaaatgaattttctaagcatttaatacatttggaataattttagtttctaaaaagtactaatgtaagttaagtttatatcaaatgcaaattaccttgtataactaacaagcacagttattgtttaacattatggattttaattgtgttgacacccttctttgaatttgttgctttacatgtgtgtctgtgtgtgtgtctgcatgtgtgcacgcatgtacttgtatgcaatgtaaaagtaacagcagaatcattgcatttggtttacttaaaattttggagttagcaagtaaacaaaaagctgatagttttatgaagtctcggttaaaataaaatttctttgctatctcactcctaggaagttatggagttcatattttcaaaagatatgttaaaaatggttacacactctgctggccacattaaaaattagaagactcatgttaaattatctcctccaaaggactttttatttacagcttttcttttcctggactctacctgcttggttcagtgtcctgaagagttatttaaatgaaccactacttagtaattagttcttttttaaagtatctacttctaaaattacctagttgaaaatatgaaggatatgcttagttttagaaatatcatgaagcaaggatctagtcagtgttacagggtaaaggtggagttttttaaagtctgtatttaaatggtgcactgatggattcatttttaatttgcattacaaaaatgttgctcaggtaatcagtattttcttcc

SEQ ID NO: 2795 - DNA, 3613 bp, Homo sapiens
aataaagttgtcactgcaggtggctactgatgtgtgacagtgtgttctgcatcaaatcaaatgctgaataagattgaagaggggaaaggcatagagaaaaaggggagaagacactcttgcaaaagaagggagaaacagaagcaatagctccttacatttcctcagaaagggagagtgagaaagcttgattattttctaggaaatggtatgtagaaaggtttggcaggaggtgagtttatgagggaatttgaaagtattaaagggaaaattacttctctgaaaaagcaagaagagtacagagacacaagagccaaggagaagaaagttttgttatgaacatgcttgaagttttgccgacattctggacatatgtaaacagagtgctcaatggaacatctgtctgctgcaggataagaaaagaggccattgatgacagaggagaaaaagaatctggattgcacattatcgtaggagccaaatgaacagaaagtcttaagaagaaaggatggccaggcgtggtggctcatacctgtaatcccagcactttgagaggccgaggcaagtggatcacctgaggtcgggagttcgagaccagcctcaccaacatggagaaaccccatctctactaaaaatacaaaattagccaggcatggtggtgcatgcctgtagtctcagctactcaggaggctgaggcaagagaatcacttgaacccaggaggcagaggttgcagtgagctgagctcacaccatggcactccagcctgggcaacaagagtgaaattccgtctcaaaaaaaagaagaagaagaagaagaaggaagggtgttttcaaccatactaaaagctgggagtgtgtgcacattaaggagaatgtaaagggagaacagttcatgggtcttgggaatttgttggttcaaaaagcatgatgagttcaagaccacagggaaacacaggtgttgagaggtataaaccaattccttgttccatttctgtaaggacttggaagagatcaacatgttagtaatttaacagaggggaaaggctcttctgggtcaacactaaaatttttaaaaacatacttaacgttaagatgttttaggggaaaaagcgatgaatgctgctgaaagtcagcaagaggcactataattagaagtcatatctagaaacaaacatctgagaggcagtggatttgtccttttgcaagctctaattcttctttttttatttgtagagtggtttttctttaaaaaaaatttaaaataaaagaatgtagagtagaatgagaatgatgaggagatggaccattctgaatttgacatttttgccttttgtggtcatagctaagcctaagtaagtatgagcctgaggctttatttccttgacttctctgccctactaatcaagggctacgtattgaaagtgctgaacaatggaagaatcggaagagggaaaccctttaggactgtaccttttactctatttatgtctatccccaaacctatcgaggcctaaccccttccattattcccaccagtcaagcactattagcggcctcccttgttctttctcatgcaaggaaggagctacagatatgttggcttacagttgacaacttagaggatgatgtttgatgttgagcctgtactttcttttttttctttttttttcgagatggagtctcactctgttgcctaggcgggagtgcagtggcgggatcttggctcactgcaacctccacacctcccaggttcaagcgattctcctgcctcagcctcccgagtagctgggattataggcgcgcaccaccatgcctggctaatttttgtagttttagtagagacagggtttcaccatgttggccaggctggtcttgaactcctgaccttaggtgagccacccacctcagcatcccaaagtgcttatacttactttctgaatataaaataaacttgtcaattatgtggtttttaagagagagacaagggacctttaataaaagacacttctgaggaacgttttcattgtgttaatattttaaattacggtttagtttggaacacattcagaacctatctctacatcgtctttgtctattgaaagatttatatgtttgtatatgtacgtgtatttattcaccgtttcattttgcaggagtaagacttgtgtggttggcctcagtctttccacagacatcttgtaagaggatatggtttccccagtccctttgaagttacatttggccgtatgacatgttttggccaatagaatgtgggtagaagtagtgtaaagcactttcagactgaaggcttaaagcctagtatgtaattcaacccacttctcttccctctatcatggcatctggtaattccccagatggcagcttctgtatctgcctgatcctggagggaggaccacatggaacagagatcccaatcaacccatcattgacatatagcttgagagagaaacattttgttgtaataagccactgagatttgtacctgtggtacagctttcaagaacttgttcttatgggtttaaaaatattcttgattcctgtgactgagtcatattcttggtaaccttcccagcctccagtcctgctacctgctgataccaaacagctgcctgcctgctttttttagcattttattctgcataatgtgttgcaaggctcctaactgcttatgtcaccccagttttatattgtacttatctgacccttgcttatctattacttgttactgcactttccagagatcctcttccctctcatagcctggactacccagaccctatatgtgtgccatcccctaagcatctagctcaccccagtgttttgcttttgccagtttctatggaattagcaatgcccaacaatgtctcttgatgtgattaacctaaatgactctaaactaattgagggtagggttcatgtcagattcaacactgtaaatacctcctgtcttagaacaggtgttctataaacattaaatgaataaatgcacacttgtatcgaatttcattaaaatttattcgagtttattcaaattagagaaagatttccacctgttaagtagattggcttccattgtgtttcaaattaaaccacaaattaaatttaaggtagagtgtcttttggtaaattttatcaaaatcattcaaattttttacaaacaaagcaaaaccagtcattgctgtctgattggacatcaagaggtaaaaccattatttttgcaagcttttgcaagccatttaaaaaatctttagtaattcagtataagtaactgcagaacatacctctggtacatcatattccatctcattggcccatctctgatttcagctgtaattagaacagacagttcagtgcaaatgcttgccttctgctttttgcctcaggctattttccaggtaggagccttctagcaaggtcagaaaccaggaagtgttggtctttactacctcttggaggaaccctcagccaatggatgaagggagacactgaatgcatctcaggcattctgagtactttccaggtggtctggcaaatcaaacccgttttccacagctagaaacttgatattgaacctttatattgacctttctttttt

SEQ ID NO: 2796 - DNA, 2112 bp, Homo sapiens
cttgctctcccctgaccccagaggccctacgatctggcctcagcctcctttggatccttatttctctctgcacctgcatccgaggcaggagcctgttcccggaacacccctcactcagctgcctctgcagtgctgctgtagaccccgcctgctggaacacccttccccccaccctcactgcactccccccacctcatccctgtttcacaccctttccttagtgctagcccctcccagcctttccctggaattccgctcctggctctgcccgccttcagtgcttgatctgggctgagctggggatatgaaacaccgtaataatgatgtgtgtgcatttcttgcttcccaactagcttgtatgtttcctgaaggcaagaactttgtcaggttcatctctgttcctcacagcaccctcaacgtcgtaggggctaaagacaggtttgtgaaataatggtaacacaaggtcaggcaggtcaacagcttagtaatgtcagctcagcaatttgatcctgcagtgggcatcacctgcgtcagatgtggagcactgcggggaaggtgctttatgttccagaggcagcaagggacatctgagcacaggcctcagacttggccattttgatagcacctatggtgggttacatctcttgagcttggtaagagatttctaaatatcggagaaaagcatttagaaaccatcctgaggtgtgagccactgtgccctgtcctgcttctcatttttaaggtgaggaggcgattaagactttacaaattaatgcttctgtcttaagttggggcagaccctggggttcaggcttggtgtgagagttggaaacacactttctctactcatctttattcaggatgcaacagggctttctggcctttaatcacaaaactgtcttcgatttcatgagctggccatgctgagtagaaggatatgtttgcctcaccaagggagatttagagattcctgaaagattgtccacgtgtttaagtagttgaggttattcagccatttgcaggttttatgaaagtcctccaggaaatagctcattttaaagctgatatttttttgacgatgcctttagcaataggcagaaataaaggggctttaaaccagaactgctatttatctttattttcatcttaaaaaaagttgaaagattaaacttgatggattgccactgatgctttttcacagtgggtttctgagcaggtcactcttcacctcttggttttctttttaagtagaaaagaggtatctggtagctctagattgtggcttctgtgaagacagaagtccattctggtcttatccaccactgtatctgctatgcctggcactgtgcaaaccatataggaggtgcttcatccgtttgctggatggggagttcagttgagtgtcagcttagtttccaggtactcgaggcaggcagtggtgtttgccgtctccattgagtgtatgggattttcaccaatcaatttgaaacaggtcatttctccacccattggactttactagtctttgagtttgaaaatagatttggaccagccctgaagacactggtagaaccctgggaaaggctccaggtgacttacaaagcttctcttaaccagcagcgctgaaggaacaatatcgtccttccctcacttcagagggtggccagagctgaatacccagagagggacaagtaagggtccagttccaaaacatcatgaggatgtatcatcccacgtgtctcacctgacagttacagaggaaacccgcacccagaatgcacgtgctgtcttatgggaacactcagcgcagagtgctcaggtctggccacacttgggctgtgcttggtcgtgccatggaattcctcaggactttctcagcctccctaatggcagaagcccctttacagcaagacatttaccgtttgtctgaaaatagccgaactgagccttttcttcaggctatatgagaagtctctagacagtgggcaccgtcagaaagcccagagccttgtgatagctcccaccctgcctggctcagatcttcccatttttttcctctggcactaacctcaccttttgtttttttgtgtttgtgtttgtttttgtttttgc

SEQ ID NO: 2797 - DNA, 3037 bp, Homo sapiens
ttgaacccagaggccatgggcaccggagacctggacctcctatcagccttccgccgcactccctcactgcagcctcactgggggtccctctccatagtgatagccatgaggacactgggattctggacttcagctcactgctgaaaaagagagacagtttccggaccccgaggtgagtgcccaacatagcacagcaccctcatcacccctaattctgccaggagcccctccagatccccagcccctcttcagctcccttggcccccagtcctgcctggcctgggacccagagcagctccagctgccccaccagaagggaaggggcagagggacaggggtggctacagctccttggtcctgggcccaggaagccccgcccagggggctgcagtcttgcccccggccacagcctagactgcgggacacagggactcgaagctggaggcaccagcagaggaggacgtgtgggagatcctacggcaggcacccccatctgagtacgagcgcatcgccttccagtacggcgtcactgacctgcgcggcatgctaaagaggctcaagggcatgaggcgcgatgagaagaagagcacaggttagcccttcctcagaggggagaggagagggcacaggctagcccttccctacacaggagaggagagggcataggttagcccttccccacaggggagaggagagggcacaggttagccccccacctcgtccacatacatggaaagagcggagtccggcttagcacagagactcacaggaaagaagagcccaggttaacccctccttgtgtagaaaaagccaagaatgcccaggttagccccttaccacagagatagaagagaagagcaaaagttaggccaggacagccacaaggaaaaggacagagctcaggttaaccctcctcaccaaggaaaaatcaggctacactttctttctctaccctcttctgaaaagaaatgaagcccggttaaccctctccacacccaaaagaaaagggaagaggcccgctaagcctggagagccacacacaggcaaagaaaagagcctggctaatctttctctcaggcaaacaaagcaggagggcttgggttaactaccctcacccccaggcagatggaaagaggagagcccaggaatagcccttctccactgaggggttgacaagggcgggtgtgagccgggaaagcaggggtctcacatgccttctccccaccatgtctgggtctagcacagggcctggcacacacctcgagcgctctataaacaccgactgaatggaggggtcagcttccatgcaggatatgggagacaagcccctcccaaagcacacacacaaaacacacacgatcatggggacggggagaggagctggttagtccctccctgctgacctcccccaggccccttatccctctgccctgcctccctgttgtctcagcctcactgggtttcccatcaccccatcgctaggtggcctggcccttaccggcaccgtggccccatttaagccagggatcccctgaatgccaccaatgttcctctgggttaactcctgaactgctgagcccagagggcaccaagcaaaggactgtaggtgcccaaggaggaaaagatggaggctggcaaggcagatggggacctccgagggtaggggtgtcttccaggaatagcaacaacagtaaaaagagcaaattgctggccaggtgcagtggctcacgcctgtaatcccagcactttgggaggccgaggcaggtggatcacctgaggttaggcgttcaagaccagcctgaccaacatggtgaaaccccgtctctactaaaaatacaaaattacctgggcatggtggcaggcgcctgtaatcccagctactccggaggctgaggcaggagaatcacttgaacccgggaggcagaggttgcagtgagtcaggattgtgccattgcactccaacctgggtgacagaatgagactccatctcaaaaaaagtgagtgagttccttcctaagccagccactaggtgctttatgtaattatctcatttaattctcgaaacaacactatgatggaaggactattaccatttccatgttactgaggaaaccgaggcacagagggtttaaggaactagcgcaaggtcacagagcacccagcagtagatctctgcccctccgcagctgactccaggcccagccagagtatttgaggactcaggggtccttctctgctcggtggatggagcccccacttcctccctgggctcagcagcagcaacatgggcttttacaaacacggccgcaagaggaggcattgttgtggagcagggctgggctcaagacccagctctgccacacacctgctgggctggtggcattgggccagtcgcctctctgagccctatttcccccactgcagcagcatggggaccaccgcactggccctgggggctgagatgggagtgagagtgctgggcacagagggctgctaggtgggagcgcctgggaagagtacacaactcaggggttgctgagagaagagaaggcacagctgtcccagccccagttctcctgacaagcttctgtctttctggaagcccctaacccaatccctgagctgagcaggtggagaggaccccaaggaagacagaaggacaaggtcagacagacagagacaaggaggtgggttgacacatagacacagataaagaaatgaagacaccatgcctgtaatcccagcactttgggaggctgaggcgggcgcatcacctgaggtcaggatttcaagaccagcccggccaacatggtaaaaccccgtctctactaaaaatacaaaaattagctgggcgtggtggcacatgcctgtaatcccagctactcgggaggccgaggcaggagaatcacttgaacctgggaggcagaggttgcagtgagccaagatggcgccattgcactccagcctggccaacagagcaagactctgtccaaaaaacaaacaaacagacaaacaaacaaaacaaaaagaaatagag

SEQ ID NO: 2798 - DNA, 949 bp, Homo sapiens
gttcagtctcattctgtgaatagtttcctacaatcctttgagccctcagagattaagtttagcaggtttccaaaaaaaagcagcccgtggcccttcatctgtgtccgtctttttctctttctgtctccaggcagcagaagcatttctagttcatctctttgaggacgcctatctcctcaccttacatgcaggccgagttactctcttcccaaaggatgtgcaactggcccggaggatccggggccttgaggagggactcggctgagctcctgcacccagtgtttctgtcagtctttcctgctcagccaggggggatgataccggggactctccagagccatgactagatccaatggattctgcgatgctgtctggactttgctgtctctgaacagtatgtgtgtgttgctttaaatatttttcttttttttgagaaggagaagactgcatgactttcctctgtaacagaggtaatatatgagacaatcaacaccgttccaaaggcctgaaaataattttcagataaagagactccaaggttgactttagtttgtgagttactcatgtgactatttgaggattttgaaaacatcagatttgctgtggtatgggagaaaaggctatgtacttattattttagctctttctgtaatatttacattttttaccatatgtacatttgtacttttattttacacataagggaaaaaataagaccactttgagcagttgcctggaaggctgggcatttccatcatatagacctctgcccttcagagtagcctcaccattagtggcagcatcatgtaactgagtggactgtgcttgtcaacggatgtgtagcttttcagaaacttaattggggatgaatagaaaacctgtaagctttgatgttctggttacttctagtaaattcctgtcaaaatcaattcagaaattctaacttgga

SEQ ID NO: 2799 - DNA, 3312 bp, Homo sapiens
tgacagggcatgtggaatggaatttgcataaaacttatcaccaaattctggaggattctcttcaccccctctccacttcctccattatttcttaatgggacaaaaagtgatccaaaaacaaccaatgaattgtgtatttcttgcatgcctttgatatgcaggcacagagctacaagctacatgtccctggcccctctccctaggagcacagagttccagtgaagaacctaaagcacaaacactgacagctgtaagatgaggaaacagaagctgggatatgtgagtaaacatttccaaggtcctgcagctaatcaatggttgacaacttctttcctctgcctatgttgccatccatgtcatggtttgtgtcaagactctaggagaagtctaccatcagcaccacagctactgtgcacaaatccagaatgccagactgaagtcagaaggaaagatcctttatatattgaaagaagaaagtagaaccatttctgggtcccagctgtgggaagagctcctgtggctgtgaattctgacttctgggtcttggcacaaggtgtggccagcaagctaagctgtcctgagggtgtgcagggccaggggctgaagacagtgttggagcatccacagactggtttgtctcaagaagcatgttactaaatatgaaatagcaaaatctgcaagtgggtttacttttcccccatagattagaatggattcaatattatctctttattagcgtcacttttaatcacttgtataacaagtaggacagaaaggtggcttgaaagtcaatcatgtgagaattccagataaattgactttgctcacaacaatctgttattcatgtgactatcaactgtcatgtgtgctggggcaaaaaaagaagataaggattcactggtatcagatagttccaggaggggaaacccaggattgaactttttcagccttctatggtaaaatttcctgctctgtcggtgcgccaaagcttttttcagtttcctaaactcccatattcaagaagataagctattttctcttctttctcatccttccttgacaaagcaaagcatattttcattgtctactctgtgtcatccatgcttggttcctgtcctcaaagagcttatagttcaaataaaggagagggagcattttacaagggaattaaaggtaaaagattctgaaagccagtttaaaaagtcgtgagggaggggtctgggagaagctgagcaggggtgaaagggtacgaaacattatggaaggagaacaggggagcaccctgactactgggtggaaacaccaatcagtgggtagaaaccacacagtggtaacactgatcagtgggtagaaaacaatgacagcaggtatatgaggcatggaacacttggcttattgtaaagttttcaaaatatgcagtcctttctatccaccaggggttgggagttgtctttgtatatcaaccgtggaagggctgttttggttcatcattctgtggtctacctgggtagacctgatgcagccgtgtttctgaggaaaggaagaacagcttttgttttgtgatatgtaatggtagatgtagtgccatggaatgatgcagatttcattcagatattcttggatcttggccccaggactcactcattcttccctatatgagcattggtagttacaggttttatccttcctttaattgtaagtcttttgaagccaaaaactgtatccaatttgtcactgtctcctaacagtacttagcagtgtctgatgcatcatagggagtttgtaaatgtttggataaataaagggaaaacaaaaacaaccacaaaaaaacctttattttgctttaataaaaatattttaactagtttccactggcatatatatccacatggtagatatattctaagaaacagtctcttcaaatgatggcttcaataatggatgaaaaataaatttcctaatgaattattttacagaaagcaccacacacacacccccaacatcaataaaaaattcatttgtgattttaagaactataggataataataggtaatccatgtgaagttatgacagcttgtaaggccagggagggcacgaggagatgaaacacacagatcatcttcaaaccacagaagctcagacttctcttgctctgaaagttgacgatcagtgaaaagcccactgatagctgagttttacctcctcttcttctgtataatcccttttttggtgaaagcagagatgtcatggacaatgtaggatttcatcaaatctgagaggccattgattataggacggcattgttttaggtatcactaagaaagaaaaaagccttgccaagtaaactccccaaattcagagacattcaaatgttgaaaaataactgtttcagaatctatgaaatacagacaattctccctaatgcttggcccagggctttgcataccataggtggtcaataagcatttgttgactgagtgaataatgttgacaagcagaaatgcctggtttataatgcctagagcccatcactgagaacagtgggctagatcccttcttgatgttttaagtaatcgctgagagaatgggtgggcgattgctcttctgattgctaagaacaaaacaaaacacaaaactgataaaaagcagagttgcagaactgcatcctgttgatgtactgccagaggagtcaggcctggagtactgttcactaagaaatagtgacttttgcatcctcgacgtcccagtcatacacgggcttttctctgaataatcaaagaagggattattttgtgtaagaatggacaaatgagtgtgtgagtttgtgtacggtaaggaaggcaggtagatagaaatacataaaagagtaaaaaatttcttaaaaaagctcactgggtttaacacatgcatcattcacacatcagaaaccaatatacacttgcgactctgtacccacagaactcagaactgcagcttgcaactccatgtctccgcacagtgataaatatgggcaatattaatgtcatcttctaagcccccaaaaatatagctgactctgttcaacagagctggtcagactgcggcagataaatcatattcagatcagaactccatgtacacataatctttggggcatttgcaaagtctaggggcatgcagtgacagatctggattattgatatcactctgtagcctgtcctccttgagtttttttttcctaccagtaataaggatggattctctgacactgacctccttataaattggcttctagttcatctttccagaggtgccaccagagaaccaagaag

SEQ ID NO: 2800 - DNA, 6449 bp, Homo sapiens
caaagtgaaactctgtctctacataaacagaaagagagaaaggtgaggatcagagagggggtgtggcttatcctgggtcgcagaggaagagagacacaaagctgattggtctctaggcttggcagtgggccagtgaatgcctgtagagattaatgctagtgaggcaggcttcattctgtaggcagggcctcgcccctgctagagcaaggtgggggccaaccaatagctctatgggtagaagagcatgtgttgtgcttatccatgcgatgtgttcccaggaaaactgcttcacctctcagagccttggcttacttggtgatacaagtttttgtcgttaggaaaactacatgagataatccctgcacaatgcatttagcacagtgccaggcactgcagggctcagtaaatgtgactttccccagtgcatggattgttgagggacctacatccccgcacttacacacactccctagaggtcccaagaggcccaggcttttgggagggagtttggagaggggccccagctccagccccaaagcaagagtgcaagacaccccttccagccccagctcccttccagtgcccaggtgctcttagggtctgtgatgtccagggtctcacagggttctgggctggagctggagggggttgaggggtgggccccagcagaggcctcatgctccccttctcccaggccccttccagaggcactgggccagatcaaagggacccagcacggaggatcaggaggcagcttggaaagaatgtaaacatgaggatatttttaaactttttccagccccagcgattagggctcttgaagccggaggcccagaggtcagtctggccctcacccacaaagaaagcaacagtctcgggccctcagagaccccaccccacccacatctacctacacccacccaggactctagctggggcctcggggcagaagttcttcctagggtgtcacctccagacacactgctgcggcgggaggatgcgtttctaatgtgagggcctcagcggcatgggaccctgacttaaggggtggtgggggcctaccagacagggctgatgttggaagactgagcttgggaggcttcttagtggcccagtcactctaccaggcgtgtgtgcacacgtgtgtctgtgggtgtataagtatatgctgcagtctggtctgtgtgatgcacgcatcggaatgtgtgagtgtgcgaggagcttgcctcggcccacccttcctcgttcttccctagcatccctgacctcctccctgggacccctttggtaggtgggtgacatggggggggtacaaaagaggaagagtcgcctgagaacagggaggacgcgaggagagaaaggcgccagagccgggggcgaggaggctgggggtaccaggtccggggccatgcaatgagtcaggctgtgagagctgcaggagtcactgatgtggggactgggactcggctccctccatcacccccatgtgtcacagttggagatgaggctccctggatctcccgattccggtgtcacaactacgctcaccatgggttccatgacaacagcctcttaccttgtagtcacgcagctaccctcacaccctcacaggagtgtcacaggactcatgcagggcccccccaacaccacccagtggtcgtatcccagtgacccctatctgtgagacatgaggaccctcactgtcttcacatccccactgaccagaaagccagaattcacaggggcactcagaagccagactagactgtggtcaccaggacaacggggtacccagcccctggagaggcctcggctggctatctcattctccaggggctgctgtgccaccttgccctgcttgtgggccctgagagggacaatgtccagctccatgtcatacagctccccagtgaagggcagggctcaggccccagctcaggatcaatgtggcgatggcatcccctccagattccccctgctgaggcagcagccacaagggatgaggcttggagttttaccctaagatgtggtaggattttgggcccaggatgatgggggagctaggtggggctggaactgatggaaaggggaacctggagactcatcctcagtctgaggctgaggctggacacctaaagacatggtttgtgtccctgtgggtgcccactcactggggctgttgctattcttatccacctcccagtggcggtggcagtggtagtggcagtagggtcagagatagctgctacgtgggagagagtcatgagcaccagccctttatctgacacattccctggaaacttggcagggcctgccagcctctgggggcctgggcggggcagggcgtgaggtggtcacagggataggatgagggggctgggctgggctcagtgccgatgaggacccgctccagctgcctctcccacagccaggcaaggtcccctcagaattggcctggggggttctagtgagatttcttcccatgcggagactaagaccacaggtcaccctcagctcctactcaccctcagtccaacccagaacaccccaccgttggccccatctctgagctttgggcactccagagaacaatgtattggcttcctcagtgatgtggcttcttccacgggagagcactgaactgtgagccacagtggccccatctggtggctgtcctgcctacttcccagcctcgtgatcttgggcaagtcaattcccatctctgagcctcaatttcctcatccctctcctgggctgtggtggagatgacagggtccagtggtcaggaagcaggctgacggctgcaaaataattttggccagaaacaagaggagtcctgtccgaggagagcccggctggctgactggaatcccaagacatgccaaggtgttagaggcactgccagggagacccctcggcccttcacacagtggctatcctctgggatattcctgtatccacaaaatgtattttctgcacacacaggtccctgggaaatgacaggacacccagatctgctgggagcagagttctcatagggtcccagctgagccctggaactccccagaccccctctgccactccatctctgcgtcagcccagcacctgtgccctatccggctttggccaccatctccaccctggggagggggagcataaccccctccagcctgaggttggcgccaaggtttaggagccagcacagaagcctctgagagccataagggtagaaaaggttacccggtactaaaccagccagcctcggggtgatctcatccacttcccaagataagccccctcccccaccctctggccactggccaacagggtaagtcacgagggagctggtggaagagtgtgtgtgagggctgggggaaggatttcaacttggggtcacactgtacattctgttttgtgatcaattccccccaacatttacagtattgacaattagcagtttcctgtcagataaactataaagatcttcccccatcactttttcttttcctaattatttctaaagtctgccaggatggacacatcagaatctctttgtccagcccttgaggaggacatgtaaacagtgtccagtttctctttcttacaaacaccagtgccataaccatttttgttcaaatcctcttacgcaattgcctctctctctctctccctttctctctttctctctccctctctctatttctcactcagttgagataaattctgcctggtagcaggtgggagggcaggcctcactgtgtgcctgagtagttctgggcccttccccaagccagaggtgccaggcccagggcagaggccagtccagggccacagggtcaggacagtggacaggctatggtctgctggactctgcctgctcgaggcgggctccccaagcttccacctgctcttgcccacccccagccccaaggactaggctggcctggacacagggaaaggccatatacagggtatcacatgacccatgcgtgcacacagcccccaatcccaggcataggcagaggtcccagcctcagggtggggcccccacactccgtccaattcacatcttgcctagtgctccccagctcttgctagaatgcttccatagaccaacagctcactctccctcctaagttgctgcccggcctttggggagcaggtggagcacatgcttcttatcaaatcaatacctattcggtagaatcacatgattgctgaggaaggtttggattcagacaccagggtttcaaactcgactctgcatttactatttttgtgaccttgggcacaaccttttacatgcccaggctcagtttcttcatctgtaaaatgggttaataatacttgatcatagggttgcatgaagattaaatgagataatacatgtaaagtgctcagcaaggctcacagatgtgacctagtttatgatcacaaattatcacaaattgagtccctactatgtccagttaacagagagactccctcactggaagcaactcagagtggctgaagcacagaagtggtagaggtatgagatggggttgaagagtgggcagggccaggtcacactcagccttgcacatcatgaagggattgtgacatttttctgactccttggaagcaggggaggatggtgggaggcagaaatgggaggatgtcactgaaagcttttattattttttttaatgatttgtttgtttgtttgtttgtttgttttagagacaggtctctattgctcaggctggagtgcagtggcatgatcatagctcactgtaacctcaaactcctgggttcaagcgatccttctgcctcagcctcccaagtggctggaactacaggggtgtgcgaccactcctggctcattttgttcaacattattttgttacaacattgatgaagaaaaaaatctatttctggctggggctactgtctgtgtggagtctgtagaggactttctctgggtactctggtttcttcccccatcccaaagatgtgcatgttagattaactagcttgtctgcatgctcccagtctgcatgagtgtgagtgtactcaaggcaatggcatcctgtctaggcctggttcccgcctggcgccctgagctgctgggataggctccagccatccatgaccttgaactggaataactggataaataattctattacttgtttttattaatctttctttctttcttttttttttttttttttgagatggagtttcactcttgttgcccacgctggagtgcaatgacacaatcttggctcactgcaacctccgcctcctggattcaagaaattctcctgcctcagcctcctgagcagctgggattacaggtgcccaccaccaagcccggctaatttttgtatttttaggagagacagggtttcgccatgttggccaggctggtctcaaatccctgacctcaggtgatccaccttccccagcctcccaaagtgctgggattacaggtgtgagccaccacacctggccttgtttctattagtctttcttacacgtgtttcaatgtttaatatgagaagcatttgggtctttatttagaagtctgatgatatttctatcaccagaaatatgctgtaggaacttaactcttgtttatgtcaattagcctatgacaaaattggtttccttgtatgtcattttgcttaaagctgcaatttccaagaactacattaagtgaggacattatataaagacttactatattctattagttgttgtcaggcctctgagctcaagctaagccatcatatcccttgtgacctgcacctatacatccagatggcctggagcaactgaagatccacaaaagaagtgaaaatagccttaactgatgacattccaccattgtgatttgtttcttccccaccctaactgatcaatgtactttgtaatctcccccacccttaagaaggttctttgtaattctccccacccttgagaaggtactttgtgagatccactccctgcctgccaaacattgctcctaactccaccgtctatccccaaacctataagagctaatgataatcccaccacccttgctgactcctttttcggactcagcccgccttgagtccaaaataaataaacagccttgttgctcacacaaaacctgtttggtggactctcttcacatggacgtgcgtgagacagttataagcaagactctaaggccagcccagattcaagaggagaggaattagaccccactccttgatggaaagagtgtcaaggaatttgtggttatccttaaaaccataacagggccagctggagcaacatggcgaaacctcatctccacaaaaaatacaaaaattagccaggtgatggtgcacgcctgtagccccagctactcggaaggctgaggtgggaggatcacctgagccaggggaagtttgtctcacgtgtccgtgtgaaga

SEQ ID NO: 2801 - DNA, 2609 bp, Homo sapiens
gggcatctgatggcaggaccaaccctccctcacaggacccagcccttgtcagggcccagcccacactggggttggtgcccgtctatccctgacaaggacactcacagtgacctccttcggacatgtttttcttcttgcctgtggatcaattcctcctggctcagacccctccaggactctggcactgatctctcttggtctcggatttgaggaaataaaaatagaagaggaaaaacacagaactctccaaagctttggagtggctgcagccatctggatggaggcagcatgcgcctgggctggaagagccacggtcccttgactgagtctcggtgcttctccccgtccctctcagacacggttctcatggtggacgagatggggccggatcttaggcccgggattctgcagaatgcaaggctcagagcttgcctagctctgagtggcttggagactggtgtgaggactgagggtgtccacagatcaccaacccacaccggcagcctgagttggaagacaggtcagacgtctcggaagagctggcttattcgggaagctccgaggaaccttgccttgtccagccttttgggcacccccactctttagctcacagtcgctccctccatcttcacagccagcactgaagcattccccactcgctctcattcagacctctgctcccaacagtcttgtcatctctctctctgaccgtctcacggaaaccctgtgatgacatggggctcacccacatatttcaggatagtctgctcatctcaagatcctgaactccatcgcacctgcaaagtcttttgtgcaaggtgtgatagaatcaaaaataaatatttggtcctgccacagagtttccaaaacccttggaatcccctcagcgggctgatgggagcatcgattgtcattcagaccaatcctctcctgaccatacctgagtttatgctaattaggtaacccttgaatggccaatggaatcaaccctccagagcgaaactctgtctcgaaaaaaaaaaaaaagaaagaaagaaagaaaaaagaaatgctgattagagggttagaactttcagccccacctcctgaccctggggaggggagagaggctgaaggttgatctaatcaccaatggcgaaagatttaatcagtcatgcatacccctccctgaaagaaggggttcagagagcttccaggttggtgaatgcgggttgattctgggaccaggaatgctgtttctgcagacagctgcagggctattccctaggcttcttgaggtctttgtccaaagtcacctttctcagagtcttctgacccctgttgacccctgagtctcctcctgaccatctcttttcccctgtcacttgctttctctccttaatactgattgtcacccaacgatggaatgccttacagaagactagagagcagcaactttgtctattttggtcactgtgtgtccccagttcccagcacagtgtttggcacacagcagagcttatttgacatgttttgatgaataaatgtcattgttgttaccaacaggctggaaatcaggacacgtgggctctgcccctcacagttgagtgaccctggggagggccttaaccctggtcttctgggcctcccactttcaggtcaaggttacagtcgggggcctgtgggtgggcttcatctgattggcccctttggtagtgctgggccgcatcttcgggtcatcagtgaaaagcgttctcaggtgtgcccaggagcacgtgcccccacagagcagtgaccttacctgctgaccctcatcccaaaccctgtagctgtttcctctgctctttttttcgttctggaaaaggaagtggctttaggaaggacattacgtgtgatgaatctgaccttggatgcatgtttgctcaaactcacatcattgtttaatgccacaggcaagtcactgagtaacagactaaataattcccaagaaaagtttatatatgtgtgtgtgtgtgtgcgtgcatgtgtgtgtgttggcagggggtatctgtgggggcgaaggtggagactgatggtgggtggtgactttggccacaatttgctccaaggtccacatccttgtacttgaccctcggtggtgcatatctaacacaattaaattatagaaatgctgggccaggtgtggtggctcatgcctataatcccagcactttgggaggccgaggtgggctgatcacctgaggttgggagctggagaccagcctgaccaacatggagaacccccatctctactaaaactacaaaattagccgggcatggtggcacatgcctgtaatgccagctactcaggaggcaggggcagcagaatcacttgaacccgggaggcagaagggttgcggtgagccaagattgcaccgttgcactccagcctgggcaacaagagcgaaactctgtctcgaaagaaaaaaaaagaaagaaagaaaaaagaaatgctgagtaaaaacggtttcgaatgctaaagccagcagagaaattacatatttgagctctgaccctttgtaacagaatccagatctgtggtatctctattttgggaggttttagcataagccatcttacacattccctct

SEQ ID NO: 2802 - DNA, 1836 bp, Homo sapiens
atttttaaagtggctgtagattgatcgaggagattggatagaaggttatagagagaaccaaggaaaaggtccttcaacctcctgttcgtgatgtgggctttctctactgctgtcatcctctcttatcaaactgtgttgccagaacgggcaagggccacagccatggaagaggggctaccaaatggaactccaacctaagggctgggaccaggatctacccatccccatcaagcgaggattgatactaactacagccactcctgcgggggcccaggcaagtcatggctgcccaactgatatttctaaaagtccactttgtgtttgactccaatcaggcctcattatcctaggggaagaggagatggaggtgagaggaagaggatggatgaatgtggaaggccttctgcagcttagcatgcaatggtcatttcctgtatgcaaggtcttctgctatgttctgtgcaggaaatcaagaatgagaaacaattttggccctagaggccttacaaatatatcttcctaattacaaggttatagtcctttgggaattgcaagttcccttgaaaattcacacaatcctaacatgtgttgtgcctagtttgatgtgttcttaaactattactagctaacacttcttactgcagaatttctgtggaaatgagacataggtatttctacaggataaatgagacgagtgaaaagaggtgttgaaaaggaaaacgaaaggatgaaacagatacaattcctacttcgctgtttttcaaagtgcttatagtgagtgctctccgtttctcacccgaaggggagaaacttccttggcctttttcttcaagtaaatagattaaatctctcttattgctattgctatttgacctttttcatgaagcatagcaaagagtttttcataatcctaatatatacttatggtttgtgactaatgaaaagaattatttccatcctctaaattaataggcttgcctccctgcccagtaagttgttccttcctatacagcattcagtaaaatatttgctgagtaactaaaatgtccaagacacctatttcagcaatatatgaactagaaacaaaacaataactacaaacatgacttatctcttcaaggaaaggagtcaatattcttgtacggaaaaaggatcgtagaaaaatacctaatagcatagtgtgacagaaattgcgtggaaattactacaaggcagcaagtgagatagaccctaagctgagcagacaataagggtatggcaatcctaaatctacatggtgtggtgattaagtcctgcgtccatggagtcagaaagagctgggtcctgactctacttattaactgtgcaaccttgaataagtcacttataccatgagctccaagtatctcatccttaaaatagatacatttcagcaccttattgaatttcttcaggctaggctctagggatacaacggtgatcatgacagttatggtctcaggccttattcaataaacagcaaagaatccaaattgggataagtattctgaaagggagatatgggaatgaaaacgaaaagtaaaccaaaaagtaaaacctttctgagaccagtgattttgacagacactggattatagaggacctgataaacgacaataaggattttaaactttaacctaagcaggagaagaattgattgaaggggtttaaatacacttcctttacagaagtcttgcgactgttacatgagaaattggtatgtaacatttttagtgccttcctgataaagcctttgcacttctaactactgcgtgagttactctacagggaatatagctaaacccgggttatttggac

SEQ ID NO: 2803 - DNA, 4234 bp, Homo sapiens
gggagggcatgcttctcaaaaaatgtgagctattgtctaagactaacaatatttatctagctataaaaataagttaaatgaataagttaagattgccaatgttacttcacaataaattcagtcctatttgtgttggagtaaatctcatagaagcacatgaagaacagcagtgaaaccaaggattctagcaaggccagctattagcaaagcagtaagcaggaactggactagataccaaatgatggggaaacagactcatagacctaagaacataggaagaagagatgtaacatcaacagaaaggcaaaaggggcaatgcagcatctctgccttcttctgggtattcctcttaaatggcttgacaataaccaccaaccagcactgccatacatgtgtcctgtacctatcagaggcactagggcagttttggaacagagagcccatagaaaggctactgcttagagatagccattttcttcttggagctggaccagtgaattagacgcatggaggagagctggaaaatccctttttggaagagctacacaaaaccaaaatttggaattcgtagctaataaccataaaaattaagaaatgactgttggaagagcactggaaatcacctgattaagttaagaaaaactaactagctcatgagaaaattattttcaggccagctgtagcctgtacccttttgaaaatcccctgactagtgagttcatttttgttggaatatagaatttttcttttctaagcagatgtaaacttgtctttctgtggttggctttggagcccacaagataattaaatggcagtgctaactgaaagcctgggctgtgcttataggttcaagaggcaggtagaagacactgggttggggaagtagggctatggaactgtggctctggctaagattactaatgtctgtgagcgctggaagaagggaaatagaaatgaaaaaacatgaatatggttgatgggccagactgagtgttgaggtcctatgatgtatcaaagaatggcttacatgaaagttataaggtgtggatggaaaaggtcagtgtggaagagaacagaattactagctttaaagctcagagacatctgcttttcaggaaaaaaaaatacaaaagtctatgagtgaaggaaggagactaagagaaagaaaggtgaggaaaagaggaagagaataaaaaggaacagaaatgagaaaaatatgacacaagaaaaaaagaaaaattaggaggaaggaaagaagaaaggaaggcagagagggaggaaaggaaggaaggagacagggaggagaaacagaaaaagagagaatgaaagaagtggaaatcaagaaagaaacaacataagattctacagagaggactcattataggcaaaataagtaaaagaaatttcttttggcattgtcctatctcccttgcattctcatctactaagccttttcttccctgtgggcaatattattggcatgagtaaactctcaccttaatattcctaataaccataagtttgtcctctactccctaaaactactgccgtgtgtgccatgctccaaagtaatctcttattctcacttcgtaacctttcatctcagctgtgtgtcagttaagaagaatttcatcaaactaagcctcttggattttaaaagaatgctcttgcccagttatatctttagttggcatcatttcaggtatgaaaaggctctgctctatgtgcccttatcaatcctgaaagagctatctccccaagcaaaatgagaaggacaatcataactggctcaaggctagtccaatctggctctgtccttagatccaaaaagttgaagttgtaagtgaccctagaaatgatctatttcacacttattgtccagacaatgaaactccagtggagagtggataggacccttctagggtcgcatgattgctagtggcaaagccaggtctgaatcatatcactgcttatggagaacttgttgccctcaccattgtcctcaaatttctcctgttgacagcaggatccctcagagaaaagatagctccagccaaagaactcagtgtagccccatgaactctccaaataatcataaacacagctatagtagacaagaaaggctatcttctcatgaccctttctgtggttaaaatcctgaaaaactgggcactacggctatattccaaacattcttgcaaatagtatttccagacacagacaatgattctcagagattctcaccatagacggtgaggcaggccgttcctgagatcttcccaaaaccaaaggtattgaagagacacatgtaacacccttcatcctccagggtgatattccagaaggtgatggttgagttttggagtcccagctgggtaatgtttatcttgtccttataggcaggctggatcaccaccccatggttctcgctgaaggtgaccatgttttctgggcttacagctttctttttctgccatgtcacaatgagggcttcctgggcattttgcagagagcattttaaggaagcaggtgtgtacagctgctctctttcatcctgggtcaccacttgcactatggaatcataaaagaacatttatatttaaagattgtaacacacatacactttttcctgattataaataaaatgtatattcaatgtcaaatatagaaaagaaagagaaaatgcaaaaaagaaaacatttatttacattcctacgtgatgccagagaaatatataggttcaaatatgtttgttcaatctttaaagaatagtagcagagtagaaaaacaagagagcaactctcagttacaagaaattgtgaatgatctgtgtaagctgcgaagtaggtacaatgagattgaagatgtaaactgccaggtaggatagcagcttcaccaatcttgtccatgcttggagaagtagaagcaaagagcaggaaaaggccaaaggataacaggcagagtgaccactgtaagtaaagaagatggagcagccctatgcattccacacaaacacacacacatacacaatctacaaaggaagcaggtggaacagaggtgtctgcctccaggaagcaagagtgtatataggaacataggtaaagagatttatgggacaatgttctggaggatcttgaagctttggcacacaaataataatttacacaccctctgctttcactaaatgctatggtggtaatttcttcccttcctcaatattagcaactcataccatcatacattatttgatggaaaatctcaacataaaaacaaatagccaaacttttgagaaagccaatacaatgaaagagaaataataaactttacaaacccaataactcatacaaaatgaataaagatatcataagacaataaatactttgacatgaatacatgtgatgatataagtgtaataaaagcataataaaagcattatgaatagtagaaattagagatatagaaaatgaggaatataaaattgcaacagataggctgacttagcaaaatagatgctactgaagagtaaattagtaaaaagtaagaacaggccatgaaattattctagaatgtagcacaaagagataatgatatggaagggattaaggaaaaattcaataagtagacttaaatgttccaaaatcagttcagtaagacttctaaaaggagagaaaaaaaagaatggaagacaaaaccactgtaagaagggaaaaagtatttttcaaaatgataaaaggaacaatctaaaatcagatctattatagtaatcataaacctttatgcacctaacaacataactccgaaatatataaagcaaaactaatagaattacaaagaaaaaatttaaattcacaatcataccgagaaccttcaatttaatatatttaaacaattgttaaaggaaaaaaagttaaataggaaatttgaaaaactaccaggtacagtggctgatgcctgtaatcctggtgctttggcaagtcaaagtagaagactcacttgaggccaggagttcaagatcagcgtgggcaagagatgagacccttatctctacaagaaatgtaaaaattagccagccgtagcgtcatgtacttgtagtcctggctactcaggagcataggacaggaagattgcttaaggccaggagttcaaggatgcagtgagcaatgattgcagcactgtactccagcctgggtgacaaggtaagtccatgtcacaaagaaaagaaaatttgaaaaac

SEQ ID NO: 2804 - DNA, 2213 bp, Homo sapiens
gatatattaatagcaacatttaggacatttaaactttgatacgccaagtgtgcatgccaagtctgcaattggatatatgagtccagagatctgaggagcagtggaggacgaaggctataaatatgggatttaccagcatataaagccatgactagtattacctggagactgaatatggatggagaagagaaggtgacacctcaccaaataacaaggagtgtgtggagatgaaaacagtggtctttgctgttaattgtaactaagtgggaatgaacagcactccttgggaaaagagcgagtcaaacctgggggcatagatagatggtgactgaggaagagaatcatttcttctagaatggcacttggcccaagatgtctgaagactcctgaccttggcctcacttgccctatgagctcttcagtccaagttctgaataatatgagatgtgacttgcctcaggaagtaggagcaatccaagcctttattatcttactgttttttcaaaaaacctcatctggaagcctaacagcaaagtagtttgcctttctgattgaaaagttaattaatgataatggttccagggatactgtcagacacccaggaatcttaacacctacaatgtgttaaattcctcatttctcccacaggatttttcagtgctaaaaacagcatcaataccagtattcttggcaaaaccattgctaattgacaatcagaggaattcaactaatgtgtttactgagtgtgaacaagaaagattgtcacatccagaatttccaaaatagctttctttctttagaatgtgtgtatcttcccaagacaagcagcagttttctcacgtgtttttagcttgtgtcattggccacagctgagtcagaacagaggtgacttttgtgctattgccagtgccattttctgtatttggtaagtgtagcagtctggatgtcctcaccacataaaaaggttgacagaatggccatttttaaatgtgcccagcaagcctatagaagccatgagaggtggcacccaaaggataaatggtcggatcagggtacaggaagtggttatcgtcaacacaaaccattcttcctgtcagcaagatatcaataacatgtcttttgctgggaggtgatatgttttgtaggtacaagtaagagaatataatttccatccacttcagaaagagataagcatgaacacctaaaaaatcacagactaatatgaagcagactctagaataactaatgagacttggttttataacctcctcctcccaaatttccaacactgttgaacgaaaccgatgccattaaacaggaagatgtataaacttataagcatattggaagccatcaaccatggttatattaatattttatactgtaaaaattgtctggagctagagtgacaaaaacaaaaaaggaaagaagctactaaaagctggaaaagttgcaagtgttttttcataatgctgaaaataatattgctcttggcaggatcttgaagatcatataatccaattgtcttcttttgccaaataagaaaaatgaaccaagaagatctaagcaacatgtatttcaaaagagtattttattagcattcaataaaacttttaagtttctttaaaactttttaaattattttgcttctgtcaagattacagaatgtctgcactactaaatattgattgaaaattgaagactcctagctctatttaatatatgaaagccagtgaagtatactctatgtactttcctggcaaatgaaagacgtacatctaccatttatgtcccaccttcttcagatatctcaattaggaaagatgtcaacaaaaagatagatattaagacagtttgttatagaaaaaataagtgattctgagattagaagagttggattccccaaagttacaagctgttatatgtaaggtaaaattctttctaagccccactttgctcaattgtaaaagatactcaatacttcctggtctgccacaaagttcgtcaatgccatatttaagccttgagctgaattattcccaacacacaattgtgtgcatatttaaatcatacctatgtaagtatattgagcaaaaatattatttttgttcaaaattatatttcaaatagcaaaattgaattatacaaatattgtataaaagtaatataaaagtaattcacaggattggttatgactttaaataagatgctgg

SEQ ID NO: 2805 - DNA, 746 bp, Homo sapiens
ccccaatctcacaggagcttttgatctacacggggacaagagagatgtgaacaaacataacacagacagtggaagaagtggagctttaaggaagctggagccaaggttgaatgcaggtgctttgatctggactgttttgctgaaaggtttccagttgcctatggtggtagtaagaagatgctaaaataactaactaaataaaagccatagatcatttaagtcatcaaatctcaaccaggccaatcaaaacaaccataaagacacatcgagatgaaacttcaaatactgtggcacagctgtggactacgaagaaacaaagaactaaactcagatcagaacagttgttaaaatagaataatatgtctgtgtctcggagactaaaatacgcctggcaccaacagaagtactgagtattgaaagttgagacaagtcactcatgacttttatggactggtggtgaagacaggcagtgattgatacattacgaagtggtcagattcagaacagaattactcacagaattctacggaaagacagaagatagagccctaaatccagcctgaaagaatcatgacaaacttcctagaagacacctgggctgaatcttaaaggaatgacctaattgtcaagagggtaacatgttttgagagttgccattggaatagaagtccctaagcttccttggcttgtcagcctcattcccttctgtccggctttctcctcagccacataacatcactctccca

SEQ ID NO: 2806 - DNA, 6402 bp, Homo sapiens
caggtatctttttaaaaaaattctatgctttgcacaactggtttctgaaaatggattttatggaaactaaagaaaagtgcttttatggaaaaaaacaaaaggccagcatacagagaattaagaagccagtccatgagctgaaccaagcaatgataccatacaacatactttcatcccaaacactggcaccctaaaagcagtgattttccaaaagaacaagtacctcttcactcaccctcagctcccatggaggaggactcagccatagaagtaattatatacagatggccaactctgcatcaataggctttgcatagaattagaagacaaagtgcttttgggtcccaaaagacagtgaagctttatttggtgactttcatactgacttcactctacttactggtgatgatggtaggtgaaacgttatttcttcaaaaatatcaccttgtggtggaagagagaaagaatatccatgcttcttttatctacagtgaaggtgaagagcaacataaacttcagaggttgcagtaagtctggatgccacatcaaactgtttgtggtacttctaaacttcgtggaagagccctgtttcataaatctgagacagccttggtctgagggagcaaagacagagaattcacgtgctgcccaggcatagccacatagcaggtggacatccctggacacttttctgacaaagcacgcaatgtggggacaacacagaaatccaagaaaggcaagaccaatttcaaggcactaaataagtggactgagacaagaagtacacagatacttcccagaacaaaaccctcattggattttcctggaagtacggagagttacatccagagaactctgaacattttggaaggaccccaatcctgcaaacaatgaatggcaataaatcctgggactggaaaggggcttctcaaccccaaggcaaccataaagtcctatacaaagaaagatacagcagtgtgaaagaggcctggatgaaaaaacaaagacagagccagtgagccagagccagagccagaggacaagagagaaaggcagagaatggaaaacacagacagagaaggcagatgcgtagagagacagagattcaatgagaaaataaggaaggaagaaagaaagaaaacaaaaacgttctcagcactacaacttctgccttgttctgttccagaacagtatgagctcagtactttttcagactctcaattttctacaactaataatttgctctttcagttagtggcaaaggcttaacgacaaaggttcatctttaatattagagaggcacttttaaaatttatgatgctaagccttttgttctggatatggtatgttgcacaggtctagggactgggatttcagatgtctattccgtacccttattcttttatttattaaatcttttagtgtgtatttttttctattttctcttcttttattagtatgtatttcttgagtcattaacatacaacatatataggacttcctctgaggatacaataatgtatatgatggacaagatacgtaaaagtgccttgaagagacttggtcttgtgaggggacagacaggaaacaggcaattatcacctaacttaggtctgttgtttcaaggtaaaataagaataataacatctgtgttggctgggatgttgtgagtgtttgtggagataatagtacaaatgaaattactgagggacaatggtgaagatagggccatatcatggagcttacactagtgatggaaggagatgggagatacaaaagcaagtcaatatttcagatttcgtaaatgaatggcaagcatagagcagtgaggcagagaatgactggagaaagagactatgttaaactggatagtaaaggaagagcaggaccccactaaactatatggagttttgtgcaaatcacatgaacacacgtagaacattttaggctgctcatgtgactttggatttgtcctaagggcaatagtaagcctttgaactgctttagcatgataggattttaaaagatcactggctgctgtgtgaacaaaaataatgttgtaaagaaaaggatattagctgtatcagatcagctggagactactgaaataacccaagctggcttggactacataggagtagtgtaaactcattcattcatgcaagaaatacttactgagtgcctactcagtaccagacccttttctaggacatggagttatagcagtgaacaatatagaaaaaaatccccgaattcatggagactccagtgagcagagacaaaaaaatagcaactaaataagttaaaaggaattgagtaccctataaaagtttatcagggaaatgttataaggaatgactttcggagtaatgggtagtgatcttaaatgtatggtcaatgaaaatcagaagttgtagagaagtggataaattcacagtacgttttaaagtagacctaataagacttaatgaatttgatgtggcaagtgagaaaaatacatcaaggatgatgacttttataatttgacttgagtatctgggaacaaacaagtacagtgccataataagggcagaaaattttccattcactcagcaacttatgaactcatttgcttagtctttattgcctcttgcattatgtagttttcactttgctggagtacttgtatagaagatcaccagtgaagaagccagagatggtttatttggtcatcccaataatacatcttattgttaattaactctcaagggttttttttcacaattttagaaaaggtttaagcaaatgaattatttaacatgaattggctatgtgaccctactataaggtgtttaaaacaccaacagcttaaacttcttagatcaaaggacatcctccaggccaaaatgtttccactggaacggtttctttgcttcctgattaaaagcttccctaatatatttccacgtgttattacatattttcgtattcactttgatggaaagcaagaatagcagccaaatacatatttcatgcattcttttgattaaaaatgataaaggtaatattagtgtttttttctttctcacctccaatttatgaagtggaaataattttccatggaatggccaactaaagaaaagaaatatgataaattcagatcatatcattgttccatttatccttgtaccctgtctgtgacagaatacctgatgtttgggatataacaaaaatagatgcatagaatcatagagtttaagaatgtaaaagacttttgaaatcagccattctaataccctaatttttaagatagacaaaaaatggtctccggaaggataaatagtctaacaaaggtcatgcattgagaacaaacctaatatgagccaagatggccgaataggaacagctccagtctacagctcccagcgtgagcgacgcagaagacgggtgatttctgcatttccatctgaggtaccgggttcatctcactagggaatgccagacagtgggcgcaggtcagtgggtgcgcgcaccgtgcgcaagccaaagcagggggaggcattgcctcagtcgggaagtgcaaggggtcagggagttccccttccgagtcaaagaaaggggtgacggacagcacctggaaaatcgggtcactcccacccgaatactgcgcttttccgacaggcttaaaaaacggcgcaccacaagattatatcccacacctggctcggagggtcctacgcccacggaatctcgctgattgctagcacagcagtctgagatcaaactgtaaggcggcagcaaggctgggggaggggcgcccgccattgcccaggctttcttaggaaaacaaagcagccgggaagctcgaactgggtggagcccaccacagctcaaggaggcctgactgcctctgtaggctccacctctgggggcagggcacagacaaacaaaaagacagcagtaacctctgcagacttaaatgtccctgtctgacagctttgaagagagcagtggctctcccagcacgcagctggagatctgagaacgggcagagaacgggcagactgccttctcaagtgggtccctgacccctgacccccgagcagcctaactgggaggcaaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaacagtagataaaaccacaaagatggggaaaaaacagaacagaaaaactggaaactctaaaaaccagagcgcctctcctcctccaaaggaacgcagttcctcaccagcaatggaacaaagctggatggagaatgactttgacaagctgagagaagaaggcttcagacgatcaaattactctgagctacaggaggacattcaaaccaaacgcaaagaagttgaaaactttgaaaaaaatttagaagaatgtataactagaataaccaatacagagaagtgcttaaaggagctgatggagctgaaaaccaaggcttgagaactacatgaagaatgcagaagcctcaggagccgatgcgatcaactggaagaaagggtatcagcaatggaagatgaaatgaatgaaatgaagcgagaagggaagtttagagaaaaaagaataaaaagaagtgagcaaagcctccaagaaatatgggactatgtgaaaagaccaaatctacgtctgattggtgtacctgaaagtgatggggagaatggaaccaagttggaaaacacactgcaggatattatccaggagaacttccccaatctagcaaggcaggccaacgttcagattcaggaaatacagagaaggccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtaggggccaatattcaacattcttaaagaaaagaattttcaacccagaatttcatatccagccaaactaagcttcataagcgaacgagaaataaaatactttacagacaagcagatgctgagagattttgtcaccaccaggcctgccctaaaagagctcctgaaggaagagctaaatatggaaaggaacaaccagtaccagccactgcaaaatcatgccaaaacgtaaagaccatcgagactaggaagaaactgcatcaactaacgagcaaaataaccagctaacatcataatgataggatcaaattcacacataacaatattaactttaaatgtcaatggactaaatgctccaattaaaagacacagactggcaaattggatagagtcaagacccatcagtgtgctgtattcaggaaacccatctcatatgcagagacacacataggctcaaaataaaaggatggaggaagatctaccaagcaaatggaaaacaaaaaaaggcagggattgcaatcctagtctctgataaaacagactttaaaccaacaaagatcaaaagagacaaagaaggccattacataatggtaaagggagctaactatcctaaatatatatgcacccaatacaggagtaccaagattcataaagcaagtcctgagtgacctacaaagagacttagactcccacacattaataatgggagactttaacaccccactgtcaacattagacagatcaacagacagaaagtcaacaaggatacccaggaattgaactcagctctgcaccaagccgacctaatagacatctaaagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtacaatcaaactagaactcaggattaagaatctcactcaaaaccgctcaactacatggaaactgaacaacctgctcctgaatgactactgggtacataacgaaatgaaggcagtaataaagatgttctttgaaaccaacgagaacaaagacacaacataccagaatctctgggacgcattcaaagcagtgtgtagagggaaatttaagagaaagcaggaaagatccaaaattgacaccctaacatcacaattaaaagaactagaaaagcaagagcaaacatattcaaaagctagcagaaggcaagaaataactaaaatcagagcagaactgaaggaaatagagatacaaaaaacccttcaaaaaattaatgaatccagg

SEQ ID NO: 2807 - DNA, 1132 bp, Homo sapiens
tatttcggtaccaacgaatctatttttcactcaatggagattttccatttttggcccacagcaatatccggagagagagagagagattcctgtagaatacaagacaagactatcacaatgagctgaaatgttgggtctgtgaaagtaatgagaagcacagtggaaataagtttctgaaggatggaagaggctggaggctggctagtgggagaaggttcccagacacgtgagagacccagcaacagattaaaatcatccttacctgacaagaggactcagtgaatcaatgtaagtaaaaggcttagtccggttgctggtgcagtggaagcacagtgtgtttactatcttcttgcttcattttcagaagatagacagggtgttagaactaccactggcctgtcacaagtcatctcactggtcaacagttattttgggggcctgatgcccttccactcacaaagaggatggtgtgtaaagaatctctcttggtgtgactccaggactggcccactggcttttaacacacaaaatcctcctttttagttaggcaggaatcagcccaagactgaggattggcaaattgtgagttttgatactgatatgtaactcattcttaattactcatccacatacattgtagtgccatctctgaaaactgagaacccctgagattgtagtaggaaagatttctagtgccaggaagagtaatagcactaaatcaacatgacccaaggacacgagcaatttcataatgtaaatgatgataacctgtaaaattatagtttttattttcttctacttttactgtaataaataacaatctggtaaagaagagtaaagacacatacaaggctgtcaatattttaaacatttttaggaggagaaatctaaaagaagaaaggaaatgagataagacacatatactgcatggaaatgatagcaaaatttatttagaaaataatcttctttttacattttagcatttaaaaataatttttatacatatgcccacaggcatagtttttacaaaaatataaatcctgaacttagcatacgtaccatttttagtacagtcttttattctctttttcacatatcttctttctgcacctcagccaataagattccctgc

SEQ ID NO: 2808 - DNA, 15166 bp, Homo sapiens
tgactatccacaggcagggctagaaaagggagtggaacattttacttaggcaggaagcactgaagagaagaatctttttttcagtagacatttgtgggaaataaaaatttgtttagaagaatttaggccaagagataaaatggtcttcttttgactgaggagagataagatagattttaagcagacatctgaagttaaaggtgagagaaggaagataaactgggtgattttgctcacctaagaaggtacacagatccaaagaaaaagagattcgagaggtgtctccagcttctgattttgatgacatctcccagagaggaccgtgttgccatcaccatcccagagtctgaaagtgtccaggtcagagacgctttcactaaggtgtctacatcctgcaactatagatgaatctctaacaagctgcctgctttgagacctattacttccataatgggactcattgctttcctaagcagcccttgtaattttcagcaaggtcctttaactcagttaatgtgaaacatttgttcatgcctaatttgtcggagcccggccatagttgtgttctccttgagttgcagaaggttgattgtgggggtaaaacggtcagcctcaagtgactacatatctccgctgaattatagtaattactgtggattgcatttggttggtggattgcatttggttgtcgtggagagaggccctccacgacaaggttaacaagcagaaggtaaccagacatcagaatataagtgcctcatcacatacagacaattgttgacagtgcatttttttcgtctcataattatgataaggttcggtaatggatgcagctgtacaatgccctggaaattaaattctagaatccataatgtaaggaaaattagaatacagtagcagtatttttcttcaaattctgatattaagacagtcctttgcaaatgctttaaaatgttagataaccccatttttatggaactttggtaattctcacctctaattctcaccatttcagactcacatcacactcttctttgtttggtagttttttttttttcaaagtgagaagagaacattatttggctataattcaaaatgacagctgcattctttttgattttttttctcataacttggtatatcaaaactgattttgttgcttgtataccatccccaaaaccatttattttattttaacgtgtgtttatataagatttaaattagctttttcctttctctttcctttgcatctgtcaagagtggaagacttttttttcaactctaccattacgatgaccttaaagtcctagctgtggaattatattagaaaactaaccttcaaataaaatttggataggagacaactgcgtaataagcatgcagacatttgagttttagcataatcttcctttgaagtgtaatttataaaatgtacatatactttatcattacccataatttaatgaagcatgatgtagaatatataaaatattcttctaggggagaaaattaacattttctaatatgcacacatgtggagcatacatatggaacatttatcacacactttatttatattactaactgtatacagtaaaattacatgatgttacttttattttagaaactaaatctcaagctgtgtagtttgagtaaaggctaacagtaaaaagtttccataactattcctcaactttaaaaatcaacctattaaatattttaaaagaaactgtgactttgaaatataattggattatgggcggtcattcatcccagaggaatgacattttatagaaaagataacttgagcactgatagtatggaaccatgctaatagagaaattatgtttcactttctagtttactaatcagtaactcgtctcgattttgctcttgcgagattgtgtgtgcatgtgcgtgtgtgtgtgtgtgtgtgtgtgtgtgtgcatatttgtgtgagggagatcttccttaagggaagaccataataaaatcatatacaatggtataaaatgagatattttctttctcatgagcttctgacaaatttcagataaaacttatttcaaaaaaaattgtcatgtgaaagacatagaacagctaaaatttctacaaatataagggtcatcaactaataaatgaattaaaatagatgcaatgattagaaaaaagaaacaatataaataaaatttaacaaaggaagcatccaacaaaaacaaaatcatgagagaaatcatgagaactaatacctggacatggggggttggggggagtagggagagagagagagaaagagacttatttacaatttccaaaaagcagttgctgaattttttttttaactctcattttgctttatttggtgacaagctccatttgataagaacagataattaagttgtttgttcttcactatcacagtctatatttaaagtctttacttctggaatatggtgaataacattgaggctgagacttgagcacattcatattcaagagcaaagatcaggtctgcacttaataaaagtaaaaccctgctctcctttgtgtaataagcctataaagtagactttttctttagcttggctaaaagcggctctattgtgtgtgtaattttgaataattatctctatgtaaatcagaaactgccttgtgacccaacatagctttactttgttaaaatttctgtccttagaaaacaatgtttcccaaggaagaactttatcactatttacataaatcttatgaatcagaatgaacaaaattattacaattcacacaaagtggactgcaaaccaaacatagatatgtgattttttaaaggggaattttcattaatctaacattttactaaaatttaagaagtaaaaatgtaagtgtatcttcatagataagaaatcaaaataataataaaattgacaaatgaaaaaagtgatatttattgtttacttacttatataggaaataacaaaatcgataaatgaaaatagtgatatctattgtttacttatttacatagaaataggtattgacacaaatatttttcaggaaatatcaatgaaatcatggaattttgaagaagatacaacaattttatttctgctacaacagacgttctgctaatggaacagaagtcagcgaaggacctattaggttttaggtcacttattactcaaagtttatacattctacactaagttatttattgctcaaatttatctcatatttattcctagattgtgtgtattaatacaaggcccagaaaagttgaataatgtacagtatatttcaagtattataattaaaaacttagagatttagcccaggtttatctgaaccaatatcttctgtttttttcactcaaatattttgaggatgagcattatttagcagtgaataggtgtgttcttaggcagaaaatcctccaatgcattcttcttagtgaaagaagccagacacaaacaggatgcaaattgtaagattctatatgaaatataaatccatggagacataactcagattggggggttgttagagtatagagaggaaggatggggagaaacttctaaatgaataagttttactaagctttgtggaaatattttgcaactcgagagagatggtcattgcacaatattgtgaaaatgctgaatgacacttaatcgttcattttaaaatgggtaattttatgttgtgtgaatttcaccctagcaaattatttttaaaatagaaaatacaactgtgatgacaaagaacattagactccagttctaacattatgacagttaatgcatggaaatagatatgactcttttcttcccccacacattacattacaaaagttgatacccaacattaaatcctttcgtaatagagaaaatattgctagacaatgacagtggttccaaggcagctttaagaacagaagtgccacatgtaactcactgtgattcatatctgtgttttgcttagtacctaacaccatacctggcaaaataccctataaaagtgaagaggattaaattttgaaatccaggatcaatataaataaataggtacaagttttctgaaagctactgcctgtatgtttcatagttttgcctttataatcagtcatggttcaacatcttatttctaagtttaactaaagatatattcttcatactttaagggtaggagaagaaagtataaattggattaaaattaaaatatagctttttgatgaaagttgaattctttggcaccagccatcacgttataagcaactttattgacacacaagtaattgcttatacacagtgtaaacatacactatagtttatctcagtcagtggtggctttttattttaaagagctctataaacatgaaaccattttgttatatgtaatcaactacactttgctgcctgattaaaaaaagagattttatctctttcattggatgacactttaataaagaaaaaggtaatgctgttgaatattagaaaacacgggtaataaacagcatcttgcagttgccaaggctttggtaaaaagttagcagtcaggaaaatttccaaatggaaacaagtgttatttgacgattttataaaattcagcagaacacaaagcaattagtcctgtttgtggcttttattgtccactgaagtaaagtaattatagtatttctgatctcatgtcaaacagctttgactctttgagctataatgtgagttctgacattaggactcaaagtctgaatcaaacatcaaacataaaacagtgagggactgcatctttaaaacttgaagatccctcagattttaacctgtaacaaagttgaactgttttatgaaattaactaaatgaaaatagaattattcattcaaggtggaatggataatatttaatggacatgggaaaataaaatgtcccttcaccaaatatatccagacgtgttcagaaatcactttccatcaaagagaatttatttacacccagtatgttgcctggtcctcactgtcagtaatgatttacaaattaaatagtcatggtgaatattcaaacagccttctgcctcctgacatctctcccttcctttcttcattctcaccactcccttccagtttttctttgctttcagcatttggctggccaatctgttttgaacttttggggtagcctgatgtttcagcagggtagttttttaaacagaactttcaaatcttagctatatcccaactttaaaggtcaatgtaaaaataatttaaagtatggagtttttaaaagggatttaaaaaaagtccccaattctgctcagtcatctctgcaatagcgcaaaactacctaataaatagcaaaacttgggaaaggtcaaaatggaaattattaataaatgctaaataacccagagccagtaccggtaatatataaaatgatgaaatgccaatttaaaaccaccatgtgaagcaaaaatatctttatatttaattgaaaatgtccataacaggaagaaataaaacaaatttccaagctaaagccttccaaggcttgattactagattgctgtcacgaggaatatcatttctgcttaggatgtcatggtgcataatggggttttatctttcgcagattattgtactgacctcattaaaataaattaactaattcatcagttgacttgtagtttttgcaaaagatagctaataaataagaaaaggaagaataatttattttttaaaacttgaaagtatttgtctttaatgacaaacttgtggacgttggttgctctcccactcaaggtcattaaccctataatactacatatgctggatagattctgaactttttttttttttttttttttttttggagacggagtctcgttctgtcacccaggttggagtgcagtggtgcgatgtcggctcactgcaagctccgcctcccaggttcacgccattctcctgactcagcctcccgagtagctgggactgcaggcgctcgccaccaggcccggctaattttttgtatttttagtagaaacggggtttcaccgtggtctcgatctcctgacatcgtgattcacccgcctccacctcccaaagtgctgggattacaagcgtgagccactgcgcccggccacgatttttccatagtcaagaaaaatcttaaaatttaatatttaatgcagttatagcctatgaaagcctaaggatggctttcagaaactttaataatcttagaaaatgaccacttttttaaggcacacatctgcccgttgtgagcatatttgtcattagcatttagtaaaataggtacaatccattactgcttatttctaatactatttccgcttgtgtttgcatttcaaagtagccttatgagaaaaaaatagagctttaccatgagttattattgttatttaaaaagatagatggctcatgataatattgttagagttgctttgcccaaactatacttttattttctgaattttcagacttcctttatttctctatttcattcttcattccccctgaattgtttttaatttctggggcaaatcataggaaaaatctccaagatatttaaggctcatatagttagagaataaatgaactttcctatattataaactataaattaggtaactgtaaaatcataaaaaatgcccttggcttgcagaaacaatggtaagtgacagactatgaaagtgtcttcataacttttatctaaatttttggggggctcagtttattattgttctcttcatgcatgacttttctaaaatgagatttggaaggaacagtatttcaggaaaaccctaagttttaatgatgaatgttttaagtaataaggataagaagatttattgtgattatatttaaaacattttccacagtgggtgcccttgggaaaatctgcattctgtgtggtaattaaaattctgcacaagctatattgaatagaacaatgtagaaataattcttggctgtatagatttagcatctatttagtggaatgaaaatctcctgtgaaaaagtagggtgacatcaattaactgccaatttttaatttataatagtgacataaagatgagaagtaaagcaaaagtaaaattaatcaatgcaataatgacatcggacactacttttctaatgcctaggaactatgagaatactgtaagaatattttacattataaaagtaatatatcaacattgctacagtctggaaaatacttttaaataaatataaaatcagtacctagaataatgcctgctaggcagtcaatacatatttttgttgttattgacctatataaatgatctgaacacaagagtattttagacttaaaaagtttacaatattgaaatcagaaaatcatataaaatttatcagaaaataatacaactatttatgcgatggaaaagacaatgttattgaaacaaaagcaatttttagaaaccagatgcactgatgctacatataaatgcagttgatagaactgctagtagaccaaaatacttttatgagtaaacatataaagaatgattgaaagttcatttatcttaggagttatttaagtatgtataactgtccatgaattttattgtggaacatttaaaggaagatgttaataaaccaattttgaatgttgctattcctagacacctcattaaaaatcagaaattagcctatcttatttcataatataaggcagcagagttgtgcctccccgaagtaagaatgtgaagataaaggtatataggtactttaaaatatcttctaaattatatgtaatgttaaaagtaaataaaaatggatgaaataggaatgcatttatgccaattcatgattgatgagaatatatttggaggctttggcaagagatagaaattgtcaagaccagtgactgaggaacagaacttgtttatggaaaagctttcctttctcttgacctcatgtgtacacatgaagtgatgaagggaggagacagccacctttacacttgatcagccagccaaatcaatcacgaaaatcagtggactgtttgccatattgctttcagtccaaagttaggaaggtgttgaagaaatgctgcattttgatggagggcaggtagtctttcaattagtatgtgacaccatgcaagtttagtgaggaaggtgagaattcagcttccttacagtcaggtttactttctggaaaaggcactatacatagaatgacactatatacatgggaaaaactaagaatatactaaatatgataaagctacctgaagtagaagggaatactgtgagaagtctaatggggatattaatgaagaagaataagtccatcttgaaatactgagaaaattaaaagctccctgtatttttcctggtgtattccatgaagagaattaagctaatacagacagagaaaattgcagaagacagaggcagtatatgaaaaaatctacatatattaaaggtaaaggaatatttgagaaaaattattaatacaccatatttcaaagaagagctaatttattaacttttgaactgagtcaacgaggtaactacatattttttttcttttgctctaactcctgtaatttgagacacaattatttgatggaatctttattctattatatatgtattatattccaatttctgatattgactataatatgctgtgattttctctgtgtataggtctgtactggaataatactcatcagtttgcttataaaggctatcattaaaaataataatgtaaaaattaactgcaatacagcaagcttttggaagaatataaacattccctcaatgacccagaaaactacaccaggatcccttcagcatccctctgagtgctgagttgcaggagggatggctgtggctctctgatttgaattgaaactacagacatccatcctctcattctccatcctatggacataagaggcagttgtccccatgtttctgctgcttcttatcgtctacttcagtggcagcctcgggccgtggtttctctggtgtgccaggtcaatgtgtccacggaagagcttgctcctgcaaacccttcctgatgatttctttagacaactccctgtgttcatttctgccctgcgtaagatacctggaataatttttattctctaatgaatgattgaaataaaagtctttcatgaaatatctggattatggaatgaataaagtaggagtaaattctataaaaatgtttgacatcctgtaggttgtaagaaaacatttcaagtttaatttttataaatttctttatattaaataatgtatacttgtaaaaaatttgaaactataaaatataaatgtagtgaaaatgtcgttgtttcctcagatcaaagtaacaagtaagcaagttaacattttgaaatatttcccatcatatgttttttctatttatattttttagtactttggatcattctggatttataattttatagaattacttataatcactgctataattatagattaatactctttaaaatttataacaaacttaatcactgggtgtttctcatctacaaaggtgtcataacaaactttttatcttactggatattagttaagattattttcccttaatatatcttttatccttggacaagtaaagaaagaatctatttgtttaaaagtaaatatttatatgaattccattgaatttaatatttttacatgtacttaaattaagtttgtagggttttttctgtttttgtttgagtcatgcaaataaaattgtggcatgggacattcgtattttaatcaatatgcaacagtgtacagtacaaattggagctgtgctaataataacaaaagctaacaattttttcataatttatgagtaccaggcaccattcaatgtggtttacacatatttcccatctcatataatgttcatagaaactctatccctatttcaattttagaataagaaattttgaggcagagaatgtaattaattgccccaagatcacttagattggaagcacttaaaccaaggctaggagcaagttaatctgactctagattttatacttaaaaacacgaagttaaataaatgctcacatattgctcctattattttccctgcccagcatttctctgtagtcttagaaacagaatatttggcccaggatcctgcccatatgttaaacatatggttctagagggtactgtcaacccgtcatctttctggaagccacacttaactagttgtgatgagcaactgtgactcacacggggccattgtagtggtaatctttgttaagtaccaagggaagggataatttctctggtgttgaaattgtgaacagtgccactacaaagatatcagtagtcatgctgcccattatgtggaagaaaacgagcctaagaccgtgaagccaacacagggaggtagaacccagggccccattttgtaaaccctggcagctgttaatctgttctccagaaatataatcttgtcatttcagaaatggtacataaattaaatcataagaatatccttatgaaattggcttttttcattcagcataattcctttgaaatacactgtccctgcagtgctgggtgacatgccattctgaatgttttaatgttcagaatgctcctgtggttgcctcttgtgtgagttcaaaagcaagcgatgtaaaaaagttaacacagatatttctaaaatctcagaggagttaaactctaattcttactgttaataatgaaaaattacacaaaaattcatcatgaatattctattatagcattttttcaatattgagagtatgtcagggctaagactcacagaaaattattagttttgttttatcaattttatatgcaatctactcaattttacagataacttatggctactctatatgcttgcaccttttttaaaaatgggagaagtcatcatcagagtacagatgtcacctcttctattactaatcaacatatttcatgtgtatttttccttatgtttcagcaattgactattcagacaggaatgtgatacatagaatctcttcttgaatgtaatagagtcatttccaacatactatgtcttatagttagctcaaaatttcgtacccaaacctagtttttataatttcacccactccaactgcttgaaattggatgcctccatgttctcagacaaaaaattttggtgtcctcactgactgcatttttttcacactccttatctctacgatttttttaaaccctgttgcagccctctcaaataaatacccagaatctgacaatatctcatgacctccacagttatgctaagtgactccagcttcccaactaacgtagttgaacctttgatccttcaatccactcccccatctattctcagcccaacagtagaagaagcgtttatatgtcagattaagtcacgcctctgatggaaagactctgatggctccctgcatccttgagcatcctggaaggaaacaggtggcatcctcagcttaggtcatttgaagagtgactgataaagggacttcttccaatgttgcaggcagggtgcagtccgggcaaaccacagtgcaggacctggtggctagtaactgtaggtctgttaccccctctaaactaacagtacaaggggagcaggtagaaggttcaaatcaaacaataaacatgaaactataaagaggccatgatcaataaaacgcaaactatggaacaatgacattgttagcttataaataagtaccctttcaaaataaaggtaatcccaagtaacaaagcatatgttccttttttctctaaatataaagatagataaacagagagatgtgtggataaatagataatatgtgaatctgttggtatcttctctagtcccatgcttcgagttttattgtttacaagatgtaaccaatcttatttcaccaacctcaacctttttatctacctctacactaaggacccatttatattctctttggaagagacaataacacacttataaaataggtgactagcatatctccattgagcaaatgtacgaaattacatagatatttctttttgattatggtgacatttttattaactcaatatttatatcatgtaaaacatttacttaatacttattaaatttttaataaagtaaatcaaaatttagagagtgcagaaaaaaaaagatacacgttttccagattttcctcccagtgttccactggcattattttataaatgaatgacagctgtaatattcaatgcttcatgcttcagttaaaacatctggtgaacagagaagatacgcatttctacttgccagataacctaatatatcatgaaacatgcctaatacacaactgaaaaatatcagcatactagtaataaatagattttgggaagcttgagcaattagcagaaactgtaataattttatatatttatgtagctttttaaggaggaaggcacacagagcacttgtgagagttgtcgtcataacacagcgtgatactgctcgagttgaactggtgctatcacctacttaaggaattggcctagaaacaatctgttactttcatgaaagtaggttaatattcaagctgatatattttgatatatttttccttcattcctcaggcttcaattctagccctgtaaattttaaaaataattggcatacataactcattgacataattacatagaaatatcaagctggctcttcactgtgcccatagtgtgctggtgttgactatgggtttgcaaatccataacactgtctgtcctactaaaatgtgcaaactattttgaaatataattaaatgtaatttaattttttacctcttatgaagtcccaggctctgatttgtgttgtgactatttaatatatggtaccatgcatggataaaatgactattacatttgccaactgaaacaacattaatcttgcctcttttttcatttaaatgatataactttttgttctaaaacaaaatattataaaatttctggttgtttttgtgtaaatgaaaacccagtttctacttttgttgtttttttgttttttgcaacggagtctctgtctcccaggctggagtgcagtgacaggatctcagctcactgcaacctccgtctcccagattcaagcaattctcctacctcagcctcctgagtagctgggattacaggcatgtgcaaccacactcagccaatttttatatttttagtagagatggggtttcaccatgttggccaagctggtcttgaactcctgacttcaaatgatctacccgcctcggccttccaaagtgctgggattacaggcatgagccaccttgcccagccatctttttttgtcctatctataataattccctcaatgctggagtgccctatttgagttatctgatttagtatttgtctgaaactctgctgcccagaatctcacaaggaaaaatttacataccagaattgtttttggcgtctcgacttctattcttcttcctctttgtcactaggtcttcatcaaatatacagtttaattttaaaaacaacttaatttttcattatgttaaatctgtataattttcccaggaatttctggcttgacttatagtctataaattttaggctataggttctagactgaaaatgttgatatggtatcactttatctgtcctcagatttctaagccatatgtcagtttatttggaatattctacatagcaaataagatatgggatattttctctttaaaattatctaaatctgataataaacacatatttttttcttaacttttatgtttgagggtgcatgttcaggtttgttacataggtaaacttgtgtcatgggggtttgttgtacagattatttcatcacccaggtattaagcctagcatccattagttatttttcctttccctccttctacctcctctcttacccctcagcctcctaaaggccccagtgtgtggtgttcccctccctgtgtccatgtgttctcatcatttagctccaatttataagtgagaacatgtggtatttggttttctgctcctgcattagtttgctgaggatgatgacctctggctccatccctatccctgcaaagatgcgatcttgtttctttctatggccacatagtgtcccatgatgtatatgtaccacattttctttatccagtctatcattgatgggcatttaggttgattccatgtctttgctgttgtgaatagcactgcatgtgtctttataatagaatgatttacagtcttttgggtatcttcccagaaatgggatactgggtcaaatcatattgcttcttttaggtctttgaggaattgccacactgtcttccacaatggctgaactaatttacactccaaccacagtgtgtaagtgttccttgctctccacaaccttgctagcatctgttattttttgacttattaagagtcttatgttcatctcatagtttatctgctattaaatgattccgcatattaagtaaagatatttgatgtacacttgtgtgtactgatgtagaaaatgattaataaatatttatcaaaaagttttcaaaatgccttaaaaactgtaagtgttttaatcctattttgatttattacaaccaacagttcttgacaacatatgaagctgaagcactgggttagaaatgtgttaaataagaaatcacccattaagggctgaaggacagttagaaaatattctaaacatgataaatatcattaagggaaacacccaatacaatggtatgactttaaaagatggagaaatcacttctggatgtggctgtaatttcagtggatcgggaaagaattccccatagagatggattttgatctgttgcttaacatgttggtgagcttttgaaaagaaagttgcaggactaagagggattgtctgtctcctggaggaaaaacagaggggtgcatgagttgcaaaacactgagaagagcaagcaaccttaaaagcaactaattcatgcagggcgaatttaaagtaactctaagaatgcacggtaaagaatgcactcatatttgattccaatgcatagtaaagaatgcacccatatatggttccaaaatactaatatcaagggaaaaatcaaaactccttgtggattatcaaaatttcccacataaaattaaatgctt

SEQ ID NO: 2809 - DNA, 2289 bp, Homo sapiens
gtacttatgtacaacatgatgttttcaagtgtatatacattgtggactaaatctagctgatttacatatgcattacctcacatagctatcatttttttttgtggtgaaaacactttatgtccactcttagcaacttttaagaatacattatactattaactatagtcaccatgttgtataatagatctcttgaacttgtcctctcatttaactggaattttgaatcttttgaccaacatctccccagcctgccccaactgctccaactcctggtaaccaacattctagtctctacttttaagatcaacatttttggttgctatatgtgagtaagatcatgcagtatttgtcattctgtgcctggcttatttaatttgacataatgtcctccagaatatttaacaaaattgttactgtaatttcatctacgatgggtaactttggaggctatgatttgtagagtaaattgacgtcttcaaagctgactggttggaaatgaaagaaagagaaaagaaacttaaaaaattacaatcaacaccaggcttaaaggggctgggatgatttatttagcaggaagataagaccctcaaagatcactaataccaaatggtatgttaaagcccactcaagcctgggagaactttccctgggatctgtgtgggcttctgttatgcaaccaatgagaagagtcatcccattatctgtctgccaactggaaaagctacagaaaattgatataaaagggaggtttgcagaagaccattgggattagcttgaagaatgttgcagcaaattttaatttttttgaattcctcctgcaaacacatattattgttgtaccaaactaaatacttttcatactacaatctataacaaaagtgaatagtactttaattgactactttgaactaagatggtttgagctgctgtggctttctctggacagtttctctcatcatgaatacaactgatggcaggtgaggtgttgacaattcctcatggatgttggcttaatattgcatgtccccttctttcttttctcgagaaaaggcagaaaaacaagattgagtctcatgaaaacttgaaaaaaaggcaattctaatggcactcattctaacagccagtcatcacaggcccgctgccctcttcctggtgcaggtccacacacatcccatgcctgctccttgtggagctgtcctggctgggaacatctccaaagcagcaagtcacctcacacgcaattctcttctcctgcaagccagtcagaggcagtgcagagatgatggctgctcaccacagcaccaccagataacctgacttggtaagacagagtgtttttgctaatgttaaaacacaaaacaaaataagtcttccctctggcctgatttgataatccccaaataatatctaacgtaaacttgttatgacacttgcacttcttcttccaagaggtggaaatcataacaatatagtgcaggaaagttatgacatttcagctgaaaactattttatcgttatcatcttcagcctatttttatttttctgacaattttatagcaaaagttaaaaacacctgtagagtagtttcctagaagtttcttttaaaaccaaataaaataataattttcttatgaaagcaatgcatgttcaatggagaaaaataaaagtgacaagaatgaaaggggagatacagtcccatcagccagagattgtaaccagggatctcagttttaaaaatcacacactttctttctcgtccttgcctcctctctcaccattttatttcttctctctcacctctttatttcttctctctctagacactctcctctggcagtgcgtgcttatctaattatgatcttacctagaaatcccagaggctaatcttgaaacaaaccagtctcagagcccccattgtggaatcctcctgcttagggggagttactgggaataagtagtccaccaccatctgctcaagtcaaaataatgccaatcagacctcgggagttgtgactacctaagataaccatcaaacaagacacacagaccctgcaccctgcacccttcccactctcccataccaagtttccctttaaaaaaccttacgcagcagtaggacaaagaacatggctgccgcttcaaatcttgtgtgaattcacctcatcactggaaccaaatttatatctaataaaaaggtaaaatgcattaaagttatattgttaaagagggaaaagaaataactaaaaatattttagaggaaaatataagagactatttcatgaatgtagg

SEQ ID NO: 2810 - DNA, 852 bp, Homo sapiens
gccagattgccatgcctaaaccactttctttgaagtttatggaagcaccactgcatttatgccagaaggtgaaagtccagaacaggtgctttttggtttgagaatgagtgttctacatactggcctgtaaggcagtgctactccaagtgtggtccacaggctggcagcaacatcataggggagtatgttaacaatgctgattctccagccccagctccggactctgttttaacggtctatccaggcatgaattctactcaagtggcctgcccctcagcagaagttggacaggtgcttatgttgcaattaacaaaaaggatacatgctgggtcctgcagtaaatgtctcccttggatcatgaagtctttttaccatgttactggaacacagaagggtactattgagaaccaactaacttggagccgtgtatgagccactgggaatagactaaatgagataatcaacgtcttgatctcatattctttcattctacagaaggaagcaggcaacaggttgcaatacgaagtggagttaaagcaactagaaggaagtgtcagtaaccaagctgagagaggctggaaggaaaacaattcatgcagcagaaaagaaagccttttgagcactgtgatgtcagaaggtgacttggaagatgatctaaatgttaaactggcagtgaagatgcgcagaggttgtagttctgctcccctccccgtcagaattaaggtggagacagcaggagtcacccgaagaatggaaggatggtgccaatgacttgaaaaggagtttagaagacaccagtttgtgacacatgtttctatataggaaaagcagaaatttggaaggagagctaac

SEQ ID NO: 2811 - DNA, 1062 bp, Homo sapiens
ggagaggagcctccccagggtctgcactcctcctcccatttgcagccttcgtaagtggacacttccaacccctacacctgcctgtcctcccagtccagccttggcccgagatgtgatctaattctcactatgctgctgtgggcagagcacatggcatcagaatgctaggagctgctgtcgggcgccatgggagggaattccccaactcaggaaagctcttccagcggaaaggagcaggtggcgagcctccctgaagagacagacactgccaacgctacaggcagagccaatcgtggggtggctaacaaatttttccagcaacacagagctgagaggattgggatctcagagaagaaggagccctgcattcttggcttcatctgcctggagtggagtttccatcatgctgagctggaggtgcacggggccagggaatgagcaagtcgtagctcaaatgtcccagactcttactattcttattgaaatttagtaggttttcttgaataaatgtttcttcatctgctgtatgcccttaggacaattcccaggaacatacatctatattgatatcaatataaatataaatagataattatgtatgtataactttagcagttttacttgttctgctggaaagaaggtctggaaggtttgcagagctgctcatgccaccattccagaagttatccaccagttcattgctttttgcacagtagtattccattgcatgtctatgccacaatttgtttatccattcacctgttgatggacatttgagctgtttcctgtttgaggctattacaaataaagctgctttacaaataaagctgctttgaacatttgtgtataagtctttggacatatgctttgatttatcttgagtaaatatctagaagtggagtggctgggttatatggtaggtttgtgttttaatttttaagaagctgctaagatgtcttccaaagtgattcccccattatgcactcctgccagcagtgtgtgagagttccagtttctccagattctcaccaacacctggtatggtcagtctttttaatgtta

SEQ ID NO: 2812 - DNA, 6067 bp, Homo sapiens
cagcacttgagcagctttcttctgcgttaggaagcctggggagaggggaactggctaaagggcaaaatgtcactgaggaacttcggagaagatggggacaaggcgtcgggcgggggagccagcgctcaggagcccaggcaccatactgtcttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtaagtgaaactgtatccaagtaagcaggtaactgggcaaacttcctacggcacaaatggctttttagttacctcctagtgctgaatgcattaaataaatggcggattcttgtcttgttatgattaataagaaagtttgtaaatgcagcctggatgatgataagcaaatgctgactgaacatgaaggtcttaattagctctaactgactaaaggcatttgttagttttggcagggggtgaacactcatctgtggctattctaagaccactcttatttcttaggtggagtccaacttgcctggaccagcttaatggttctgctcctggtaacgtttttatccatggatgacttgcttgggtaaggacatgaagacagttcctgtcataccttttaaaggtacatgttttattgatgttaacgttaattgattgagctactgttagtgatgattttaaaattaaagcagatgggaatctctctgagaaagaaaatggagattaatcttaaactgaaacagtagttgggaaatcttttagaaatccacctattactacctattggtaaaggagattaaatttctacaggtatggagagtcggcttgactacactgtgtggagcaagttttaaagaagcaaaggactcagaattcatgattgaagaaatgcaggttagtttaaactttgaaggaaatttttaaggtggcaaaaggttttggtggcatatacaccttaatctgtagatgggagtgattagctgtttaaaagttaaaatgtgactgagaaggaaattgagtagggcaaattttaaatgggtattatttttcatcttcaaacaggcagacctgttatcctaaactaggtgagtcagcttttggtacatgtgatgattttcagtgtaaccaatgatgtaatgattctgccaaatgaaatataatgatatcactgtaaaaccgttccattttgattctgaggttactctactaacaagcatcacacatttgtattttgccctgattaatatgttggcttcgctttcagggtttttaatgaccacaacaagcaagcatgcagcttactgcttgaaaggtgaggattggaaatgttgggactattataattgcagaatacatgatgatctcaatccaacttgaactctctcactgattacttgatgacaataaaatatctgatattctgcattcccatgtagcattttaattgaagtctgtaaatgtggctaaaagtcttgtcttattttttgagacagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatccatctggagtgtgtagtgtttacttaaaaaaggacagtgcttttcatctgttcattagctgtaagcataaatcacattcaaaagctattataactccatggtatttgcttcattaacactgcagccagttaaaattttatgggtattttacaaggtgtcttatgcattaaagtgcaatatttcctaattctccatatgagcaaattgtcaggtttcataggcccctgtgctaattggttttgagcttaaagtattgatggagctacttggagaaagtcatgttgagtctgaggctgggaaaataagttatagaaaatactatagaaatgcccaactagtgataggcattaatggaattgggaaaatctacaatccatagccatggtgataggtttttggcaagcactaagtgtttagggatgccaaaagtgggtataaagggcacaactggtttaaggcaatctgtcccagggaaacaggaccaaggggccaaaattccaagatgggtcaaattttaatttcagtgtcagtacagctgtgcttataatgatgtctttgttagcagtaatggttttacaaatctgtttctgggctaaagcactttagtcccattaatgataaaacttcagttactctctgaattttcctttttttgagactgaatcctgttgcccaggctggagtgcaatggcatgatctcaaccgctgctcactgcaacctctacctcccgggttcaagcgattctcttcagcctcttgtagctaggactataggcacctaccatcacaaccaactcattttggtatttttagtagagacgaaaccccatcctcccaaagtgctgggatttcacaggcctgagccgcagtgcccggcctcccaggccttttatgcttgatgtttttttcagggcccttcccattgtcatttcacaatctcattgaaatgtcagcttatgcactaaatgcgtgtaagttgggaatgcccaattttgtctaagaaaaaaggcctccccctcccccaaataagcacattctttcatttcctggggctcacccgaatgtctcacacaggctgtaaaacaactaccaccacctggctgggtgctgaggtgggcagattacctgaggtcaggatttcaagaccaacctggccaatatggtgaaaccccatctctactaaaaatacaaaaatctagccgggtgtagtggtgggctattgtagtcccagctattcgggaggctgaggcaggggaactgaacctgggaggctgaggttgcagtgacccgtgatcctgccactgcactccagcctgggtgccagggtgagactttctcaaaggaaaaaagaaggctgggcgtggtggttcatgcctgtaatcccaccactttgggaggccgaggcgggtggatcacacggtcaggagtttgagaccagcctgaccaacatagtgaaacccccatctctactaaaaatacaaaagttagccaggtgtggcgtgcacctgtaatcccagctactcaggaggctgaggcaggagaattgcttgaacctaggaagtggaggttgcagtgaactgagatcatgccaccgcactccagcctgggcaacggcgagacttggtctcaaaaaaaaacacacacacaaaactaccaccacctaccccaatcggttaccctttacttttcatgtgaccaccatgacctattatgtgttttgttcttacttcccccacaagaatgtaagcgcttcaagtttattccttaatgttggaaaaatgaatgaaactgcaaatgtagtagatcagtttttggggaggtaccaaagacaagttggtaaaataccttgattttgaagtgaaaaacgatgttacatttcaaagtatcttttcgccaggttatggctcaggcttcgagaccagcctggccaacatggcaaaacccggtctctactgaaaaaaagcgaaaattagccgggtgtggtagtgtgggcctgtagtcccagctactctgaaccctggaggtggaggttgcagtgaaccaagatcgtgccacctcactccagcctgggcctcctaggctcaagtgattgttgtgcctcaactacctgagtagctgggatgacaggtgtgtgccaccactcccagctaatttttttttctgtatttttagtagagatggagtttcaccatgtcagccaggctagtcttgaactcctggcctcaagtgatccaactgccctgccctcccaaagtgctgggattacaggtgtgagccactgcatccagccaagttctattctttttttttttttttttgagacggagtttcgctcgtgttgcccaggctggaatgtagcggcgcaatcttggctcactgcaacctccacctcccaggttcaagcgattctcctgcctcagccttccaagtagctgggattacaggcgtgggccaccatgcctggctatttttgtatttttagtagagagggggtttcaccacgttggccaggctggtctcgaactcctgacctcgtgatctgcccacctagcctcccaaagtgctgggattacaggcgtgagccaccgcatccagcttcttgttctctcttttatatataagtgccatttgctgaatcagaaaactttttgacaagcatattaaaagatttcagttgtatgtagtagctcatgcctgtaatcccaacactttgggaaaccaaggtggggggattgcttgagtccaggagttcaagaccggcctgggcaacatagtgagaccctgtgtctacaattaaaaaaaaaaagaaaaaaaaagtgagccgggcatgatggtgcatgcctgtagtcccaaccactcatgagactgaggtgggacgatcgcttgagcccaggaggttgaggatgcagtgagctgtgtcacaccactggattccagcctgggtgacagggtgagatgttgtctcaaataaaatattaaaaattggatcaccttattcagcattctgttgtttagcagttttggaattttagttgttagtaaatcttgaccttgagtacacgttattttgatattctgtgtgacaaaatgggaagtatgcatgaagcacatctgccataaagtatggatgtctagatttttttttccctagaaaaagtagttacaattgtttgagatacaagctgaactagctgcttgttttcacagaacatttttagtttgaaaaaacctgacaaattgattattcatattttaggggtaattttggcagagatttgctcaaaaaagaacaagtcagcttggaaaaaactgatggcatttgttgccaatgataaaactcaagcttccaaatgaaacctaaaattttggaaggcttgtatacacttctgtgcccttatagcttcctcagacttagacttttgtaatgggattggtggtaatattaattaatggtattttgttttagatattgtatatcaaaatgtgtcaacatttggaagatttgcataactcagtgaaccaatattttccaaatgatcaatcactggactggtgttacaaatatcacacataggtaaaagttctatttaaatacaaggtacaccaatggactttagaaaagctcatcaatacgatttcagaatccacattgcaactagcctttaaggaactctactacttgtcatattttggtgtggtatcaaagagagtatccataattatcagacaaagctattaaaatactcctcccttttccaactttatatatgagtggggtcagattttcttcacagacttcaaccaaaacagcatataacaacagataggatacagaagcagatatcagaatctagtgtcttctattaagccagaaataaaaaatatttgcagaaatataaaacaatgttactcttctattttttttttgaaaataattatttttaaaataaaaacatggctgagtgtggtggctcacgcctttgtaatcccagaactttgggaggctgaggcaggcggatcacctgaggccaggagcttgagaccagcctggtcaacatggcaaaacctcgtctctactaaaaatacaaaaattaaccaggtgtggtggagggcacctgtggtcccaactactcaggaggctgaggcaggaaaactgcctgaacccgggaggtggaggatgaagtgagccaagatcgcaccattgcactccagcctgggcaacagagtgagactctgtctcaaaataaaataaaataaaaacatgctatttgtgttaacatgtaatggg

SEQ ID NO: 2813 - DNA, 662 bp, Homo sapiens
aatcccagggtctatttcaatagattttttttcctcttgactatgcatcccagttttctgggttttaaatatgtgtcttataattttaatgaacacagtagatgatactttacagagataatatgttctgttatgctcctctgtagaattatttttgttatagaaggttgattatcttgaacttgtggtattcttatcttacttttataagaatgtcttgttttgttcgcagaaaaatctctcagttctggatcatagcatttacttctgaggtatggctgtttttgagtttcagtggaagactctgacgtttcaaataccaaggctctttacgttgttgggacccaatttgttctcctctacgttccagatgagcacaccttccagtccgtctgctgccaacaccacctacaggggtcccacagtagccattttcattgggctataaacagcataaagaggctattgtcggagagcagatgcaggaaaagtttttgccaaatggcatattctaaggtgaacaggttttcacaaatggagcattaatcacaatcctctgatactaccaattatggaagcagaccaagaataaacctgcaaatgagaagagccctttcctcccttctcaaattaagaaggcaaacatattggaaatgcaaaag

SEQ ID NO: 2814 - DNA, 2276 bp, Homo sapiens
caggattcgaggaccacacgcctcagccagccccggcaagggcctatcaggggtgggtcggggcatccgagcgggtttgacggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaacatgaattgagtttctgtagatttctagttctcaactttagcctgaacgccaacacttgaaggtgtttttcatcctctgtatgttgaaggtggttatttgtatgtaggaacaggactgccatcccagctttgcatgccaaagaaataaagaacacactttaaagggcaaactgaagagatgagcgagcaaaggtgcccttcaggtctactgaaaagttagagtacaaaacaacactgttgatctggacaaaagaagaaaaattaccctttttgcttgtgttgtgacaacttcatttaatatggtttaaagatttatgagactgtcagctaaaagtcttttcacaagaatgtcaacagagaatggcatctcaaaatatatatatttctttgcacaatttgtgaaaccttataagccattttccccaggtacaatgtagttcctgctgatagaaaggaaatattttgtcaagagctttcatttaaaagctactacctccacaatcacccccaaacccagaaaatccccactggctcttgccagtctggttttcgtattgcagttattccaattgtatttgatctccctgataacgtattttcatgggtttgggtagaagatgctaatcagattagaagcaggaatagttatttgctgtctgtgaaattgagccttttggtgcgccacgtggtgccagatcaacacttctatccctctgcactgaccacgttgtgaactgggagaccaaatgcaagccatttcatggacatagcaatatacaaccaaactctgttccttggagttatattgtaaactcttgcaggtgggagagcagttcacctccttagctctgtttgccagctcttacagggtaaaataaacctggcaatttatcctcagtcctagtttgtggtttaatgttgctatcttaagcactggcatttgggcaaaacatgactgtgttctgtgggagaatccaaaggcattattcactctagttgagatagaattgggtggctaaacagggtgtgtggtacccaaaagattaaatgttacatgtccttttagtccttgaccaggtctagccttggcagaagcaagggagccactaagccaaactccctgtgcagacagaccatgtttcaaggctggaagtagtgccctggcaacacacaaaaggaacggtgaaatgtggtagcaactgcccttgctaatcaccgtaacctcggctgagaaagaagaggaagcgaaatccaagatgcagctcagttcatcaaagcctagcaggtcccctcagctgccttttcatgcctgccacagactacagtaggacaaaacctgacctggtctttgaagttaagagctaagaaagcttcctatagtagtatctcccatggcacttaccacattctatctggtattacagttatttgtatgcaattaatcactcttagattgtatgttcctggagggcagaatatgcccattcatatttgtatcttcttccttctgctcttggcacctaacacagtgccttgcacacaaacaataaatgattgttgagtgaataagtaaacctgatt

SEQ ID NO: 2815 - DNA, 3164 bp, Homo sapiens
gttgctctcctcccttccccggtcccgcccccgtctgtctgtgtcgactgcggacgctatcgataaagttgctgttttgacaacatggcggcgcccatggtccgtggcccggcagtgctcgcctaaaggtggagaacgaggagtagaggagccgcaggccagagcctgtgagcagatccagacctacagataaaaaacattatttaatctatctgggatttactccggcttatgatttgagggccttctcaccttctgaagaatggcttctgtttggcagagattgggtttttatgcctctcttctgaaaagacagctaaatggtgggccagatgtcatcaagtgggaaaggagagtaattcccggatgtaccagaagcatctacagtgccacgggaaagtggacaaaagagtatacattgcagacaagaaaggatgttgagaaatggtggcatcaacgaataaaagaacaggcctccaaaatttcagaagctgatgtgagtattctgagagattctaagagggtagagaagaggggttgaaggtttggaccctggggttagactacctggttcaaataagatattaaatatgtgaccttgaaccaaattgttgaatttctctgtgcttcaattctcttatctgagatggagagtgatcataatagtgcccacctgcactattgggaggggtaaatggattgggaggcataaatgaggtgatacaaaggtagtgtttacaagagtttccaatgtggtggatgcacacatagtaatattgcgcacgaggtgtatgacagacagcagcaaaccaggtgttctagagcaacatttactggggaagctcatcaaaataggagctctaccagatgatgggtcctttgtggtccattgcatggtggggcagcacacagggatctggcagggtcatatctgagactccaggagaggcacctgggctcctcgctggctacatgttctgagaagtaactgccccttccctggcaatcgtagcctccaactctgttctgctgccttagcatcatggtttggggcacaccagccctttcactgttgtgaactggggtagggtctaaccttgaggtagcagctacatgagttagtggacccttggcttctgcaccaggtacaccagctcggcactctacctgaattaatggtggaagcataatacttggctgcagccagtttccacagagtgctctctgttccttttctgggaggccagcttgctgggaatcagtctggaacgtgttaacccttacctcttgatactggtcaaaatgacagctgggagatgtgattgttacatgaaatgtttgaatctgattggagttttaaattctgatcatctctttgtagtagttatagtcaaataatacaaaccctctatgtttaataaagagattaggcccaaggcaagcagctgaataagtacagctgcacaagaccacacctctctagacttgccttttccccatctcctgattcggtcaacacattcattctttctgtgagattggtggttatgaaaaatgagtaaggggaggagagctatttgtgttaaactgaaagatgattttgggcaatggttagaaagaaaaattgctattgaaaaagatgtagtgtgtaacaagtaaaatgaaatgaaaaaaagggaaggtttgaatgtaatacataattttacaatgaaagcttgacttctaccttgttaggaagtgaaaagcccttgtgtcaacatcatcagactaatgtaacttaatagattttgaaaacaaactcttaaggagcagtttaattctgagtgaggacagtaaaattagcttttttttcccttttggtttagataatcatttattgacttccaaatgttttgatgttgtagcttactgattttgtgacatctcattcttcttaagcatacagttttttaaaatatcaaatggatcaaaataaattgttttagcaattggggagatagcataaggggcattgtgtgtgatcccctggcagccccctatcagggtttgaatcaaggaatggcaaagcagagtgagcactcagtgagtgagccagagcctgggctgcaatgctggctctgccccaggaaacctgtgtgatccaggccacatcatttaatgttttggattctgggctccttgcattgtttatctcacagaattgttttgaaaatcaaatgagaaaatgtgtgacaaaatgcattttacaaactgaagtggtacataaataaaagatacacaaagatcagaacgtggtgtgtctatcaggacctgagactatgacggaatgctcatggattttgaagcatttataatcgatctcactctggtatcagattcacttgaaatccactcacataagttttttgaaatggaatgtcttgaaatcaccatatttatcatttaaaaaataatttgcatttaatgagcatttaaccatgtgccaggcactgtctttcaattgattatctcatttaatcctgaaacaacccagcgggtaggtattattatcctcatttttggagtaagaaaactgaggctcagaaaaaggtttaggtaatttgccaagacatggcagagccaggattcaaaatcaaatgtgtgtttgattcctgagctcatgcttttccacacagaaaccttcttttgtctcacctttgatttacagttagcaaactgatcccagaaggcaaaagaatttgcccaaggcctcacagctagtgacaaagctaggaccagaactggggctccggattcctattgaggtgctccttttactctgtcaccctctaggctcagccacagcttcagagcgtgatctataaagaggcagaagtcatctttcttctaaagtcagaagctgacaaaaataataggacccacttataaaagccatcctttccctatcatttaaatcttaatctcttttaaaggcttaaattcttatacttttatataattatgaaaatttccctttcaatcagattcttgctcaattataacagaaactcccatcattccttctctcttttccacccccagatgatagaactcatttcattgtcacagaggaaaatgacttaattcatgcagaaaagcaaaaggcagggacaggcaataagctg

SEQ ID NO: 2816 - DNA, 5153 bp, Homo sapiens
gcccagggtagactgtatttccaggtccctcagatgcagtgcaagaggggcatatgcctcggagactatgttccccaagcagctttgtgagccttgggagaccagctcaggatgaagccttgtcttctgttatccattgctgcctatctaaatgtgaagaataaaaagttcagaagccatttgtattcaaatagaatgcaattaaaaagtcccaggcaagcattataagctcataaacaagagagctagcaagaagaaaaaaatcaagaagcaaatcttgaagcaagttataacctgccagatgtgacaaaggtgatagaaaatcagaaaagaacaaaaaaagttatgaccgttaattagcatatggaaaaagataatcagaggcccccaaggaagctggattattaaaaatgcgacctccatttcaacaaagaaattccaggcagtgacacggttttgaatttataatgaggattgatgaatagaagagaattggatatttcaagaaacaaagaaatacatgagttgaagctacagttaacaaaaaaaaggtactggaggaaaagttttctaccaaagacagaatatatcactctactcttatactcttctttgtgtttctacaaccacttcgattcttcttttctgtattgtcagatccctgctaaatgtttctccagaaggtgctggttttttctggtcatcggggcactgccatcttctgtaatcgcacctcttcgaaaaatatactatttttaccaagagtaaaaatagtattcacttatccatggggaatacattccaagatccccattgaatgcctgaaactgtagatagtgcagaaccctatatataccatgtttttttcctatacatatatacctatgatgatgtttaatttataatgggcatagtaagagattaacaacaataactaaaaataaaataggataattataataatatactataatatgtgactatagtctctctctcaaaatgtcttactgtatgtaatattttcagaatgtggttgaccacaggtaactgaaaccaaagaaggtgaaacgaaggatgaagggtgctactgtacaagcaaagaaatcccctatggatattcattactgagatacttctgactgatctcatccatagtttgcaattatcttgatcgaggtctaatgattactgttaccataacactgaaacaaggctataaagcaaagtatcctttgaccaaaattgatcaaataaacatcagcaatacaaactgttcctaatgataaaaatagttactatttattgagtacctcgtataggcagacttagcacccctaatgtctgatttaattcttacaacaaacctgtgagttttgtatgatgatctttattttaaagatggggaaactgcagttcagaggggtttgataacttactcaagatcttctagctgataagggcagaactggacctgacccaagttcttctcacaccaaatcaaacacaggtaacatgacacaatgttcctataatttgtgagtccctttacagctttaagtgctttcatatgagcaagggcaacttccaaaatctgaagacactttgatcaaagttgctatggcaagagattcagaaaacaaagagagtaaaaatcttaagatttagattctaaagttggtgaataaaatgaaagtagacaaaattaattcttagcgcttgtgagagattaagcacagtctgccaatctctttgattacaactaaaaactagacagaatatataaagcaactatctgagaactttgaagagtaatagtaggcatattgaggagggaaataaaagcttgaagatcatgactgatacaggagcaagtttcccattattttaattttaatttttattttaaaaaagtagagatgagggtctcactttgttaccgaagctgttttcgaacttcaagcaatcctcccacctcaacatcccaaagtgctgggatttcaggcatgagccaccatgcccaccgcccacccctcctgctcccccacctttaaaaaaactctgccatatcttccggtttatactcaagagcagcctgaatgctggaagtctgcagcagttgtgaatagaaaaagctccaagaaaaacgcttactttttggacagaggaaataaagcaggaagtgggtttcttacaggacaaattgttcagtagaaatacctcctctcttcattttctctctttttattctctgagtcctgctttgaggcaagccccagtcatgaagctgacttctgcagtagcggccgaggccgtaaaggcacctaactctctgaaagactttttctccgatcagtggaccctgtggtcttgttgccctgcccttaaggtgaactcagtccttgatgtgtgtaacagtgcagggaggataaaaacccagtttttaagttatagtactgggaaaagggactctgggttctggaaagtgtgggggaaatatcacagaaagaaaggaattgacaaagaaatcccttgaatctgtgtatcaaatcttaaactcaccactgagttgcacatgcataaaacagatctgaagcagcacagcaaaggcttggagaactgaactacgtgtagaatgcctcctatatcctatacctgggtggtgctcccatggtgcagacccaaatatcaaagcaaatgttttgaaaaataaaaactgacattgaaacagaaacatgcaaaaggtggatgagaacttgcactccaacctaatcagattgattacaaaaataaaaatagacattttccagagcatttaaactagagtcagagactcaaaacaaaatttaaaatgtctaggatataatctgaaattactcaacatacaaagaaccagaaaaatctcagtaattctcacaagaaagtaagaatcaacagattgcaaccccagatgatccagatgttggaattatcagacaaagactttaaagcaattataatagctatgttccatgaagtaagggcacatactcttgaaatgaagggaaagatacaagttttcagcaaataagcaaaaactaaaagaaataaccaaatgaggattttagacctcaaattacaacaactgaaaaaaaagttccctggaattattgaatagcggaatggagataccagaggagatgagaaacgtgaaaatagataaataaaaattatccaaggaaaattttaaaacattttgaacataccaaaatttgtgggatgcaaccaaggcaatgcttataggaaaatatggaacattaaatgctcatattagacaagaaggtctgaaatcaaaatatagtattataccttaagaagctagaaagagttaaacccaaagtatgtagaaagaaggaagcaataaagagcagaaatcaatgaaatttaaaacagaaaaataatggaaaaaataatcaaaaccgaaagcttgttcattgaaaagaccagtaatatccggaatgaggtgagagagagagagaggaaaaaaaaaaaaacacaagaattacaggtatcagaaacaaaaaaggagatatctcaatagatgccacagacattaaaaatacaacaagggaatacaataaacaactatgctgataaatttaagactttagattaaatagaccaattatttgaaatacacaagttgctaaagtttatacaaaaagaaatggaaaacttgagtacttttatccgtatccaagaaacagaatttatagttaaaaaccttccagcagggagaatttcaaacctaagtgtctttacttgtgagttctaccaaatacataaggaggaaataatgccagttttacatgatctctactcatcttacaagaccaacataacttgcatgcaaaattagggaaatagaatagaagaataaaaagaaggaggaagaaaaggaagaggagtgtttatatgaaacataaagtaattagaatagctaaaataattttttaaagagaagaaaaatgttggaggatgcaaaatacctgattttaagacttcctgtaaagccacagtagtcaagagagtatgatattggtgaaagaatagaaaaatacatcaatggaacatttcaataaccctcataaacatagcaacacaggcacaaaaacctccagtaaaatattaatggtgcaaatccagctatatattaaaagtatattactaccaaagggaagagggttatcccagaaatgtaaggctggttcaacattctaaaatcaatcaatgtaacttaccttattatgttttattttcagaaatcattcattagtttgtttgataaatatttttgagcacctactgtatgtctggtatagttgtaggtccttgggaatcatcagtaaaatgcattaatacatgactttaattctgcagcatttagaaaaaaaactctctgatgtttgatgggtttttaaaatatatatacatatatttttattatactttaagttctagggtacatgtgcataatgtgtaggtttgttacgtatgtatatatgtgccatgtcggtgtgctacacccattgactcatcatttacattaggtatatctccgaatgccatctctcccctctaccccccctacaacaggccctgatgtgcgatgttccccttcctgtgtccaagtgttctcattgttcaattcccacctatgagtgagaacatgtggtgtctggttttttgtccttgtgatagtttgctgagaatgatggttttcagcttcatccatgtccctacaaaggacatgaactcatccttttttacgcctgcatagtattccatggtgtatatgtgccacattttcttaatccagtctatcattgtttgacatttgggttggttccaagtctttgctattgttagtagtgccacaataaacatacgtgtgcatgtgtcttcatagcagcatgatttattttcctttgggtatatacccagtaatgggaaggctgggtcaaatggtatttctagttctagatccctgagggattgccacactgacttccacagtggttgaactagtttacagtcccaccaacagtgtaaaagtgttcctatttctccatatcctctctagcacctgttgtttcctgactttttaatgattgcca

SEQ ID NO: 2817 - DNA, 13575 bp, Homo sapiens
ttcttcttgtccaaatgaagttattacaatgaataattttaatacaactctctttctccaaaaatgttcagcgttctcatcctgcttaaccatcagctggaaataaagcttggagatatttcacggttgtaaccacagtggtgaaaaggtgggagacttttaggaagacatcaaatgcctttttatatttcacacaacctcctgggaggtggaggctaggagtctctggcaaaactaattcattatctgtaaacctgttttttatgccaacctagacctcacagaggaccaggacagaatgctatctgaattatgctgtctctctggggcactgctgtctcttcatctttgatgttctgtgccacatgctcatttttctgggccatttgcccatgtactttgttctggataggtttgcttttttaaatttcacatgtaaacttgagaagaaaggaacttgggagtttttcatgattggcaaagcaatgagctctgcagctatccatggaagattatggcgatggatgaaaccagcattctggaggtcatctccagcaacaaaaaatgactagaactttcttatctctgttaagaattttattgatgataacttttagtaacttgaggaaaccttagcgtattcgtctttactatggcatttttcacaaacgtagaaagctgctaatgttaattttaatgtaatttttaagttagcatacaaattacatccctcttgacttactgcccatatagctggagtcattcaaaaagtcagaaatatcagcctctttgcagtggtttcctttagcttttcaggaatatagatgtcgaacaattagtaaaattctcaaatgacagacactttttttcctcactctgagttatatgtgtttgctgatgtgaacagatggactcggtgattgggtgagacttctttagctctgccttctgggtgtcactcattgtcatcactcgtggttagggaaggacttcccttcacattctgttatactctgattccctgtaaaacctaaagattatttctaaaagtcattggttcaactcaccagatttctcattggttctcagagggtgtattcacttagcctataaacccaccactgccatctaatcatgcaatttcttcatctctaaatgtatttgctcacaattctctgtataacacaaagtaaagaaataatggaaaataatattctgcttctaatgctgctgcctgcttagatgtatttcatttcttctaagaccctatcatattggctagtaattatttcctgactcttattttctgctttattttctattcaacctctcaacctctccttcatgagctgctggtaactgagtttgattcattgctcaacaagaattttcattgttcccaatcatctttgtagatgtggttacttcaaaagcgtgtgcttaaaaatatgaagtatatgattatcgagatgtggaaaaattcataataccttatttgtaccattcttagtgagaactgcagctaatattccttgactccttaccatgtcccaatgcccgggccatgtgtgtgctctgtttgtgtatgcacatgaatgggtacatgtgcatgtgtgtcttcaagtgcatgtgcatgaatgagatctcatgtaattcttaaaacagctctatgaattttgggtatactcactatcttccttttacagatgaggatacaaaaattcagagtgattaagtaatttccccaacatcacatacctggtaagcagcagaactcaaaatcacattgggtagctacccaagtcttgcttttgatgccagcattgctcccttactgtacttttctttttgacttatggcatagttatttgaggatgggttttgctcactgcagcagattaaagatgctgtaagttctttgacatcttcccatcaagagttgagttctatttccccttttctatactctggacttgcctgagactactttgataatagagtgtaatataaataatggcggggcattctgagccttgccctaaaaaggactggcagcttccactttgatctctaggaactctgagccagtgtgtaagaagtccacataccctggggctattctacagagaggaagcttaaaccagccacttggaaaggcgaaagagagatagagaagacggtccagccagtcccacctgttccagccctcagtcgttctaactctccaactgtacaagccattttagctcaggccacaaacttcattgagcagaagctagcttattcttactatggattgtcctaattcttgactagtggaatcatgaaatacaatgataataaattgttgtgtcaagccattaagctttttagttgcttgttactgaggaggagataaccaaaacatccacgtttgtgaatgatatattctttgaaaacagagatgatgtctcattcatctttatatttctagcatttgtgtcactggaggtcaattaattttagatgattgaatgaataaatggatgagtggaattaagctattgggaagacaagcacacaaatctcatggagcttctgttccagagggagggagggggagacaggtaataaagacataaataaacattctcaggaggtggtgagtactatgattggaaaataaggcagtgtaagaggacatttttgcagagactggatgagggaattgagtgagccttttagtacctacaggccacatggactttgactttcatgcttaaaaacaaagaatctggcttctatgttctctatgtccatatacccctgagttttgtgatggctgcatcacatctcagggtctgaaaagaggttggtgccagggcagaaagcgtgggcagaaaaagcattggttatgatatcactcaacaaaaaccacccctggaatatgctgcattctctcttccaaatccttgcaagtatagtcccctctgtgtgaaatgttctttacaactgcaagccctttcatcgttttcttgtcaagttaaaatgttccattctcagacagataaatttcttcctctactgtgttacagatctttgtattaatagtacttttttcaaatgcttgctcatcctctctaatataaaagctattgttatatagctttcccccagctatttgtgaaataaatgagagtaaagtatctgtgtcttcccatcatctccactatagctcttagtacagtgtattgcagtagaagatgcttgttacattcaaaacaagaaacagagggaagagataaggaaggaaagggccatgcctccttaactttactcatgtaagaaacacctggcacataaaatatattcggtaaataatgaatgaatgaatacatgaatgaattaattcgtgggtaacttggtactattttcagtatttttggtcataggttcattttctctcctattaaattcctaaaggcaaatatatttttttccagtagttgagtagtcctcattgatgatctgggcatcacactttttgtaatgtacataaggaaccaaattacctggtattgtaaaaattggtcaccagagcatgtcctcaagttctgcacatttaattaaactaatgtcgtaatggtaaccagattctcacagtgtgaaagctccttctgggaagtaacttaggaatttttagacgctaatgttcgttctctctctttctctctatcagaacataacctataactatttaagttcaccaactgaaatattaatgagctaaaaatgctaatttttaatactgaaattgcccaatttatatctagaaaacaatttatgcagtaagatgccttaatgtgatacaggcacacacacccaccacccccctccacacacacacacatgtgcgcgcgcacacacacacacacacattttaactattttgctataatccaaatgaataatttgcaaaaatacatttcccccatacatacctgtggactctttaatggtagctgaacttaaaactttctttctcgtgtaagtttttggaaggatattgattaattaggatgtaatgacattaactatgccactcttgtttcagtagcaatttcaattaatagtgtgagatgtagaatatgtaaaaaaggagtcagatatattgtctttgcattaaaatgacaatggattctgtttatatcattccattatgtcagacagtactgaatggtttagatgtattaatagacaccccaaatgttacctctcccttttaaatatcataactggcagaagtacaaatgttagtgaaggtacaaaactatttcctgattgaatgggagaaaatgaccttgaatgagtcgacacagttaaggaaattaattattctaattcactacatttgaagaattaagtcagagactttaaactgggacattagaatgaatgaccatatcatttgctatataaatatcaggaatagaaagcttgtttgttatttgctgtttgtttaattggttggttcctggctgtaaagggaacattgggctcatcctaattgattaagtaccttgtttctccatattctttaattttggattcaaggcttgtatgtaatctgtttgatggttttatttgcttttttctgtaatgcaactttgctgactaggaattggtttactctttcatgtctgacggctctaataaattgaggagcttaggcagacagctcttttatccaagggcccttactgggctggtgatactgctgaaacctgcctagcctcaaaaaatgctcagagagggataagagtcctgtagggaggaagaaacaggggaatttttttgcagtgacctcaaaatagagacagagagacagagacagagagagagagagagaggacaaatcactcacatggaagtctgtcaaaatgagaatgagagtaggctggttctgctttggctgatgaaaggatggtgaattgaaaaaatgatcaaaagtgacattgtgggccaactaagaaatatcaaaggagaccgtactgccgatcagtcatggaattcaccatctgctagggagcagctgcacaaacatttgctgagtgattatatagaaactgtagtggttggtgggatagatgcagccataatgaacgctcactgggttctgtctgtctcttgctttgctccttgtctttccttttgccttttcccttgcccttgaccttctctttcttttcacaaagacagagctatgtcagggacattctgggagatacaaagatgcatgagacataattcctgccttcagggaagtctcaatctgatggaagcgacagaagtagaatgggcaatgtttacctgtattttttgttttgcttgaaaacagattctgataaaattgcaggaaatcaatggggttgggggaagtctagttacattaattaatgagatgtgcattttattactgtcaaagggcatccattttatctgatttcctctattttgggagtgccagttgattaaaagctttactaattatgttccaagtggatggtatctttctctttctgagaaatttaatctacattcctgtctttgcctgtcttagtcacacatatcaacttaggattctgacttacaaatctgacatgaatatggcgacatgcagtgtgttcttcgggattcatctttaatattttcaagatccacatcagttgaaggatctgagctgatgaaaagatgactttcagctttctggaggaactcaagagggactggggagtttattttgtccttggatgaaagagaaagggttttgttgtggggataaagcgaaggcactttccatggtgagctgacatcttggtgttttttttgtttttgctttattttctggctgcctcgagcaactcatcgtcagaggagccatcagtgcctttggtcttttatgtacaaaaacacaccaaccagtggaggaatatggtgtttgtgatcagtgcttatgggtagtggtgacttttgatagttttgggtttttagtgctagcaagctacctgagtgtcagtgaagagtggccccagtgatactgtggcacagacacagttcataataaatgctctctctatgcctggaaggcccttctccactttttccaaatacatacatcatcctggcctcatggactttcacctgcctagaatccattcctcctcttcctgtaccaccatcttgatattttggagagcctcttttccctcaagctgaatctgtgggaaacggtgtagtatagtgttgaactggatggtgtctagagccagagttcctgggtttgaacccagtacacacactcatcatcagtattggatatactctgttctttgtattgatctttctgtatctgtcctcaattgactgagctccttgggagctcctctagttgtcatttccatatggacaacttcagctgctagcgcagagcctggaacatgataggagctcataggattaaatgaaggaacccctgtcgtggataatgacaggacttgctgtggaacactggcatggcattttgcctattccacctgtatgtccatcaacattgatataaaaaaagttttcttctgaagttagagaacaatgtctccttccacctaaaaaataaccctatcactttccaaggtgcctttttcttgtaatttttttcaaatgtgctatgcatggtgtccagatcattgaatgagtggagtgtttaaagtagttcaatcctttggaaattgtcaatagacttgaaactttggtgatattgccttattatcactaatttaatggttttttggtgtgtgcagataaggtctttttgacaaattgaaaacatgtgaacccatatacttcatgtattttggcagatgcatttgtgatgaggacttcttgaagataatagcctaacttttataattatttctctatggtaaataatattattttaaagaagaattgttttcttcccctattaagtgctacatgtcaaagaagtaggaggatggaacaaatttgaatatgaatttctcctgcagtagaaaagttaacatgtagctcactgaaaactgtcttggtcaaataaatgaatattgactttggggaaaaaagaaaagtgaaggagaaagaaatgtagaaaaaagtataattcattcttttaacgtggcgggttatatgctttagcgtgcatctttttgttgttgtttgtaggccttgatgtattgatgtcttacatcatagatgctaaatcacctctcagtgcatttttaagtgcttaaggcagagttgttcaagtaatagagaaaaagtgctagctcatgtggtctgaatcttgatttccgggtgacaattttcttcttactcctcccatttacatttttgtacgaattgggacatgctcctaataattccttcttctctgacttcagtcactatttccttttgcatttccataggctaaatatccaagctctaagactggaagagttttagttataatataatggatagaaacatccattattataatataatggataaaaacatccattattataatataatggagagaaacatccattatattataactgagataaaatattattactgttatttaacagttgattgttagcatgcattgatcgatatttaataaattaaaaattcagagcccacccttctcatttagcttcttacagaggaaaatcatttcaggctctttagtcttggtacaactgtgctataagaaagcaatttcagtagaaaaaatggatttggatcacagtttcttgatgggttttgtagaatttgtcagttagaaaaaaaaaatggccttactgaaaatgtgtttgcttctctgcttacaccttctaactcagttctgatgctatttgaacaattgttgacatgcctctttacctttcaatagttaggagtaaaaacatttattctcaattttgttttgctcttgcgcctttaaaagttgattaaaagtcgccaggttgctcagagttctaagtgaatagacattgtcattagctctttgataatgttctctgtgttctataaaccaagtaatcaggtttcgcgtgtacttgtgtcaacgttcccagagggattgctaatgaaaacaaaaaggcaatatatgtcattatagtaaaccatcattttgcttaaaataatttcaaaatgagtattttagcccatgtactacatttctgaccttagtttccccaggttcttctctgtcattatttcagctattacaagtcagggtgaattaaccaaggttatgactacaccaacattttaattatctggctttgttgatggcttgttgaaattgctttcatgtggcagattgaaacacagcaaatttatagtagggatggttacccagcattcaaagccttcttcatgtacacttcttttcataggaagagtatttttttaacatttagaaaatatactctatttaaccttattttttaaaaaatcttgcacaacagaaacattattgtttagagaccctagaggtttatggcattataacatagactgtaaattaggattcgttaatcaaggcacaacttcagttgtcaggggctgttctgtgctttttagggtgggtagcagcatctctggtttttactcactagatgccagaagcacctttttttccaccagttgtgacaactagaaatgtctccagactttgccaaatgtcccccaggggaaattattactgggggttgagaaccacagctcttaattgttatttcatataggttttattattttgccccatttatgttaccctttggcatgtttctatgacataggtagtcaaattttagctaattttcccctaagaagctttttttcgtggatgtaaaaataaattttaatttctatggaaaatttgcctcgtatcacagcttcctatatctgatttaaattctcttgattacaggtagattatgctgattcaacttgttggaccaaatgtttctgctattaagaacaaaacaataaattatttctagaaggcttattaactataactcgtggtagtgatgttttagtggttgctttagaatgtatagcgcgtgtatatacagtgtaagtatatatgtatatgtaagctatttcaattacttcagtctattgtctgtgtttcattttgaatagtttgtgttgctaccttttcaagttcattaatagtttattctacaacatttaatcttacattaatctcatgcattatattttttattttcaacattttgatatccatctctacaagcttgtttgggtatggtggatagattcatgatgttaatggtggtgatggtttcatgtatacatacatatatcaagacctatcaaattgtactgattaagcatctgaagttatgtcaattatcactcagaaaacttgttttaaataacataattttgaaggaatctgtgcagaagccctctaaatttatatcatcttttgtagttgtcatattcacatcaaattcaaggatattggctttataaactcatctttattgagtctttacaaaatatccaacttagttttcagcaaatcaactttttttcactgtcaaaatacattgtttaatgtaatataattaagttatctaattaagaaagcaaatgaaagtggtgtatggtgtttttggaacaaacacaatcaatgtgtgataaaaatcccagcttctcattggaggagaagttctgggtcgattagaacctgattcaaggtgtcatctgcaggccagcagcatcagtatcacctgggagcttcttagaatctctgaccctgctacggattaactgaatcaggttccctaggtgagtcctatgcacattaaagtttgagaaatgttttctttgggaatagcctactagctttgagaattgaatgtgttatggttcttaggcaatgcaggtttttttttttctctctcatggaaatagagttattcagtttcaagcatcagttaaatagggcattgtttacatattttctactgttataatttttattttttcatatcaggttttcttttcttttcttttcctttttgaaactgggtcttgttttgctgcccaggctggagtgcagtggcatgatcatggctcactgcagccgtaacccccagactcaggcaatccttccaccttagcctcctgaggactacaggcatgtgccaccatgcctggctaatttttattattattattattgttatttgtagagatgaggtctcactatggtgtctaggctggtctcaaactcctgggctcaagtgattctcccaccttggcctcccaaagtgctgggattacaggcatgagccactgtgcttggctcatatcaggctttcttgaggtatgatttacacacattaaaattgaccaattttatgtgtacaagacaatgagttttgataaatatatagaatcctgtaactatgacttttacagccaggatacaaaatatttctgtttcttcaaaatattccctttggcccctttgcagtcaatcttttcctctaatccttggcccttgctagaatttcatataaatggaattacctagtatttcatcacttttttgttgttgtttttgttttttcacttagcacttgcttttgagattcatccatgctgtcatcaacagtttatgtcttttatggatgcatagcattccattgtatagatgtaccttatagttggtggtggaaggcaggcctgagactagtgttcagggagcctagaaatactcaaatgaccttatgtggtacagaggctgccatggctgtggccttaaaaattggtgaagaagttggaaacatggattctagtggttgaatccttaccctccaaatccaggtgatagtcacacttcagaaaagggtgctgaccagcccatccaccctatcacagacatttcctgacaatccagacatttccccgaaaatttgcaaatcttcttgtcctttctatcaggacatctctagaggcacagcccctctcctgctgtaaatacagtgctctttggagaggaaaatgtggaggcagagagagaacaatttacttgaattgctgaatatttgcccagtggtcttcaaatgttattgcctatgggcaaaaccgttgtttttcttctcccttctacctgtaggtagagatacctgaggaagatcaggccaatgactcagaacatcacacaagataaattttggcatgatttgtttctaatagaatttattttggaaggttacctgaaaactccaaatggtcatttcctgcttttaactgacaatcctgacatttaaacttttttaacctattggtatattttatcattttagaaaggttgcatcttgtttttatcattaattttagttgggaaactgagtcaaacctcaagtcagatttgactaaagttttacttatagttacttttcctaaatattctccagtagtgattagaattagccactggacaaccatatcagaactaggagcttgatactaaaacaagaaggatgaaaataatcaaagaggatttgcaaatgattaaggtactgaatttcaggtgtgcctctggaaaattaattccctctttttgcaagctgttgcatctcattttaccaggtaccttgcaaagtattcttgatgagatgcgtgcttcgtgggaatcactctttcccctgtgtttgggtatgcttacttgcaggctctcaagagattcacttaagattttcaacatttctgcattagatatttttaaagagaaaaataaaatccagggaatatagcttttgaagtggaaaatctgaaacaaaaacaatttgataactgtcacagacaaagctgctagagctctaaagtataatgcaaggtttttataaactccaagttgtaggttactctttggcatataataaatgagttctgagcctagaagtggtttaatctgaaaacttcatttgaggaaaaagcagagaattggaaggtattgaatagcgtgcgtgcacacacacacatatttttcattgtatatccacacatgcatatatagctcatttatcacttgttcaacaaatattcaccgaattcctacaacgtgccaagcctagtgtctgccctttattgcctgccccacggtttagtgggggaaaacttaagtaattaaaacaagtattatgattaggctagtggctggtagcacagaagcatgtatcaggaggaaatagtttcattttggggccaaagacccctctgaagaaatgatgtttcactatattattattgcacaatgtcttcatcttatttaacttccagcaccttgcagagctatgcagagagcagttcagggtgctgttttttgttcttgtggcatagaagttgcccatcctgactggacacggtggctcactcctgtaatcccagtactttgggaggccgaggcgggcggatcacaaggtcacggtactaaaaaaagaaagagatcgagaccatcttggctaacatggtgaaaccccgtctcaactaaaaatacaaaaattagctgggtatggtggcatgcgcctgtagtcccagctactcaggaggttgaggcaggagaatctcttgaacccagaaggtggaggttgcagtgagccaagattgtgccactgcactccagcctgggcgacagagcaaaactctgttaaaaaaataaataaataaaaaagaaagaaaaagaagttgcccatcctctctatctgtgtcttggcctttctggcttatttgaaattccgtggggaaaagatctgagaactagaagattttaccgggagtgaggagggatcataatattgaagccatatacggaacattcactttctgccagccatcttgttttgtgctttacagaagagtcccatcctattacattttatgtactagctgctctcccccatcctctcttaggagaaggagatagagagaaagaagaatgtaagcagcgtgggtgatgctgctagctgttcttctcagtgaaccttggtcccagagagatatatctcaggagacttgacacatgtctcgtggcactttcacagtttgagcatcttgctgagaacaactgtgtatgatttctaggatgcaaatggtgttttcaccctatgtaagccttcactttattttttatttttgagacaatatttatagttactttttctaaatattttcctaaatatttaatatttatagatacttttcctaaatattatcctgtagtaattataattagccactggatagccatatcagaattaggatttcggtactaaaaaaggaagatgaaaataatcaaagggttacctaggctagagtgcagtggcatgatcatagctcactgcagccttgaactaaggctcaagaaatcctcctgcctcagcctcctaagtagctcagactacagacatgcaccgctacacctggctagttttttattttattttatttttttgtagagac

SEQ ID NO: 2818 - DNA, 5757 bp, Homo sapiens
agacattggagaggagccaggagcggctgtgtggtcggaggagagaggagagctggtgaggagtgagccaggctgggggtcacagggccaggacgtagccgtgggaggggctgccgggccactgttgagtgttgactgaagtagggcctgggacgaagaggaaccagagggggctgttgagggccacttgggtgggtgacagagggagctgggagaagggcgcaagttgatggtgagagaagagtgtgcacagagttgggtatccgcaagtgtggaggggctggcaagaggctgagcttgggggtcaccttccccagctcccagggcccgggagtatgaaggtagagctggttctctgaggtgttgtcctcacacagagttggggtgggtgacagggtgactggccatccagtggggacaccacagccctcatgaggggctgtggagtcctggggtgggtgagaatctgccccatctcaggtcagttgagtggggctctgggagaagccctggggagtggctggtgggacccaaaggccttctggcaccccgctggctctgggctcccagggccaacgctccctccctactcatagtagcctggcctttccagagccccctccagcagggctccccacagcaggtcccctcaggctgcttgggctggtgggtctgccctgagctggcccctgactctcttacatgttccacaggacgatggaccgccggactcttttctgcagcacacgcctgtgtgctgtgagccccccactctgccgtgctcacacagacacacccagctgcacacatgaggcatcccacatgacacgggctgacacagtctcatatccccaccccttcccacggcgtgtcccacggccagacacatgcacacacatcacaccctcaaacacccagctcagccacacacaactaccctccaaaccaccacagtctctgtcacacccccactaccgctgccacgccctctgaatcatgcagggaagggtctgcccctgccctggcacacacaggcacccattccctccccctgctgacatgtgtatgcgtatgcatacacaccacacacacacacatgcacaagtcatgtgcgaacagccctccaaagcctatgccacagacagctcttgccccagccagactaggagacacctttgttcttcaggcctgtgggggaagttccgggtgcctttattttttattcttttctaaggaaaaaaatgataaaaatctcaaagctgatttttcttgttatagaaaaactaatataaaagcattatccctatccctgcagcctgtggctatgtctgtgcttgcttcctgccaggtgctggcctggtgccgggtggagggggcaggatacaagcccctcagcgccctggccagaacagcagacatcagtggaaagtccagttctcggggcccgcagagtagctgcacaggcaggcatcctgggagaacagggcatagcctcaggcgagggggcctgaggtgtgtgcagatggcccactcgggaatagtaggtgaggcctgaaccagcacacgcggcctgtgagcttgctgtgcattcccagaggtggagcatccaagcaaaggacctcatgggctttgggcctgttaagggctcacctggagggtcatgggtcacctttgcactgacagggtgttactagtgggttctagaggagagcaggggactggaggcaggcctgggagctggagcagagccgacttgggggcccaggtctccgcagacctttccaggaaagagctaacagatgcacccagtgtgcttcccaccccagtgggagagctgccaccgggaggtggtacccagctctgagctaagaagagcctctgatgggcagagctgccccactgtgggttgagatgctcgggaagtggtgacctccctgctgctggaggtgtgtaaggatgctcctgccaagtccactaaagagcagactcctgccttgtgctgggacagactcgattgctcaaggggtcttagagatgtgacacctagaaggggctgctaagcttgtctgcatgaaggtgggatgaccgattgcatgacatctgacctctcccaggtgaggaggcctcagggaaggaaggatgctctcgtggaggcctgcagcccccagccctgcagtgggaggaggtgtcctggggtcgtgctcttcccagactcctcacactccacccctgggaggagggtggaaggagttcaggaatggggcagtgggagcaggtgccctcttgacgctgagtgacctgggggaggcctgtcccctccctgggccttagtgtcttcaagggcatcatggtgcaagcccctccagaccccagagctgtatcttctccccaaggcatatctggaacaggctgtgttgccagggcccttctgtgtgccctgcaggcctcctggaggcagcctggggtgtgagaatgagggagaccatctggaaatgtccctgggcacgcccctgtctaaagcaaagcattcaccacggggagccagactgggaaggaaatctgtttcttctttggggactgatctcaaggccctgcctgcagagcagagcctagaccatggcagagaggtctgtccacactggacgatgcccagctgccctgtggttattgagacaggctcctgggtaggctagcttatactctgtcttctgcatgtgacagctcagataggactgtccttactgcagccaccaggacaggcttctctgcactctggctgcccatacaggcctgtccacacactggcagcctagacagacctgtctacactccagccaaatggacaagcctgttagattctggccacctgcataggcccgcccatatcctggctgcccagacaggcccgtctgcactctggccgcctgtattaattagcccagtagctaatatcatatttgctggctagcataaggtgttgaagcccacaagaagtgaaaaacaaaatacctttatttagttaacactgaatttgcaaacacagaaaggaatagaaaacctgactccacttggacgcacaggcctttggggagttctgacaccagggccccatcggcagctccaccagagcatcctggctgcacctccttcccggagtcctggcttgcctacctattccatgggaggttggcctggatgtgtcaagggggcctttcagctctagtaaagacatctgtctccacatccaaggagctttgcaaaagacacgtggcaggacaggagactggacgcactgtggcctggggaaggcagcggggcttggccctgggctgctccccttggggagaactgtgtggctgaggccacctgttatggggtggggcctgggcctggacacagctgcaggctgccctgtcctccaagaggagaggcggggcttgaaagatttgagttagtgtcttgaccttaacgtgagaccttggacaagtgttttcagctctcagagcctcaagtctgtcatccagaaagtggggccggataacccctgcctgccgccctcaccgggctcacaccggggaaactgtcacagcggggcctcaggcaatgccgggcccatcactccctagatggggctcccccatgcagcctttcccttctctgagatacattttccgtcaagcggggttaattccagcctctcaagggtgagaagaatgtgtgatcctggcccctgccggctgctcaggagggttggagagtcgagttcctgcctcaggaccctgcccctggaggcctcgcctgcccctgcagctccgcaggctcagacattggtctccagctcactgatctggatggtgcagtggttcagactcgcagcgggcagctcctcatcctgctccacttgaacggggacgtggtgggggcaggtggggcccagggtgagctcggaggcctcggctacactcttcacacagccattctgctgggctgccacgatctcctggaggctcactggcttggtctcgcagggcagcagtttctggtgaagggaaacaggtctttgtagcagcaggagggaccaaggttagatacgagggaggactgagggccagtggggcagaatgagctcagggctaggaaccacaagatggattttcctgcagacacgctgtgtgacctcggcaggtcacggcctccctgggctcctgttcccaagcgtcctgcctcccactggagctggcttagtagaggaggggacttaatccacagggtccatctggggaattggtggatcccctgcctgacctcagcttcttccccatgatgtggggacagccttctccatttgcctgtagaaggagcctgaagcccacacagcctgcacagacctacaaatgctcacatgttggctaaactggacagaccatcccgacacgagggcggggaattttatcatatcttgttctactgttcctcctgtgtctatatcagcgccagccacagcgggtgctcaataaatagatgttagaggaatcagtcattctgtaacggatgaggagaccgaggcccagaggcatggagggagggattggctggaggctgccgagctggttggtggaagatctggtgccctgcccaccctgcgtggctccaccctcctggcagcctctggatctcactgctctcacctcggtgcctgtgtcccgggcaaaatccttccgacatatatgggccatgatccccgctgccagcgcatcacccagcacgttaatcatggtgcggaaacggtccctggtgagccaaggttgggggtgagtggtgggcacttgaaggggagctggaagagggcagtgctcaacccagcacagtacagcacggccggtgaccagctgtcatgcaaagcctgcagccagatggcttcctggctcctcccaagcccaccctttggcatcattgaagcagcttcttggcatgcagctgtgggttccacaggtccccatgcttagaagggttaggtttggtttaatcctctgctgtttctgtcttgaaattctttataggtttgttttttgtttgtttgtttgtttgttttttgagacagagtcttgctctgtcactcaggctggagtgcagtggcgccatctcggcttactgaaacctccatctcccaggttcaggtaattctcgtgcctcagccacctgaatagctgggattacaggcacatgtcaccagtcccagctaattttttcttttctaatttttagtagagatggggattttactgtgttgcccaggctgggctctggaattcctgggctcaaggaatgctcctgccatggcctctcaaagttctgggacatataggcgtgagtcatcatgcctggcctttacagtttttggactgggttccacattttcatttttgaacactggaccccacaaattatgcagccaggcctgtgctaatgagtagggcactcccacagtgccaagcggggcagtccccagccttctaccctggggaagggactcagccgctcaccctgatccctgctgaccctgaagtcagcccctcccagagggctagagctagaggcaaagtccactcacagagcccagtcaacggcaatgatgagggtgatgtcatcggtgggcagtcccacggaggtgagcacgatgaccatggtgacgaggccggcctgggggatgccagctgccccaatgctggctgcagtggctgtgatactgcagggggt

SEQ ID NO: 2819 - DNA, 859 bp, Homo sapiens
cccaggatgaagggtgactggaggctaggagatggaatgaatggaagatttactaaatagtaaaattagctaacattaagatgctatagctgtataaaaaatgaatttgtcagcatttaaaatagtttataataaaaaacaggaggacatgtttcaaacatattggtttatattgttcatcctttccacgtcattattcctaatggcaaaaggttgtgagctcttatccttgggtctttgctcaaatttgaaatgccatatccttttaagattaggataacaaggtgaacctcagaaattaataggcacaaccccaaggcacaagatatgcagcctcctcattgcttgtctcttgcccactcacacacatagagtagcatgttatggcacttacactaataaagccactgctatcaaagttctggacttgatttccagcagtattagctctgttttaccctcaagcttctgggttagtgggttattgctcaccaaagaagttctggttggaagaagaggtaagatatctccagagccgctgagaagaatgagtaaggtaaaactggtggcattcctgactgaatacccttcactcacaggaggcagtgtggaacagtgggaatgaggagtgctatgggactttgtatatctggtctggaagcctgtttctggtacgtacagctaggtgagttgggcaaattacttaaacggtccagatctcaattttattaactatgaaatcacgtaataagatctaacttgaaaggttgttagtatcaaggctaatataaccctttggttgttataatgaataatagataagtattattcttactactatttattttttggaaaaatc

SEQ ID NO: 2820 - DNA, 12535 bp, Homo sapiens
aagccaagccaccttgttatctactttaccagctaagcccagagagggtggagcaggctcaaggtcggctgcggagatcctggcctcagcttcccagcagagggctcttctgcagaaagtgatcccaggatagggggctgccatgggagtcagggatttgcaccccaaatttcaggtggtatctgagctctgtgtgtccttcctacccacctctcaggtgctacttacatctgataaactcaagtggtggacagaacagagagggcctcctccaaggtgacttgctaagtcctcccctaacgacgaaatagagaagcttcctgcccctgttacacatggcctcctcccgggcccagcagctcacctggaccacggaaagcacagaaagaactggctgaatgaatcaagagatcaagtgttctccctgaggccctgtaacagctctgcagctgactgcccagaaggaagcagaagtgagtgacaagttgggggaaccagagcttgcacaccataggcctgaacactagcctctggggaaaggcaagtccagctgaccttggtgaagttaggacccgggccgaggccacctcttctggttcaccctctgctggcctcccagcttctttggctcagcaacacccaggattccaggcatgtttgcctctggccttctaaaaatacccaggccacccagcacctcccagatgtctgagcgctgagtctgtgatttccctgccggtaatgggacagccccggggtgggcaggcgggggtggctcgagcagctcaagccacttcctctgcctcccatcccctagcctaccagaagctggacccagccctgcctcccaatccttgcaaggcaaaggagggtagaggctagcagacctcagagattgttgactccagtctcttcttgggacagatgggagatctgaagtctaaggattgctcatggcacttgtgccattaaggtcctcctcaccccactccccagcactgtgttcatgcctgctgctgtctcacttcccacatgctacttggagtctaggtcttggagcccaacctgacttcctccatgcagctgaaagctcctgacagcagtgaaggggaggatccctgtggtctccatggtgcctggaagagtgtccaatccagagcacaccatcagtaaacgtagattggattgaacaatgtagtggcagctggggcaatgggtggagcactgggctggaggacaaagcctctgaattctatctagcccagggtcagccactgtgatactatgcatcctcatcaattgccctggacaaacctgtttctcctgggctggataggatggtgtctaaggactgagccagctctgctgatatgaagctgcaagctgatgccctgctggatattcctgtcccttctctgctctactgtatgtctgggagagatggcacaacctgtaggttccatcagctccaggttctcagcttctgctcctccctccgtgcttctgaacattccacctctggtcctagcccctgaggcccagctcttccaatagtgccacttccacctctgctgctgggtacacaggggtgaatgcatacctacctcgctcactaatcatgtgaccttgggtaaggcattgcccttttctgggcttcagttttatcatatctaaaagggaataataaggcctaccttaaaggagtgctatgaggatgtaggagattccatagctcagatgtcaggttatatatcacctcctgcagaaagtctcccctgtcctcccaaggatggctcagatagcatttgttgctggctcttcagttctgaccttcccatgttcacactatgtggtcattggctctctatgcatccatcccccaccaagctgtgggctcctcaaggccaggagtctccaggacccagtacaggacctttacagatgaagtgcctgggaacgttttttgacagacacagtgggtgagtaaagcctgagagaaaggcaaggggttgtgcagaagtctgggagtctgagtaagaagtggcctgactgacagggcaagttctggtggtatgaatattgacagctgcttggagcccttcccccatttccctgcttggtaaattcatccttcaagatcccaggagagcatctccttccctgagaaacctgatcactctcccctctaccacattacacactccactgtaggtgttctttacacacctgtctcccttctcagatgtgagttccctgaaggcaagaccctgttggatctcacagcaccaagcactagatctggcatgagttagtcaaggttttggagcagaagaatggatggaggaaataatttctgaatcgaacttggaattgaactgcctgaactttaatgccctttccagccttagggatgataatgaattaccaaagtgagaaaaatggaggcgcaagctgttgtcatccttccagaggcaccctccaagtgtgtgtgggtgaaatgtgagctggagagaggattgacaaagagcagtgaaaacatattcctggaccccattctttttttttttttttttttttttgagatggaatttccctcttgtcatccaggctgaagtgcaatagctcaatctcggctcactgcaacctccacctcccaggttcaagcgattctcctgcctcagcctcccgagtagctgggattacagacacacaccaccacgcccagctattttttgtatttttagtagagatggggtttcaccatgttggccaggctggtctcgaactcctgacctcaggtgatccacctgcctcggcctcccaaagtgctgggattacaggcatgagccactgtgcctggcctgaaccccatttttatctctggatttttctctctgttgaagaattgctgcagaaaccatattctaagtataaaaggcctttagatacctaagatgatccccagaaccttgatgtgaatccatttactcatactttacattctcactttacactttgagcatgaagcccatggtgatctggttgtaaaaggtttaaaggttaattggcagccaatgttgggggtgagaagttgctgctgcaggcaggcaggtattcaccaaggcagcagagagaggaggcatctgccaggctggtagaaaggaaatagaaaaagaaaacaggccgagagcggaggctcaggcctgtaatcccagcactatgggaggccaaggcgggcggattgcttggttgcagtgagccaagatcgtgcactacactacagcctgggtgacagggcgagactccatcttaaaaaatcataataaataaaataaaaatacaaaaattatccaggtgtggttgtgcatgctgtcgtcccagctactcggggcgctgaggcaggggaattgcttgaacctaggaggtggaagttgcagtaagctgaggtcacacccctacactccaggctgggtgacagagcgagactccgtcaaagaaaagaaaagaaaatagaagagaaaagagaagaaagaaaatgggcaaaagcaactaaaggtaccacagatcaaaacctttaagatcagcattgggtacaccattgcatatctgctctgggcaaatccctttctgggcctcagtctccccatccgtaaaatgaacaggttttaccaagggctctgagggcttatgattctccaggagtttccttatgtgaggcctttctgtccccaaccatacagatcagatgaggtgtcatcaaagtcaagactccaatttctagggtttgtgggttatcaggctttcctgccacaaactttcctgccacgaacctcctgctaggctcctcagggggagttcactactgtggctgtctgggccgagcccccaagaagaaacaaaactctccagggtctggtgcagaggctgtggcccaaggtctgcttgctgcctaaggaagatatgaaaaggaagcctggctctgggtgaaacggaagtgtctgaggtctgacagttgctctcagcatggtctctgcagccaggagggaagtaaaactgtctgggcatctggtagtttctaccctgagagtccacaggacagtgacaagtggggcctggtgcaggcctgttctctggtccagagccctagcttaggccagagacagtctttggagagatgctggcccaaagatttggagggagggcaaaggagaatactctgaagctggttcatgaccttaggcaaatctctgtgcctctttgggtccagtttctccatttgcaaaaatggagtttgggctaaatttgcctgtgcaataagggtttctggaatggtgggcactggggatacagagacaatttggttacaaggaacctggattgttaccctgctggcaagggactcacagcctggtaggacatagttacagaatcattggttaattgtgattatcaatgcatgtataggtgccgaaaagctgtggacatagagcattaattcagcattcatccagagatccagggaaggttaagcaacttgcccaaggtcatatagatattaagtggtccacctggggccagagtcttgaaaggaaggggaattcagaagaggacatggctaaatagaagtctggaagaccagtctgcttgtgcttgctgctgtcatcaagatctgaacaaagttatggagacccagaggaggggagattaattctgacttaggagaaggaggaagacttcacagaagcagaggttttgagctggggtttaaagggcaaatatgagtttatcaagtacagaaagggagaagggtgttaaaagctgagggaacagcatattcagatgtgtgatgttgctaaaaagagcctgatgagttgctggaaaagttgtctgtgtgtgtttgtgcgtgtgtatgtatgtgcggtatgttaggaacaaagagtacctaaaatgggaggactgagagatgaggtttcatagtctggctggaatcacacagtgaagggccttgaatgtgtttggagggcagtgggcagccataaaagggtcttaagccacggatgcatggtcaaaatagcctattagcagtcttgctcgggctgctaggagggcagaggaccaaagtacagggctggggccaggcagaaacaactgtaaagaggcagtggcagaggattgagggtgtcaggtgtcaggcctagcccctgtcaagaaatagaaacttttcaagagactacataggtgtggaggaaacaagaattgaaacctgagcccagctgtggctgtggtctgggcaggtgccgtaagcaagggaagtgaaagggttggggtgacttccagttgaaggagggggatggcttgtgggggatgctaggggcctgtcctcaggctggagacctgttccaggacggggcagggtaaggggctatgcctgaccaagcccctgcctcttgttcctgccctcagagatcccacttccttctgctaggccttaactctttctcctgagatattccttccctactccccacccctcccagtgttccatcccaccctttctagcatcccatggttcctatccaggtcctgtaggccctccagcgaggctgccccgagcagctcaagttccttggcttctcctacaccaacctgcactgctcatgctgcctgagcagtggtctgaccatgttttgccttgaggcctgttttattctgtagtgttggttcaccaaactagtcactgttacttcactgtcacctcactgcagctgcaggtgcccctgtctcattgggctctgcccacaagagctcttgataagtcagaatcagaccctcatgtgcccagagaagctagcattgagtatgcctggcccaaagcatgaacttggggaggggctgttcatgggctgcgctgatgagttctttgttctggggcaaatcttgacatgattgtgtctgtttttttcatttgttcgtttgtttgtttttttgagacagagtcttgcctcattgcccaagctggagtgcaggggcaccatcacagctcactgcagcctggagctcctgggctaaaatgatcctctcaccttagccttgtgagtagctggggccacaggcatgtgctgccacgcttggctaattttttattttttgtaggggttatgaaccacgaggggtgaattccttcctgctggtccccaaatacctgaccctccacctggatctgcccattcagatcaatcatctccaggtgcagggtcaggtatttggggaccagcaggaagcaattcacccctaatggttcagatgaagagactttaatgaggggactactgtactgaggtgttggcagggtaagagaacaaaaaaaaggacgttgaggcacccacccagaggctggcaacagtggaaaagtcttacggcccagcactcaaaggggtcaggaatcatgtccagaccgaagtggaagccagttggcaagaaggcctcatgagggagcccacagaggtctgcctcccagggcacagtgcagggtgtgggtgtgggtgcaaatggagactaacggtctccagatatggctgaaagattctcacccagatggaatatctggaagatgcctctggccttgatgcagtcacttctctgtgatcggtgctggtttggaggtttttccagctgtcccagagagaacaggtgaagctttactttcagagtaattccggtaccatctagaaagcatgttctggtcttgatagtgacagactagagagtgacagaggcatgtgggcctcaagggtacagaattatcccaatatacagagtgacagaggcacgtgggcctcaagggtaccgaattatcccaacatatatagtgacacaggcccagagagagtcagagctgtgccaagggtaaacaggcccagggcagaacatagtagaacacggtggaggggagatgctgtgagctcatgttggagaggtacacagcatccagattatggagttaaggccacacagctagagagcagcagggccaaaggtccaactggtcagtctgaattggaacttgactcaagctcttaaccaagaccctaagctgaccctgtagagaaaagagagaagggtgttaaaagcagagggaatagcatgttcagatgcatgaagttgctaaagagcctgatgagttgctggaaaagttgtgtgtgtgtttgtgtgtgtgtacatatatgctgtgtctttggaacaaagggtacctaaaatggtaggactgagagatgaggttatgtaggctggctggagtcacacagtgaaggaccttgaatgtcaggttaaaaagcttgggctaaatttggagggcagtgggcagccataaaagggtcttgagcagtgggtgcatggtcaaaatagcctattagcaggcttgcttggaagctgatgtgcctgtttgtttgtttgagatgtgcagcttctaagtgcacatctacttggaagctgagtgcccagtgtgcagacaggaaaggtactggagttagtgtgaccaagcccagggtatcttgtctttcagacacaccccatcttctccttatggaccactcactcacaaacctcccccggtcacaggctcagcacagcaggtgaggttataggctgaatatgagcaaaggacaggcctgtgcaggcccttgggcacatcctcccttaggttgctgactgggccttgtattccatgacctggctgcccacacttaatgttccactactgttaaacctctgggtctacagaccttgaaatccatccatctagtgtgcctgttgggtgccacaaacaagatctcctcccagaagtctacggggatggggacattgataggatgagtgagatagccaatatttgtggagtgtgataaaaccataaaggactactgctttttaaaattgggagcagagccaggtgcggtggctcacacctgtaatcccagcactttgggaggtcaagctgggcgaattgcttgagcccaggcattcgagaccagcctgggcaatgtggcaaaaccttgtctctacaaaaaacaactacaacaaaattagctaggcatggtggcatatacctgaagtcccagttactcagcaggctgcggtgggaggactgattgagcccagggggtcaaggctgcaagcaaactgtgattgcacaactgcactccagcctgggtgagagagcaagaccccatctcaatcaaacaaacaggaaagtaagacagaaggaaggaaggaaggaaggaaggaaggaagggagggagggagggagggaaggaaggaaggaaggaggaaattgtgagcagacattcaagagggccacccaaggctacaccatctacctcatttcacaggattctctatccaagagaaatatggatagagccatgtttccaaacgtggctcaggcccattcagcttgtggttttcgctctctctgtccctccgcagggagtgcctgcctcccatgcatcaaggcctacttccaatgcagccctcgtgggcccctcctttagacagaggcagtcttcccccacttagaacaaccacagcactttgattttgtgctttggaattactcagactcaaacaatcattagggaattctatatcttgcctctccgtctagattgagggtacctgttaattcaacttttcattctcccctcctagaatactacaggtacagaaatcatttgctcaattaaatggtggcagcccagttcccatgaggaaggtctgggtgactctggtaattgtgatggagcggttaacctctagacactggggcaggaccatctgtgttcaaatagcctacctcttactaattgtgtgatctcaggcaagtgacttagctccattcttgcaatcaagaccattgagtgttgtgagaattaatgggttaacacagtcaaagccctcagagctgtgcctggtaccccctaagcattcaagaaatgtcagctattattattacagctattattaggagccagccgggtatgcttataaacaatttcccacacccagcaaagctggagcagacacatacactggcttaacccacagccacacttggaaatgggggagggtagggagctgtaactctattttagagatgagcagaggctcagagaagtcagaagcattcattcatttaacaggcatttatggtgcgatttccacatgtcaggcactgcctctcctcccacttcaaattcagtgaatcctcagagtggggctggaggctagggacagaggactatgtattttaaacaagcaccccctggtgattctcagcttaggcaagttggaaagatgattggattgtaaggtcctaaggcaagcatcttgtcatgttccaagtttggacctgggttttatgggggatatcattttttggtggcagattagtttagcagttaacagcacagaccctgtagcctggttaattgggtatacatctcagtttgccactggctgcatgaccataggcatacctaacctgtgaatgcctcatctgtaaaatgaggctagtaatagtacctacctcagagttgtgagaattacattagttttttatgcgaagtgcttggaaggctgtctgccacatagtaactattataaagcatgagctattattattaatgtacacagtgtagacaagcatcagacagaaggccgggggtggtagatttgacacttcttaccccacgattggctctgcctgtagcgttggcagtgtctgtctcttcagggaggctcgccacctgctcctttccgctggaagagctttcctgagttggggaattccctcccatggcgcccgacagcagctcctagcattctgatgccatgtgctctgcccacagcagcatagtgagaattagatcacatctcgggccaaggctggactgggaggacaggcaggtgtaggggttggaagtgtccacttacgaaggctgcaaatgggaggaggagtgcagaccctggggaggctcctctccacaccctaggccagctttggctgagggtggtgccgcagacaggggaagggcggatgcccacggaggacaggcgggatgccagggtgtctgccagccctccaggacacttattttggcctgctgccctcgggcagggagcaagcaagtgtattttgttttggcattaactcagcaggctgtgggaaaacaggcaggcaggcatcctgaacagggcctgctcccttcacaggccagcccatggtggtgacagaactgccacctctgcatcctgctgtccctctcccacaactctcctctctctcccctgatccctgcctggccctccttacccagctcagcctgaagggtcctttccctgaaaggggctcacagacttggtagcatcccatacctcccaggctaggctctggagaaactccctggtggaacccctggtgttacagatgagaaaacccgggctaagggagaggcagggactttccaggtcctcacaatgagtaaggagcagaactaagattctagtggggctcaatctcccccatggaaattcctctttttgtggtttattttttaacttacaaataaagccataacaaaatgacgggaaactgaaggaaaactcaacaaaggaaacacacttgtgggccagcacagttgcaggcactttacataaacattcccatttgattcccactgcaaccctgcaaagagccattatctctcctttatagacaaggaaacctggctgaaaagaggtttcaagacttgatcaaaaactctaagcttggcagaggagaaatagacatctaacccaggtttgcttgacctcagacccctgtaacctcatccctccaccaaaagtattttactcattggtgcctaatcacagtgcagctcatggcggaaggtgctgatcagcgttcaatacaggtggtcactcaaccttccctgatgtgtcctaggatcagcagttacttgtttatgtggctcctcagcccttgcagaccatttacctgttatttcatttaacctgcacagccctccaagaggaagacaggatggaatttattattcctattttatagatgtagaaaccaaggttgagaggacagtgatgcgctagaggtcacactcagtgagtacctggcagagatagaattagcaccgtggtttcctgccttgtaatgttaaaaccatgtgcctatcagctcctaccatagccctgggactgactgctcatttaccgtacacccccacccctgccacccaaagttgtaatattccctggtaggggcaacacttgacaagataattcctggtcccagtgcctgcttcttagggacttgcctctggccttagatctctgctaccacctggtaggatctgggtccctatgaccctcctggccctgcatgtttcactgctgtgaccttggtctctgtattgagattgggagctcctggtgggcagctcctcacctcagagacctgcttatgactaagcccaggataagggcttgttgagtgatactatggaattcaaggcctagtgccttgaacaaactcactatgtgtcttaaggagagcccctgctctcttctggtggccaccaatcttgaagtctcatttacctgtgctgggattctgtcctgagagctgatagtggaagagactggcacactctcacatcaggctggcaggaggctggtgttgagggaattagctcagggagcaaaggcatgggtagggaaaggtgactaggggtaggaaggagatgaatggggatggggtccatagaccacactgtctgccgcagcatccccagctggacttggtggggcccaggcagggaatagctggcatccagacgtgctaacaagtattcctgagcagtctgtgtcaatgcaggtgggggataatgacacagaggaagacagagtagagagagctgatggaccccaactgcaggaacggtcagggatgctttggtgcagtgtgggcagggggactggcagctactttctctgaagagagcctttgacgaagtcaaactgtcctaggtgcgtgctctggatggggagtagtgtgctactcatgttctggccatgctaaagggccgctgtatactttgtctccctgccagttttcccaggagccctggaatatcagaacagctgatcttctgatacccattcatatacctgctccaggccagtttttgatcctagctctgacttaaccttagaatcatattcctaatgaaatgggagactgcactgcagcatgctggagggagagcacagcttcagagccaggggccagccctccctttccttcactagctgtgtgaccttgggtaggtcatttcacttctgagctgcagcctgtgcaatggggttatatgtattatgaggagttgttgtgaatgttggaaacaatgtaaataacacgcctattttaatgtctggaacatggaagaggcaaaataaatggcag

SEQ ID NO: 2821 - DNA, 7165 bp, Homo sapiens
ctgggacagcaggcacaagccagatatctggttactcttccttatgagggatgtcttcagcttataggagacacaggtggggtgcagttgatgggggcaccaggttggaatcagaaagcctggattgaaggtcctgcctcttgtggttgctgagatctgagacagtcacttcacacctagagcctgttttctcctctgcaaagtgaggggtaaaactgtttaccttacggagctgacatagagaggatgttaaggcactgagggccagagcacttgttctcatcagcatcatcatcagcctcagcatcattgtcaccgtaatcagcatcattggcatcagcatcatcagcatcaccaccctcatcatcatcagtagcatcaatatcactatcatcagcattagcatcagcatcatcagcagcatcagcaccatcagcatcatcgtcatcaggatcatcagcatcatcagcagcatcaccaccattatcagcatcaggatcaccatctaacattttttgagggcttcaaatgcacaaggcactgggctgatttctttacatgcattgtctcacttgtttccaacaatgacagcccccaaagttaagtattattattgttaatatcctcatttacagatatataaactgaaacttagagagattaagcaacttgcttagggccacagagctatgttaagtgtaattttcaaaaatgtaaatcacaattctcaggaaaatataaaatgataccatgtcaaagattttatttaactcaataaccaatgagagaaccaataagaagtttaaacttattcaaagagcattagagaatttagatatatgcaggcaatttaacaacaaaaaaataaggcgagtatgataggctaaataatgttccctctggaaaaaaatcaatcctgatccctggaatttctgaatatgttacttatgttactttataaatagaaaggactttacagatgtgattaaattatgggttttgagatggggagattattctggattatctgggtaggtccaatgtaatcacatgcattcttataggagggagacaggagtgtcagctgagagagaagacataagaacgaaagcggaggttggagtgatgtgctttgaagacggaggaagaggccataagccaaggaatgtaggttatccctagaagctggaaaagacaagaaaacaaatccttttctagagcctccagaagaaaagggctctgcttacaccttgattttagcccagtgaaacagattttgaacttctgacatctagtactgtaagataatacatttgcatgatttttacaccctaaaatgtgttacattgttatatcagcagtagaaatttaataccaaaagattactgggtgagatagaaagctagttaatgtccaacagggctatcaactataacccttggagctaattcttctaccagagttaaattatttgcttctctgcgggaccaaaatttacaagtaaacctctgccgttatggagatgaaaattgactagtcagtagaaatcccagttctgcactggcagatcactcaataatctcttctgcacgtttccaagtttagaatactcttttggacagttaggaagtcgaagcactgagatttgaaccaggctcttctaagtccagaatctgtgctcttaatcactaaggaacatatttttttattagcattatttcatagactagcaggacaatcagtggcaaaaaaaattgtccatggaaactgagaacacagcttaaagattgccaggtttgggcgtggtggctcacacctttaattccagtgttttgggaggctgaggcgggaggattgcttgaggctaggagttcaagagcagcctgggcaacagggtgagacctccatctttacaacaaaaaaaaaatagccaagtgtgatggtgtggacctgtggtcctagctactcaggaggtggaggtgggaggattttgtgagcccaagtgttcaaggttatagtgagctatggttgcactctagcctgggtgacagagaaagaccctgtctctaaagaaaaataaaaaaaaaaagagtgccagtttgattcaccaactccttcatggtgcttcccccaaacagaggaccacagaaagaaccttctccctccataacatggaaattcctacactagctctctgaaaacttagagccaagctttcagtaggtggttcctggttggagtaacttgaaggctggggtgggaaactaaaatacacctccccacaactgttcccttccctgctcaagagtaaatggtcttgacaagcccttctttaaaactgtgttacttggttagacatcaaaacactttgcctagtaaatgcttgaaaaaggtttgcattgcatttggtttggtggaagggcaaagtagactttgggagtgagaaaagtcaggagggacaaatgagtgagttgtatcaggaactagcatggcattcttaagagtcatgcgggctgggtgcagtggctcacgcctgtaatcccagcattttgggaagccgaggtgggcagatcacgaggtcaagagatagagaccatcctggccaacatggtgaaaccccgtctctactaaaaatacaaaaattagccaggtgtggtggcacatgcctgtaatcccagctactcaggaggctgaggcaggagaatcgcttgaacccaggaagcggagcttgcagtgagccgagattgtgccattgcactacagtctgggcgacagagtgagattctgtctcaaaaaaaaaaaaagagtcatgggttgaagcgtcccactgcagttgggaacctttatgggaaagtggggtctctgattagacaggtggaatgtggccagagtcttgaatgggggctgggcagtgtaggtttaccttatagggcaatcattcttgaagccgaacattagaataaactggcaagagttaagaaatatgaatgcaaccctgtattcatctactgaggctgccataacaaaataccacagaatcggtgacttaagcaacagaaattaattttctaacaatgctggaggctagagatcaaagtgttggcagtgttggtttctcctgaggcctctttccttgatttgtagatggccatcctctccctgtgtcttcagatggtctttcctttgttactgtccatgtctgaatattcttttcttataagccttcccctattgccccaattcttcccattaggaacctcaccagcaccacaggacccaccaccaccatcacaagccttatcatcacccctgccttctctatccctgcagcagtccggggatagacacagggagaggacagccatcttaccagccgaggaaggaagcctcagagaaaccaacactgccaacactcggatctctggcctccaggattgtgaccgcacccaccacagttatcacaggggcagctataatggcagcagctgcagcagcagtgagccccatgccaatagagagacataggcagtcacacccattgtagaactgatcacttaggccaagttattaattttgtactggaggaaactgaagtccagagaggtcaactgacttattcaagcctatggagctcttaaatagaaaactaagtccaaagatcctattttttggcctcacattttctttctttctactggtccacatgacttcatcccagcccatcagccctggaggctgggctaaggacagccccactatttgagcctgctcttccttcctatcaggagcaaaccatcatgaaaatcagccccattaaactctgattgtctgtgtctgggccatgtgtttcccttgtcaaggggttgaaatgctttgatttaagggtaggcaggatacttcttttaatgtttttagttaggacttggtcagcaaacaggaacaaacctgatcaaatgtggcataagcaaactgcaaactcggctcatgtaacaagaccaaggcagccctggctgcaggcatagcaagattcagggctcacatgatgcaatcacgtgtctctcctttctgcttgctttgcaatctgttgactccagtctcagactccatttggtagcgagatggcagcttcagtttgtgaattctctggtgcagcaggaaagaggtagcctgtttctcaataacataaacgaaagtcatggaattaattaatgcaaaaatatttattgaggtcctagtatgcaccagacattcttctacatgctcgggatactgaagtggacagagagaagaggttcctgtcatcatggagcttacttgagtcttcttgggctctgacatgactgtttttggccatgtgtaatctgtgagccaatcactgtagccacgagtacgcgatgtgctgggtcatgtgccccacttaaagaatgcaagcctcaggccaggcgtggtggctcacgcctgtaatcccagcattttgggaagccgaggtaggcggattgcctgaggtcaggagtttgagaccagactggccaacatggtgaaaccctgtctctactaaaaatacaaacattagccaggcatggtgctgggtgcctgtgatcccagctactcaggaggctgaggcagaagaatcgcttgaatccaggaggcggatgttgcagtgaaccaagacgatgccactgcgcttcagcctgggcattctttcaaaaacagaatgcaggtctctttttgagtgccaggactatgtcatagttatgtttgtgatgtgtccacaaagcataacccaagggctgtccataataagcacatgagaagtgacatcaaacgagtgaacaactgagtaaataaaccacagagagagaaagttcatgaaaggcaaatgtgtaaaaacacacgaaaaggggacaaatccaagtaaatcgaacaacgaaatgctagctctcagttgccaatccaaaaagagacataatattcactatagatgtcttgctaaaaatatttgcccagtgtgtttcatatcaggccaagaaaatcctgctcattattcagagaaacattagacacaaaatctgaagttgcagttcatttcagagttgtccctggggggtgtcaacaaaccggggtcactctggacctcacactttgaggagcaagtgaaagaagaaatgaagacagctcacagctggcagctaaaatatgtcgatgtcattatgtaaatatctgccacccacagccctccatggtctctcttgcagcctgctgtgggcacctgggaaacacttctccctgttgtctggtgttcttggacatagcctcttagttcctttgatgttctgcccttgatgttcattttatgcagctttcaactggtaaaaaagtttaaggcaaggaaaaagtctggaagaaaatttatagctcctaaattgttaacatgtaaaagagccattcgttggtcctaaatcctaaaagcgtggctctgtatatcttgtataaaacctatgtgggttggcacttggagggatgtatgcaattttagtcattacactgcttaaggaaggacctataaaggacacgtagaaagaggcaaactaaattattaagaggaacctacatttgagcatgagctcaaaggaggtggactccagcatggagagaccaaagctctaagaagaaataagtacatgctatgaattcatgaagggcatagaaaagatgcctgtaaacaaacttattcaccaaatttcaatagaatcaaataagaggggcaaccatggggtttcaaaagggtcaaaattgtacaaatattaagtgtaagtggctttaaacgatggtggcaaacatgaaatttaaactaatttttatgttttagagacacagtcttggacttaataaaaagagctttaaaaggtatattggggacaattggtaaaatttacaggtaagtcacatattaaatggcaccatttaaccgaataaatgttagctttcttaggtatgatggtggtgtgcttatttaggagaatgtccatattcattcaagatgcacggtgaaatgttgggggaaacatggctggattttgcagctgactttcaaatgaattagaaaaaacatctataaatatatgagagaatgacagagcaattgtagcacaatacagtcatgtgctgcataatgacatttcagttaacaatggattgcctatctcgacggtggtctcataagattataatggagcagaaaagtttctattgtccagtattatgctatgctatgctatgctatgctatgctatgctatgctatgctatgctataccataccatactatactatactatactttatttatttatttattttttggagacaaaatttcgctcttgttgcccaggcacgattctggctcactgcaaccttcaactccccggttcaagcgattcttctgcctcagcttccagagtagctgagattataggcgtgcaccaccacacccagctaatttttgtgtttttagtagagacggggtttcaccatgttggccaggcttgtctcgtttatctatttatttttgagacagggtctttctctgttgcccagtctggagtgcagtggcatgatcgtgactcactgtaacctcaaactcctgggctcaaggaatcctcccgtctcagcctcccaagtagctgggacttcaggtgtgtaccatcacacttggctaattaaaatgattttttttttgtacagacaggggtcttactatgttgctaggctcatcttgaactccaggcctcaaataatcctcccacctcagcttctcagagtcctagaattagcactctgagtacctagcatggaatttattacctttagaagtagcactgtttgaaaatataaagtcctttaagaatttggatatgttcatgagtgatgggtcaagagtgatgggtcagatatgttcgtgagtgatgggtcagagacttgaagatgcttttgatactgccctacccacagagaacaatcacacccacccttgacgcatctattggagaccgagtgttagacaagagtccagatggctcacaggcaggtctaggacaggtctcagcaatgttttgagaataaaacaaggaagatctgctgaatgtttaagttttttttttttgag

SEQ ID NO: 2822 - DNA, 734 bp, Homo sapiens
ctgcaggttacactatttgccaatatctatttaattgtagcaataacaggaaaaactcccaaatccaaccagctagaaattctctggctctcttccactttagtggaatcaaatttttgcacttgcggtcatctttatatatgagaggagagtgaggctgggagaaacttggtgttaaaaataaagcaaagttacagactctcactctctagagctcatggaagattctggctttttattattaatgattagcattgacaccatcccccaacctcaagagcatgctgaggatcttcagggaactccagcttgatctgggcagctgccagggttgacatctatctgaagattctgttctcctcctgcccatcatgtcaaggtaccatgcaggctgcctgaatggacaaagtcaccaaaacagatgtcttcctctgagtttcgaagtgacagcaggaagggctgaaccctcatgtctatttctccaaagatggagtgaggctctgtctctgtgctgttattctgtcctcccgtccatctgaacatctttagcaaatggttcctctctcctgctgttcttcagccgtcctgctgtccacaccctggcagcctggaggtgggtccagccaaccatgggcctgattcctgagtaggcttcaccccagcctcagttccctccttgggtgagttggactgtgtgacctgaaaaaacagagtctcaagagctttttcattct

SEQ ID NO: 2823 - DNA, 794 bp, Homo sapiens
ctccaatgtgccaaaataaagcagaagccggagagtaaggatttcagatgaggcaaccaaaagaggttaggctgaagcctctgcatgtcccgatgcctgatggagatggaggaatcctttctacccagacagaagtcacactatgtagcctgtcctctttagaacataacattctctggctaacggtgattaagccccaggaaacatatccaagacaccaagaaggccctcactggatggcggtggctcaagcctgtaatcccagcacttcgggaggcggagatgggcggatcatgaggtcaggagttcaagaccagcctggccaacatggtgaaacctcgtctctactaaaaatacaaaaattagcaaggcgtggtggtgcacacctgtaattccagctacgcaggagactgaggcaggagaattgctttaacctgggaagtggaggttgcagtgagccgagatcgcaccattgcactctagcctgggtgacagagcgagactccatctcaaaaaaaaaaaggaaagccctcactggatgtgacccttcaattctggtgtccctagcctccagaactgtgagccaaataaatttctcttcactatgaattacctagtctgcggtattctgtgatagcaatataaaacaaactaagacagtgggagataatatcacagaacaggcccaagccagatgaagcagacttttgtaggttgaggtaaggagtttgacttttattctaaatgtattgggaagccactggaaagttttaattagtggagtaatatttggc

SEQ ID NO: 2824 - DNA, 3828 bp, Homo sapiens
gaagagccggttgtcagtcttatcaagcagggactcagcttttgtccccagcacaggcccagctcctttgatccgcagcaaggccattgtttccccggcagtggcctctctgcttcacaggggaaaatgtggtctttgttctcctgagactttttatccaagtcctgccctggtggggacaaaccgggcggggctccatgtgaggatccagtctctggcagctgggggacaagggcagcccctgtaccctttcctctgccttgcgtgggctacacaaagcccttagaatcctcttgctcagtacaaatcatgctgggttgggggtggagagagaattgtgggcaaacactttcagcttctttattttgaaaaattgttttgtttccagctcaatcatagtataaatcaagtgcagtaagtcctggtaaaaaactaggtttgatcttacctgaaccacttactggctgtgtcacctgggataagacatttcacctttggagtcacagttactttctctgcaaaatccagaaaataatactatttactgcacagcattgcaatgaggttgatgcattcattcattcattcattcattatctattaagcacctactccgtgtcagacactggagaatgaaatggacttgattgtgccccacccccaccaccccatgaagcttacaagggaaggaaggcattaaacatatgcttgcacatgtaagtattgcaagaagaaatacagcttgctacgagacaggacttcactgagtcttggctgggggtgggacaatcagggaaagcgcccccagaaaagcgatgctcatgttaagatttgaaagacatggataaaagagcctggtccatgagagatggtctgaaaatattagttcccaccccctctgccttggatcagatccctcaccaacacctgctgggtgtgaatgggcttaagaagctccccctcccctctagggaacttagctgaaaagaagtggattctgggaattgcttccaggggcctggaaattgatgaagacacatacaagggaatgaacatggggccagctgtgacattttctgtgtgccttaatgagaagtgctggggctgtactacccggagctgaactcttggcccagcttgccaggctggaggaggagggggagttgcttcacagactgcagggctttgtgaggggaaaacaaatgggtctgtaacttgatggaggcagaggggaggctgccagagctgtgagcctgaagaatagctttcagaggagtgtcaggggaggaggcagcctcttccctcaagctaggggatgtgcagagcagagctggctcttggatcatccccaaatctggattgtgtgggccatgctgctctgggcacccctgggctgagttactcacctatatccagtactttgtacgagccaggggcatttacagagggtatcagagttaggccttgcagcaaccctaatgggtggggggtacttctaccccaattttgcagatgagaaagctgaggttcagagaagtcaagtaacttgcctgaggccacacagctaggagtggtgaaggtgagatctatatttagttcagtatgactttaaatccatattcttccttatgtatcatgctgctagataattttttgatcaatatttccctctgaatttttaaaatgtaataaagagtcccttgtatgtaatatgtttaacaaagaactcttgcaaatgccatgatgcttgccctgtgagttgaaatgcttttatcctcagattagagatgaggaaatggaaggtcagcgaacccggtggatctcttaatgccacacagcaaggaagtcagggagctgggtagatgccaaatctcttgcactttccaccactgtcttgagacccaggtgggctcttcaaggtatccgctgacatccagaccttctcctgatccttaaaattaaaagcccaagcacagtcagtttgtttttctaacagactcagagtgttcactctttctgactcttgataaagccagcagtcaaaatctcctttcctggggcccctccttctgagaaagggatggttagccatgtgtatttttcactggggctcccacaaagaatgtgcatataatacgaaacatatgtcatttgtgcttgtgggagtgcccctaccccatgcccttccctgcacagctgggagccccatctgcaggaaccctgtgcagggggatggaaccatacacacctagagaggggcccgccagacctgcccacctcctgcaggcagaactgggtactgatcccctctgctctcctcacttctccatgggagtcctggtcccaccacgttttcattcttggcaaagaacggtggggctgggattcaaatcaggtgtgtctgaggtcaagcgtgaaacataccttgcatgggctacagacatatcagtggatgaattaaagaatgaactggggaagaacacttctgcctctggtttctatgcagtaggtgctgtttaaagtttactggaggaaagagtaagtacaccctgatgggggagcttcatagtgggtgtgtttcaggagaactctggagctgaaggaagcacattggtattttgtcctttcccttcttagaagatagattgtcaggcacagtggttcttgaatttgacgtatattggcatcacctggagggttagttaaagtacagatcgctggccccaccctggtctttcagattccatggggccaaggatggggctggagaatttgcatttttaacaagatctcatatgatgtgatgctgttggtttagggccacactttgggaactactggtgtgtaggaagaaagaaagaatggtgggtggagcttgtgagacggaaagataagaaatgagattataccatgctcagagtcaacattctaaaactcaaacttggagacatgactcacgtgctcaaatatctccctggcttcccactgccttaccagttgggctctgctttcgtccccagcctcatggtttacattcccctcttggactccttatctcgtgccacaagcttctcatccttcccctaatgcagtggtccttttcttcttttcctacctttgcacgtgctgctacttctaccttggcaaccccagtcctcttttctaaacctggaaaactccttttctaaaagaacctatcaactgccacctcctctgagaagccttccttgatactcctaaatgaagttttagcttccttccctgtacttctacagcaataaggttgtatctctactcatggcttcatcccctatactgcagttgtttcttgcctcttttagcctggaatcttcttgagagtaggaactttagtcttatttatcattctatcccaggccagggcctgacacatagcaggcactggataaatgcttgtggacagaatgggtccatgataatgtctgttgtgcatttgttatgagttcggtgctgggtgaagcagtagagagtaggataatccacggtaggccattcatgcagctgccctggggaggcactgtcctgagtgctggggatctctctctaaagaatgggagagacaagccctggctcacatacagtttcttgcaagagccggagaaaggcatagactggttaatttcagcaggaatcagtgcagtcatgggggaaacacagggtgtcaagggaactcatagcagtggcacctcatctgagcggaattggaggtgaggatcaaggaggtgacatctaaactgagacctgaagtaggaagatgaggaaggaaagctagagcatggcacatttggg

SEQ ID NO: 2825 - DNA, 5590 bp, Homo sapiens
atgcaggtttgttacatgagtttattgcatgatgttgaggtttgggctatgaatgatcctgtcccccaggcagtgggcatagtatccagtaggtagtttttcagctctggccccacaccctctctcctccctctagtagtccccagtgtctatttttatttttattattattttttattttttgagacagtgtctttctgtgtcacccaggctggagtgcagtattgcgatcttggctcactgcagcctcaacctctcgggctcaagtgattctggtgcttcagccttccaagtagctgggactacaggcatgcactaccaagctgggctaagtttttatattttagtagagatgaggtttcatcgtattggtcaggctgctctctaactcctgacctcaggtgatcgacccacctcggcctcccaaagtgctgagattagaggcataagccactgcgcccagcccccagttctattgttcctttctttatgtccatgtgttcccaatgtttagttcccacttataagtgagaacatgtggcatttattttctctggggtatataactggtaatgggattgctgggtcaaatagtaagttttgttttaagttctttgctaaatctccaaactgctttccacagtggctgaactaatttgcattcccatcaacaatgtgtaattgttctcttttttctgcagccttgccaagatctgtaattttttggctttttaataataaggccattctagctggtatgagatgggtatctcattgtggttttgatttgcattctcgggtgattagtatacatgaatttgcttctgcctttgccacccctgagacagcaagaccaacaaccccttctcttcctcttcagcctactcagtgtgaagatgataaaatgaaacagttggtgatgtttcagagaacccaactcaaactgacttgaacaagagaaatcagtgtttactgcagagaacacagaagccagcaagcagcagggaagggaggcgaaccaatgcagcagcccaccgggaccgaggaggacacacgcagagcaagtcacaggaagcgcagctgaaaacaaatggacgcttatcccaaatgcacaggacacttaccaagaactgatggtccgtcaaagtaaagctcaacagctttggctggcaggacagtcaaacttttggacgacagaaagtaacagtgggaaatgggacaacatctgccagcaacgcgagaggccaagaccatggctgctacaggaggggtcagcgtcacagtacacgcatggcggcggttgcacatgcatgcctggggaatgtgagtgttcagacatgccaggagtccagcctcaccaggaaacaggcacacggggacagaggcgcaaacactgaaaactctcgctgaatccactcggctgagcggtggtcacgagagcacggccctgcgctccccacaaaactgcacctgggccccagggcgagacaggcgtggaaggtgcaggggtgtgtgtgggggcaggggctcctggctcagagccgtatccaggaaccccccttcaggctggagccctgccctgagccccctgtggagagactgtggagagccccctgtggagagggtgactgtgggagagcagcatcaggcctagtctcggctgtgaagtaccccccacctccacgcaggatcccggggattctgtcaaggtgggggccgcctgctcagcccaggctccctgaacgtgtggctagctgagtttgcggaagaaaccaggagagtgccaacaccaggcttgcaagcaagaggctccctgactgcctgatcctggagcgcaccccatcctccctgtgttccctgggcctcagctgttccccagtgaccttggagacaccctgccccaccctggctccacaggagccctgcccatcaccgcctcagctctgagtctcccctggggacacaaccttcctcctggtgcagaggcgcaggatgctgcccctaaggcccatcttcctctgcagcatgttttgatgtcagctcattcacaggaaagaaacaatcacatctcagtgcccagaatggggaccaataggagaggtcactgggaataaagcccacacgcaccccagggtccatgggctccccagaaatgcaggtggcctccgccagagccaacaagcctaagttgctgatcagcccctccctgcttccctgtgtggaagaggaaacagaggcccagactagtagggctctgccgtggtggccggctgcgtccccagacctctggtcccagggctggctgggagtgcccctccctgtgctcacttcctgctctcctgggaaatggctcagggatggggcgtgtggggacagatgctggcatagctcacaaaatgcttgcacaagggacactccatggcaggtccctgcaggagagcaaagtcacaacattcagagattccctgcactctgaggcccgcagagcctggccgaccaagcgaggctgggaggatgttgcctgctggtcagggcagccctctgatcagggcggccgagtgaggctgggaggatggtgcccgctggtcagggcagctgagcgtggctgggaggatggtgcctgctggtcagggcagccctctggtcagggtggccaagcgaggcagggagggaggtacccaccggtcagggcagccgaacaaagctggaaagatggtgcctgctggtcagggcggctgaatgaggctgggaggatggtgtctgctggtcagggcagctcaggaggtgctgcccaggaggtgctgtccaggcagagcctagggctggtgtgggtgtgccatgctcctgagaagtttctgggttgtggctttaatgttctcctgcagtgagaacgctgacacttggccaaagggtcctcacctctcccctagtacacttctgagatgccaggaaggttctgaacatcagattgattcctgggactcccctccagggtggccttactggagtcaggagcccctgccccactaggatggctctgcagtggcctgaggacagtgagcactgactggtcactggtgcaaagttgcccactgtgatggttttgaccgttgatgggaaccaagtgaaagccctgcagctatttctaggcatttcagagggtgcttccctgcatgtactctgctgcagaccatcctccctgggccaggagcccgctacacagtaggagattctttttcttctcttttgagcacttttattctctttttcttaatctctgctcctcctttgaactgagaaatgtgcaaatcttttttgttagttttgaggttgcttcttatgcatatttcatctggaactttcccctttgggggtgatctgttctatcagcctgcccgctgctagagaggccgaggtggtccggccagccgtgcgctgctgctggtgtctctgtgggcatgacctggtgagatatcattctgcatctgggggtccatcctatcagccctgtgttctagattccccagtgactgacatttagccagtctcctctgtcactctccagtgacatgtacacactgttggcacgaactgcagatgtcacgttctgtggctgagagcctcagtgtgcatctgtagtaggaggatgtcagtgaggactgtcctgtcgctgctgagctggcaccgactgtgcctggtctacactccaggtctgccaaacgacccagcaaggtccttcacaactcttctgatccaggatcacacatcacttgtgctttgatgcctgcttctgaacaattttacctcctgagatgtccatttttgggagtgtgagccctcctctcctggtgacagctggctgaggccgtccagcctcaggacacacagggaacggctgcataaggagatctggggcagggggcccaccaggatgttctgccctgtggggggcaacaccggctgtggtctgccggcggcatccagggacagtctgtctaggtgaggctgaggccgcccccactcgctccctcacccccatgctgacagcagtgagctgaccacagactgggggagccccacagggagactggcctccccagcacatgccccgcagtgccagacgcggtcatcacagaggcaggtacacgacaccacggacgtgccacgtacccgccatcgggaccaaggaccactgagaaaccatgaaggccatgcagcgactgtggtggcaggaccgtcaggaggccataggtgccacggctcccctctggtggttcacctgcccacctgtagctggggtggcccctccagtgcgctccccagagcagaacaccccccaggcaacacgtctgatgaaggccaacagcgtcagtcctctggtgtttggtgacatcaaagctgtgccgaaaggccttccctcactgctaacacttgaagggcttctgtccggtgtggaccctctgatggcgaatgtggtctgtcttatgcttaaagatccacctccattaactgcactcttagggtttcttcctctgaaaaggaatgaacacgggaaccccctcaaaggcatttttaaatgaagcgtggaaggcatcaaagatgtgctcttcttcaggactcaggcttctccatcattctctgttccttggaagcgtgagggctaaggagctgctgacttctctctcttggccccacttcaagaaaggcttgcttcccacacacctctccacgctcccagtgcgggactgacactctgcaccgggaggccaagggccaccatcgtcttgctgggagaaggtgtgacgtttcttggtcataggagggagtgtgatctgacaccagaggacttaatataacattgcagtgttaacatcttcactggcagattcatggactttccccctcctgaatgcatttcaacaccttgaaatgaacgatgcctcatgtctctgcagggtggacatagctctaactctctgaagctggtgagaatgttgaagcctaggggtgccttttgaaagacataaatttgggccctgaagtggtagtggggaggtgggataggagaaaaggagaaacctttgtggtggaaagatatctgggttggtcgttcaggttctgctgtaattagttgtgagaaagtcagtcagttaccctctgtgagccctatttttttaaaaaaataataatggtctgcctatttcagaagtttgatgcgagaaccaagtagaaaggttctttgtgaagcaagtattgaaatatattctcattaaagcgtgtgcatgggattgtgctaagcactgcagggggtaggatacaaataatacttagactctcacctcaagctaataaggcaataaaataaacacctcaataaatagaacaagtaaattgcaaaaccagtaatttggagagtgattttcaccacttgagacatggtgtctctagagcagtggctctcaaatctggctgttcattagaattacctgggagctttaaaaacagataattgtccaggccccagccccagaaattttgacttaattagttggatatgcctcaccttccactttcccctacattatcattt

SEQ ID NO: 2826 - DNA, 1649 bp, Homo sapiens
aaaacaactaatatagagttgacaaacctatattagatgaaggtgataaaaattattatgtcctttatcacacaatgagtctagacagaaaccaatcaagggatctataataaagatttaatggaaaaatcttcatgatattcttcatatgtgactactggaggtcttataacatttctaagtaagcttaaagcttaaagctaaagcttctgaagttcttgtgagtttcagcatttaaactgcccggcttcttgtctagtcacaggaaggctaattttatcagttttataccacagaattacagtactgaccaagaattatttgttagaccagggggtctaggtcccacagagatgaatcctgtactatttgttttactgcttacattgcacaacagaagatatgtagatcagaaagaagtacattttccacatgcaaataaggtcactatatttctctaaattttataaattgcatctgttttgtttttaagtacaggtcaagtgaagttcttctgctgatatgttctgctactgcataagagacggaatctatgttgcctcgactggtcctgaactcctgggctaaagcgatccttctgccttggcctcccaaagtgcgaggattataggtcttttttcccccctctgctcccacaccacagcaatcaacaacacagaagacaacttctgcaaccctatcgggagaggaggggttctctccaccaccaggtgagcaatcagttctgcagcggacaccaactgggtgtccttcaattcaattctaacactatctacctggagacagtgtcaggttgagggctcagtccccaagactgccccctcaacaggagttgcaagtctggcctcaggaacttctgactgacaggcttcaaaagttgggattctcacaaacccatctttgctggagcagctcacagaactcagggaaacatgtttaccagtttataatagaggatattaataaggatacacatgaagagatgtgtagggcgaggtatgggagaaaggatgcatctatcaagtaccatgcactgtgctaggtactagaaatatagtgagaagtagaatagcctttgagcttaaatggcctcccactccttagtctactgaaatagtcacctaatgctttattcccaaatgcttgtctagctgcatcgtgaaggacattcaacatttcaaattcctaggcctcactgggaatttgaatctgtaaattctgattcagtagatctaagtcaggatcccaaaatctgagtttttaaaaacttccaagatgcatatgatacgtaagtttgggaaccactagctgatcattattgctaaccactgttactctgctttaatttctttctgaaaccatcaccataaagatccttccgaagtaaagaaatttggcattatggcctgattaaaatcccattaaatgtacacaggacaaggtctaattatttaaaaggaagccctcccttacctagttccctgtccacctctttatcctcatcattttccacattcttcagccacactgcagttactcaaaagcaccatagtatttcctttctggcttgcttactctactccttctgcctggggtaccattcccaatatgtggcttggtaaatttat

SEQ ID NO: 2827 - DNA, 3114 bp, Homo sapiens
ggccaaactaaatactcggtgcagcaaccctcgcctgggtcaggtcaatcggctgccagccggattggccggcgtatcattccagaatgtactgtttgttctgtggggtttaggagttctacagtggttctgccccatctttctaaaaatacaatacagtgtttcactatgttacccaggctggtcttgaactcctgggctcaagtgatcctcccactttggcctctcaaagcactgggattacaggtatgagccaccgtgcctgacaactattaatttttagacaatcatttcacaataaattttgaactattttgagtaattaagggctaacttgttcaaatactcactagcacataagtcccttaacaataagcattttaaaaaggaaaagggcctattatgaagtttctggtgaaggatatgatattaaaaagccctcttgggccaataattaattattgctgcagtttcaaattttctttcttttttttttttaaaaaaaaaaaacagtggaactcctaaggacatcttgtgaatatcaaaacaaataaaatgtccactgtggaacagagagtctcagtttctctgccctccaccaacccccagttcatgagaagcagccctctaattcatctctctcccacaaaaatgttgcattattcatcttatcactgaaagtttttatgctttaatatctccccatttcccccactcccagccctaacaatcacctttctactgttcagggaatctaatatacagtatggtaatgacagttaaaataagcagagaataagaagtctccatcagtaaaactcataaaattttttttctctatccaaaaacaaaaccaaaattttatttttattttttattcttccataagttattggggtacaggtggtatttggttacatgagtaagttctttcgttctttcatggtaatttgtgatattttggtgcacccatcacctgagcagtatacactgcaccgtatttgtagtcttttatccctcacccatctcacactcttccccccaagtccccagagtccattgtatcattgtatcattcttacatacctttgtgtcctcatagcttagctcccacatatcagtgaagacatacaatatttggtttgccattcctgagttacctcacttagaataataatctacaatctcatccaggtcactgcaaatgctgttaattcattcctttttatggctgagtagtattccattgtgtaaatacatatatatgtcacagtttctttatccactcattgactgttgggcatttgggtcggttccacggttttgcagttgtgaattgtgctgctataaacgtgtgtgcaagtttctttttcgaataatgacttcttttcctctgggtagatacccagtagtgggattgctggatcaaatggtagttctacctttagttctttaaggaatctccacactgttttccatagtggctatactagtttacattcccaccaacactgtagaagcgttccctgataaccgcatccatgccaacatctactgttttttgattttttgattatggtcattcttgcaggagtaaggtggtattgcattgtggttttgatttgcgtttccctgaccattagtgatgttaagcattttttctttttcatatgtttgttggccatttgtatatcttcttttgagaattgtctattcatgtccttagcccactttttgatgagattgtttttttcttactgatttgtttgagttcattgtagattctggatatttgtcctttgtcagatgtacagattgtgaagattttctcccactctgtgggttgtccgtttactctgctgactgttccttttgccgtgcaaaagctctttagtttaattaggtcccagctatttatctttgtttttattgcatttgcgcttgggttcttggtcatgaaatccttgcctaagccaaagtctagaaggctttttctaatgttatcttcagaatttttatagcttcaggtcttaggtttaagtctttgattcatcttgagttgatttttgtatgaggtgagagatgaggatccagtttcattctcttacatgtggctagccaattatcccagcatcatttgttgaaaagggtctcctttccccactttatgtttttgtctgctttgtcaaagatcagttggctgtatttgggtttctgggttctctattctgttccattggtatatgtgcctattttataccagtaccacgctgttttggtgactacggccttatgatgtagtttgaaatcaggtagtgtgatgccttcagatttgttctttttgcttagtcttgctttggctgtgcattctcttttttgattccatattaattttagagttgttttttctaattctgtgaagaattatggtggtattttgatggggattgcattgaatttatagattgcttttggcagtatggtcattttcacaatattgattctacccatccatgagcatgggatgtgtttccatttgtttgtgtcgtctatgatttctttcagcagtgttgggtagttttccttgtaggggttttttgactctttggttaggtatattcctaagtatttaatttttttttgcagctattgtaaaaggggttaagttcttgatttgattctcagcttggttgctgttggtgtatagaagagctaccaatttgtgtacattaatcttgtatctggaaactttgctgaattctttttatccgttctagcagctttctggagtagtctttagggttttcaaagtaaacagtcatatcgtcaggaaacagtgacagtttgacttcctctttactgatttggatgccctttatttctttctgctgtctgaatgtcctggctaggacttccagtactgtgttgaagaggagtggtgagagtgggcgtccttgtcttgttcccggtctcagagggaatgctttcaacttctctccattcaatattacagtattatgttagctgtgggtttgtcataaatggcttttattacattaaagtatgtcccttgtatgccgattttgctgagttttaatcataaagggatgctgg

SEQ ID NO: 2828 - DNA, 5878 bp, Homo sapiens
cacaaaaatagataatctgaacagttctatataatcttctaatgattatatatgtataatttaaaaccttctcaattagaaaactccaaactctgatggcatcactggtgaaatccaccaaatatgtgaacaaagaataatatcgatattatgcaaatttttcaagagaacaatgaaagaatactcccaactggtttcatgaagccaacaaaacttgacaccaaagcctgactaaaacattagaggagaggaaaagtgtaaccaatcacaaatgtgaaaatggatgcaaaatttctacatagaatattagcaatctaattcagcaatatataaaatgataatgcatttgttggggggcaattctcagtgagtctcttccatttatgcatgtcttatgaatagaagtactgactgacattttttccaggctatcttggcaagagaaaaattttgaacatagaattggtatctcctcctgataccaattttgctgctgagcaaaggcaaacatgcaggacaagtgtggttctgaccattataaaagatttaaattccttacgatcaaggtttctctcctgtaatgtagcgatataaatgatattacaataggcaataggatcaagtaggtcccaagattcaaaatggattgctcccactcttagtatatgtgcatttctgccacaatagtaactacctccaacacacctagactcctgggagttttctatgactagaccacgtgtgaagggttgcggccaacaggtttggggaagacctctcagaataagcttaaagtatgagcatatatacatcccatgaaaattctcaccagaaggcctctagtacagtggttcttcataaccagatagataaaagatggtatgccctaggagtatgaattaaagcaccaggaaataaaggaaagtttattcatggatccaccaacatggattaattcttatgttctgtactctaaagactttgttgatggaactatgtaaaggcccagtccctgtgtccccatttcaagacaaaattgcagggccattccagatttagaactccctataggggctggccaaggactttgcatgattgtttcacaacttccttccagttctcatcctttcacccatccagagctgatggttcctagagcacccttcaatgaacatcctacacacaaacctatctccaagtctacttttcaaggaatctaatttatgacacaggttagacacaagctggatttgagttttatttctctatctgtcatgctatatataactctacaatctgtggtgtttctgaaaacttcatcgtggaatcttatgcaatattgctcctgaacaaggagcagacttttggtaaaataagatgtacaatgggctaaatttcatgggattcactaactttatcatctatcttattgcaaagtaagccgcttagaataacaatgtatgctccaaaccagaaacaacaaataatattgtttcttttatagccatatcccaagcatctggaaaccaagcagttgacataagagtgaaaaaatgaacagaactatcatgccaaaatatttttgtaatgcgtaccttctctgctcaaatatttcagagccactttccaaatttacttgcttgttcaagtaataacccattaataactttttactccatctttttaacttttggttctattggtttgaaggttttgtacctgtgagatttgtgcttccaagatggagcaatgccaacttaatgataaattgagactgcagtttgggggtctttgtgccaaaagactattgtgaccatgaaatttggaagccaagcataggataccaggagaggttggatagaagcaagatttatcagaattagccttggaatctctgactcaagtatggactatcatcagccattagcaccagacaaaatgcagccactgacaatcttctgggatgccgctaagtatacttgacctaacaactaccagtaaaactttctgacatgtgctttgattctagattatcaactaagaattcagggaaacattctactaaataacatgtcctatgtaagtgagataattataacagcctcctcactaggttatgggcccccaaatttgtacttttcagatctttcttctacgttgcagtcagacacagatttgatcacgccacaccattgctcagaattctttggatgcaacttactgcctataggatgaagaccacactcaggcatttccttgaatgctgacacaatcctaccccaacctacctcacgatcttcctactgcatgcatgctcccttcagatctaattggctttttttcactaatgcctgcacttgacctaagtgaagattctgaagcaggagagaaactggttttctaggcctatcttgagtctcttttatcattgaccatctttcgctaccacaaaagaatcatattctattgcacaagacctagtgggcctcatttaagattttgaacattattccaacaaaattcctaaaattttaagtttgtacttatatcataaagctagaccttgcatttaaaactcacctttagaaaacttgctttaaaaaaacaaaaacaagtaattttgatgaatttggaaattctgtgacttaatcttatctgttatctgagtaagagtttaagcaacagtgacactggaaaataaaatgatatttatgtataaaacaatgataatactatagaatgtcatctttcagggtaacatttgttgagttacagaactgattcattgattgcactaaagttataccattgaataacttgcatggagggaaaccagaattataaccacgggtaaaaattgatatattagaggtgaattttggaagaaataaaaatgtagaaggcaattataaggggagcacttaaattaggtatgaatggtttatgctattgattaaagcattttaaaaatcaataaaagaacactttgtaccaagtagctttcaggaactttcagggaagaccatttgattcagttcaaaagtcagaagcctctgccctaacaggtaaaaagcgtggttccatctcctttttaaaaataaagcaaataactacaatttagagtctaaaatcaagcattaatgatctgctccagtcattttttaaagaagcaagctatattaaaaattttgatacttaatgtgaaaattatatttttatttatattttactacatgctgttatcttctaataacaattcatgcctaatttatgtgctccccttctaactgctttctatttttttgcttcttccaaaattcatccctaatgtatccatttttacctgtggttgtaattctgatgtcccttcttgcaagctattgaacagtataaattttattatcatttttaaaatttttttatgcgttgatattaaatgtttatatttgtaaagtacatgagatgttttgatacagcatgccatgtgaaataaacacatcatggagaatggggtatccatcccctcaagcatttatcaacagtctaactgtcatgcagttataaacttcttaggagaaggatctcttgtgttatataaattataaaatttaatgccatatccttgtacaaggtaggctaacaatgcctactttgaattgtactatattcattcaagaagctttttaaatctcaggctttctgactctttgttctgcatttctcccctttcaactaaagaatatattttataggtgagctacaggtggttgtatgtatgcatctgtcagtcttattcctaggaacccattcgtgatagctctgccacatccatttgacaataaacgactcaagttcaagaacgctaactgctttcttgtcaacttctctgaaagtatgtttaaaacacattttcctgactcatacatttagcttagccaggtcaccaccaggcccggccttgaaagcagcagatgttgacgggttaataaaaaaaagagtatcatgagaagtggtgaccaaagccctctgctcaaaatctatcctaaaaactatggctgacatacttgtgaagtatattaaatgagaacctttcttgctatctaatttgggctgaaattccagagccaagaactctaagtaccctcacattctaaaatgagttgcagagtccttgcaggcattcacagaaggagactccaaacagccttggtgactcctaggtatcacctaccctaggaaaaacctacactgccagagtttggtgcagcaggacaatgggtggttcctttggaaagggtgacctcaaagaagactttggttctcttggactttgcatgaaagtaacagccacaggacaatgtgaatccaacaaataacatctgtggaagtggacttccagaattcaggcatcaagtcataagcaactggccaaaagaggcagcacctatgttggaaaaagtcagtgagaagtctcaggaaatgtgtaacagtgtgtgcatgtgtgtgtgagtctccaaaaacttccccaaagattcagggaagaaggcaatgatttgaatattcaataaaacccaaaggtcacttctgtctcataaatctctctctgaacctgtttccaactttggagaagccagtggcccaggatgttggaaaaaaaaaagtgtggaaaagtgagtggggacattggtaaaagttgaactgtgtcttccctaagatagggaagcaaagaaatcagaaatgttcattcgaatgagagtttgggtgtggaatattaaacagaactactctttctattaactaaaatatgttactgtttattcatacctgagagtgactggaaaagctagaggacctgcaagagataactcatgggtagagaaaaatgaacaagcagctccaaatgatattgaaaaaagaaataaagcacttttggaattttgtctctaatacaccagtttgttccataaatttgttgtatttatttcttagttttgtctaatgcttggaaggcactgttaaaaaaaaattatctatgctgagccatcatacctgaactatcagaactccttcagttgcaaaacaaaacaaaaaacaactcaaactagatttaaaaatagacaaatgtcttggtccacataacttatatggcttcgtgcacaattgaatccagtggctaaagtaaaccattaggattttcttactctgtttgtcatctctgttggctctctttatgtctcctacagatgctttcctctctgtgattttgcatctgttattcctcagcaacaaatataaactattagagaactttcttggatcatgtgcctatcactaatgcaatcactggaaacaagagaagggggtctctgattggccacctggtcctatgcccacctctatgatgatggtggcactggtggcaccatgactgatgttctcaccaaacccacatggagttgtggaaaagtggatggctggaactcaaaagaaaagtgaattgctgtaaccagagaggaaggtaggcaaaaacaacagatattccctacaattacctaagcttgttgtacattacagtgcatagctagccagctgggagtctaggattaagcttggatttctgccctcaatgagtaaaaatatctgggtagaaaacagaagattgcagcaaaatttcccagattatgttctatgatgttttaagaatagattcacaatttcttttacactcttcccttccaacagaggaccattattctgtcctcttgagggtgggctggacctcatgactcacttttgataaacagaatgttgtcagcatgatactatttgacttctgaggctaagtcattaaaaaaaggatagtttctgcttgtctctc

SEQ ID NO: 2829 - DNA, 1315 bp, Homo sapiens
ctttggctatggcagcaaggctttctggtcagtctggaaatcagtagctggtttcctttcagacccatcaagtggccatcctattggcttggactgaagacccccactggagaactgtctctgcagcctatactgatgacactggccactgtccagggctccaccccaaggagtccaagccccagacatttagccttagagagaatccagattttgcatttccagtgcagggattgatggagccttgtgtatcaaagtgccaatttctttctaacaagctagggaggataccgttgacagcagcagaaaggggtagcagtggtttgctttccaaatggtaataagaagggcctggcagtggcaacctgtccacgtatcattaaaaatggactctcctgcttcgtttggaattcaacccaatgaacttgaataaactctggacaatgaccagcacagagccctaagcaggatacagcaagattatttgctttactcatccactgagtacctaccatgtgccaaatactatgctatatgccgagtatacactggcaaataaaacagatatggtccctggagcctatgaatcttaccccatctagccacaaataataaaaataagaagaatctgaaggacaagtgggacagaaatactcaagcagaatgagggtgagattgaagtccctgaacatacagtgccctttacacttgatcttagccaaaaggccgagaagagattacagtgctttttaaaggtagcatttcacccagccaataatcaatccctttggccttcttgaggtgcaaggccacacactcaaattctttaatcaaacaataggctagtgcaaatggagctatttcttaaacccagctgtttacacagcagctacaaatctgttcagaaggaatcccccaccatccacaactgtctatcgagcagatgtgcaagagtatttgtctctcaccaccagggttgcagtcaggacaagagagcaggtttgaacgtcttcggctcctagaactgcacaagctgtgtcttcagtgcccagaggcggctgcaacgtctccccagttctcctctcagaacaatggaaattttttttagaggcgtaataggaaggtttgcattgaattattaaacaatgggtattgaaaaatatgttttctttgacctctgtacttctagcttttaccagtcagtgttttcttgtaccaaggctaagatatgtataacactgaaatggatgtcttcttatataatattttacaagcttttgaaaacctgtgccctttaataaattttaaaacgttt

SEQ ID NO: 2830 - DNA, 22315 bp, Homo sapiens
aagcaagtcatttggccagagctgcatatatcagaaaggaggtgtctatttctcctgcagggaggggcactgaatatttgggacggtctttttccaggaagataccagctctgcctaaaatatagcagttgcatgcgatttagaaatctgacaaacaggattgtcagaaaagatctgaaggaagctgccatgtggggaattgtaattttttcccctaaagattatttcatgcttgttggatccatcatattctgaaatccttttgctgtccaacaaatattgataagtggaggctattcagtcacatagttcttaggcatatcacgccatagctccctgacatatgcctactggctgccttaattttctcccaatttgtagctccatgtttccccatcttcctccccacaccccatctttttctttttttctttttttttttttttttgcccttcttcatttcttctctggtctccaaaacccagatgactgtgacttttctgtgatcacttaagattttcaagctcctccctcaagaggctggtaatttccacttggagcattttcctactattttgtccagctaagcagtaggttcttaggaaaactgtgtgtcttggagaatgaatttccatcagaggttggagtgcagtggtgtgaatatggtttactgaggcctcaatctcctgggttcaagtgatcttcatatctcagccttctgagtagctggggctacaggtatgtgccaccacacccggctaatttattttattttattgtaaaggcaaggtctttctatgtttcccaggctggtctcaaactcgtgggctcaagtgatcctcctgccttggcctcccaaagtgctgcgattacaggtgtgagccactgcacctggcctctactttatttgttttcatatttatctgttccactagactgtgactatctagaggcagggactctatcctgagcatctttggatctccaagcctggctcagggcttggcatgaggaagaaactcaataattagttgaataaatactgaatacattgtaagaaaaattatttgtcaaaaaaaatcagtaacctactacttacttattcatttaggaaatacttgttgagtccctacaagatgctggatgctgttctaaacagaggatacagtggtaaccacaaggctacagtctattggggaaggcagccaacaaatgctttcactcattcgacatttattgaacaacaacaatgtgccagacactgtcctagattctgggggttcaataatgaacaagataaagccactgccctcactgaacttacatttgagtgagcatgttttgcccttaagtagccatctttaaagctgaaggtaagcacaggggcaccagtttttttagaaagcaaagcaggtctgtggctcctgatagatgagaggcaagcaggatgccactttaggtcatggaaagacaatcccctgagctgattggaagccagaacttggagtgaatgtccttatgggtcaagggtgtctttgctaaccacatctgaagcccttggcatcgggggattgggatgggtcccaagtaagaaaatctgagcttttcacacttctccaatgacaaagtcttacacacagtaggtcacttaatttctgtgggattaagtgactcttaccagtcatttatcaagatgtgggctcctagaaatggagcttgagagatgaagggctagatggagcccagtggagctctggcagaagaagggggataacattgccttgtttagatgctctggatttttttagagcatgtgtcattggctctgcatgctggaaccagccttttctgggaagctaaagggtagactgaacccagcattgtatcatattaatattccccattctcctaagctttgggagtctgtattcctcttatgtgtaagtaccaaattgcaggggaaatggtatttctctgcatagaaggaagtaccttccatgggattttccagggatggaaggctggattccaggtctgcatttctcccacgttggtgtgaggccttcaggactcaaatgaatgaagtaatctcttagtgtccctttcaacctcgccattctctcttttgagacatttctctcattcccaggactttggccattgcagttgggctgctccttctctctcgtgcatctttggccaccaaagaagctgctgtgaatcagtaggattggttttaagcactggcgtttggagacagctgcttactcagtgtgattttgcaggctcagggaagggactttcctccctacgcaagtcccaaaatacctcctttatcagtcttttggtgtttgggactgctttactgtggacaaagcctttcattccacaatgaaggatcaaaaatagaaatgaatgcacatgtgtttggcattgcccataacaagctgttcttggccttcatgctgttgctcgtgctgtgccctctgccaggaatatcctccccatgccctcgtttcccttatactgatcctttaagagtcagtttaagcatttcttaccctagaggatgccgtaattggtttctcttgattgcaagaaacagagttactcagagtagatcaaataaaggctggttgagtggggttgtgacactcggaacatgaaccccaggatgaagatgaggaggggacctaactctctgcttcgacagtctgtctcccctaaatagactttcatatcttgaaagtaggggctatgtcttactcgtttttgaaagctcagacctagcacaaagcccacctcttaatagatgtttgttgaataaatgaatgaatgaatgaataattgaatcctaagtatggatagaagatgtgggttctgtcttttagaaatttatagtctagttgggaactagaaaataggtaaaaacctaagtaaacaatggttaaaaactggtacaaagcttgcaagacaaacacattaaaggcatcttggggggatgagatttagttagcagatagccctgagaaagacttcagttcatactcacatgcaattgactaagatgtttctgagtgcagaacacagacttttagttgagaaattgaagtgaacattgaactaatgtataatttcctaaagggtcccacaaaggatgactagggacagtaaaagggagccagggaagcctcagagtaggactcagaggtccttattacttggccaatggttggcctgccccatcaggtgccttagagcccacgccaatgcccctggactcatgagtgacccccgtggccttatctgagtggctgatctgacagagcaaggtgtgtgctttgcgcctgctgagttactgccagctgcctgtggtggataaacaggcaggcctctgggcggccctcaggactctatagtgaacaaagaaagtcgttcagatgttttcagattgtattgagttaaatcaaaggccaagagagcagaggtctttgcagttctttgttgtagagggtggcccctgggcgagtcccttatcatactctcttctatttagatgtgtttctttgaaccttcccgcagaaagtgatgccctttgacaggctccctcagcttgccaaggataagcagtgtgcagttgtgagggattcccagggtctcttctcccataacatttattgtcagtcctgcctacctgaaacttcatcttttcttgtactcaaaatagagaaagtgggtgcctaagtgaacccactgagcccagccccctcaatgaggaaactgaggctcaagaaaatgaaactttcttcatattcatgtagtgctttgagttcatcctgttttgccacatatgctcacgtggttttccatttccttcattaaacagccctttatgaagggcctactgtgtgccaggcaccgtttaggcattggatgggtgtatgggtttggctgcaagttacaatactcagccagtagtggcctaaactcttaccagaaaggggtcccaatccagacccccaagagagggttcttggatctcgtgcaagaaagaattcgaggcaaatccacagagtaaagtgaaagcaagtttaataagaaagtaaaggaataaagaatggctactccataggcagaacagccctgaggactgttggttgcccatttttatggttatttcttgattatatgctaccaaggggtggattattgatgcgtcccctttttacaccatatagggtaacttcctgatgttgccttggcatttgtaaactgtcatggcactggtaggagtatagcattgaggatgaccagaggtcactctcatcgccatcttggttttggtgggttttagccagcttctttactgcagcctgttttatcagcaaggtctttattacctgtatttgtgctgacctcctatctcatcctgtgacttagagtgcctaactgtctgggaatgctgcccggtaggcctcagccttattttacccagcctctattcaagatggagttgctccagtttaaacacctctgacaaaacaatgcaggcattcattatctcatctaaaataagaaagaagtccagggctgtggtccttagaggctgtagggtccacagctcagcagtgccatcaagaaccattcttggtgggtcagtgatatctcccctcagatggcaagatggccatcatagcccccaacaacatcctaatgctcaaagacagaagcaagacagaacagggaccttcactttgctcttttttttttttttccataggggaagaacacctttcctagaagtgcccaggtgccttcttattataacccagtgaccatatctggatcacatgcctgtttctagaccagtcacaggcaaaccagaatgggatgccataaatggctgccttgggccaattgtgatgtgctgttcatgggaaaagcagtgagtctatcatgtccactaagagcacaggctctggagcccgatggccacagttcaaatcatggctccatcacttctgatttatataaccctgggcaaggagcttaaccttttgttcctcagttttcccatctgtaaaatggtgataatgatacttcacaggttgatgtaaggattaaatgtttaatgtacataaggtgcttagcacagtacttggctcacagtaaaggttaactactaattatctattgtatatttcaaaggagctagaagacagcaattcaaatgtttctagcatgaagaaaagacaaatatttaaggcaatatatatcctgagtatgatgatttgatctttacaagttattcaaatgtgttaaatgatcacatgtatccccaatgtatgtacaactattatgtatcaataaaaaataaaatttcaaaaagttaaaaaaaataacgatcatcctcaagactgagcaatttcttgcctgaataaaatcaggaaaaggtcctaggttttggatggacaactccagtgcctgccatgtgcggttgccctccggttcacagacaagtaaacaagcaatgttgaaatcttgtgccatggtactagatactgtgcgccgcccccctcaacaggaggggtgcctggtccagacttgggggatgtcagagaaggcttctcagaggaggtggcactgatgtaggttttcaaaatatatagcagtggctcggcaaaggcagagtgtgggtgggtgggaaaggaaggttctccaggcagaggcagcagtgggcctagagacactggagcgtggtgctctgtggtctatgtaggacaagtacacacaattgattgtgcccagagagtgaagtgagaacctggggtggctctagacgtatgtgctgccaggctggggcgggcttggatatcgagctaaggggtttgtgtcttttcccacaggctatgaattttgagctgaaggtagccctagatttttatttttggtcagtgactcaggctgcaatgagaagggtggatggggggcggtgggacccatgtaggaggctacagcaatattcaaggggactagggcaacagcctgaactagggcaggtactggagggctggatagagagagagagagaccaagcaagaaagtaagaaagtgggatgggaaaggggggaaataaatacaggcaggaggatggagagaaatggaggatggtgcattcaaatttggccaagttggatctaggggcagctggagatgtcagcaggccctcacatgcacagagtctgaagccaggagagagacctgggctgaagacagcaggtgcagaggttatcatcatggaggaagtagataatagacaaatacttgcgatagatgaaattgtcccgggaaaatagaaataagagcaacaaccctgcagctctgagcatggtttggattttgccaaaatgttctgttttgtttggacgctttatcaggctgggtatggttcaaggcctgtagccaggcaaaggttttgtttggttgctgtacaagcagctattgtttaatgctcagcctgctgggtgaatttctgcacactgcttgtggttattcaaatctctaagccctgatgtggggggagaagagaggtaggttgaaggtggatccctatagaacaccagcattaacagggcagcttgaggaggagatcaaagggaacattagggaggtgggaaggaacacacgagaatgtcccaggacccaagggaggtcatggagtgcacttcatgtgttagtctcttcaaatggactgaggatcctagcagacgtattacatatttctcttcttcccagcagagtcccactgtcagctatttggtatattaaattatattgagaatctatattaacttatagtaagaatcaagatccacagtagagaggatggggaagcagtttatcttcctgaccatcccctgtgggtggggttgatgccacaggttctgggccacacagagctgagattgagaactggctgtctgtgtgatgttgggcagcttactcagtgactctgggcctcagctacccaatccatcaaacagagatactaacacctaccctaaggatgttcagacaattacatgagatactgcatgcgaacattcagcatatatgaatcctgtccagtagcaagtgcttgctaactggtaatcactatcgccctgaggtccttttctagcacccagctcaagattggagctctagcatcatgttttgaaggaagaagggaaaataattttgctagtgaaaaaaaacctggaggagcatgggcttgccaagagttaagggagcaagcatagaccagggtgtgaaagataagcagagagctatcttgggaagagctccgttaggactctcaacaaaggcaacatcacagaaacaaaagcaaaaggattctcaatgaagaacagactggccacaggaagctggttatagagagatccaaaatggaggcggaaactagtatgaagaactccaagtctgggtcctacaactattctgtatctttgctgtttcttagcaattcaaatgtttctagcatgaagaaatgacaaatattttgtcattttgtctttgtggagtctgctctgcctccttgaccattctgtcatgtttatgtaattagcatggtagaaagaacatgcatattggagtcagagaactctgggtttgagtccctgctttatcacttacccacctgtgtgatcctgtcaaagttatttaactccctgtgcctcagtttcctcatctgtaaaatgggctaactcacttcagccagttactatgtggtgtaaatgagattagtgtgcataaactggctggcacaatgctgacgcatagtaggcactcagtaattatttttgcctcgtttttccttgtgccgtaagtaaggaagtttctattgcccttgagaagaaggtcttaaaagcatattttgtcctgtccggaaaacccgttctgaggatggaaaattttgctgatgagtgaacttggaaggatcatgtttccagggtcagggcagaaaggaagaggcccaagccctggggaaggaatggcatcagggcacagctttgtggtggtgacccacaaccgcgggcccagcaggccctgtggaactcccacattgacttccctatctatgaaacagtgccagtaactcagtctcaatgcttccttccccttccctgtcccctgaggatcccgggactgtgaactccagttgtggcggctccgtagcacctcctctgctgcctcccagaggtcacttccaggatggccgtcccagaggagccctccttccaagatacaaatggccttggccccgcttcacctgacccaaaggccgattaagaggtctgtgggggtccggagggatatctctcaaagggcccctcccaccgcccaatatatcgtaactcacaattgtacagcacttggaagttgtcaaaaacgcttttgcattccccataatgtaggcagggaagctattttacagaaaagggaaatggagcctcagagaagagacctgcttctgacagcatggctaataaatgttggaaccaggacttgaacccaggaactcccagcccagggacattctgttttataaatacggagggcacaacgttccatccctttgacttgtaattagtgggtgttgtatgtatggttatgagctttacccatattttttggtgctaggagggaatctgtcttccttccccactactcttcctctcccacaccactgtttccttgagtctttaaaaggtgtcctgaagtacagaactccaccccccatctcctggagggcctcactgacccacctgtggttgcctctaacacccaggcttgaggagtgaagccatttcccaacctgctaatggcactgctgggagctcaagaaagctatgctttcaggtgacgcattgtcatgccggtctacacgaacatctctgtcccctgtaacagcatctgccatagcagcagcccagctcaaatggcaggcaaaaaaacttgtctggtgcattccattagagagcaggaagttaccagcattgattgaaattctcaggtagagtgagtaccaggtggcatttgaagaggataatttaattcaatagtttatattccacttaagttcctcctctatctgactgctagtaaacagctgtaaaccgcctcagctgtcttagaggtgaagaggaaacacagtctagaaagtaaaatggtgatagcaggacagaatctcaagagaccaaaaacccctgggaaaataggcataggtggcctggtgtgtgaagggtgggtgtaggtgcaggaggccccattccctcctgggcccccactgtgcaatcatgagctcacaatcaatgatcactgacggttcctcctgctctgaactccacactgttactggggagctcagtggagtggggaaggaagctgagaatgtggattcagaaaaccagagctcaaacctggtcttggctcttacttcttgcaggacctttggggcaatccacactgtctgtctccctccagggtgcaatgagaggcaaaagaaagaacgtatatgacagcgtcttatgcccgagagggccagttggatgttagtagttactgttgcatcgttattggaacagagaagcccccaaaggcctgcttcccatcgttctccttgcccaagggctgggaatcctgcaggagggccagatctgtgctcaatccaggcaggcagtcaccctatgatttgaaaactgtccaaactatgcccggcccagcaaagcttgcctccgcataatggacctgttgaagcatggtagtctgttgccttaaaagggtaatggtgacattttctcagcccctgacacctaagcctccttcccttccctgattggttggttggctctcaccttaggaagcagagaggagacccctgaaacgggtgggactaggatgggtgaaatgtaatcatcttgaccatcctcaattcactttctcctgtgttcctggcactgttctggggtggggtcacaaagcagcactcatgtcatctctccatttattcctccattggttcggcaggcactgtgagagcattgcctatggcaggcgctgaggacacagagatgaagggcgtggcgggagctcaggagcctggcatctggctggtgggcccggcacacacacaaaggatctaagtcctccagttgggcttcctagttcctctataaccagaagcgaggctgcctgtgggcacctcaggaattctgccaccatccagttcctgctcactgcttaaaaagtctaaataattggaaaaaagtgatatgatctgtttaatacaaccatctagttaaatgccacagagttcacctactcttcattgtcacaggtaaactgcgatgtcttcttctgtaacggtagccctgtgctgacacagtctcgggttgctttctgtaagcgtcatttgagttaaatatgtgaagaagtgggaaggaggggcagacagcctcactgcagggctggacccccatcctgaggatggcctggcagccttgatgatggtggctagttgcatgtgtgtgagcctcagccacatgaggaagacgtttggaatgagggcacgtgaaatgatgggtccagcgtcgctttaggggtggggagccattgctaagggaggtggtgagagctgagttcagagtatctgaaatataaactctaagaaagatcgctcctcaccaacccagtctaagtcaaaaccatcgcacaccgggactattgcaccggcttgtggtccgtctccctgttcttacccttgtacctcaccttctgccggctgtgtgtgacctgacttgcttccctcccattctttcctagctcattctgccccatccctgggcttcccttcacagattaagtgcatcgcagcctgccctatgccctttgcacctgcacttctgttggtctagtctccccctcccgaacattagggccctgctcaaatgtcacttcctcagacttccccacttaaaatcagaccccaacaccattatatcccagggcctagaaaaatggcaggcaagtagtagggattgaaggaatatttgtgaaggaatgaactgccctaattaaagggggttggggaaagagacctcaggacccaggagcacaagtttggagaggaacagaggacttgtgcaccaagatgttgcctggctactctctgggtgctgagggggagtggaggtcatggagagaggtggggaatgagaggtatggggtgcctgggtcagcgtggctggcacccctgctctccccagggccctcctggctgaggtcatacccgctttcccagcttcccttcacgcttctttcatttccaccctaccagccgctccacaggactaatgaataatgacaggcctgtaattagactgacattggagcctgcgttgtcccagatagttgctctccgaggcgaaggtctggtctcagctcccagctggcacctcggcttttccctccacatccttgctcacagccttgacttcctgcaaagtgacttgcctcccagatcctgaacagtcagataggaaccagatgggatgttgggacatcctgtgtggcacagaattggagagacatggagctcctctcagctggtgccagcatgtcaggcagagacagaatgagtgaagagcccagggctgggatcgtggcactgttgcttcagctcccaggtctcaatttggttttccataacccctcaaaatgttggccaagatcagccgttttgtactacgcatttggaatactctgggaatgcaagttattgagttctgcatgaaaccagaagcagcaagaagattgtgatcatcacctggttggcaggttttcaccaaggtctgtggacacctgtggggcttctgaggggagcaaagggcacagtgcctagcacatagtaggtgctcactcattattgactgacagacttgagaaaggtcttagcatgaagcacatctcagtgggaggaagtggccaggacgtggggagctgggacacttgtgcagacaggccagggggtggctccaccctgccccttgaagcctgctcttgttcctcctgggaatacctgacagcagcaattagcaggaggtcctttagtgtccccctctccactgcatgcttcccccactaaggcagggatggtgcttcatctgagtgacacctcattcaaatgggaatgagtcctcagtctcatccagagtggaagaagcactcgttgtctcctgattctgctttaagaccattgccatcgctctgacgagccacgattgtcctagcctcaatgggggacatcatggagaagaaggtgggcgcaatgagtcacgcaacagcagaggctgaggaggggagcaagggccaccagaaaccaagaaggaaccccagagtgaaccccactgaaagaaaaccaagagtcacagcacagcataagagaaactcgtgtctcgctgaagtaatgggaacttcaaatgtagctcttctaggagtggggatctgagcccctccatcaagctggctcaaacattcagcatgtgcattgatctcacgtaaggagcagtccagagcagggaggggcttcagggcctcacagctgagagcagcaaaggcaggattggaagctggctaacaggtctgggaccctgacatgtagcggggaggcctgggcaccttcctcagctcaccctgctcagcacaagcccctctgggcctcagtgaggcaagggtggcatcacagcctctgtggagatgggatggggctgatggcctgtgtccttagctgtaaggctgaccataacagggatgtctgtgggggaagaggggaggcagccttcacagaggtctggggtggatgcagggaccaagtcttgaagggatatctggaacaggagcaaagtgagctatcgggaaaatggggttgtgggggtaaaggacccaggcctcagggcagggcagatgccttatgaactcaaagaccacaaaagaaggaaagaaatttcacagacaggggcaagtatttaatatctaccatctctttaatccttaacatagccttgtgaattgacgggagaaaacagacagagaaccgttaggtaatttgtccaagatcattcaactgggaagtagcagagctgggatttgaacccgtgcccagagccattgtttttctacttgccagattggcgagggtcatgggggaagctgctgctcagtggacatgggtgtatgtgagactcaccccatatgcattagatgtcacggctgcagaattgcttccagactccactggctggccagttgggagcccagaactttgcaggctatcttgacccaaactggttgagggtctggatgggccaagggcagatggaaggttctcatccctctgagcagggctggcagaggtggcaggagccatcaagggtattagtctttgtttcagtaaagtggtttatgcattttgtgagcttctcagcaaaacaataaagcagtttatgcatttgtgagatgcggatcagaggtggaatttcctttcttctcaccaccatgatccactttttatttcatttttatcctgagtgtgtcctttctgtttctcaggcggcttccacaagcaacacctagccttttgggagtcctggtgtgctgtcattgtttacttgatttctcaacacctttctcctgcctgaagtgctgcctaacaaggattttaaaaaattatattactgtgatttcccttgctcttttattttctctcttttaacgtgaaaggaaatatgtctttatgcaatccccccacctctcatcttggtggggtgcttctcatcaagtaacaatcctctcacacccctgaaggtgtaaccagaacagctgcaggtggggccaggaagggcaagagtggatcccaagatcctccaggttgacacgtcactcctgaaaacattctgctttaaacagaagccacttcgctgctctgacgtgaatttctataaccaagacatactcttcgacctagagagatcaaggcatgaaaaaatggaacttctcaaggatgaggaaacagactttgagaggtaaaataacacgacggaatctatgcactacctgatggctgagctgggacttatccccaggtccagtggcctctagagcacaggtgtgttactaccaccccattctgcccaagtgaagcaagcagcagagaaataatatgcaggtttgctttccaaggaacccaaatgaagatagaatgactcaaagagaagatgtatagaagtacttacagcatgtggcacatggtctctgtgcctgggcaccaagcagactgtggtatcaattacagtggaccctgtgcatccctcagccatccaggcaggtgcagacactcctcaggctagggatagcctcaggagactgactcagccagaaggttgccctggagaagaccaggtagtccctgttggcatgctcagaggacgtgtagatctctcatggatggtcaggacaatcaccagtaccaggatatctggatcaggtaaaagatattccaagaggaggttcagttcagaaggcaaatggggcagcaatcagcactgagatccctgttcatacacaatgggtaagagacccagggacctaattcagcccaagggaatgggttcaggtggcgtctgggtgagaatcagggccagcgaccatcatctgggactgagaggacaactcaattcagaggcagaaattcagatttcttgaggggcaatctagcatttatctttgaattagcatgaattcttatagaaatgcagtgttgctttatatgtatatgattttgagtttacacaaatagtacagtattatgaaccttgttctgtatttcactttttaaatcctagcactgattttttaaaaacattttctttcaggtatatttgtttatttatttacttatgtataacttttatacagtaacatgaaaaatattaagtgtgtagctcaatgaatttttaataacagctttgttgagatctaaaatctcaatcactgatcataaaattcacagttttaaagtttcagtagtttttggtatattcacagttgtgcaatctttaccactgtctaatgcagaatatcttcatcacccccaaaataaatcctgtacccattaacagtcacttcctgttcttccctgctcctcacccgtgcacccattagtctactttctgtcttatggatttgcctctgcctctgtggatgttggatatttcatataagtagaatcatatatgacctttcatttctggcttcttttacttagtataatgttttcaaggttcacctatgtcgtggcatgcataagtacttcatttctttttactgctcagtaatattccattgtatggatataccacattttgtttatccattcttcagttgatggacatttgggttgtctccacatttaaggtattattgacatgaataatgctgctatgaacattcatgtataagtttttgtgtggacatgtagtttcaattcttttgggtgtatacctatgagtggaattcctggatcacatgctaattatatctttaacattttgaggaactgccaaactgttttccaaaatggttgcaccattttacattctcaccaggaatatatgagggttccaatttctctacctccttgccaacacttgttattttctttttaaattatagctatcctagtgggagtgaagtggtatctcattgcacatttttttttgcattttctgaatgactagtgatgttgagtattgtttcatgtgcttattttagtgaccatttgtatatcttctttgaataaatatctactcaagtgttcattgaattttgacatgtgtcaagttaccctcgtgtaactatcacccaaatcaagatacagaacatttctacctccctagaagactcccctgttcttcttcccagtcaacttctttccccaagagtaactattatccatttttatttatttatttatttatttttgagatggagtctcactctgtcgcccaggctggagtgcagtggcacaatctcggctcactgcaacctctgcctcccgggttcaagcaattctcctgcctcagcctgccgagtagctgagactacaggcgcatgccaccacgccctgccatttttttttttttgtattttagtagagatggggtttcaccgtgttgcccaggctggtcttgaactcctgagctcaggcaatctgcccgcctcagcctcccaaagtgctcggattacaggtgtgaaccaacatgcccggcctgagtaactattattctgatttctattaccatagactagttttgtctgcttttgaacctcaaagcaatggtactggatgaggttttttttgtttttggtttttttttgacagagtttcgctctgtcacccaggctgaatgcagtggcgtgatcttgactcattgaaacctccgcctcccaggttcaagggattctcctgctttagcctctcacgtagctgtgattatgtgtgcaccaccatacccagctgatttttttgtgtgttttggtagagatggggtttcaccatgttggccaggctcgtctcaaactcctgacctcaagacgtccacccacctcggcctcccagagtgctgggattacaggcgtgagccacagcgcctggccatggatgagctctttaatatctggtttcttttactcaatacagtgcatgtgaaatttatccaagatgttctttgcttttttggtcattactatgtagtattccattgtatgaacatactgcagtaggctcactcattctactgttgaggttgatttgggttggtggtagttttgggctatcacaaataaagttttagcactttgaaaagtctgttcattcagctggtctctccaagagtacagattagctacctgggtctcagatctggctgccaccagagacttagtgatggggacacacctgagaacccagtggcagtcaggctgggatgctggtcctcagtctgaggagggtgagccagttgcagggtggtggtgtggtggcatcaaagtgctgagctgtgacttgacagaaaaggtgaaggtggaggaggcagggggtttgaaggctggggagcaaccctggtggagacaagactgcagttactcacttctagagatgagtcagagatgagccaaggggcctcacctctcccaaggaactttaatcatgcagtgactggcatggggaccacagacttgcactcatgtgaagggccccctgggcataacacagaagaacacagtgtgcatggtgtccctggaactgggctactcgaccctgaaggggcatggacatttgtgggaccacaagcaggaaagttccagcattttcttaggcttagctgtgtctatgaaggtaaaaccaccaaacaaaatgagtattttcctagtgccaatgcagagcctacccacgcacagtccttgggcagatcaaggctgtgcgtgttctctcagccagaactgcactctggacatgagctacagggtgacctcatgagggtccattgcggatatgcacatggatgttctgtgtagtgatgctgtggcagctgggattggaggcaacacaggtgtccatcgttagaggaatagagaggtggcatgtggcagaacctcctgcaaactctgagcagcagccagaatgatgaactccatctgcacatagcttctctgctagacattttgaaatagtgctgaaggtaaaaaaaaagcaaagtaaaaagaacagagtctgtaatgcaataccatgtgtatgaattaaaaaggcatgaatatacaaatctaatctcagggtacactacaaaagatagagtggttgcctatggtgggggtggtgaagggtggtaatggcaatgtgggtgggagaggggtcctgcatgatgatctgagaaggttgagtgacctggccaagacacttaacactcacatacctgcacagaaagaatgggagggaggaaggaagaaaagaaagaaggaaggagaggaggaaaagagaaaggaagatagagaaaaggaaggaagaaaggaaaaaagaagggaggaaaggaggcagggaaggaagaagggagaaaagagaaaggaaggaaaggaaaatggaaggaaagaaggaaggaaggagggatggaagggggaagggagaaaggaagaaaggaaaacagaaaaagaaggaagaaagaaaaaagaaggaaaggagggagaaagagaagtcacttctgctctctcagacttgctcgaggaccttcactgaggtgggggctgccagtgtaatgttcaaagttgttgccatttcccaggagtttctggaggggcagggagggctgaacggtgcgattccaaccacccaaggagaagggaattagcagtgctctcctcctctcattaattgagcactcatctgggcgggcctgggcttactaagtttccagttcatcaagattataaatgagatttctcctccttcctgtggagcaggttgagatttatactgcatcctgggcaaaggattctctgggcttcatcttcctttctggggcttctttctttagaaaggtgggttgggctcccttgaccagagaaatcccaaagctgagagagtccttctgcccacccccagccctcccccaggcaggagttggtcctgtgagggaaacaggttgtacctaagcttctgccattttctgtctcatgtctgtccctccatatgccccctccctcagtcctgcccccaccctacctcacatccctcagcaagctctccactcagaccctagctccagttctggggaggggaggctggtgcagagtataggggatagcgcaagtgctcttcaggagccacagacagagatctgcttaccctgagcacatggcagctggggcgttcttcttgctcgcctatttgtgaaggtctacccagaggaaatgggctatggcaccacaaaatggtccaactggaagtcaaacatgagacactagaaagtatcctacaggctgcagtgcttgggacttgagacccctgccaggaatccccaaggagaaaagaggagttcatggacttgtggccttgagcctcttgtgctgtcacttatacccatttccatagaattacagagtgtcggtgctggacactagacagtgtaacatcgtcttgtccaactaccactcatcatgtagaagggatgtgaaaaggaaggatgcttcccagggaatgtgggaacagaaggaagccacgtctccctgtgccatcctagactaccgctgtgtgtgtgtgtgtgtgtgtgtgtgtgtgtgctcacacacacacgtgagcagctcctgccttgacctgagcctagagtgttcctccttggaaggggaccctatttcacaatccatctggtcctggagaccagtggggctaagttttgtttagggatggggggagaaagcaagtgaaggagagacagagaaagagatgaaaagacagggacaaagacctcttgacagagagaaattataaaatagggcaagaaagagagagaagagcagacacagggttggagaaaatgaagaaggaggagccagaaagagaggaatgaagggtgaccagcagaccaggcagagctcacagcccaccctggcatggtttctctttgcagagggttgctctccccatcaccaccctcctagtcattctctggagcccctggtcataagtgggtattagcttagcccagtgcttgtgttcaactgtcatccaagctgagcctcccttactgcacccacaactacctggttaagtaaagccttaaggaggggtggcagggaggaggtccatgtgagccagtgccctgggtaactcccaccgtcttccttgctttcttcctatgcctgagaccagagcctaagcaagccagtgtgtgctttggccccagaatccctgttgggggcagcaaaggagatacaaagtgatggaggaagcacggtggtagccctgtggcttcagtgaccctgtgtgagacagaaatcagggttggactggaagaatggggaacaggtatttcctgcggtcctgctgaacagtggctcaaccagtccacccaaaatgtcagaagcagagaaactgtaaacatgaacagcggtgccatagcaagagctggcctgtggaggctggcactgtgagcccaggcacagcaccccaatgtacaaagagcccccacttatgagccatgtgagggcaggcaaggtactttaacttccctggcctcagtttcctcattgtgaaatggagctaataataataacctaacagggttgtagttatttaataaaatatcccagcactgtttctgttccctagtcaatgtacaattcacagtcttttcccccattccctatgagaaggcacgggagcttctagactctgggcagagccccagacacagcagtcaggatgctcagatggagaagaaaagcccttaaagctctctgtagcagctagcgctacctgtgtttggaaggcagccagagccccacagacatgcatgggaacacccaggattgtaatggaagaggtacaatgccaatcatttaaatttaggtgttcttggtgtcctaatttgatggaagggtaaactgaggcagacagtggggaaacgatagataatgcagagtgaacaagtcttactttggaaaaaacagtttccctggtgggagaggaagggagattgtgctgtgactatcacccaactcaaatgtggaacccaagatgggcaagaagctcaggtggggctaatgctgtacaaaacacctggttagctccgataagcagctgtcccaagccaggactctgccccggctgcactcatccagcccggaggggccatcagtcactcctttcttcttgctcactctgtcttcatccccagctgtcaattcatgtgtctcaaaatgacacgagttaaacatcttaaagaactagggatttatcatatggcgatgtcaactcagaaagcagaaccagggatttgtatctcagtagtggatgattacagttttcttggtgctatgaaagccctatatcctcatgtgtcatgatctgattaataggcagtgttggggttgaattacatccccccaaaagagatgttgaggttctaacctgtgaatgtgatctttttggaaacagggtctttgaagatataattaaggtaagatgtggtcattagagtgggcttccaccccatatagctattatctttataagaagagaagacagagagagagaaggaagatggtcatgtgaagatggaggtagaagttagaattatgcagccacgagccaaggaattcctggggctaccaggagctggaggagacaaggaaatattctcccctgaaggtggcagaggaagcatggtcctgccaacaccttaattggcaaccccaggaaatgaatacagtaggaaaaaaaatatttaagtgggaggaaggaggctgggaggaaggagggaattctgtttaagggaaccctggaatctcttttcttctacccccatgtctttttctattttctatcctctacctcctttcaactcttcagccaatggatctttaattcttaatcaataagcatcggtgtcctgcctccatgtgcctggctttgtgaaggaggcagaagcggcacagcgacgtgagttgaactccttgcctgttgacctctagcctcccgaaggcagttcttgggagtgggaaagggtgccagctccagggtcagagcacctgggcccaaatctcgctgtctgggtgacctcaggcatgtgattacatagcatgagcttgcttcctcctctgcaaaatggggaaaataacacacctattttgtgaggttctcttgagaattaaatgagataatacatgttaaatgattagtacaagcaatcaatcagcattaattattgttatgactgttattattagcgtagggaaaagaacatgaacagcattcagctgactacaggataaagtgtgataaatgctggcacaaaggtgcagatgaagcatttagagaagaaagagagatgaattatttctacccagaaatcagggaaggctttgtagaatcacagcatttgaatagagcctgaaaggacgggtagatgttacccagtggagaaagggg

SEQ ID NO: 2831 - DNA, 2934 bp, Homo sapiens
agatgatgaaaatgttctgtctattcttgctttggaatttcagataagagtagtcatattacaaagcagagataaaaggagaaagcaagaaatcattcaattgctggtaaagtaatactctacacagcaaatcacaatagcgtgttatatatagaaataagatcagtcactgttttcaagcctgctaaataaaactgaactcttggaatggcataccatttgacctttcaaaggttctccagcagtatttaactgatgcaaaaggaacacacttgcaattttctacttttgacatgacagaccctcctcttagttcacacaatgttcaaaaggcacaagtccctcgcttcggaacgcaagagagcattactttcccaaagagctacacggttcatactgaaggatgatatgagaaattttcactttttgtcaaaacttgtactctcagcgggccctctaagaccaactccagcagtcaaacattcaaaaacgactcactttgagattgaaatatttgatgctcaaacaaggaaacagatatgtattctggataagaggtgacacaatcatctactattcatgatgttaagcaaaagtttcacaaagcatgtccaaagtggtacccttctcgagttggtctgcagctagaatgtggcgggccttttttgaaggactacattaccattcaaagtattgcagcttcctccattgtcacactgtatgctacagacctaggtcaacaagtcagttggaccacagtgtttttggctgaatacacaggacctctgctaatatacctcctcttttatttgaggatcccatgtatatatgatggaaaagagagtgctagaagattacgccacccagtggtacacttggcttgcttctgtcattgtatacactacatccgataccttttggaaaccttatttgttcacaaagtttctgcaggacacacacctttgaaaaatttgataatgagttgtgccttttactggggatttacttcttggattgcctactacattaatcatccactatatacaccaccatcatttggaaacaggcaaatcacagtatctgctatcaattttctgatttgtgaagctgggaatcatttcatcaatgtaatgttgtctcatcccaatcacacaggaaacaatgcctgtttcccaagtccaaattataaccccttcacatggatgtttttcctggtttcatgtcctaactacacctatgagattggatcatggattagtttcacagtcatgacacaaacactgccagttggaatttttacacttctgatgagtatccagatgtctttgtgggcacaaaagaaacataagatttatctgagaaaattcaattcatatattcatagaaaatcagcaatgattccattcatattgtaaaaaaagaatcttatctcctatagaaaacagcaacatataaattcaataaataagacttagttaaggatagttaactattatactccaacaattcatgagcaacagtatatacactgagtaaaaatataaaatagtaaaatttcactaaatttagagaaatgcacatggtaataaaaagtataaattataaatgcaattaactaagaacagctctgaatgtatttgcatgggattggtccttgaataaaattgtcttacttcattaatacttcacaatactatttgcataagacaaaataccacagcaaaaaaaaaaatctgattaacaaatgaaaaagcgatctgaacagacatttcccaaaggaagacatatacatggtcaataagtatatttttaaaatgctcaacattaactattcatacagaaatgcaaatcaaaaccacaatgagatatcatctcatcctaattaaggtgactattttcaaaaagacaaaaaatatgacagccgtggtggttcatatctgtaatcctaacactttgacaggccaaggcaggggaattgcttgagttcagaagtttgagatctgggcaacatattgagactctgtctctaaaaagcatattgagactctgtctctacaaaaaaattttaaaaagtaaaaattagctgggcgtggtggcacatgccagtaggtagtcccagctactcgaggttgctccagctcaggcgttcaaggctacagagagccatgattaaaccaaggcactccagcctgggtgacagagtgagactgtctcaaaataaaataaaaataacatattggtgaagatgcgggaaaaaaaaaagaactcttagacactgctggtgggaatgtaaactagagcagccatgtggagaacaacatggactttcttcaaaaattacaaatagaactatcatatgatccagcaataccattactggaaaaaggaaatctgtatattaaagagacatttgaaccctatgtttactgcagcactattcacaatagccaagatataggagcaacctaggtgtccaacaacagatgaatggataaagaaaatgtggtatatatacacaatagaatactatgcagccataaaaactgaattcctgtcattcaggacaacatggatggaattggagggcatatgttaagtgaaacaagccaggaacagaaagttaaacattgcatgttattacttatatgtggaagctaaaaaaattgatatcatagaagtaaaaaataaaacagaggatactacaggctgggaaagctgcagcaaagggagactagagagagatttgttaaaggatacaaagttacagcttggtaggaggaataatttctggtgttctataccactgtaggacgactatagttaagaacattatattccatttagtttcaaatagctaaaaggagattttgtccccaacaaaaagaaatgataaatatttgaaaccatggatactctaatttctctgatctgacc

SEQ ID NO: 2832 - DNA, 1848 bp, Homo sapiens
tctgtgtgcatgtgtgtgtgcacatgcatgtgtgttcacgtgagtgcatctcatctgtcacccacaaccaggggagcggtgcttgtacaacgtggcttctgcaaccagcagcttctggccgtgcagctccctgtagggaatatgagttaatctggatgtcagcctaagatgtagtcagggaggtaagtgtgtgggaggaggccacatcccctgtgcctcaagccggctgcttccacagctgcctgggccagcagcctcgccaggggccgggagcagggcctgggccccccctcttactttcctggctgtgttaccagggccctctccgccctctctgagcctcagtttcctgtgaattaagggcgttgagcccattgttcctgaggaatcactcatctctgagcctggcccattgcctggcattccgtgggcacccactagatacttataaggggagaagttgttccagtccggctggccagtggaatccatgcgtcttgggccatttgaagtgagtgaagggctgggtgcggcccacctggagctggactggaggctgtgttgggtggggcggtgtgacctggaggtgggctgccccctcaggagacagcttcacccctgtgagtggacctcatccttccttccttccactcacatggacagcacatctgtgtgtagacagggtaggcctgtggggggagtgggacagaagccccccccatctaggacctcgacgcagaggctagtgtcttggggcagaattatccggtgtggggggcctcagttccctgggctttcacttgcctcctgaactcctctcccctcccatcctcacccccagagtggtttttgggaggcacccctggacgcctccctccctcgcagagggtcctggtttctgttgcctcttagaacagtggccctccctgctgttttcccaacagcacccgccgtggtctgaggacactttcttctgctcctgtttattgtttatctcccccaagcacaagcagtcgagttaagacaggagcctcgttcaaagttccgcccggggccaggcacagcgcaggctctcagaggagggcccaggaaggctgcggcggcgcgagacaaaagtcggaagacaggaccccgcttgaggagacagcggccaaccctccgttccgcctggtgccttgctctgaggaggaatttggtggttcagtcggcccatccgtggacaccataaaaacaaagagacacacacagatgcacacatagatacacacagatacacacagacacggatatatagacacacacagatacacacacgtggacacagacacacacatagacacagatatatagacacacacagatacacacacgtggacacaaacacacacagacatacccatatatatgcatggatacacaatacacagacacacagatgatacatgcatagacagatatatggacacacacacacggacacacagatacacacatagacacactgagcctccctgggccctcccttgtggctgtcggggagggcacctggagaggacacacagccccatcagagaccagggagtggctctgggagctcttttcgtccaaaggggctggagctccagttagccaaggtgagcgccaggtggtgacaggaatgacagcagggagggctgcctgtgtgaggggattgctgtcttagaccacgtggcccaggaaggcctccaggcagcacagaagctggtacctgagggctcagccccgtggaggcctgcggggtggaaatgccaaggctggggcaggggcatgtctgaccgagaaggcctgtgaggtgggcattgtgtgagg

SEQ ID NO: 2833 - DNA, 2882 bp, Homo sapiens
ccgcaatgccaaaaccagaatatgcactggattcaagattttgttccaattgtcatattttaaactagaccccaatgaattggaaggatgaccaaatgacagccctgtttaaaacttcaatttctaaaagcaaaatcaattacagaaaaaaatattacagagggattatgtgtgcttatgagtgtcttcatgtggtctttctccaagtttaaccaccaaggactttgagagctggcaggtctgagtaaccctggagacaattcactttatcaaaacctgagctaaaaacaacgcatcagctgatgatgaccgcagagagtggcaggactgaggacccaatatttgttttccagcctggtggagagtgaatagtgaggttccaaaactaaacaagggaggtcaggaaaactttccaaccttacctaatggcttctggccaaagcaaggaagtgtcatggaaagtgttgggtggtgatggtgcaaaaggaacttgaggaggagggaagaaaaagcacccctcaaagctggggaagagaaaatatggagaaagccctaaattcctcattgaaggccagtctcggaagtggaggggttatgatctgtgcttcagtcaaagtcatcattgtgcagagccttgctgatattctgtgacagacccgaatttactacacgtgctctgaagcgatcaccttttctagagtttcttctgcctgctttcaaattggatgacaagaagcaaagaccaacagatcctctagaccagtgtcagaaatgagagcgaccttcgagagaaaacatccagttccagagtgaccagactttcaggataggaaaactgaaaacaaaattctgagcttgcttttattttgctaagtaaggatgaaaatttttttccacttactatcactatttcataaacgacaggatgttttaacactgaaaacaaaggtagaaagaatcaacttttaaactgaatggcttcaactctacaaaatactgtatttgttttcttcacctcacaatagcctggtatttgacaaccactgatgtggtccaaccccttattataagatgaagaaaaaagttcataggaggaagtgttttgcctgaggttacaccaggccagccttttcctggctttacagggactaatcacccttgggttccataggtcttggaaccaaatgaactaaggaagctctaaagatgaaggatgtgttggtcatctatttattgcctcacagctccaaatgcactcttcaatacctgtaatatacaagagaattcctttaaacatttctccactaaagggagtgtgatgttaagatttctcagtagagggcaatggaggcacattccaggagaaagaggcttccccaggtttctgggcgaggctggtgtcagccctgtgagtgtgaagatctccatccagtggagcctgccccagccgtgggaccagaaaaaccatccatctacaaccttacagcctcttctcatggtaacctttccatagctctcttgacatggaaaccaaagctcctgcctggctcacacacaggtacttttgcctagagggtcatacacaggataaccattccttctgcaagtttccatgtggcccacaagctctgaagtcctctgccctgctggtgtccaggctcctactgcatgtccacaccagtggctgctgactgactgcctgctctccagccacactctagaggttagctgttgcttacctagcaactggtagacccgccctggcctggccaaaccatctaacattgctgcttatccagtgggctgagacataccttctccaacgaggtctgaactcctcctttgagtactctctctgaaccctcgcatactgtataggatttccttttacctttttttttttttgaaatggagttttgctcttgttgcctaggctggagtgcaatggcgtgatctcggctcactgcaacctccacctcccaggttcaagcgattctcctgcctcagcctcctgagtagctgggattacaggcacctgccaccacgcctggctaattttttgtatttttagtagagatagggtttcaccatgttggtcaggctggtcctgacctcaggtgatccacccgcctcgacctcccaaagtgctgggattacaggcatgagccaccctgccaggccccttttatcttatagatactcctttatcatagttaatagttctttgtattaaacttcgattttatccactatgtgatttctatttcctgattggacccagctcactactgaagctgagcatgaagagctctgtacagccttctgaaaaggcacaaagacaagaggttgctgtttgatgctcaaaagattcatgcttaaaaaatgaaaaaagaccatttcttctcattctattatttaacaaattcatacaacatcattatttatgtgcaaggcactttgggagataagtgcataacttggaacaagatgggaagagatcagtgccctaagatggcactgataggggtgggattttagctggaagagacagcatttgagaaggactttcacagataggaagaaatagaacatacaggaggaaaatcagagggggaagtccagatggaagaaacctccatgccttttgctcagggcaaaagttgctgcagaggtggtaacgtggaatgtgtagaacgtgttcacctgtttgttccatttggctagaactttggatcatgttcttggcaccaaaagatggcatttgttttgccattgccaacctttatcatatttagcaagaaatggtaagacctataggaaaggaagggaccttaggaagttatctaattaacagtcaggctgtgaacaatcttgaatgtcac

SEQ ID NO: 2834 - DNA, 1771 bp, Homo sapiens
cactatttgccaatatctatttaattgtagcaataacaggaaaaactcccaaatccaaccagctagaaattctctggctctcttccactttagtggaatcaaatttttgcacttgcggtcatctttatatatgagaggagagtgaggctgggagaaacttggtgttaaaaataaagcaaagttacagactctcactctctagagctcatggaagattctggctttttattattaatgattagcattgacaccatcccccaacctcaagagcatgctgaggatcttcagggaactccagcttgatctgggcagctgccagggttgacatctatctgaagattctgttctcctcctgcccatcatgtcaaggtaccatgcagggtgagtcaaatgcaaacagaaaatatttagaacctggccagtagagcagaagtcaccgtgaagattggacttggttgtggtgttatgggatcctgaacagaagctaatggcagctgaaaagaaaaccacatgtggataaagtagaaagatcatcagagatgagctaccgatggtcttttgagttccatttgaaagtaatattatggagaggctgggggagaaaaaaagagtaaagtagtgacgaacttggcaggaaaatacaagaagctgagaccatgtgaattggagtatttgggggacactgaacatgccaggcatttctgcgtagaacagccaaaaatcacccaacttcatgattccacgttgtcttacctgttcggctcatcatgtctaggtgaccagaggcaatgtaaccagaagaatcaaatgggaatttttattaaggaaaggagccatggccttgacttggaaaacagactcaaacaccagcgctcaagggcaagatgaggctcaaagtggaagaatgagcatgaagatcggaagccagaagaagcagcgatgagtagagatgccgcacacatacatgatcagcacaggcagtgcaggacaaaatcatgaacaagatgaaagcatgaacacccagatgaatatggtgccagtcacagtacaggaatgacgcatgttctgcaacttcaatggcgcaaggaatactggacctggatggttgatataataacatagccataaagtataagaagcagatgggattgcctcaagatgataattttgattattcaacattgttatgttcataaatacatctttgtgcaacatcttcatcacagatggcagacacttgacacatgtgcggtcagtggcagggattactaattgatcacagttgttttttccccaaggcttggatacagcctcaaaattcttctcaatgtagtcatccagtatgttacagatagttcgctgtaattggtatataaagacaaacatatatgctatcctaatctatagattatagatattgatatggtttggctctttgtccccatccaaatctcatcttgaattgtaatccccacgtgtcaagggagggacctgctgggagttgattggatcatggaggcggttttccccatgctgttctcatgatagtgagtgagttctcatgagatctgatggtttaaaagtatttggcagttcctcgccacccgcctcctgccaccatgtgaagaaggtccttgcttccccttcgctttacaccatgattataagtttccggagacctccttagccatgcagaactgtgagtcaattaaaacttttttcttcataaattacccagtctcgggtagtcctttatagcagtgtgaaaaca

SEQ ID NO: 2835 - DNA, 6865 bp, Homo sapiens
agcctcggaatgtccagcaagggcggggccagcctgcgaggccaagacctcttttcactgcatcagaagtttaaatccagttgagccctctgacttgcacctctgtagtggtctggcctggggaagactggctggggtggacagaaggagggcgggaccctcagagcaatcacccctgacctccaaccctggccaagaagggccagcccctgcctcagcaccttctctctgtaggcggtttctctcccaagacatttgagacttttgccctctgcctggtcaccttctttcctagccaggatagggctggtggatggttttttccttaaagccaattccaaacaagggctgatatttagttggcctttctttttcttctctcatggttttgtgggttgctggcactttagggactctgttcagagtggagcctccttactctacagctcgctggtaagccctggtggcccatcagcccacagaagggggcactcactcaggtgagtatgaatattcacactccccaggataaatatagactcgaaataatagtttctagtcagtttgggtcagattttcccactcagtgacaaaaacaactttcattatccagagttttgtttgagttgagaattttgaataaagggtggtgggtctgcatcaaccacagttacaatatgcaagagctgggtcgtgacttcatccctttggtcttggtgggacatcaccctgaccggtcccattgccacctggcacatgatgcacctcagtcgtcagcgtgtgcccagcccagggccatgcagagtgagcactcagggaaggcgcatggaactggactgggtggctggtgtgtttggtgataggttagctctgctgtcaaagccaagcccaggtgggtcactgtcacatacccagcacggtgtgaggagctcctccagccactctcaggggcagctctcctgaccctgcctccttgattttggaccaggcgcttttgtttctgggccaagcacctgcctgtagcaatgggtgtggggacttgggttttgctttgctagtggagaatatggctgggatctgggttagggcagaaagctcaggtagatgacaggtgccagagcagtggttcaaacttgggagaatcacagcaggagcctattaacaatgcagattccagggccgtttgtgtgattgtgaggcaggtggccccaggattgtgctctggttgggtggaccaataggtaaagcacagtgtgatgagctttgggatgggggagaaggaaggggctgtaacccagggagagtctggggtcaaggaaggtcacccagaagaggtgagctgagtcttgaagaacaaagcaggaatggtaataatagctaatcttgattgaacgctttgtgccaggcacagttctaagccttttccatgaatttcagtcctccagacaacccctgaaataggtagtaaccccagactcacacaggaacagacaaaagcactcggggttaagttgctggcccgaggctagtgagtggtgagctaggtcttgcctgcttattgcacggcaccacgtggggtaaggtgtgccaggcagcgggagcagctcagcacagtgatgcaggtgtgctgttcagtggttcagatgatgcagaacctagtgtggggggactgcttcagttctgctttgttggtggagaatatgtctgtgatcttggttaggacagaaagctccgggtggatgacaggtgccagaatgtcagtttgagagggctgaggctggagctggcaatcgggatagcaggcacacttcctcacagtctgaactggaaggagcgtggagtgttggggagaagatgcagtgtcagtgcccagggtgcagcgaggcacgggctggcaccctgacccagcccccttcccagaggggaagaattcgctatggcccagcccctgcccttggggtctgaggggatccacttttgttaggagcctgctacacactttgctttctttcgatccttacattgcccttccaggtgggcttattattcctattacagataagagagctgaggctgggaagccgagtaatttacacagggtcaggtcatacagcaagttagcaggtagtggtgccagcagctggctgtcttttgtggggatgtgttttcaccacagcggtggcaacctgtgtcctgacaggccaggttcctgcatggacagtggggcccccaaagagcaggtgcagtgccaggctggacagattccagctgtgccggggccttgggcaaagtggcctggagacacgtttcctgttgctgggtgacattccacaggtgggaggccaggacctcattccctaggggccttcctggtctgggccctgatgccctgagttgaccctctactgccctggaggctcacctgggcctcgggacagaagggattgtcccattaaggagaatcctctacgagtctctgattctggaagctcttgttttttatcctcccatacaaaaaacaaattggccaccagtccttctttttggccactgtctcaccatctccttcacccaaccttggtttctttcagcctgtgcttcccagcagagcctgtgggcttgttgatttgaacccagaaaccacctaggacattccagaggtctgtctttgttgcccattgtaggccgttttcatagaagggtattgggaggacctgccttcccactcaggccaatgtgaagctgttgctcttttgctaagggcagggtgggatatggccgagaattggtgggcgggcctgagatccattcagcagcaccccagggcgtgctgtttctcacaggttgcagcctcttccagcccctttgctttctgtgacagagctgaaagtctcatttcctctttggctttctcctgtctgtgtgccgttctttaagatgggctggagagagtcggggcagctcttctcccgggttttcaggcctggctggtgtttttgcctgaatcaggcctggcctcaggcctggttacaagaaggttggaggctggctgtcttgtgttcatgtgtcacgccaggcctgagaccatcattgtctctctgagatggtccacgcccctcctgtgaacacaggggctacagactatagtccacgttcccgagttttgggggctgattccaccagctgggttctgagttggcggcccggcatcggagaaaattgtggtcagtgtcgggtgagggaacaccagcttcacctcggctcatctgggcgtggcagacgactgcttcctcacctggagagtgttcaaggacagcaagaaaaatgagggactttcaggggcagctgtgttttctgactcagtcataatgcccctaaaaatccttattgttcttgcagtgtgcatcgggcagcggccagcaacctgcctctcacccacctggcccttctgggaggaccgggacttcctggggtcagattggaatgtacgtccaaaataagagtgaatggggatttgctgattattaaaacaattttgtttgcgtgcatttttagcatcttctcttctgggagggtcgggatggagcccaggagggtggcagtgaaggggaaggtcatcttccgggtcagtgatgttagaggcaaggacaaggagtagaggaggctgtctgagacccagtagccattttgagagggtctttccccctctactgtgaccctggagcttgcttttcctccatccttatttcacttcatggatctcctccattctcagcccctacccctgccctatccagccccaccctgcagatattttgaccagccaaggcttttggaggtcctgggggattgtcgagaagcagaaatacctttttttaaatttaaatcaatttgtgatatgcctgccttccccaacaatgccagtccaccaaacccgaagcaacagaatcctgctctccaggggagactgggggcttgcagttggacaaagtgacaagcaggactcgccccagtgggtccactctatgtcttactgccctcatgggtcagcaggggaagtttacccttgggtctctaggtgcagctcaaaagctctcgtcacttgaccacgtgtgctcagcatttgcagaagtccaactgccacgatcttccctgcagcccagccctggctctgtggacagttttgaaggagctgggtttgctcaggagctttctgctgatggctttcttggtaaggacggacaggatccccgatcagcttccctgccatttgctcccctcaaccatcccctcccatggggcccctttctcctgcccttcattcccctgaacctccttgttcttacatgtgttcctcattctttaccacaaaacatttgcaaaagataatacagattactgttttttcccaattataaaataattgccttctactatagggcatttgaaaaatacaaagggcttccccacccagttagcaggattgggacttttaaaagggtcaggctcataactcatttgagcaatggccctgtgccctcaggccagaaagcctttattttctttttaccaagcaggatatgctgtgggccgctgctggcctctggccaggaagctcagtgatcttgctggagggtgtttgagcagcaccaggtctctctaaaccaggattgatgaaattgtcagtgaggatgccggacaagagggctttatcccgtctgatttataagtgggcggctgcattgcttcttgacctggctgcacagaagaatcacttgagagcattaaaaacatgccaatgcctggtcccatgcagattggatctgaattgctggggaatgaaagggtttttttttttcttatgttcctcagtaagcaatcagaggagaactgttgggttaaatgcccacaagctagagatggaagaggttccttcagaggatgtgaccatttgcagttggcaggctaaggggatcgggggacttatctgaagacacagaatatggcagagatgagatgtaaaatacacaacttctgaccctccagattagtgctgtttcagtagtactagtcattagtattcatgatgagcatatggatcataagaagcatattcttgtgcttaataataattggacacttggtcatcacagtatgctgaggcgtgggtaggggctgccccagcagggtgagtcatcatcccctagtttcccaatgctctgtgtcccctggcctggacccacagctgcccgcagcctgccctgttgcactaatcccagctgtgggcacggtgagatttggccccattttacacatgaggaacaggctaggcttggcccatgtcacccagctctccttgcctggacagaggcatctaggaaggaacacagccctgcatggggcttgcttgtctgagtcctcagggacagagctctactgggggtgcccaggtctctagcagactgtccctgcccctctctccttcctgcccagctcagctccagaggcctggcctgcgggcaggctgggcaggcagccagcgcagggagctaacgatgggtgcattgtcggctccaggaagtggtcagctgttccctggcaggtctgcagagccggaggaccagcctgccttgctcgtggagggtagagatagaatctgggagctcagaacaccattttcccggagcccagtggctctgggccagccctcgggcttcctttggaagggagggccccgtgtactcctccgctccttccttgcttggcattggccctctccctcctcagtctggctctcaccgtcccccggcccagcactttgcagcagagtgtacactcttggcagcgatgtccattaaacctgcttcccagaaagcagcatggctgtacaggcagattcagccagcaccttagtggggttggaagatagccctaagctgccttggccttcctggatcagaagtgccctccaaggctgagacaagcgctttgacctcctgagtacacttcagcagagaactcagtgatgcctggcatggggaagatgcccagtgaatggtggttgccccacacggctcaggaaatgaagtttgggtcacagcctgaggatggtgccttccatccttgaccctgcaaggacaacctttcctgacagtctcctccctgggtgaagtattgggacagtggctctggactggaaaactgaagctttacctctttgctctggattcccatcaggtctagattgctgaggcccagcgcccacagaggcatcttcccctctagggggtttgtcctataagcccggactccgtcagctccgaggcactcctgctgggcctgggccatgtggaactgctccctcccctgccagcttccttggggtgcagacagcccagcacaggcaggaagggctttctgtttggctggactggtggggaagcaattagtgcttactttctgttttgattcttgtagcaaaagcagccttgggtgggtttgaggtctgtccctgatagtctggccaatgtggaattgtctggaggtaggggtgtatgctgacagggtatgaggtggccatctgttggctttccatgcccccttctgataatacctcttttcttcaggagatcacttctcccctaccctgtatctctggggttctggtgtggccaaccccaaaccctggctttagacactggcatgtgttccaggcctggaggccaagtcctgagactctgccatgggacatctgcagcatttttctgagggagttgctgtattgataggatgtaggctgggaactgctggtggccatcctgtcctcaacttgacaaagccaacaaagaggaaagaaaatgaagag

SEQ ID NO: 2836 - DNA, 1963 bp, Homo sapiens
caggaagtaaatttctttccaagagaaaaaagctggaaaaataattgttcctcttgtttagaagatgacagcttttttttttcttcattaagcgcccttctcttcaaaagacaaaaaagggtgagagaaacttgaagacttcagtcctttttgtatctatgactccggaaaggaaagaaaaataaaccatgtagaacctgcttgctgtcctgtcctctgccagccgttggcctcagtaatcggattcaaggatatgtatgacctactttttgaatcactgcagcccaggctgcgcaatttcttatgttctcttgctgagaaaccaacatacaagcagagattgtgtatttttctgtaaaggtagaggtaggcgcttctggaaattctggaaacctttccaagtttacagcacaaacgaccggaatgttaagaagggcttttgttaacagctacccaacactgtcctggaggctttttaaagagcttatctcattgaagccaaggctggggctagcgagaggccaatgagagacccaggtaattttagagtcactctggagggaagattcgtatcttgaaaaattcttccaggtgatttggacatacctttctgcctcccagccacccccccccgccatggctcatagccacgtctccgggattcctcagctctatttctggatttggtcagaaaacagcctgctctgctggattagctcatctctccatggaaatgccaccctggagttatgaggtagtgttatgtccttggcttttagagagataatataagaaacagacagttgaaaggcatttctgaatcttttgcaaagcctgagatgagggcattgtccattatgtgaccaaatgtcacccaaataaagatttctcttcacaatcgcttataatattcagtgctagagaaaagttcaattctccaggaaaacctgaattctttctttttatagataagcagaattgcagtgcccatcatgctgtcatttattttttcattatcttccaggggattctgttcaatccagcaaatattgaatgctagctaccatgtaatatactggattataaagatcaatagggccagttctgggctctgagacacggtctagggaacacagaccaaaatacattatagctatgctttcctcagatgccttttgtaatgatatctctttgttcccagtagtttctgaaaagctttgttctctaaatttttatgtgctatgttgtatttatgtagttttccccagtggaagacagacttttggaggagttttttgttttatttgtttttggctagttgttgtcctatatttcctactgccctacatccccctttcagagcacggcctctttctaaggctttctggtgcaatgcaaccctcctcgatggccacagctgattgactggagtgaacctgtgacctgaactgggccagtcagatttttcatactggaaatttggcgtcggagccctgagaaacaagtcaggtggtctcgggggctgaagctacccctgtggggtgactagtggaactcctggtagtgagaaaaagtgagatgagactgatgatcttcagaaggaaaagtttggactaaacacccagaggaaagctgaaatgagagaccacatggaatgaaggagaacgtgagtatgagcaagcgaaggtgagaaaaacacacggaagcacatgaaagttctttttggcttgttcctattttctctgtgacataaaagggaaggtctttggtggagagtaggaatgggaagagggtgggcaatttgagaagagagagggtgtgaattactcatcatggagcaggggtgtgaattgactgagggaatgtggttggagggacaaacagcactacaggcacgctggaggtttttgtcatgagtttacatggagacaagtcgtcctagctgcatgctttttctctggac

SEQ ID NO: 2837 - DNA, 1538 bp, Homo sapiens
gaaagttttaagacttttgtgattcgatcagatccttctgcgctcccagagttcaagcaggagtaagcaattcctttgacgatatttgggaacctcgctattcacagtaaggaatccattccttcctccccttctgctaagacttggcatttttgtgattaattatatacgatatggcctcctcatatgctaggtttcagtgttttttccaagctccttcttgcttcccaggacttggtttttcctaaagctttatttttgctgacaatgaaatcttccccctcactgcccagaatctttcacagatgttccctctatcaacagagcagcagctgctgcctggacactgagagcccgaggaatccactggtgtcttttcatcttgacaaatattattgaaataagcaaataactttcaaaaaaaaatcccagaagagtctatgtatgtgatcctttccctgtcactttcttttcaaaacttgtcttcattttgatgcttttatcaccagggataaagatttagaagggttccataaattgcaagagaaagcagtaattgccttttgagttcagcataccacgcaaagccaatgtgaagcatggaatggctcagatctgtaagggatgctttctacctagagctcacatttaacactgagcagaacgatgcccttgcagctatgcctgcaagcagagtgcagcacatctgaatcttgaaatcgaggtccattttgctgaaatgaggctagaaaaccatctaagggaaagttatgttttccaaaaataaaaatggagtttgataccaatctattgtacatgctgtttaaataagatgtgaacacttccatgtgattgcaggttttggttttctgtttgtaatgccttcttgcaattttctcatacctgccggcctaaggttaagaaaggcagatgtctccgatgtgatgtcttttattacttacagacttgatatgtaattttgatagagctaagcccattattaaccttgaagagggtgttgtaaagtaagttaaacagtagcttaatatttttatttgcaggaaacacacacaaaattagatatagtaatatctatttatattaggtatatatataaaataagtaatgtataatgtatgttttttatatatacgcatatatatatatatgcacacacatctataaacaaaagtggaggatgaaatggcctacattaggtgcaaagaaacctgtattctagtcctgtctcaaagataattttagaatgtcatttccattctctctgtttccttgtcaatgtaaaatagtgatgatatcatctgacctacttcctttatagcctcaaatgagaaaatgctgtaggaagacaaatttaaatgtaaagtctgggtggctcctgtgcgatacacatgcaggaagaaatgcatgctcgtcctgcagcagacctcctcactctgtaaacattcacatgattggaggcaagcacgatgtataacaattcagattcatgtcctcccaagaggaagggtggctttctt

SEQ ID NO: 2838 - DNA, 577 bp, Homo sapiens
gtgtgtcccttggcgcggtagccaatttaagaggttaggagcaggactctggggcccaccaatctggatttgaaacctagctcctcctggtctagctgtttgctgaagggtaagttattttatctttctgagcctgagatgcctcatgtgtagagcggggagaatagtgactacctcacagtctgttgcgaggaccaaatgaggtaataaacatccggggctgagaacagtgactgtcaagtagttagcatgcctcgaaggccagccattgccatcattgtgatttctaacatcggctttttcatgatcatcctacagagctctgcgcagccagaaatctggaggcagcaatcttgtctcccctttcaaatccagcacataacacaccacttgctccccacaccaacccacaagtgttgactgaattgcactgactttacttgcaaatgcatttcctgacttcagtgtcaccagacctcatcagtctgtggctatcaaatacattctgttgacttcagtaactcaaaagtccatgtccttgtgatcaccaccttgtgcgttgtctctacccgctccc

SEQ ID NO: 2839 - DNA, 1818 bp, Homo sapiens
cctattttgcactgccaaagatacacctttctttaaaatcttgctatttctcgaactatcacagtatttgctcctccttccacttttgactgtttccatactaatcatttctaaataaaattaacacatcaatttccctataagaacaactcttaccatactatttctgttaaaccataaatactctggaattgcttcttgaattaaaataaataaaattttctttccttgaacttcaaagtttttcacttgatactcaaaacctactttgttcatttcatcatgccaatgacatcttccctgacaaatgtgttattagctggtctcaaatacttccagtctttttctgcttccaggtctctatgtcagaaatactcttctttctctatctttcaatgttaaaatccatcttccataatctttaagatccttctcaaatagtgtctcccctgtaaagcaattccagtagatgtaatctctacaaacttttcacagttgcaatggttatcttcagtattatgtaaaagctattttgaggcttgtcttcttccttttgttagaatcttgcaaattctctgaagcccagactttaagttattcatctttgcatcctccattatacctatcacagaacttaagtacaataggacctcagccagtgttccaggaaataaattaaattgaatgaaatttccatacagtgataagaaggagattactgctgcccacggggaaaaaggagaacagaaatgggaaagccgtattgagaggatgtttgagaactgtgaaagacagaaagcagaccagattgccatgcctaaaccactttctttgaagtttatggaagcaccactgcatttatgccagaaggtgaaagtccagaacaggtgctttttggtttgagaatgagtgttctacatactggcctgtaaggcagtgctactccaagtgtggtccacaggctggcagcaacatcataggggagtatgttaacaatgctgattctccagccccagctccggactctgttttaacggtctatccaggcatgaattctactcaagtggcctgcccctcagcagaagttggacaggtgcttatgttgcaattaacaaaaaggatacatgctgggtcctgcagtaaatgtctcccttggatcatgaagtctttttaccatgttactggaacacagaagatgaacaaactgaagctaaagagaagtattatgtgtgcaatggcatacaaccatctgaaatggaaaaatagattgtgttcctatgagcttccataataccatgtgacttctctgacatatggagggttttgagcctgggaatgaggcattgtctggtactattgagaaccaactaacttggagccgtgtatgagccactgggaatagactaaatgagataatcaacgtcttgatctcatattctttcattctacagaaggaagcaggcaacaggttgcaatacgaagtggagttaaagcaactagaaggaagtgtcagtaaccaagctgagagaggctggaaggaaaacaattcatgcagcagaaaagaaagccttttgagcactgtgatgtcagaaggtgacttggaagatgatctaaatgttaaactggcagtgaagaattaaggtggagacagcaggagtcacccgaagaatggaaggatggtgccaatgacttgaaaaggagtttagaagacaccagtttggcttaggttcctgtaatgtgtaccctctacttgttctggctctgcgaggctcagctaacttaaaacttcagagttcttcaaatcttggaccaataacc

SEQ ID NO: 2840 - DNA, 3034 bp, Homo sapiens
agcatgatagcatacaggataaacatataagagtttcctattataggaacaatagcaataaaacttgagttttatggcaatattttgatgcatagtccagacttcctgccagggtatctcctgaaggggctttctgaaatgagtttcgaggactgtgaaaaccctggaacaccctgactatcaaagaggtggaataaagccagcacggaaattactgaggtttgggaagaaaagcaacaactgcctcttttcttggaagttgaaggctgcatgggggtccacagtggctagaccaagactaaaattataactacaaaccaggacaagacagcagcaaggcatcgtttttcaaattagcatgtctgtcttgtttgtttggtgcaatgccagggatcatgaccatttcccaatttggttgatggcatgtgctctccacgcagtgaaactgacttgcaatgaatctcagtgcttcagtgaagaaactgcatggcgagaaaaggggagatcaataagagaaatgcctggtagtgtctgaggaaatggagcctccatgaaaagaaaggaccatacacaatgaagagaaccatgaatgccaacggctcacctcagagtccccaaggtacttctgtctggtaagtatctcattactggggcatcgtttgtaagagctgagacctgggccagtaacagcaattatcaaagtaggcggtcaaatcacccttggatattttagaagccacacttaaggcttcctttctcctcattctgttgtggatttctaaggagagaggcagaacattttagcaaccacccttgtagtgaattgtgtcacttatctggagaatctggtgcattgaatttatttgctgtgttgggacacagaacacacacacacacacacacacacacacacatatatcttattctcttcaggacacatttagggtgtctccatatcgatttcctacaatgtaagggcacgaaagctgggctgtgttatccagccacagggctcacagcggaccatcataacaaggggtgacatctgaagccaccagtcacatcccactcctttgtcctctcacagcctcttagaggcctgcctcagttactgtgttagctgagtggaattgactgtttcagggaaggaagtgaattgtcatggggaaaaaggctagagagcaggatgccagcaatgtctctgctggtatccttgaaatccacagaatctagagttgccaaagaaatattatagcatgcattaaaatactatatgtctttttttcctgatggccaggaatctctctttggtaagaagatggagaatgagattatactctcaactaatatgtcatcgattccttatattttatccttccagtttcacctttcataggaagtaggacacagtttcaggtgggaaagctcctctcaaatgtaaatacatgaaattttattcaagcaacagtcagttcttggagcccacagctgaatgagctcagccttctctgacctcccagccctggactattgattctagagacatggtttacagtttctaatttgggcagtgccatttagtagctgagactataagcccatttcctaacatttcatagatatggttgcactatacacaaaatggaaaaagtaattatacttcctcgtagattttgtcattattaaataaaaataaaatgtagaaacatttagcacaatatctgacacataatgagtgctcaataaaccaaaaaaggttagctgttgtaagcattactctcaagccaatgcctctctccaccctcctctaacataccaatattctacttgcctttactctcttccatggggttcaaatgcccctatgttcttacttcttttctctcactttggttttcttctatgattccaatctcagcccagttaactcttagcattttctggctcttgactcagtaatcactttatgtcaaaatgtttcctagtctccttaaacttgatcatattccttggttatttgttttctaaggaccatattgctttactttagcgtcaaaatctcagtgtgtttcttcattttatgtttgtttcactcatatgacattaaactccatgaaaacaagaaacaatttcttgctcaccattttcttcccaatgcctggaaagctgcttgactcacgggaggaggtcataaaatatatttggaagaaaatgaatgaacaaataaatgctgtcacctgcaggccattctttattattttcaagaaattctgtaatgacccattacactattttgtctgcatcattcagatcacttttataaatatatttaagatagtataacagcttcttccataatagcagcctctgactgaggtattttcttttaattccatcccttccactatccttgatgtacagttcctattggcaagcttgatcattccttcagtcactccttcaattcaaaatgtgtcagaaatggtactaaaagactgagggtaaaatgtcatcattttgttgttgttgcttgcttatgtgtttttatttgtttatttagttgaggggtggtagcagacataatgcatataataaagatagtaaaacaagtataatctaaataggcaaattcaataataattctcagcacaaagaattgcaagagaataatagagagattctcaacatagtctgggagaatagtgtcagggaaccttccagaaggggatagaggaggaaaagcaaagcaaagtgggactagaggcattgagggcatgaacataatgggactccaagatgattgttgtaactctagtgtaaagtaaggggcagggagactgagtcctgagtccagaacattgccgaagtgagagcctggtggactgtgactattcctctgaggagtctctgctccctcctgagtaacaggcattgccagatttcaagaggagaggtactgtaagattcattttctgttgagcgctgaaggctgtgtggaggatgtgaaggagccagaactgtaggaacaagaggc

SEQ ID NO: 2841 - DNA, 5439 bp, Homo sapiens
cggcttgtgccgcagcggaacttggagaaaggccagctgccttttactgaggccttccgaggtggggctgggatgccacatttttcaaacacaccaccgcaaggcagcacccctcccccttagagatccaggtgactccactgagaattactgcgccacaccgtggcttctagacccacactgtcaagtatgtagtccttgccacctgggctgttgaacctggaaatgaggcttgtacgaactgactaaaagtgcaaaatacacattggattttgaagccttattacaaaaagaaaaaaaagaatgtgaagtatctcattaatgattattttattttggttactgtggaaacaaatattttagatatcttggtttgtgtcaactatgttataattaatgacacctgctttttaattactctttaaatgtgactactagaaaattttaaactgtgtatgtggctcagtttccatttctatgggacagtaccgctagtctgtgctgtgagttcagctgccagttgtggctttgaaaccagtacattcccagaggctcctctccttagtggtctggctgagggggggttacccagccctaaccctagactgcctagggtagtgtgtgggacagcctgcttccaggcaaaaagttaataatttaataagcagcagcaagaatttctaaaaatcctttccaaagcaccccccctggcttttttttcttcttcttcttcgtagccttcttcctggaccagccttcttcctggaaatctttttttaaatgcagaactcttcccttctgtcccacatgggacctgtggaggtgatggtgtccagaggggctattgttttattttattttcttgtttaaattgttcttttgcccacaggtcaggctgctccagtagctgccttttaacccttcctctgcaggaccatctcagaaaccacccagcaaagactgggaagccactcttttagaccagttccccctcccttctccctttggagtggttactcaagcgcagacatatattgggaaaacacaaggtggatgtgaaaccaaggaaactcctgctttgagaagtacagaagtgcagacccacaaccaacctcctaatgtcaagctggcattttaggaaaaaggcaaacacttcagagcatgtacctttgcatctgaacacatacgtctgtatttgaatgttatatctttcaaagccatgacctcacctcaggagactcctctctcaacttgatctcacagccatttactggaaacattttcagaagcctttgtggaactcttttcagaagaaaaaaagagagaaagtgggggccatacttggcactagtaagtatttatcttgtaaaggtagatttttaagtttattagagctaagtttggtaaataagtccagaacaagctttgagccactgaaattttaaaaatggtgtttaactaacagtaaggatggaattttttttaatggctgactcattcatgattgactagcctcgaaggcagttccataagaaaggttccagacagcttttgacttctgacagcgtctctggaacgccagtagagtctcctggggcaaaagctttaatgacaggggtttggggatgagtacgcagccttgactaagatctataaggttgagtctagagagaaaaaattagtcttatttacacctacggtattaagtgatactggcacctgagtcgaccttgtctttggggcttgcatagctacaaatgggaccagtaacagagaaggttctctgcatccaaggagtagagtccaaaacgtgacttttgacttaggttgacttgcacaccaggtttctctataccttatgatatacagaattcaaacctgaatatgtgagtgcaggtcaagggaaggaccctcaggttggtatcctcagcaaggactttagagttgggtgtgtaagaagcactcaacctccttgtatagtgccacggacagagcagccagggcagctggaaagcaacacccagctggggtgggtggaggaagaatgcatgtccccatggaacacgataaagcaaagttcaaggctcatgatgactaataggttcatctaggaggatgtgtgaccaagcaacctttgtattatttcctacaggtggaaatgagaggtgccatgttcattctatcctaaagtatctcttagaggactttgctgtggagaaagtgtagtgccttggagtttggctgggtcagattccagccctgctctctattgcagtgtcgactcaagcatagtaactaaggtttcatgagcctcattacgctcatctataaaatggaaacatgattacacttcagggttgtcataggagggaaggtcataggagttacacagatgaggggactcaacagagcaagtgttccacctctcccaggctctgagaatgacaccagaatctatctttttgccacaagaaagtaggcagaggctcatcgttgctcgtcagagtatgccacctgccacaggaaaatggccccagtctctttgtgaggagaggcttgccctcctaagagaattctccttcctctttgcttgaataagaccagctgttagggccccagtactcagcagctatgacaaatttcactgcttaagacccctcagcctcttaaaacaggagtttttctgtagctaacataagctgctctcagcaagatgcacattagcacttaatgctcaggtgggtgagggggaacactcaatggaacacttggtgtatccactgcaatcctgatattggtaaaaagtcacttctcatctggctttaaagtaggtccagcttctcattttaacctgtttgccaagtccctagtttttactatagctctcgtgtcatctttgattgcaccggtaatgtagggatgctcagcctggaccccagacttggaggccctagagagacagataatcaggccaagggggtcccaggaaaggcttgagcagagagcatccagctgcccctgtcctttctcattcgcttacccttgatatcttcctgaactggtatgttaggttctcagagtactaactctcaaacttcactgtacattagaattactggggaactttttaaaatccagaaattcaggctgtaccccaaacaattaaattaggcatgaattaaaacaacaaaagtaacccctccaggtgattccagtgtgcagccacatttgagaaccaatgtgttagttgatggaatgaaaaatcgagtgcagttacttactgggttgacttttgtgcggtcaccaactcttatcatctgaggatcacacaggacacaatgtcacccctatggggccacactgcctgttctggtcactagtgaggtctcagtggcatatagccattttaacagctctttttcctttttaccgtgaaacattgacagagatagagtagtatatgcccccaccccatgtactcatcacccagctgtcattcatgtctcctccgccccacacacacactttttcttgtatggagggggtggactgcagtattttaaagcaaatccctgacatataatttcatctataaatacttcagtatgtatttctgagagataaggactttaaaacaagaaccgcaataccatgatcacacctaagaaaattaacagtagttctttaatctcatctaataccaaatccatgttctattttctccaatttgtctgaaaaatacctttatacatttggtttattccaattaaagcccaaacaagtgttactcacttttagtagtttgactttaaccccagggtaattaaactgtcattgtgtacacaggtaacgatgcatatgcacttctgaaaagaggtgtcaatggaatttggctcagctgatgtttactggatgggctctctcctccttccttccttagcccttctggtgggatcttgacatgttacagaggaaatgctaattgaagccccagccacaaccacttctgtgctctgcttctgcctgaaggcatgttccctttggtaaacttagaatagaaccttcaggatgcatgtggaaagagagtatgagtcagctccgtggacagcttagaatttcctgcccctttgctggaggctgtgtctgagaagtgctgggactgcccccgggctcctctttggtctctgctgaggactgccgctttgacagttacctagggagttgcccaggacttgtgttctgatggaaggaccagccaacacccacacagccttcctttccttggtgtgcagatggctctatgcagtcttatctccagctgggcatctgggttcaggtcagacgatgaccaggaaaggagggggtgagtttctgccctctgaggtaacacctaccacctcatcagtcattgctttgccacagtgttccccctctatgagaccgaacactgttagaatttcttagagtcagacgctgcagctttaatgggtgatgaggctttggggggtcggcaagaggaggataaggatggagaatgggcagcctaaataatcaaactgtatcactcctttcacaaataccaatccagtgctaccacgtatgcatcattcattatcctgacccaacaaatctaaatttggttttatttttctgtagcttttttcttctttagaagggctttgtcttgatttcagatgggtttacagttgcaagattttcttctgtctttgtatcatggttagatggttacagagcagtaaacaagcatcttaatatgtaaaggcaactctaatgtataaggttatttatcacaggattatttttaacagcaaaaagtttggaaaacactaaatgttcattaataagaaactagttaaataaatcatggtacatccctatagtggaatattgtgcagatataaaaggaaatgaattagttgtgtttcaatatggaaagattgtggccaggcatggtggctcacgcctgtaatctcagcactttgggaggccgaggcaggcggatcatgaggtcaggagatcgagaccatcctggctaacacggtgaaaccccgtctctactaaaaatacaaaaaattagccgggcatggtggcgggcgtctgtagtcccagctactcaggaggctgaggcaggagaatggcgtaaacccgggaggcagagcttgcagtgagccgagattgcgccactgcactccagactgggcaacagagtgagactccatctcaaaaaaaaaatatggaaagactgtgaagagataaacagcaaggtctagaacatgtgaataacgtgcttgctaccttttttgtgagatgagtttgggagagaatacatattaatatttgcataaaccctagaaggatacacaaagcaacctttaagaaatgggtaccactggcatgttgggtaggagaaggaatggg

SEQ ID NO: 2842 - DNA, 715 bp, Homo sapiens
gtggttatggccctgagtccttaaattataggctctcctgcagtttcaaaaagctaattcacactactgtgtgcattagaaaggtggtatatatgatattccactaagggaaaccctaggaacattaaactcctactagtaactggtcacgagtcagggctagaactgacactagtcatttttcttcactgacaagttttcattatgtggctttcccagaacaatttagaaattgatctgcaactgatggaagctgggatgaattgggcgcataagtgaacccaaagcatcagagcaaagtcaaagcgaacatctggctccagctttgagtacaagagacttgtgtttccatggaataatcttgggatccatgtggagtgcaagagattggaacagaaggagttctcaaaaaataaaaacttcgggcgggtgcggtggctcacgcctgtaatcccaggactttgggaggccgaggtgggcggatcacgaggtcaggagatcgagaccatcctggctaacatggtgaaaccccatctctactaaaaatacaaaaaaaaaaaaaaaaaaaaatagctgggcgtggtggcaggtgcctgtagttccagctacttgggaggctgaggcaggagaatggcgtgaacatgggaggtggagcttgcagtgagcctagattgcgccactgcactccagcctggacgacagagtgagactccat

SEQ ID NO: 2843 - DNA, 2580 bp, Homo sapiens
gttctgagacagttctgttggcctttcctggaggtgacgttgacccaaccactttaatttggatctatgaatggtggagtcatttaagaaagtgacacatccagccacagagagcagtgtttatggagtgatgtgtattaacatgaatcaagcttcttttttattgtgaagctgtcatgtccctatacgatctcgtctttaaactcagaagtgtattgaggctgttttcaaagaggttttcttctccaggaggaatgtttggtgatggttatacagtcaaagtttggctctgtaaggaagcaaatcaacattgcactgtttctgaccacttgaagctttattttccaggaattcagttcaagggacagcacctgaatttattagaatatcatgtgccaaaaagatggggatgcctagctgacttgttcaaagttatagagaacaataaaaccttcttgaatattaagcattattccattaaccaaaccactttggagcaggtatttattaattttgcttctgagcagcagcaaactctacaatctactcttgatccatccactgacagtcaccacacacatcacttgcccatctgagcactaaagaagtttccataaggaataaaaccttgtcttccattacaattaacagtcaaggataaaacaagcacgcgcacaatcaaggagctggaacacactctccaggccgtcaaattattctcttgttcattttctattttgaatctccttgttagttaataaccaccaaatggaaaggtcattctttctgcagacttttggggagctcctccaaaacatttgttctctttaccatgccagatggacaccagcttctttgtgacaaaggcatgaatgatttgacagtgtccaaactgagacattctggagctggaaagcctgtcacactagagtgtgtgtgacatgtccactctaaacatgtcacttttctgttaagaaaactgagccccctccccacaggttaaaaaactttagtaacttgtttgtatagaaaatagtaacaaggactattttctattgttgtcatctatttactagatacatgtttttaatgattttaatgtaagcttttattaatactgatgacattatatggtatgatatgaaaaaatcaccaattttttacatataaaagatacctttttaaaaaaataggttttaagagctcttttagtatacactttagcaaaattaattaaattgaactagttactctgtatcaattacagtagttctaccagaatctcccaggttataatttatgagggtagagaaataaaatgtagatgcattttctttttcttcatttggatgaataattactgttttttgttattctaagtcagtgtttttcaaagcgtagtggtccccatattagctgcattgccatcttctgggagcttgcaagaaatgtacattctcaggatccactccagacctattgaatctcaaattctggggcttaaacaagcacattccaagttaagaaccaatgacctaagggaatgtctggttacctcctagttatacaagcaaaatctgcatagtatgtagtcttttttatttatttattttttttttttgaggcggagtctcgctctgtcacccaggctggagtgcagtggcgcgatgtcggctcactgcaagctccgcctcctgggttcacgccattctcctgcctcagcctccccagcagctgggactacaggcacacatcgccacacccggctaatttttagtatttttagtagagacggggtttcaccgtgttagccaggatggtctctatctcctgaccttgtgatccgcccccctccacctcccaaagtgctgggattacaggcgtgagccaccgtgtccggccgtagtttattttaaaatatatttttaaaagctttgtaaaaattatgtcattctcagaattgttgtcttcaaagcattgtcagatgtagagtgctcagatgtggctcttaaagactatatacatctgaatttttcatcctatagttagtaagatgcataaaatcaatccactactgaaatagtttccagtcagacatttctgagttcagacatttctcaacattcttttaacaacatttttctgaatcctcaatagaaaatcacattaatcttattttaaaatttggcctttttcaacactaacgttgagtaccggtagcttgtgatcaaaggcatatacttccttatgagatttctttactaaagcaagatttcattaaatctctatttcctaaatatcattctatacaaaagatattttttaaacggtaaggattaagacaatcactgatagctttgttgtgagcaattttgattcccatgtatcacatgaattacacttccttaaataaattacagtttatggctgtatgatttattctctaattctaacatagtctagttgtcaaaaggaaatatgtaatctttttatgattgttgaatcaataaataccaatttgtgaaacatgaatgtgtttaaactgcagtgaataaatgagatgtgctttaatttaacccg

SEQ ID NO: 2844 - DNA, 2049 bp, Homo sapiens
tgttattgcttttcttttcatggatattactcttacagttctagccaagagatagaaatagtaaattttacttttcactttctaaatgccaaagtcatctctcagtcatttatcagaatttggaggctcatttcttagtgatcatatatcttagaatccaaaagatgagaggatttaagaaaaaaaaattaaacttaccatgctttcaagtttgtcattttctttctggcttgaagcccagccctggaaccagtaagagtgattcatccacttttaggagatggacgactccaagtgatgaattagagtaaatgtgtgctagaagaaatggtgcatgcaaataaaagatggcatgccaagcttttagtggggatttttttgcataagatcatttgaaggtacatgaatgaatggtacattcatgatgctacttagagggccactttttaaaaaatattttttatctggcaattagttttaggaatctgccacatgtaccatagagataatctctcagaaaacaaaaaaaaaatgtgatacctttaagtttatcccttgattttatacactgtgttttccattggttgggaagcttgcattggtatttattgtaatatgcctctcttcttcctttgggcttcttccaatatattccctctttggtccacgaagcttataccaaagcacttggattagcaatcatctgaggcctagtctgctcagaggtgagcagaaatccctagcagaggggattttacaagtgttttttatttttcttttttatagcattggaggtaaatggccacattttatgatgttctatgcatgtccgtctcttgtcatggctacatcagatcttgtatcagagccacttatttcaagccactggctttcccctctgtagacaatgacatgctaccttccaaaacccctcctttgatttgtcaccacagaaatgataggtgacaaagaagacagcacagatgatgaatttaggaattaaaaactaaagctagcgagtcatttttaggtagcagaaatgtgctttagtgaaacactgacaggatgtttggagttggtggaagcagataaatatgaatatcatttttagggataaatgttcatgctttgtaccagctctggacttattttaataattcttttcactgtattgttggctctgtaaatcttattgaataaaatgagcaaaaatgagtttctgaatatgactattttaagcagagtggtttttcttgtgtaagtgtaggtgatgtgaagaggatgaatttatctgtaagtcatgggtgagaagggagtcctgcacagcctgagtacttgagaggtggcctacattaggctataacttttctttggatccgtgccatgtgaacactagaaaccaacacaggaagtgttagctgtgaaaaccatgtgaactataagaatctgctccaccggttttgaaagaaaggctaaagaagaaaaaagtgtcaatgttaaagagctaaccaaaacctatcctgctagaatatgaaaaaaattagacctttgccttgcaacctgatgccctgcttctgtgccaaggttggtgtaaaaataaaactagtcaccactagttcagatccaagaagttcaatatagttcagtaaacccttccttgtcttcataaaactggagcttgggggaagggaaaaggaacacatcattaatttcttttttgttacaaattttatttgtttttaatattgtggataatatacaaatatctttttatctgtaaaatagtaaagcaatgtaactatctttaaactgcactctcccattgactccaatcctagttctctattcagagtcaactaatagtaatagcttcatggtttcttcctaggtctcttttaaataaatttgtgcatgtgtaactatggaaatatttcattttgttttgcttatgtccatttttatactaagtcacatcatattaaccattctacaatttcctttttaccatatagtgtgtctcagagaacttttcaagttagtacatgtgtg

SEQ ID NO: 2845 - DNA, 9310 bp, Homo sapiens
gggaacatgagtccctgcagtggcctcagcccctggtttcccagaattggagggggtctttgaccgggaggggttggtctttactggcctggagccctcctctgccgcccctgcaggcagtgggatggtccccaggtcttagagtcctcaggatgttcccaggcccctgggactcctaagctggaactggagcctctttgccagccctgatctgcctgagaccctctcaccacctcccaaggagtttggcccagggtctcactgcctgatccctgcctgtgccactgcctgtgaggcggtgaagtgaaaaggtggacttgtcctgtcttggggacaggtccctgtgtggagcctcctttctgcactgacaggtaggtcagggtggagggtgaaggactccgctggaacggtctcaggcttgcaaacggagccttgctagtgggtgtcccagagcaggcggctgcaacgagacaggcatgttggagaggctgcccctgtgtgggaaggctttcgcagacatgatgggcaaggtggacgtctggaagtggtgcaacctgtccgagttcatcgtgtactatgagagtttcaccaactgcaccgagatggaggccaatgtcgtgggctgctactggcccaaccccctggcccagggcttcatcaccggcatccacaggcagttcttctccaactgcaccgtggacagggtccacttggaggaccccccagacgaggttctcatcccgctgatcgttatacccgtcgttctgactgtcgccatggctggcctggtggtgtggcgcagcaaacgcaccgacacgctgctgtgagggtcccggtgagatggagtgggtcacacctggcaagctggaagaaagttccctggggatgggagagcgggtgggtgctgccaatctccagctactgtggccacaccccacctggtcatgggcagacccctcccttcctgggctgacctgctccctcgaggccagcctgctccctggctgaggctcaggctatccgcccaagctctttgctcattctagggccagtggaggaaaatgtgataaggccagagcttgtgtgctgggcacagaaatcacctgctgcatcctgtgctccgcaggctgggccggagcctctgcccgcaggtttctatgctgtttcttagcacagaatccagcctagccttagccgcagtctaggccctgcttggactaggactccttgcttgaccccatctctggttcctgccctggctcctgcaccagccccagctcctgcctacatccaggcagaaagataggcaggggctcttggaagacgttccgtgctgtgacctccgagccctcctggtgggaagacagctggaaaggctgggaggagaagggaggggctgggggttcccaggagccatgcgtggcctgcagagtccattccatcatgatgctgtgcccgctatgggctgtgtccatgaccagaggctggagtgggggtgtgttagagcccctcaccgggacttgctgtgcggatggggcctgggcctccttcctacaggggctcctctgtgggtgaggggccctctggaatggcatcccatgagcttgtggcctctatctgctaccatctgtgttttatctgagtaaagttaccttacttctggaatttcctgttttgtttcatgttattcagagagacggtgcatctcttgggactgatgagtcccctgtacatattgtacagatagggaacaactgaggttctggaatcccagaatgtcagcgcttagggggctcagagagtgttacaataggagaggggcctgacaggaggagggacttgcctagctactcgcagccccttgggcacttcccatccctgacccattggtttgaggatgacagggaagatttctctctcttctgttttccctttgcagctgccttgggcttgctaggacccctgcctgggttttctggggaccgagaggccctggtcaggtctggctggaggcagatgctggtcctggggggtccctagagcaggtggaggggctttatctccaggcctctggccaggcccttgtccaggctccagttctgtggacctgtgtcttttgcatgtgggctgttggatccaggatcttcttgctggatcccaggacccctgtgagtggaggcaggcacgaccctggtagttcctctgcctttagaggcccagctccccttcaatgcccaggcaggcaggttctggcactggggatctgcatggtggatgccactggaccggaggtctgggtgggtggcctgagcctgaccccattgggggcacagtgtaggggacagaatctgagtctactccatgttcttggggcagccttggccgggcatgaaaggttgcgatccccatcacctgagccttggccagctatctctgagatgggacaccatctgcccgatgaggtgactgtgtggagacagggaggtcagcgtgcccacaggtgtcaggccatctggcctgcagtggtggctctgtgttcagtggatcctggggtctctcatggggcctctgtgtaacttgctccctccagcccattccgattccagaaccactctgcactgggttcctggctgctatggtagaggtgcagccctgccccttggctagtgttaggcaccccctggttgtgcatccctgaagaaatgcttgaaatgtgctgagggaaccccccaacaaggggctgggacacctgcagctacctcctgggtcccctggaacccaagccctggaagctgctctgagtagggagtgagcctggagtcatgctctggcctcctcccaagctcttgggcactgtcttctgatctgctacctcctccctgaggacagaggtcctggggggcctggtgagatttccgtgagggtttggattcctggggatggggtccaatgaggggtgttctggaggcttggaggtcccagggcagggccctcaatcactgtttccaggctaggtaaagcatcaggctctaattcagtcagatgctgctcttgctgagtgcactctggagacagcttgagtttttctgcgatgcaaactccaaactcggcaggagtttcaagctccctcaccagggacagggccggtgggtgcagctacactgctgtgtgggcagattgaggagttgggtagggagccaggaggcctgtccacataaccctgcagaggctcacaaggcaggaagggacatcaacatttactcagccttgatcaggtgaaagagaagtaattattcaggcagtaagaggatatctattcatgtttcctattggaatcttctttcaatttttacttctccatgtgttttctccagggcaccaagggtctaaggtgccaggcccacaaagggaatgtgcttgtgtgggtgtatgtgtgtatgtgtgtatgtgtgtatgtgtgtgagcgtgtgtgtgagggtgtatgtgtgttggtgtgtacatgtgagtgtgcgttggaggcagcaatagtgtgtgtattctaggagcttccttatctaaaagtctcttacatttcatcagtttacgcaatcattattaatgtctcattttgcagatgtggaaattgaggctcagaaatgtaaggggacttgctgaagagtggtcttttatattttcctggcctgctgccctactgaatccagccctgagaggtgacaactgccttgaggagcccctctggaccctggacctgcatgggtttcctctggccagagcgggtcccttcctgactgtggcaagtttcgggcatgcagaaggctgccggggtcctctaatagggtgactggcccaggcggtcagtctggtgcagccttagtactcgggtcaccatggtggttgtggtggagtgcagccacagccctgcctcatgggggtggaggactcatccccgagtctgttctctgggcaaacccagctgtggtccacaggtcttcctttctggacacacccagaagaccccacctgcttcactccttgaagaaggaatcaacccttagccctgaaaggccccctgtggctcagcttcaggactggactggcgtcacaggtgattagaattaacgtgggaatgaccgctcataggaagcagccgccatgagtatgcgtgtgtgtataagtgtgtgtggatgtgtatatttgtgtgtatatgtgtgagcatatgttcatgagcgtgcatgtgggtacatgtgagtgtatattcctgagtgtgtgtgtgactgtgtgtacaaagtgttggcaactacagcaagatgatggctgaaccctgtgtgggttgtacacatttgccacagtccatgccctttgtcacgtgaaaatactactactcgtaagtgagaagagtgaatgccagcaactcttggggactgttgtggctgggttgtgtctttaatcatttcatctgccaaggtttttgcaccactgtgttgagagctgtggggatcacagagacatacaaggcacagcctgacccccaagggttccccgacttgttggagaggcagatatgcaaggcccaaatgcagtgtgcacagtgagtgaggcagctgagaggtaggttcctccggggattttgaggaaggttgatggttgatggagagggtttttaagctggatctttaagggtgagtaggagttttccactgcaggagaagagtgtcatgaacagaagctcagagatgtgcaagaacatggtgtgggtggagcccaggctgtgtgggtcaggtgggactgaaagtgtgagcagggcccaatttgaggaggcaggaggggacggtttggggatgaaggtctctgcaaatgcacattatttaagtcattgatggcttctctcatggggcctctgtgtaacttgctccctccagcccattctgattccagaaccgctctgcactgggcgccatgcaaggctctgggagacagtgggaagggagccgctgtttctgccctgtagggaaagggagagactctccatatcaaaacacaacacggaacaagacagctactctttgtacagtggccttagcagaggcacttcagtgggttgcaacggctcatcaatggaagtgtgaattctttttgtccacctcacccctgactactcagcaaacaaaacctgggagtacacagggtttgtagtgagggcagctattagagggtagccatctttatccttggcagaggatatcctgcaccggtctatgggacctgccactgaggtcactgtggtggcagctgttgacctcattcactggaggctgagcctatgggagcatcttgttaaggagcaggtgacctttattccctgaaattgccccatgtgtggtctgcaagccagttctcatgactgaggagtggacttgccagactgcagaaatccaggcctgaagaagttatgttgccaaaaggggagatctctagaacacagacctgcctctccatcaggcctggcaattactgatggtacctggggcagtccaggcaacgtgggggccgagcagctgcatcatgaacggggtccttgaggactctgacttccatctgaagagtggttgtgcggaattaagaaggaaatttcctgaccctctctggcaggtttctgaaggcctgagtacagcgtgctctaaaacaggcttcaagtccacgccgagactcagccccgaggatgtggccagtgatgctcactcagggtgctcctgtccttactcactgggggaggcatttattgatgaaatagatttgaatttttcaactgatgggattttgttcacttttaagaccccagtgggttggaaaggctttaagagcccatggaatttcttctgatatatataaagtgaaaaagtagaatataaaacaatgtagaggaactgcttccgaaatgacatgagaacttcatggaccaaacaaccataactagtgcaaatcataaaaaaaccccagacaaccgtttaaagtctctggaaattgtcttaaggctacacagcaaatgaaacatttattaaagaaaatgtgtcaaatctgggtaagaacaggagcatctgtagcactggagctgtgactggttcacctgccccacccccccgcccccaacccagagtccaagaagacagggttctctctctctagctcccaatcaaggcatcttgacatgatgccccttggaggagcaggttgccagcactgctcacccccacgcagctctgcgctgcaggggccgagctccaggcaggagcgaggggttggcttccaacatggtccttgagaaggcgaggcactacttgtccacagcctcatccctgcctgctgagagccacgcactgggcagctcctggccctctcgatgcccactggcacagcagaccatgagctccagggcacactcaaatcccccacctccgtgagactactggataaggttccaggaagcgagagagtccacgggtgagaggagtgggctggagggtgggggcctggattttcctgaggggtgctgaggagtgaagtggactggccagaggctgctggcccaggctgttttacagagagcaatgggagatatgggaagggtgtgttagaggtgcaggtcacatgatgggagcagcacatggcagaagcgagggatcttgaggggtcttgggcaggaggaccagccccacctcaccccatgggtggggacagtggaggggagctgggggcatccacttcaactctggcttcctgttgacagggaaggacggtctgtcaggggacggagggcccctccctcacacaggcatctctatttccttcaggccctgggccagcctccgcttccctcagggtggtttctgctctattggccgttgaggcagcgtgacccttcctccctgagcgggagaatgttccgtcctgaccccttgctgccagggctgtgagctctgtgtccatctctgttcacacagagaggccggctggcatttcaaggcactgtcttaataccctggtgcccccttccctgcaagcccctacagcccttccctcagtgtccttgctcggactggcctgggctcgtgcatcacaggcattgcggccagggggcctgtgatgcatgtgtcagctttggttacacgcctggcatatgtgtagacacagcgatggagcagccacccgggagggcgcacaagacctggcaccagggagcagaagtgggggccgaatatgtagagcctgctttggggtaactgaagggaagaaggaaagcaggaccgcaggagcatggggcctgcactgttacccaccagaaaaccgcctgacgtccaggaggcccactcctggccatggttaccaaggaagcaaggtcgaggagagagctggttgaaaataacttccaggtgggcgtggtggctcacgcctataatcccagcactttgggaggccgaggcaggcggatcatgaggtcaggagattgagcccatcctgactaacagggtaaaaccccgtctctactaaaaatacaaaaaaattagccaggcatggtggtgagcacctgtagtcccagctactcgggaggctgaggcaggagaactgcttgaacccaggaggcagaggttgcagtgagccaagatcacactactgcactccagcctggttgacacatagtgagactccttctcaaagaaaacaaaaaacaaaaacaaaccaaaaaaaaccttcctgtccttttttttttttttaaatcaaattcagttaaaattggattaactcaacttcaaatatagttgaaatgattccggcaaatggagggtgatcagtcagcaccaagcggcgaggacaggccactgggaggaagaagcctcctgaaggtgcaggccttagtcaaggagctgaccaggaaagtggaagagatgaccggaaaagaccagtttcggcacctctgacctacctgtaccaagcatgtcgttggccacatgtggaccccaccggcctgaacctcctgacaggagcctgccttaggccaccagccattcgcaggactgggaggccgtgcactgggctggcttcagcactggggcctggctcctttcctgatttgctgaggagctgcaggaaatccccccacacccctatcccatctcagtttcctctgtcagtcatgcagtggatctgcgagggggcctcagtgcatcctgggaccccacccttcttgtccttccctgagtcaccctcattctgtctggaatcctctgtggctgcttttccacaaactacactcactggcagagtgacccctggggctttggacctctgggtattatcaacatggtaatgagccggcaggcctatcatggacacctggggggcgatcatgcttgtccacagttaggttttctaatgtatttctctgtccctggctgtgacagcctgtggaactcagaatggaagacagtaaggggcctggacgctttgttcccaccttgaccggaggcaacaatcttcctcttgcatgccaatgtcattgtataccttgcttctggcgctgctgaccccaagtggcccagaacattcctttgggtctcctcagtgaatcaaacatgtccctattccagtacatttctattaaaatctgctgagccccacaaagaaccaggcactgctaggagcttcctgtaggtgtgtaaacttccatgcactcaagccgcttgcccccaggcactgtgttggattcagcctgcagccactcatcctcactcaaccctcctgctctacccaccaatgccttccatgggtttgcctaaaattaaacattagtaaatgttgaatggatccaactggagagaaagatgttcctttgccttaagcatctatgctccatatgttttgtttccaagcagtttcattcagaaggatgtgaaagggactctgttccacagctgcactggttcatggtggtggaataatcacaagatgaaacaatcgtatcattgcttttccagcaaagtcaggcactgtgctcacaatacactacattcatggaagcctctttgttataggaatttgctttgctctaggggcgttcttttaattttacggttggaggattgagttctcaattaagggatcagcaacaaatagatattaggtatgatcaattagctatctgggaagtatgaatgttctttcagttacctagcactaattaaacaagtgtcttgccttgtgagggggagaggctcataaagacaccctcttttctctcaagggctatctgtcttgg

SEQ ID NO: 2846 - DNA, 1683 bp, Homo sapiens
cccgcaactacattggagaggcgctcccctgccctcttccagggaacttccttctccatcagggccaagtctgagactgagctagccttccaagagtagagctgcagtatgcttcaacctgtgatctccgttaacaaggccactggcttgactattgcaggagagcctgataagatgtgaccccacctctttgctgtgagagctcctctccaccacttcgtcccaggtgacctgggtacagtgtacaccaagagatcatgagacatgcatgccaagtgggggagctgatgtcaatccacacataaaaggttagtacatttttctttttcttttattggtaacaagtaaatatatatgtgtatgtatatatacatatggacatacatatgtatacatgtatatttgtgtgtgtatatatacagacatgccttttttaatgatggctatacgttttgagaaatgattaggtaattttgtcattatgtgaacatcatggagtgtacttacacaagcttagatgatacacctagtaaacctaccatacacctaggctatttggtatagccctgatatgatttggctctgtgtccccacccaaatctcatcttgaattgtactctcataattcccgcgtgttgtgggagggaccttgtgggagaaaatttgaatcatgggggcagttttgcccatactgttctcatggtagtgaataagtctcatgagatctgatggttttatcaggggtttctgcttttgcatcttcctcattttctcttgctgccaccatgtacgaagtgccttttgcctcccgccatgattctgaggcctccccagccatatggaactgtaagtccaattaaacctctttttcttccaagtctcgggtatgtttttatcagcaatgtgaaaactaatacagtaaattggtaccgggaagagggcgttgctgaaaagatacctgaaaatgtggaagcgactttaaaactggattacgggcagagggtggaagagtttggagggctcagaagaagacagaaaaatatgggaaagtctggaacttcctagagacttgttgaatggctttgataaaaatattgataatgatatggacaatgaaatctaggctgaggtgatctgagatagagaagaagaacttgttgggaatgggagcaaaggtggctcttgttatgttttagcaaagaggttggtggcattttgcccctgtcctagagatttgtggaaccttgaatttgagagagatgatttagggtatctggtgggagaaatttctaagcagcaaagcattcaagaggtgacatgggtactgttaaaggcttcagttttaaaagggaagcagagcataaaagttgggaaaatttgcaggctgacaatgcgaaagaaaagaacgtcttattttctgaggagaaattcaagctgctgcagatatttgcataagtaatgaggagctgaatgttattcccgaagacaatggggaaaatatctccagggcatgttagagacctttgtgacagcctctcccatcacagacccagaggtctaggaggaaaaatggtttcatgggcagggcccagggtccccgtgctgtgtgcagcatagggacttggtgccctgcgtcccagccactccagctgtggctaaaaggggccaacatagagcttgggc

SEQ ID NO: 2847 - DNA, 2926 bp, Homo sapiens
cgagctgctgtagcccctacgtgcaggtaaaagagagaagccagattcatggaggcgtgaaggatcccagcaagaaaacacagacttgatcttgagacgagatttttgaaattggttgcggcctcaaggcaggctctgagaagactcgataaagagttctcaggaataggcatccctcctggatatttcccccttggaagcgccgaggagccagctctatgtttgtaaccatagcatttctaaagctccagccccaggaacctgctgtgaattagagacagattccaccctaggcatcactgatcttggcctctcttgtattgggaaggtcaacactgttccagtttctctcctactcccatctggttgtgctcggtgaagtaggtgagcagtgctacccttctgttaaaaaaaaaaaaaaaaaaaagatcctgaaagaggaaagaatttttgctacacatctgaaagctaaagtccaggtgatgccttgattacctagctttggcttctctgaactctgcttctctgatagaggaaacctgaagagaactagcatttctgaaaccatggcccgggtgagttgatgtctcttttgcttttctgacttattgtgattttttaattcatgtaatattttcatttttttaatcctgaaacctcctatctcagaaagctctctcttggaacctatttcacattcctcccattccagtgatggatgatgtcctcctcatttgccctccttttttgaactgattttcacttattttcaaataattcatccatcttctgtgtgttcagtcttctctcaagagcagtgttagagcagtgaaagagtgaagtaccttgaaatagttgagctgccgttgtcaggttcatggtttcgtggcataggaacaatggtcctatttgactacaggagtggaaactttctccacagctcccttatctccacagttagataagggaaaacttggttatgagtggtctcagtctgtttgagatgagatctcaactttgaaacgcatttaggtttgagtgaagatgggattatcacttacctagagagagattagggatctagctaagggatcactgagaaatgaaaacaattccagggtcccattttgtagtggaagagaaattgacagtcctgagggaatcaaggttgttctggatcattctgcattactgtgttccaactcaggaacagatctataaagagttgtagaaaggaaaatcaactagaatgatatgtggtagatgatattgaactatggggaagaggttggaatttgtgtccaacatacatgccatattagtataattctttatacaataatattatttttaataatagtgccttaataccttaagaaagatgaatctaataagagggtgcttgtcacttgattcttttttttttctttgagatggagtctcactctgtcacccaggatagagtacagtggcgttatcttggctcactgcaacctctgctgcccaggttcaagcgattctcctgcctcagcctcccaagtagccaggattacaggcacctgccaccatgcccagcaaatttttgtatgtttagtagagatggggtttcaccatgttggccaggctggtcttgaattcctaacttcaagtgatctgcccacctcagcctttcaaagtgctgggattacagtcatgagccacaatgcccagcctctttttaattttttttttttttttttagagatggggtcttgctctcttgcccaagctggagtgcagttttgttatcaaggtttaccgcagcctcaaactcctgggctcaagtgatcctcccacctcagcctcccaaagtgctgagattacaggcataagccaccatacttggccattttttcattcttttaactgaattttgaagagcagaagtttttaatttttcaaagtgataataccattttacattcccaccaacagtgtatgagagttccatttctggatgaaatccagtttatcagctttttcttttctttacagattgtactttttctttagggattgtactgttggtgttgtatctaagaaatctttgcctcaccccaagcttatgtagatttttatactgtgttttctcatagaagctctatagttttatgttttatgtttatctccatgtgccattttaagttaatcttggcatatggtacaaggtatggataatttattttgcatatagatatccagttgttcctacaccatttttttaaaagacggtcctttatccactgaattgcctttagtcacttgtttaaagccagttgtctagatacgtgtaggtctatttctcaactctgttccattgacttatttgtctacgtttatgcaaacaccacatactctttattattgtagtattacgttaagctttccaattagtagggttgatcctccaactgtgctcttcttcaatgttgtctaggttattctagatcctttgtgttttcatctgaattttagaatcaccttgtctatttttacaaaagctctgctgggattttttttttttttttttttttgagacagagtttcactcttgttgcccaggctggagtgcaatgatgtgatcttggctcactgcaacctccacctcccaggttcaagcaattctcttgcctcagcctcctgagaagctgggattacaggcatgcgctaccacacctggctaattttgtatgttttagtagagacagggtttctccatgttggtcaggctggtctcgaactcccaacctcaggtgatccgcctgcctcaccctccgaaagtgctgggattacaggggtgagccatcgcacctggcctctgctgggattttgactgagattttgttgaatctgtggatctgtttgcaaaggtaagagtcatctgact

SEQ ID NO: 2848 - DNA, 2036 bp, Homo sapiens
cactgcctaggcagcctttacctctccgatctgctggagaatctcattatcccatcggcgctctgcctgctcctggcctccaagcctctgaagcccctcgggtttcagctgccggctaccctcgagcccgtggtgcccacgagagaggcgactttacgtcagcggccctgggctgagatttgagaacgcgaccaagtggagaatgttggagccagattttaaaatccttgtcttccttctgcgtgctacttgatctaaatgagatacggcaaagtcacagaacctgtttttatgtttttgcctgattcatacgggcttctccggtgaagatgggcctgaagtaacgcttgggttgcttctgacgttataactcatcctgtagctgcagcaaccgtggtccttgcaacctcataaaaatgttgccagcattgtttcgatagtgctgcttaattcttggaaggttcttcggacttcacacattccagcagtagctctctcagctcctgtcctgcacagctttgaagtgctggtgatgtcattgaactcttaagtgcaagatgaaacaagtctttctggggttctaagtaggtaagtgatctgtccatttcttaactagctaaatgaattgctttattaagatactgaaggtatgtcaggcctatcaagatccagtatctggaatcactaatcaactctctatgaacattatttttttgaagacttttctttcggcacactaaacaaaaataaactcaacctgggggaagatgcttggagctaatgtgaggaggaaggaatgatatcaaagaccttgctttctcaaagttccctaagatgcgaaagaatcagtactgcagttttaaaataggctggggttggacagaggagcaacaaattgtaatttaggagtgccattgctttctcagacataacggcattattgtctgggggaaagagttctattgtataaatactgttgagaggatagtggaatttagatctccagcctcttccttgattttggcaaggttgaatgtagaggaaaccacagtcgttcaggaagaacgttatgtgaacaatgtcatgttttattggtggaatgagtaaaccaggcagtacaggctgtaaaaacgtatcagttggtgttatggcaggaaacagatggctcattccaatagagtaattcaaagaatatccaataaaggggctacttacaaaggtgtagatgggaaacaggtgagccatgagatagagtgtatccaaggctagtaacacagggtctatttctaaccctatgcttgaaggggtgaattaccgggaaagagaggctcctaaggaggggccaccttgagaagagccacagtcgtcgcggagggaaatgggaacttgtgagctaagggaatataaatactccttccttattcacctccttccctctgatattctgccagatctctctaataatataatccaatctggagccagtgggcaagaaatctaatggactgactctttagactggcctcctgcagctgactagggtgaaaagtgtgatctggaggaacaaacaactccccacattaagtggtttacagtcccaaaggcctacttctcactcatgctgaatttccggcatggatcagtagggagtgtttccatgtgtcctcactctagaacttcagaaatggagcagacatttcttcagaatataaccaattgttttgatagagggaaatagaatttgggatagtctcaagccagcaattatgtattttggtcttaaataatttatgtcatttgtacttacccagaactagttcagggccctgtgcaagcttcagggagccagaaagttgaactctaccaggtgcctgaacgagaaggggatgtgataaaactgagcagtgtgaataaccaccacgggtaacttttctgttcaaagcatgctggtccctaaattaaattgaagctgggatatgggttggcagaataattcaggcagaatttagtttacagacaacttctgaacaacttgc

SEQ ID NO: 2849 - DNA, 8149 bp, Homo sapiens
ctcagagaaagagagagtctttggagagttgtgaggagataagtgacataaactggcatgttctgaaagaatcactctggatgctgtgtggagaaaacactgaaaagcacctgttgtttcctgactttttaatgatcgccattctaactggtgtgagatgatatctcattgtggttttgatttgcatttctctgatggccagtgatgatgagcattttttcatgtgtctgttggctgcataaatgaatagactaagatttcagtgattgagtctcatggcatgtgataaagagttagtgataaagatttaaatggcacataacatcatcccaattgaatgcatcggggggtcatgatgctgtgtgggtttgaaatggaaattacaagcgcaatattacagaagtgtggattttagttacaatgtctctatgagaaagtctaaaagttaaacataagcaaaacaacaaaaacatctaaataccagacactatcctcagaaattagatttgaaaaatgagcttcattttcgaagaacatattgaatttgttatctcgattatggagggcgacaagtcccacagtctgccatctgcaggatggagaaccagtctttatagggggagaataattgactccattcaagtgttcgctcctgtttcaatcaactatggctgaagagtgaggagacatttggaataaatatggcttctgggggcccattcctatggatcagcagctggcttctggaggcccattcctgtgaatcgtcgatctcatagaagataatattgttagaaggcttacctcattgatgctgaacatcctaaaaagcttctgctgctttgagtcactgaaaaagaccaagaaacatgaatttaaaaaaaaatttcaaatgttataaaataaataatatgaactcattatacctacaatgaataatttaaattcttctttggtagtccaggtaaataacttctcaaatagatttttttaagcatctgtataagttcaagatgtacatcacttcatgtagaataacatctcctaaaaagaactgaaatgcctcagtatacaaccagctgacctggctatcaaacacttatttagcacatattacatgatggacactttgatgtagatacggaccttgggttgtgtcctcaaggatcatacagtgggttgaggaaataggatatgctatccataggaaagtaaataataatatgacagcttattttcaatgagaagtgaatagtacaaagaataggagttgccagatttcaaaaggaaagagctatcacacagaggcggaacaattagaaatttttcatgaaggaagtgttctttgtgctggacctttgagaaagtatagaatgtagattagcaaaaaggcatggaaaaggcatgataggtaggagaggcaagttaggcaaaggtccattagaattgctcaagatataatagaccaacttggcctgaaaaaggcctggaagtatcctcttttgtgctctgtgagaagtttgccaccatgtaaaaagtctaactaccctaaggcaaccatgctctgagaagcccaacctatccaggtggagaggtcctgtagagaattgaggccactggccctgagctcccagttgaaatagacaatatcaacatgtcagcagggtgaatgagaccatcttggaagtgggtcctccaagagtagttgagccatcctgcctaaatttcagcattttgagcaaataaatgatttataccattttaaatcactatatttttgagtgaatcactgacttttttctcaattaagcataggtttagaaactatgaaaaccctagaagaaaacctaggcaatgccattcaggacataggcacggacaaagatttcatgacgaagacgccaaaaacaactgcaacaaaagcaaaaattgacagatgggatctcattaaactaaagagcttccatacagcaaaagaagctaccatgagagtgaacagacaacctatagaaagggagaaaaattttgcaatctgttcatctgacaaaggtctaatatccagcatctacaaggaacttaaataaatttacaagaaaaaaacaaacccattagaaaatgggcaaaggacatgaaaagatacttctcaaaagacatacatgtggccaacaatcatacaaaaaaaacctcaacatcactgatgattagaaaaatgctaatcaaaaccacaacgagataccatctcatacctgtcagaatggctattaataaaaagttaaaaaacaacagatgctggtgaggttgttgagaaaaaggaatactgttatactgttggtgggaatgtaaattagttcaaccattgtgggagacagtgtggcatttcctcaaagacctagaggcagaaataccatttgactcagcaatcacgttactggatatatacccaaaggaatataaatcattctattataaagatacatgcatgcgcatgttcactgcagcattattcacaatagcaaagacatggaatcaacccaaatgcccatcaataacacactagataaagaaaatgtggtatatatacaccatggaatactattcagccataaaaaggaatgaaatcaagtcctttgcaggaacatgaatgaagctgaaggccatcatcttcagcaaactaacacaggaacagaaaataaaataccacatattctcacttacaactgggagctgaatgatgagaacatatggacacatataggggcacaacacacactggggcctgttggagggtgctggggggaggaggcagagcatcaggaagaatagctaatggattctgggcttaatacctaagtgatgagatgatctgtgcagcaaactaccatagtacatgtttacctatgtaacaaacctgtacgtcctgcacatgtacccctgaacattaaaaaagtgtgtttaaattgtgagataaggattcaagagggcctcttgcttcactattgttcactttcctagctttaagttttctcttctatttatcataagtatttatccttaaatgccatgtcaaatgatgactggttaattaattattattattttttagttcaaagggtcccttctaatgttatttatcttttaacaagggaagacaggaatattttcaagatccaagtatttaaaaaggtggaagtgagataggatcggggtttggaatgaagtagaaagaaaaggaaacatgtaaaaatgtaaaatcaccatgtaggagcccaacatatccaatataagctatactgctttgggttatctagctcataatttttctttgcctaatttctctacttagaaataccatgtcacttacggtgtgtttttaattgaggaaagttaattactaactattgttttgtaaaactcatatgccaatttattctaggctaaaatcaacttggcagataattatttttaaataacaaacaaaagacctttcctttctgatgcttttcccaaaacatgcaatataaaccaaagagtaaaacaaaataatgtgttacacttctcttcaactagtctaccatcacttctgtttaactggtttgatacattcatgaaaaatttcctttaaaagacatattcttctaaaactaatttaaaataaaactcttattaatattttcaattcctaccactatcaattatttggaattagaccaggttaagaatttaaaactttgcctatcattttgtattttaaagtcatgggtattgataagggactaatatttaggaattattttatgtctttcatttccttatcttctcagttaacaggtatgctgagcctttgctattttcacaataaactgattacttggttgatttaggtagcaaaaaagataatgaacctgtatcaaatttctacttacattattttatgcatagtaaataaaaatttcattgctgtgcatcctcttactagtaactacaaattttataaaaatacaattttttaattattttgccactgaagctgcaatgactagcagaatgtctggcatataacaagtgcagaattatttttaatagatttattgaggtatattaatatacaataaaatgcccacatttaaattgttttgacattttgacaattgttttgacacacaaaataagttttgacacatgtacagactcataaagccctcaccaaaatcaaggtaatcaacatattcattactcccaaaagtttcctcatgctttctttgtaatctcgcccagcaatcaccccgcaccccatccccatgcaaccagtgatctgttttctgtcaccatagattagtttgcagtttctagaatttgatataagtgaaatcgaacagtatatattgttttctgcctggcttctttcactcagcttaattattttgagattcatttgtcatgtgcgaaaccatagcttatttatttttattccttttgttgactagtattctattgtatggctgtactacagtttgtttatccattcatctgttgatgaacatttgagtcgttcccagttttcggcttttacagattaagctactgtgatgatgggtacataagtctttatatagacatactttcatttttctggggtgacacttcagagtaggatggctggatcatacagtaggtgtatgtttgactttttaacagactgccaaactgttctccaaagtgattctactatttaacatttttatctgcattgtatagcattctcccttcctctcactgttggtatggtcagtcttttgaattttagccactctcataggtatacagtggtatctcattgtggttttgtttttccctaatgtttaatgatgtttagcattcatacattttttttttttgccatctgttcatcatttttagtgaagtgtcttcatgtctttttcccatttggtataggaagggagttggttgttttcttattagttagctttaagagctctttgtatattctggatattagtcctttatgagacatacgatttcaaatattttctcccattcagtggcttatcttttcagtcctttaacagtgtctttcaaagagcagaagtttatgattttgctgaagtccaagttatcagttttatatggattgtattttgagtcaaccctaaaaaaaaaaaattgcctgactgaaggtcataaagattttctcctatattttcttctagaagttttatagttttaggttttatatttaggtctgtgttccattttgagttaatttgaagggtttttttgtatatggatgtccgattgtttcagcattatttgttgaaaatatgactctttctccaccgaattgcttttgcgtctttgtggaaaattcagttatttatacacaagtgggtctgtttctgaactctgtctcctgttccattgatctatctgttatttatgccaataccacactgtcttgattactgtggttatatactactcttaaaatattcaactttcttctgtgttttcaaaattgtttcagatcttctagtttctttgtttttccatatgaactttagaatcagcttatctctttttgtttgtttgttttttgagagagagcctcactctgtcacccaggctggaatgcagtgccaatgatcacggctcaccacagcctcaacctcctgggctcaggtgatcctcccacctcagcctcccgaatagctgggactataggcacacaccaccatgcccaactaatttttgtagtttttgtagagacagggctttgccatgttgcccaggctggtctcagactcctgggctcaagcaatcctcccacgtccacctcgcaaagtgccaggattacaggcataagccaccatgcctgtcccagcttatcaatttctaccaaaaaaaaaaaattgccagaattttgcttgacactttttttattctttaggtcaatccaaggaaaattgacttattataaccatattgagacttctgactcatggctcaatatatttttattaaataaaagaagaatttttgaaacgggttttggaataattttcagaagttctaggaaaattagaaatatcatgtttaactgctgaaagaaatcatagatgacacaaacaaatgaaaacacatctcatgcttggggtggggggaggaaatcaatattgttaaaattaccatactgcccaaagcaatctacagattcaatgcaattcctatgaaaataccatcatcattcttcacagaactagaaaaaaaatcctaaaattcatatggaacctgcatagccaaagcaatacaaagcaaaaagaacaaatctggaggcatcacatcacccaacttcgaactatactacaaggttattgttaccaaaacagcatggtacttgtataaaaataggcacatagaccaatggaacagaatagagaactcagaaataaagccaaatacttatagccaactgatctttgacacagcaaacaaaaacataaaatggagaaaggacaccctattcaacaaatggtgctgggataattggcaagccacatgtaggatgatgaaactggatcctcatctcttaccttatacaaaagccaactcaagatgaatcaacgacttaaatctaagggctgaaaccataaaaattctagaagacaacatcagaaaagcccttctagacattggcttaggcaaagaattcgtgaccaggaacccaaagcaaatgcaacaaaaacaaaaataggtaaatgggacataattaaaccaaaaagcttctgtacagcaaaagaaagaatcagcagagtaaacacataacccacagactaggagaaaatattcacaaagcatgaatctgagagaggactaatatccagaatctataaggaactcaaacaaatcagcaagaaaagaaataaataatcccatcaaaacgtgggcaaagaacatgaataaataattctcaaaaaagatatataaacagtcaacaaatatatgaaaacatgctcaacatcactaattatcaggtaaatgcaaattaaaattgcaatgagatacccccttacttctgcaagaatggccataatatgaaaaagacacttgcacatgcatgtttatagcagcaaaattcataattgcaaaaatatggagccaacatacctgcccatcaatcaatgagtggataaagaaaatgtggtatatatacaccatcgaatgtggtatatatgcactcagtcataaaaagaaatgagataatgtatgttgcaccaacttggatggagctggaggccattattctacatgaagtaaccctcaggaatgaaaaaccaaataatgtatgttctcacttataagtaggagctaagctgtgagaatgcaaaggcttaagaatgatatcatgggctttggagacttgtggggaaggatgggaggggggtgagagataaaagactacacattgggtacagtgtacactgctcaggtgacaggtgcaccaaaatctcagaaatcaccactaaagagtttatcactgtaaccaaaaaccacctgttcaccaaaagctattgaaattttaaaaagagataaaataaaaatgcatagtttaaaaatgtagatagtattcatatggttcaaaactccaaaattatagaagaatacagagcatccctcccactcttgcctcccaggaacccaattctcatcctccatgatctgcacattaaaagtttccccattcatttttatggccctggatgtagggccataaaatggcttgtaaggatgttccataatttatttaatcagtgtcttagtgagggacatttagattatttccaattctttgccactacaaaaattccacaataaataaccttgtacaatcataatttcctacatgtatgtacatagctgaagaataaattctttaaaatgagattgacacctcaaagggtatagatatttatacttttgatagttactgccaaattgccatccaaaggcaatagaaaatgtatattctcaatttttagatctttgtaaatctcatagatgaaaaatgtcatcagagcacagttttttatttcttttactatgaatgaggtgagtatattttgatatatttaag

SEQ ID NO: 2850 - DNA, 7809 bp, Homo sapiens
aattggtaaaggtacatgccttgctcagtgcagaagggcagggagagaaaatattgcccagtcttgtagccaggattgtagctccttcctacagggaacccaattttagtcagagccatcctaacatattcagcattttagaaccacccttgatgagtctggcatccctgcaggtaattcagaatcagaccatcctaggtgtgatttttgaaagaaaaatgtcatcaatcccaacatgtacccaccatctgaagcttgaagtccctctacagcatcacccagcataatcattgagctaaaatgcaaatacctccaggaatgaggaattcataccccacaaagccactccattcacctttggccagagatgttagaacattctttctctctttgagttgaaatatgcctccctgttacaccttccctgtggttctgcttctgcaccttaacattcaggttgacttccttaggatatatagaaattctgtcaatatctagggtgcccatataacttactgtgtaagctatggcttttgagagtggaaggagatggtaactgggtgcagtgctaggacatggggcatgaactggggcaatctgagcaaaccaggacatgcagtgaccccatcagtatacctcagaaaatctgacagctggtggttccatgtccaggcaatgaggcccttgcctggcacctctaacctctgacgacctgagggtgctcctcacagcacctgggagagtcaagggttccagtggggcttagcatgctatagtcacctgttcaagaggatcttctttctctcccagggactttgtgaaggcctttatccagtttaagaagcctatcgtggtggccatcaatgggccggccctgggcctgggtgcctccatcctgcccctctgtgacatcgtgtgggccagtgagaaggcctggttccagacgccctacgccaccatccgcctcacgcctgctggctgctcctcctacaccttcccccagatcctgggcgtcgcgctggccaatgagatgctgttctgtgggcggaagctcaccgcccaggaggcctgcagcagggggctggtgtcgcaggtcttctggcccaccacgttcagccaggaggtcatgctgcgggtcaaggagatggcatcctgcagtgccgtggtgttagaggagtccaaatgcctcgtgcggagcttcctgaaatcagtgctggaagacgtgaacgagaaggaatgcctcatgctcaagcagctctggagctcctccaaaggccttgactcccttttcagctacctgcaggacaaaatttatgaagtctgaggggccccagctcacgggcccccaacttccagctctgccctgtgtttcggaaaccagagcacagtgtctgccccggccaaggagtttgtcaaggtgtctctttatacgtagggttgtgtccatttcctcgtgtcctttggttgctcctccttggtttgattttgtgtaatggatggaaaacgcagcatacttggcctcccccacctccctgcccttcctggccagagagctgtccaaggctgtatcttcccagggctccgccaagcaccgctgtcctttccccacttgctgaaatgcaccatgacggtccaggaaggggaagaccactttcacattcttctgactcaggctgtgtctacacagtgcctctgacttggagacttggccatcatggctctctctggttgtatttagatcgggtgtcagaggacgaccaatcttagggaatttccagaccaatgagcaaaatgattgtgcacacctggcctcagtctcctttccgacgcaaatctgtgtgactattagggcttggtcttaaaacccaattgagtgatttgcaaacccagatattgtacatttagaaatgttttgttaaatatatatttttaaaacaatgtaagtggaaattctgataatttatgtgtattatatgtaaagctagttttgcaaaaacaaactactagggaaatgttttttctttccttggacttgttttatttatttatttttgtttatatattgtgatgtctgttgttcacacagatactattttcatactaccctggaccaaatcccacacaaggttcatgccgtttggtgcattctagcaatgaaccatgtagaaataaagtttagagagatgaaaacagaaggatttctgtggacaaaaggaatagcgctgcacctctgtgtaaaacggttctcagctgtaataatagaatactagttccttaggtttgtccttaggagacatcttgggagagttttttcttccctctgctgtctttaaggagttaaagggccctcttagcctgaatgatcctgaaacagacccagtcccaaattgcgtgatgttgggcaggagtggggataggccctacctgagaatagcatactgtctagaataagacttctttctttggggcaaatgactgaacttggatcctgcagtctgttgcttccatgtgatcagtgatttctggtattggccagggggatggggaagagttcccactctgctgagctgtctggaggtctgaatcttttccctccagaagctgaaatgactcatctgttttctagtttttttatgtacatagggagcaatgaccaggaatgagatctccttgcccctgtgcccctgggctgcaaggggactccagcagctgtgttagaccatcagattcaagtccctggattaactacagagaaggagggattgggggttgtggttttgagtggtgaggagaaagttcaggaaaacctgaagttgagagcagacaaatggaagggatgtgttctgcgtgaggtttaaaccatgggtcaagcacccagaaaaagctagattctcagattctcaggatggagggatttttttccgtttctatcacagcccctgcgtattcctggaggcccttggccctccccttcttcccctttcctgttgggcaccagcctttcttggcccttctttgaagagagtggaataaggcagcaagaagtgggcacagcttatggaggtgaggcaggcttagaagagagagttctggtgacagttctctaactctctgtggtcctttatcttttcctggcaatcaggtgcactgggcagggcaggtggaatgtattcgtggccctgagctttgagtttcaaagaacacgttgatagtctacaccagatctagagacatggtcctttaagcagtgaccctcaagttaatctggactgctggtccttctgatgaccttggttccctccctggaaagcgtgtctcctttaagagttcatgagggtcaggaaggaggggaaacctctccttcagccagaggaggatggaattaaagtcctgtgcaccctcccctttgtccatgtaggatcctgtaaggacttcggacctgtcctacagggagttactatagggagacacctgcttttgcccaaatgcctgttgtcacagctctatctggatcttatctcctcctttgagaaagcaaatgtgagctttccaaaacccttagatgaccctggttcttacatattgtggcagacagtgtcttcactactgctaaattttcattagaaagagccccctcttttctgttgaacttctgattgggcgcagttatattcagcatcggttgaagtggggtcaggattctccttggacatggaaggggatgtttagaaattcctttagatcagtgtccaccttcattccctgcttgaaagaactagaaatgcttcagctttggatgtactatcaaatccaaacttctaaacatttcaaggatctctgaagattaaggtaggaatgtgaaaccatttctaaggtggaaatcttgctgttaagtcacaggtcctgggtgtaacgggggtggtgaaagtctgtattttggttgtttccatacagtcagttccaccaattgggtgaaagcaggtgaaatctttttgctgcagggtggactgaatttttcactttctgggtagttgttttgatcatgtgtaggcgaattccaggtaacttacagcaaatagatttgggatggaaaataccagacctctggttgtgtcagggtttatcctaatagctttcctgagacagagctcagactttcatttttgatcttccaccccagggccccctctctgtctatgggatcctttctcccctctctctaccattttcccgtaccttcccccataagtcactcccaagagcctgggcaggtctttgaggaattgcggctcattttggcagccccgtcctgcaattacctttgggtttgaaagaatagctgtgggtgggcaattgaggacacctctttagtcagggacctttctagcaatccactccctcccatcctgttagccatgcagtggaactctccttccctctctgccccaaccccggtgatggctcactctcagcatcttatgggaccatctgagttaacaaccctgttccaagaagactttgtgcagaacttttgttagggtggtcataccttctcaccaccatttggaagacacagcctaatgctgatgtacttaatgtgccccttccggcatagaaataatgtctgggtaacagccatcaaaatcactaagaatgacattggatagctatgagaaagtagtagagaattgatttaaaatatcattcttgtttggtatagattaaactaggaaatgttctctctgaagcatgaaaatgtttttcccatgtgaagtttagtacaaggatggaaaaataataatcacagtagactttgaacaatgcaactgtatctctgaatatccacatttaaaaatagccttcactgaatgctgaattgcatttcccattaatttttggttttaaaaattttgtaaactttttttttatttggaatttagtcacatccattaaattttccaatctagtttctgtggaaattttttaacagagagaaacaaatagaaacatcttcaaatcttcctaagtgaatatttaaaatgcagaattgcttatcttctgtttttctgtattcagacacttatatctgttgtatatattagtttagacactctcactaatatacacagtatttaagactctaaatgagatttcttaagtattttattttattctctgtaaatggttttgtataatctttaaacatctacactttgcctttgtagatatttaagggaaaccatttggggttgtcttgcatgtatatttttgttgtagataagtgttgcttagttatttctgcaaattttggttgaaatgcttacagactttaatacagtatatattttcaaaatataaacttttatatttctgtgataagttaggatatgcgttttaggcaatatttttcattaatatcacttgttcttttgaaaaatagcatactggtttggtgccaattttttcattagaatataatgctcttatattgttggagagcaggttaatcttttttcgaagtaattgcgtttgaagtataatttcaaaatgtattgaatttgtgaataagccttaccattaggatcagtaaatttttcaactttgcaactacataagtagtttaagatctccccgtaaattctcactgtgtggcagttgatggagtttgtgaacagagccttaagcttgttgcaaaaaaatttaaaaagggtaatacgggttgtttcctccatgcaacgtaagccatgctgatggactgaatgcagtctgtaattcatggctaatccgaagagtttgattgagttgatggcggcagggaccagatagacaccttggtgattgtctttggccataagaatagaccaaggataggttttccagagacaccttcatactgtaaacatggtttagacacggtcatagggaaggctgctggtccatcatttgttctgaacaaatggcatttcctgctcctgaccctggcagttggccccagattccttgtcgatgacttggaaacgtccattctgggtaaggtcagcactccctgagagatgttaacaaagtttacctatgagtcttactgtgtagacaatctgaagtcaattttagttacacaatcagcattcccatgtgtcctcagtgtcttatcaatgaactatgtgtatcaagccatactaaactggagtttagcaggacaaaggcaaactaaatgtagaacataacatatcagctgaatatgtctatccaggactgtttttctagaacataaatcatggagctccttgacagtgtatccactgtttttggggtttaataaaaccaactagaatttagacttaaaaagaaattattattccttttggttgtccacataaagtagtccagggctatcatatggctaaaatcaagttatttggttcatctctggtatgtatttataaagtcaacttatcagccattaagatggagatttgctttaaatttttgcagtgtgtgtggcagtcagaaaaacccatatctagttttcaacttcacctctggtgtttttatggcttaaccttatatcattgatccaacatctagcctgatgctggagctcttatttctagcctgatgctggagctcttatatctagcctgatgctggagctcttgaagctgactcttggaagtttggagggtgtagagtttcccatctagtatttaatttgtccctgtgccattagtcccagcttgaagtcatttgccagtgtcgatgttgacaggattgtgacaatattgcctttcataaaaccgagaaccaaagaattccattattctaacaaagcctgagtttcatagattgtgggcacatctagacagatatgtgcatgcttgatggtgcagagaaactgctgacttccaccaacctcatgctccccctggctggccatacagagggattcgttgtcatattgaaaaggctctgaaagatgagtttctaattgaagctcactatctcaggttggtgtttctactgtgtagtcccaagcctgtatccatatcataaaagtggaggcctggtactcctccaggttatctggccagtgtagactcctccatctgaatatgaacctccagggtaagaatttttcagacatgtctatactgaacagtaggatcctgcactttccaaatgtctgcctccttttgttcttcattgacccattctaattcctgttaggtgtgagaagaattgtcttcagttctctctccattctcattcatgatggaatcattgatccattgaccagttgagaaatgattgatgctgaagaagtggtattctattggtaaggcttattaccaaacttccgataatgaagcaggctaccaaaaacttatccagcccaccctaggagtgtttggatttgatcatggatgtagcatacaccaaaatccaccgagacctttgcaaaattaggctacttgttttattttgccagattatcatgggagagtctttaactagttctgaatatttgtaagtctgagtacttcatagaattataaagaaggtacagctgaccccttctcaccatgttgtaaatatttactgagactgggtgcagtactgagggataataatcttctgatttatcaaatcctgactgtctagagcaaattgtacactctctttgtgaatggtcctgtaacgtgtatgaacacatttctgggtgccttagaagttgtatttttcatgtgtgctaatatgcagtatttatacattgtgagaagctgctttgaataaaaaggttgaaacttcgtc

SEQ ID NO: 2851 - DNA, 11545 bp, Homo sapiens
caaatgaactggttgcgtgaggagtgaagagaccgtgtttacagtcaccagcaggctgcgtaaagaagtggcccagtgagacagggaaagtgacccagaaaatttagttttgttcagaatgaaagctgctgtatttcatttttgtttcttaatttgacggagtaggaacgttattttccttctctgtcattgagaccagtagcatttctatgttacaaactgaagatatttggggtctcgtcggcttgggattatcaatgcttgggagtgtgagtgaagacactcaggatggctcaaggatccggggatcaaagagcagtgggggttgctgacccagaggagagttctccaaacatgatcgtttactgcaaagtaaggcgcctggtcaagtgccgtgcgtgctgtccgtgtggactgttgtgttctgtgtagggctgataaaaagacaaatgttttctgcctaaactgccttactgataaatgcatattttcttctcacatcctctggttctctagttctaaaattcaaggaagttcatacttgagcacttggtatttaacacttgaaaaatattatgccatttagttttctttaaacccaaaggttgcctaagcaatgcagatgggaagacacattctccttcagtggaaaggccttagtgtaagatgtatgaactgaaagttcttcagactcgtagtatgtacaaaatctgggctgaatgctgtgggagatagagaggtatatttgtatgagatgcttacagttggtaggagacataagatgtacacaaataactgttatagagtctaaatgttaatttccaaaatagatgtgcaagtagagtgttacataatttcagaggaggaggccagttctcccagcctcagaggtgagaatgggcttgtggaagagtggtctttgaactcagttttaaaatatgtgcaggattgctttatgtggaaagcagagaggaagaacataccaggtgatgagatgtttcagcaagggcacagagctgaggaaagtaacagcaaccggaactggttagcttggacataggatgcattacaaggagtaaatggagataggattttgggaagagaggctggctggagccagatgttagtgttgaattagacaatttaatcaagaaaaacttctgtgccaagagttgcaagattgagatctctttgggattatgactgttgccccattgtgctgaatggattgttatcaagatagagcggaggctctaggagagagatttctgtgtctgtgtgaaaggtaaggagggaaaggagagacactaatccagcctgtgaaatcaccttcagaattaagagaaactgataagaggaattaaagtctggattaaaaatgacttggaaactgaaggaatataggcggcaagtagagggtcaaagatgacggggtttttgacgttgggtaaatgaaaatcattggtgctattaattcaaattgggatatttggaaaaagaatacattttaaaggaagaaaatggcacataagtttattttagtacatgctgaatttgacataattgcttcttattgtacacctttttgatgtttgcatgtttgtgaaaatttaaactaactctcttgtatgttaataaggaaataagttaatgttcatttcactaactacttgagtttctactcagttctgtgcattctgagaggctctgtgtattacttatatgggcaatgtggaactagatattcctggatgatcaatatggtgaatttttctcttttccttgtaaaaatagagttctcaaattattctggctttgagtgtaagattctgtaattctttgctttgcaagagaatgtctagataacccatctctaagaatcatgcttattaaattgcgataaagaaaaaaataggttaatgggactcagcaattagtgaaacatacagaataatagacattgagtcattgttactttcttaacccacccccaaactgggagaccccgtgccaggctggtaggaacatgggctttggagtgagacttaggttaaaatgccaactttaccactctttagcagtatgactgtaagttagttctttaacttccatgagccacaattttttcatctgtaaaaagaaaaaaaaatgtgggaggaaggtaattgtgaagatcactttagataaatcgaatgaggcatcttatatcctacttagaccacaatgtggtccgtaatgaatatctctttttcttttcatgtttaggtcttgtagagtcagtgacacttggagaggaaataaatgataaaatctctaaatgttggtgctgttaataagttgtctagagcaaatttatacagtgagtttttttttaagacacaggaaaacaataaaaatatttttatattcttcagaggattgcaaattcatggattattaaagaataagaaatgcaaaggtcatgtaacccaaccacctttctactagaatgtttgtattatgtttacaggaaaaaaaaacttcctgcaggtttatgagaacttggtttttactttttggtggtagtaaggggcccttttctggtttaatttagtaactaacatgtcaattgctgtagttctttagagaaatgacaactagtaatgaaactatatcttactttcgtgtgacaaacttgtgtaaagagtatatatatatatatatatatgttcatgtttatttgctatattaattaccataaaagggacattgaattggttcagtctgttagaaagaagacacacttattgcacagtgtgagctcaggtcctgacaccattttaaacctagttaacctgactgacttaaaccatggttgtacttgaactatgggattttcatatagttttctactcctgatgctgtaggctgccttttggctacaaccaagaacttacttgctgtaggacattatcctcaaggtatcatcagtaagggttggattgtgaagccaatgacaattcaaagcattttctttggaagtccttttgtgtaatcaattattcaaagtcatagccataaacccaaacctttccttagatacccacgactacaatttacatttaaaaaattgtgctttcatttttgttttctttctcttgtttgttgttgttgttttttttctcttgttgtcagacactttcagtgtgaaatttttgcttggactgcattgtgttgattcagatgctgacatttaaaaagccaaatctagagaaatgaagcttttgggtaaactttcgagtaataagtggatgattatgtccataatgttgttgtgacttttaaatgacatttaggatggtaacctcctgacatatgagtaatgatgggtgggtttttaaagcccacacttttcagaacactcttcatttccttttcatgttttcatgtcattaactgtgagaagttgtactttcccaaggcatgacttatttattgacttgaacagactttctaatttagtttttcatccctcatattcacagtttggattggaggtgtgtatgaaaaatgtattggtcacattaaagatctatttaaaagaaaaccttaattattcatgaagacacccagacctgttaaccttttttatattcctgtatccttaggatcctgagttactgaattgcccagtgtaatgatgatatttgaacctagctatacatcacatcatttagggtgctttataaaaatgttaatcctcaaaggaccccctccacaaggtatttctatttaataggtctgagctgggtcctaggaatctgagtttcaagatgttctcaggaaaatctgatgcccaactaagtttgaaaagcacttacttagtcttttacaatatccagacatagtatgtgttgcaaagtaatgagagagttggtgttttgaattagatttttgatttcataattatttgtagatctctcaaaacgtagaagaaccaagctcttgtcatagggattttagtagcttttccttagatattttctagtcttattttatagatgaaagaactaaaagtatagagagggtgagtaacttgattaaggctcctcagcactttcccatggaagccataatggtgtccagggagcctggccactccaatcagttgcctttctagcaccctatgcgactaccatgttatcaaccacagactactgttaccacattgttggagctgagtagccatggggcacattaaattaatgaaaataatatgtggcagatctttgactttcatgtttcttctgggagagttgacttggattaatgtctcacttttttattgatttttaaaaaatactttaagttctagggtacatgtgcacaacgtgcaggtttgttacatatgtatacatgtgccatgttggtgtgctgcacccattaactctcatttacattaggcatgtctcctaatgctttccctccccactcctgccaccccacgacaggccccagtgtgtgatgttccccttcctgtgtccaagtgttctcattgttcaattcccacctgtgagtgagaagatgcagtgtttggttttttgttcttgcaatagtttgctgagaatgatggtttccagcttcatccatgtccctacaaaggacacgaactcatccttttttatggctgcatagtattccatggtgtatatgtgccacattttcttaatccagtatatcattgatggaatgtctcacatttttaatgctaaagtttcattctactcattggtgcttttgcttcttcggtaaagattttctaaaatgtttacataggtaagattgcttttgagtaagagtaggttgctttctgattttgtttggatctttggtgttaacaatgcctcttgacaaagttctcctaactagactggtaatttgatttgtttgggtcaggaggcatggaagacatcacactctggatgtcttctacatccagaaggatggaggcatggcagatgtcacactctggatgtcttctacatccaaaagctggaggctctgcctgtctggtcccagctttgtgtggagaacttcactttcctgattctacttcttgttttgttttctaccttcttcattcttttcctccttccttttcaattgtgagatacttctaacacaaaaagaatatattcagtgtccatgtaaagtagaaagaattaaaaaatgaattatatgcactcaccattagcttaataaataaaatgtaatactttggcctcatttccccttctgtaaagggaggaaattggtctaaaaatgtacaaatacctttctgcaatgatttcaaagttccattctataactttttgatctttcgtaaattagtacacttccctgatatcaaaacaatgttgtgagactatatgcacgtttaaaggtcttttgagcttttgaagaaatattttagatagttgtaggtaatctaaattggattgagataaagcccagttaagtcaggcattagaataaaaagctttaattgtaattatttaatattcaacagtggaatttagatgacatcttggtggcaacctgtttctttggcttgctaataacatttaagacatttataaaattatcattttgtagtattaattatatgctatatacataacaagtggtgtttaagtagcaacactgtacattgccagtagtatatagtgtcatagatgaaataggggttttagaggaagacaaaaaaggccaatgttcttgtatatcaacaggttagttgcctagcctcgtcactgatggcttccttcacctattcatttctagttattgactccttttctgctggaatttgagtctagcctttatgttgctctgataccccaaggtcactcttcctaatgatttagggcccttgaagtcctgggcagttgttggtttaggcatacatccagaaagtaaatgtcacactattttagttacattggctgtggtatgcagcaagaagggaaggatctagcctggaagaatccgatgctatggaggaagctagggatagagtgtggtttggaattcatagagggcagtggtagaagccagcacaattgagagtctggggacctgcaggtcctggtgactaaggcatgatgaggattagaaactgtcgaatcaggaaatacgtattgagtgtcatttgtgtgccagacactattagatgctaggaatgcaagatgagaactgagccctgaatgagcccacaggccagctgggggtaaatggggaactagacaattacagtgttggtagaagcaactgaggggcatgggaggaggtagaggggtcatgtagtccatcccaggagaggggatgatgatgtagaagacatccagaggatttggcacctgcttcgattcttgaaagatgactaggaattaaccagatggaggaggagagagaaggtgtaggaggcaggactagcacctgtaaaagagcagatttgtgatgtcgtataccgagttcaggagactttaagtggttgatatgaagctaggtttctgtgatgaaaggttgaggaatagagctagacagatggattagggccagatcacaaaagaccttatgtaccatgccaaggagtttagacattgtaaaagtatcttccctttgggcctccacacccaagttcaactcctttgcatgctgctgtctgccccagaggctgagctgtgaggactacatttacagggctcctgtgacctctgggtttcagttgggtttggttagtaaaagtctggaaagagatgggagggaaggagaatcgcaatgtcagagaatttcttctcctgggtctcactctgcaaaaccttgcactggccatatccgtctactgaagtttgttgattctctcaaggcagactactttcctcttctgggtccggacatcctttttgtctactcatccttttgggcctttgccgactactttcctcttctgggtccggacatccttttcatctactcatccttttgggccttggggtggttccagtttgtatttgttatctcttgctgtgtaacgagttatctcaaaactcaatggcttgaaaacatttattatgtcacaatttctatgggttagtaatccaagtgcagattccgtgagttctccagcacagtgtctttttaaaaggctgtgatcaagatgttgactcggattatggtttcgtctgaagtctcagctggggaaaagtctactcccaaacttacttgtgtgactgttggctggattcagctccttaggggccgttggaatggtggactcggttcttcgttggctgtttgccagaggccattcttagttatttatgacacgtgtctctccatatcgcagctcataatatggcaggttttttttttttttttttttttttttttatcagagtgacaacaggcagagaaggaagatgggtggtagtagtcttagtgttttataacctaattttggacatttttttctttattatactttaagttctagggtacatgtgcacaacgtgcaggtttgttacataggtatacatgtgccatgttgttttgctgtacccatcaacttgtcatttacattaggtatttctcctaatgctatccctcccccagcccaattttggacatattatcccatcccttttgatagtaagaagtcactaggtccacccctcactcaaggtgagggatttacacaaagatgtgaataccaagatccagaattcagaaaatctttgtgggccattttggaagccatctaccacacagctctacttctactagccaggggtttctgagtgttttttttttataatttccctgtaccctagaactcctttaaacttggtccttttggaaatacattttccttaaattgtcctatgtatatcatctgtttaccaataagaccctaacgaatgcaagtattatcccacaagcaaagggaagcgattgagactctgcgtttcttgataagggaattcttcatgaaagggtttgaagcaggggagtcatttgtccaaagtggaggatgggatctgaaatggggaagtcaatgtggagaagattcagtgtggaggtcaatgggtgatcgatgtggaagggttcggtgtggagggagagtgttggagaagtggtaggattggaggtaggaggacagtttagagattgaacaggaatccaggtgaggaaaaatgatgcccaaatcagtggcagtggtaatacagatgggaggatgtgtttgagagatgtttaggaggttcaggcaacagaatttgggggctgagaagacgtagggagaatttgagaataatgaggaggaatgaggagtcttttccctaggctatatctgtgattctcagaaagtctcctgggataaacttttgaagcaaatagctgtagaactggattgcctgcccctctcttccctgtatgtagataaattgagagagcccaagacagagtctgtaaatggaccaggatatctgggtatttgttctggctgccccactccactagctcatttatggccatgcgtaagttgttcctactttttgttaagtctagttctttaatttgtgaagtaaggggttagctatgctgggtgatctctaaagcatttttttagatctaacattctaggtcttttgtaatctaaaatagagaaacccacattttattattttactacttcatagcctcctttactttatttttaattttctttaaaaagtgaaccgagccaaaactttaaaaacaggtaagtcagaatgtttaaaacaaatggcttttggtcttcagcacttagggcttgttttttttcactctttttttttttttaacattaaataaaattcctggccacatgcagtggctcatgcctgtaatcccagcactttggaaggccaaggcaggcagatcacctgagatcaggagtctgagatcagcttggccaacatggcaaaaccctgtctctactaaaaatacaaaaattggccaggcatggtggcacacgcctgtaatcccagctacttgggaggctgaggcaggagaatcacttgagcctgggaggcagaagctacagtgagcagagatggtgccaccgcactccagcctgggtgacagagtgagactctgtctcaaggactaacttcagaaagtgttcagggtaactaatttaattgttcagtctacattttaagattcctttcattaaattttttgaagctttttttattgccttaggaaaaaactgttctgttttccttttcccccaggattagacttgctggaagaaaagctcccccatcacattatcttggttggcaggagacaggcatgcaggcaagtcccagaccagtggtatcagtgtccacagatgaaagggatggtatttttagtgtggggaatagctcagtgtggtttcatatgatgcattttgatgagtataactttctaatttgaaaagcctttggtgtgtttacgtcttcatttaatctttccaatttctccccctcatttcatttcaaggagtctaagatttttcattttggcaggcagttgatcactcttgttattgacactcctttgcagtattcttacactgtggagaacctgaatggctgtaaattccctattggcaggattttggagaaaaaaaaataaaagcgaatagatacctgtgaaagaaaaaataaatacattttaaaataattggaggatagaaggattacttttaaaagttctgttagtttgccagtacagagcaaaacagaaaatggacacatttttttgatcagcattctctgttctaaaaacttatttcaataagggaaagaatatgcaaagacatatatatagatatagacatacacccactccaaaagaatagtgatatctttctggtaaataatatccaaagtttggaaagaaatcaaatatccattgaaaggaaactaattttagggggataggattcacatttggaatgatctcatagttagtttactggatttctgttctggtcaacctaataattgtcttgaaagtgagatggctactgacattctagggtatggttagggagaatattctttatttttaaaaccctacaagattttttcattttttaaaataaaatgtcttatttgttaaatatgatggttatgtaggtttactcaaaagtgattttttccattgctctttattattttctgcatctctgtgcttacagctgaaataatttttagtattttctttagtgcaggtctgctgaagataaattctctcagttcttgtttgtctaaaatatctttgggccaggcacgttggcttacgcctgtaatcccagcacttgggaggccgaggcaggaagatcacttggcccaagagtttgaggccagtctgggtaacatagggagacaacatctctacaaaaagaaagaaataaaataaaaaaaaattagctgtgcatgttagtacatgcctgtagtcccagctactcaggaggtggaggtgggggaatcacttgagcctgggaggtcaaggctgcagtgggccatgattgtgccaccacactctagcctgggcaacagagtgaggcatggtttcaaagacaaaaagaaagtctttgtttcatcttcattttgtgaagggtgttttttctagatttagaattctagattgtcggttattttatttatcataactgtcattgtctcttggctttcattgtttctgttgggcagttggctgtaagtttgattattcctccttcgaatgtaatctgttttttcctttggctgcttttaagatttatttcactttggttttagcagttttattataaggtgtgattttctttttaatttattctccttagagcttatgagacttctttttatttggttggtgcttggggattctttttttttttgatggaggcttgctctgtcacccaggctggagtgcagtggtgcaaccttggctcactgcagctgccacctcctggaatcaagtgattctcctgccccaacctcccgagtagctgggactagaggtgcgtgccaccacgcccaaataatttttgtatttttagtacagtcggggtttcaccatgttgaccaggatggtctcgatctcttgacctcgtgatcctcccacctcagcctcccaaagtgctgggattataggcatgagccaccatgcccgactgtgcttgggaattcttaaccattaacttttcaaatattgtttatgcctagttttctcatttctctcttcttgggattgtgttcatatgttaggacctttttcctctagatttcatgtgtttcttatgctcttttctgtattttttattcctttgtcattttgtgcttcaacatggatattttctaccgacttatcctccagttcactaattctctcttcaatatattagataatctgtggttaaagtcatcccattgaatttgtaaccttagttattgattttttaagttct

SEQ ID NO: 2852 - DNA, 46394 bp, Homo sapiens
cctgccgtgtgaggtgtcagtgtgcccctgctggggggtgcctcccagttaggctgctcaggggtcaggggtcagggacccacttgagggggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccgcccagttggagcttcccggctgctttgtttacctaatcaagcctgggcaatggcgggcacccctcccccagcctggctgccgccttgcagtttgatctcagactgctgtgctagcaatcagcgagactctgtgggcgtaggaccctccaagacaggtgcgggatataatctcttggtgcaccgttttttaagcccctcggaaaagcgcagtattcgggtgggagtgacccgattttccaggtgccgtctgtcacccctttctttgactcggaaagggaactccctgaccccttgtgcttcccaagtgaggcaatgccttgccctgcttcggctcgcgcacggtgcacgcacccactgacctgcgcctactgtctggcactccctagtgagatgaacccggtacctcagatggaaatgcagaaatcaccatcttccgtgttgctcatgctgggagctgtagaccggagctgttcctattcggccatcttggctcctcctcctttttttttttttaatggagtttcactctcgttgcccaggctggagttcaatggcacaatctcagctcacttcaacctccacctcccaggttcaagtgattctcctgcctcaggctcctgagtagttgggattacaggcatgcgccaccatgcccagctaattttgtactgttttagtagagatggggtttccccatgttggtcaggctggtctcgaactcctgacctcaggtgatccgcccacctcggcctcccaaagtgctgatattacaggtgtgagccaccatgcccgacctacttttatttctttaaggaatctccacactgttttccatagtggctgtactagtttacattcccaccagcagtgtaaaagtgttcccttttcaccacatccatgccaacatctattatttttaaatttttttttattatagccattcttgcaggagtgaggtgatattgcgttgtggtttttgtttgcatttccctgataattagtgatgttgaacatctttccatatgctttttggccatttgtatatcttttgagaatgtgtctattgatgtccttagcccacttttttataggatttttttttcttgctgattagcttgagttctttgtagcgaatatgacgtatttcttaattttcagagttttgtaatcttcggagagaaaactcttaatttttagttttgtaattcattttgtaattcagataactacaaggcagattggcataaggaaaggtccattaatttagtagagttagcatatttggaaaataagggatagaaatattgattccaacagtagaaaatctggggtggagaagatgaaatgtgaccaactatttgaagtatgcataagactttatgcagaagagggagagaggaacagttagggcagatgtgattgtatgatcaaaggagtaggaattggacagtctgaaattgtatagttggagataaatttggatggaaatctgaggttactaaaggtattgcataaatgaaagataatgccagagtacaataagagttttcagaattacattttctgattttgagaatctagatataatttagtaactttttgctccaatattctcaatagttttttagtactagattttacattttaatatataatttctgtttttattatttttttcctaaactttttcctaaaattatttttgtccagtctagtacactgtcagtttatccttttcctatggaaataccttataactggttttcttgtttccccttttgccctcttccaactttttttcctgtacagtagccacagtgaccatttaaaaaaatgaagcaaattttttcactcttttgcttcaaacttgtgggtggatttccatcattctattttaaaaaatagattaatgaacatctagaagactttaaaaagaaataagctatttgcgatatataagggaaaagagttcgatacttctgaaagaactttctttatgatccataaagcaagacttcctgtcaggggttcagatatataatgtgtaatagtaatagttcatcaccactaggcactgcttcaaggacacacacacacacacacacacacacacacacacacaatcctcaccattattatatgcataaggtactagtatcatctctattttataggtaagaaggcaaaggcacagataatttgtatctaaaaatccagacaaggaaaccttagccaaactggtgatccccagtttcatggtcttctaatttcgtgatcccactgactgcagatcagtggtgtctgcaagacatttttcacttgtcatttcttgatttccatgcctttctactaagttcaatttgctgtttgtttaagtatctagagtgaaaatctgtgggagtgggaattttcttagtgtttgtctaaaaatgtgtttattttgcccacattttttgaatgataatttaataggatatagaactctagactaagatattttcccccagcacaatgaaatattatttttggatgctagcccctgttgctgcagttgagaaatctattgtttttctaattgatttgtttttcctctttggttactcttatttatttttaaaattttattgatgtataaaatacacataggaagtgtacaaatcataattgtacaactctattaattttgatatatatacacacttactttaccactcagatcaaggtttgaaaacatttctaggatccagactgttcccttatgtccattctcagtcaacatccaccctttcccctctagcacttggatctctctccttttttaaaatcataagctcctatctacgctcaattttttttgctcttttatccagcatttctaggtgtttatggatggaagtttttcaggtgatcttgcttgaaatatgacgttaagtagaagtctaaggtaaaggttatttcccattgcacttaaaataaaatctcacctacttaacctggcccacattattctgtatgaactggctcctgtgcaccccttgaacctcatctcacacaactcccttcctcattcaagcagcactggcctcctctctgttgcagagtacaacaagccctttcctaatgccaggccttgtatttgctgtccctctgcttagaacctttttttctgtagttctttgcatggctagtttacccttcaagtcagactgcaatgtcagcgcctcagtgtcctcctcagtgtgaccttaatctctactcatcactctatatatttctttcacagcatttatcacagtgtatatcttaattggtaatttatttttatacttctttaaaaaatcaccttttattttagatataaggactacatgtgtaggattgttacatgggtatattggacccagatagtgagcatggtacccactccctcctgcctcactctagtagttgacagcatctattgtcctcgtgtttatgtatatgtgtgctgaatatttagctcccacttatataaatgagaacatgtgatatttggttttctgttcctgtgttaattcacttcagattatggccttcagctacatccatgttgctgcaaaggacatgatttccttattttttatggctgtatagtattccatgctgtaggaggcatcgcattacccaacttgaaattataccacaagactacagtaatcaaaacagcatggtatgagtacaaaaacagacacacagaccaatagaacagaatagaaaactcagaaataaagccatacacctacaacaatatgatcttcaacaaggttgacaaaaacaagtaatggggaaagaactccctatttaataaatggtgcttggataactggctagccatacacagaagaatgaaactatacctgtacctttcaccatatacacaaattaagataacatttctttttcaaaaatttaatttttaaattttttgtttctgactgcttctctatctcaaatgtcagctctctgaaattaggcacattatctgattcataactatgtgattcgtcaccactatattcattttctaaataaatgaatgaaataacttttgtagcttcagaaaattttaactccaaagaacatatatgttacgtatgcttgatcactgaacacttaagagtctgttctcacactgtgaaccagattcctgcagtgcttaaggcactgctcactaggcaagttagacatcttctgaaatctgggccagttgtggcaagttaatgatagaccatttaatagactagcaaataaatgtattaggttggtgcaacagtgattgtggtttttgccattaactttcaatagtatatcaaaagatatcaaaatggcaatatttctggggtggttcataaacaatctaagccccattgatgttgggtcccactaacccttgttatctcacccccaacctgccttctgggtctaattttaaagttaagctctatttctcccttatctctcttttccaatataagctaccagcccatttcttgctatcaagtttttaaactatttctgcatttcaaatagagtcctgaaaattcctttcgtaaatcagaagggttatctgccattttctaagcagctgatttaagagaattggatatataattgtgccaggtccttagacagctcattatatatgtaagcttatattttattgcttcgagaaaactgcataaaagcaaaatcacaaattccagcagcatactgaagtgactacattgaatgtagatattaatctttgcattctccaatctcttatgtgcaaaaccatttgtgaaagcaaagatagcatgcaagcttcttaatgaatatttgtccagtgagcataagaataacaacattttgatattttcaatccaggtgatagagctttctttttccctctgctctctcagatgtctctagtggagtcaatggttaattaattggtcaatattttaaatatttattgcacttttaccatgtgtatagcaatgggagagggctattatgtgcagggggaagagagtggcatcagtaaggaggtggagacaaagctttaagacagtgtttttacatgaagataagagaacaaaatagtagtcatttagcaaatatttattaagtacctatcacgtattaggtattgtcttagacattggagatacattctcaattctcatggactttaaatactactggagtgagaaaaacatttagcaaacatattggtaaattaaatgatatattatggtgataagtattaaggagtaaaataaaggagtgaggaagtatagcgtgttcaaagactggaggcctataatttaaatagggtggtctgggaaagggacagtgagaacgtgatatttgagcaaagacttgagagaaggtgcaagtgatgtggatatcacaggagtttacggttatagaaaaatttaatattaagcagattatttgtatttgtttctaaatctaataaataaataagaaaataaataaataagcaaaaaatcttgaaacctctatgaatactgtcaaatcagcctgattagtatatgggtctgctctgctagtcctttacaatcctgttcttgcatccagttgaggtgttgtctggctgagcagatgggctgttaataagcttgagttctattgtgccatctgaatcttcttcatctctgtagcattagatgtatcacaaggtgagtcagggagctggtgaggcagatggcacctatgtctcactgtggttgcattaggcaatgtcctatgcatgcatatggaagtgcagacagacagtgcaggtgggtgggaggaaaccaactacccagagaattttcactaggaatcttctcacagcagaaaactggaagattgatcaccttatatttattccttcattacaatgaggacctccagagttttacagcctaagaaacgtgttttaagaggcaacttctccaagaacacttctctaaagaagactttttgtttgctctcttagactggttcaggtgtgactttactatgactttctaaacttctgctgaattctgctcttttcaccactgtacaggaaagggcaggccttgttgactataggattgctatgaaactttcttaaaagttacccagaggtggtgtctgtctttcagaatgtggaagatagtatcactttaatttggccatctctgaagatggaaatagggaagggagttggtattataaggaggaattttgatgttattttttctaccacttgcatatgattaatggccaattacaggtattccaagttagtcataggatccagttattctcataaaattcaaatggtcacctagaagtcaagtttttttttcccataaaatattgggaaagatttatttgtttcattgcttttgttttgttttgttttgtttttggagacagtgtcttgctctgttgcctagtctggagtgcagtggtgctgtcacagctaactgaagcttctatcgcctgggctcaagctatcctctcacttcctgagtagctatgactacaggtgtgcaccaccacacccagcaagtttttatttttggtagagacagggtctcactatgttgcttaagctggtctagaactcctggactcaactgatcctccttccttggcctctcaaagtgctcggagtgcaggggtgagtcaccacacctgggccagaaagatttatatattacattttatgatatctacaaagggaaacttttgctagaagaaaatatgtctattaggcaatcattcatgtcccaaattgcaattacaagaatcaaaaaggatggggagaaataaacatatgttgaaaactttctgtgtgttgggtgctttccatatatggtcatctatttaaacttcacaaaagccccatgaggaaggcattgtcctcaattgacgggtaggagagtttaggaaactttcccaaggtcacacatcaagaaagagttagagtctgagttgaatccagatctgtttgactccaaactacttctcactgtgctatttcctctctgcatggatggtgctttctgactttcccattagtaccattagttacttgttttacatattttattgtctctttggcagataatgggtattaggtgccaagaattcattaaaacattataccataaaacaattatttataaaacaatataatataaaaatagtattaactttctgtattagttatctattgctatgtaaaaattatcccagttgggtaataatgatgcgtcaatgtaagttcatcaattgtaacatatgtaccactctgttgggggatattgacaatgggggcggctctgtgcacacatggagggagaaaggatatatgggatatttctgtacctttctctcaattttactgtgaatgtgaaactgctaaaaaaagaattcttaaaaaaatttcaaaacttatttacccccaaacatagcaagtaatgacaatatatatttatcactttctaagagttaggaatctgacaatgacttagatgggtgattctggctcaggatcccttatgaggctgcattcaagctgctggctggggctgcagtcttctgagggcttgtctggggtaggaggacccatgtgtaaggtggctgtgaagaagaagccccagttttttgccacatgagcctctcactaggttacttatgacatggcagctagttttccccagaccatgtgctacaagagagaaagagagtaagcaagctggaagctgtcctgtgttttacaatctgattttggaagtggtatttcatcacttctgctgtattctgttggtcagtgtgggaaaggactgtatagaggtatgaataataggaggctatctgtgagccttcctggaagttggctatcacactttctacaattttaatactttttcttggttgagaattgggaaaaacatcttccatgaattgtctttttgggcaccttttgcccgcttcttccatgataatatttaaaggttatctaatttgatcattctcttgttagcttagtatcaagcacatgtgctggaaagaactttgattattacttttgtagggactattcaggcttcatatcctgaacactctttatagaaagagatacagaattcttatcctgtatcttattttagctctaaccccaaccccaaacctaagcatcatatgcctgcaaattgcctcaataatgtttaaaaaaatccaatcatatctgatcaaatatagggccatctttctattctggagtatcttttctattactctttgactgcggcaatttttgttttatctccaattgtctcagagttgaagctggcaaagtgagagtaaatattcttccccagtgcaatgcactctgctatttagaccatgtgcatttggtttaatacataagtgcccagtgaataaacatgagttgattttctttaaatgacagctccatcttctcaggacatccaaggtccaaaagaccatctgtgtcattgtggtagacgttgtagcttctccttgcccatcttaagtgcaagtttttacacctcagctcttctctactcaggttgagccccttccctaatccaaggtgaccattatccctcagcagcttagataactcactgtagggattctagtgtcggctttttataaagctctctggcctctcaatcaaagtagtccagaagcccatatcaagaatattttatcttattatttgtcaaagttctactttttggaaggtgggaaaacacttgttaaaaaatgcacatttctaggccttctccagatattctgaatcagaatctctgtaattgggtgggtagggagactcagactatatctgtgattttttttttttttttttttttttttttgagaaagggtctctcagtatcacccaggctggaatgtagtggcatgatcatagctcactgcagcctcaacctcccaggctcaagcagtcctcccacctcagcctcctgagtagctgggattacaggtgcacaccaccactcctggctaatttttgtctttttgtagagatggggttttgccatgtcaccaaggctggtggtttttaatttaaataatacatttattaaaacgaaatttcatacaaagaatttacctttttaaagtatacaattcagtggttttcagtatattcacaaaggtcggcaaccatcaccagtaattaatttcagaacattttttatcacccccagaacaaatcttgaactcattagcaatcactttccatgttccctctccctagctcctggcaaccatgaatctactttactttccgtttctatgattactcattctggttattttatatatggaataatacaatatgtgtggcctttgtattgattggcttctttcacttagcataatgatttcaaagttcatcaatgttgaatcataaatcagtatttcattcctttttattgcccaataataatccattgtatggatatagtatactatgtttacccattcttcagtttatggacatttggtttgcttcaacttctagccattatgaatgctatgaacattcatgtataagttttgtgtggacatgttttcagttcttttagatattgttatggcctaagttatgccctccccacaaattcatatgttgaattcccaaccccaataccccagaatgtgattacatttggatacaagggtttcaaagagatgattaaattaaaatgaggccattagggtggacccaaatccaatctgatgtaagaagagatcatgactgcagagagatacctagggtacacatacacagagggatgaacacgtgaagagaggtggcaagagggcagccagctgcaaggcaaggagagaggctccaggagaaagcagccctggttggcaccttgatcttagttttccagctttcagaactatgagaaaataaatttctgttgtttaagccacccagtctatagtattttgttttgacagccctagcaaatgaatataggtgtacagctagaagtggaattgctggctcatatggtaactgtatatttaacattttgaggaatggccacactgctttccaaaaaattgcaccattttacaatccaattccttcacatccttgccaacacttgttgtctgctttaatttttttttagctatcttagtgggtatgaagtggtatctcattgcaattttgatttacatttcttgaacgattcatgaggtgtgcattatttcttatacgcttgtgttttaaaacgaagttcacaaataatttttattcattccaaaatttgagaactgctgtgcagatttatcatacttcaaagttgttacccagcttaaatgctttatctgggacttcagttgtccaaattaaagtgacctatgctatagtatggtcagtagaaaatatctatgttaaagttaatttatgagtaggccaatcagtccttaggagtatatgtgatgtgacctcagaaacttcacaccagcttgttttcttgcctgcatctgtgacatctaacctctgagagcagtaagtggcaaagtccactttgtcttgggagctagttagtgggaaagagaagccatccttgtgtgatatcctgggtgtgacccttgttatcactagagacacaaccatcactgtgcctcctcatggattaactgcaggctggctgagcctttagaaacaagttcagcatcccctagtttggacttactgctttatccaagtccagcttctgcttttggcttcactcaccttttgaatttacattcttttttgtctaattctgagaaacgtaggtgtttccaaatttacactctctaaatgtaactgagtgttgatataacgtggctctgaaatactgttggagagtctgggaaacaaaaagttgggcaatctttttgaggaaatgctgggcagtagtttttacttgtgtctctattataagtcacatgttcttataaataagcaagaaaattcctttaacattaagtgctgtgtaagaaaactggatggaaatacgtcacttttattcctccttaccattgctagattaaagtgtgtcacttacctgcatgttggggcctcgagatgctgagagtagaaatcaagttctgctctctctccatgaacttttggatcagcaggccgccactgttaatagaagtaatcctaaacccctgaaaatgcagtattattagcttgaaatttctaggcaagttttttttttaaagatttaacaatttttggcaatttctacacatttatattacgtggattgttatttctaattcctgctattaaatatctggcacaaaagtagggatgttaaatctttgcatttcagagctcagctcaacaaacgtggtgaagtttcataacaacaagtgggatgctagtctgtcagttttcagcaaaatgctatctctctttgttatgatgcttcttagtgatgatagtttctctgtaaggcagtccttggtattaactgaacataattaagctttacttctgcattgtagcaattaaagtaaaatagaagaaaaatctggcctgatacatgttagagttgttagattttcatttccatcctctatttctatttgtggaaaattctccattctcccaccattctcctcctaatgaagcttcaagggccctttcttccttttcccgccctctggcattgaggataaactagatcccaagattcagcagctacctcagctgactaggagccagctcaagatttttgtacatgttagattgaaaggcttaatggactcccaagggggagagatctaacaggcagttggacacatggacaacacatttattttacaaagttggacaatgaaaacaatatatcaactcaatgtttctgtttcagtagcaaaatatttgcaagcattatgtaataaaatatgaaataatatagaagtaacctgatagataatttgtacataatgtcttagtaatgtctaaggaaattggtaacatcaattcaaattacagaattatcataatggtttagttatatgaaaagactgttaacatttcattggtcaccattgataatctctttttattagatttatatttaacagtgattaagtaccacaatgtgctggcaacagaatagaataagggctcagaaattgttcctctccagtgatcttataatcttgccttatgcccatgaattttcttttttatttcttctgtgtggaccatggaacagtttgcattattactgctcataaattctgccctgatgagattagttttatagatgtagaatcaataatacttgaacacatttgcagctgtgtactgcccagtattgctcattaatggctttaaaagaatcagtgcattttgctagaagcaaagataatgagccattgattatccctgcacagcacaatttacagcccattttatttttaatgcaatgttaaattaatttgtaaaagatcagaagcattgctttattttcaagctgtgattaaacagttattgaacttttcatggagagcattaatcaattctcatctcttctgatttcccagagttctctgaaaataaagatgaatagcttgtgattacccacacttattgtgaggcagcaaacatggaggagaaaacatccttatggggttcatctctatgtgatggaatttgtcaggaagggttctagtccaagtatttttccttaagttcagattatggatatattctagatcaatgagtggggatggaaatttcactagagttttaactaaaagcaccttgaagagtatgaagatacatagaagttaaggcatgcatgtgtattagttaattcttccactgctataaagaaatacctggtcaggcacagtggctcacacctgtaatctcagtactttgggaggccaaggtgggtggatcacttgaggtcaggagtttgagaccagcctggccaatatggtgaaaccctgcctcttctgaaaatacaaaaatcacacctgagtgttgtggcacacacctgtaatcctagctacttgggaggctgaggcaggagaatcagaactcagaggcagacgttgcagtgagccaatatcgtgccactgaactccagcctgggtgacagagtgagactccgtcaagacctgagactggataatttataaagaaaagagatccacaattccacaggctccacaggaagcacggctgaggaggcctcaggaaacttacaattatggcagaaggtgaatgggaagcaggcacatcttgcaaggtcagaacaggacgaagagagtgaagggcaggtgctacacacttttaaacaaccagatctcatgagaattcactcactatcacgagaacagcaagggagaaatctgtccccatgatccagtctcctcctaccaggctctgactcttaacactggggattaaaattctgtatgagatttgggtggaaacacagatccaaactatatcagcaagagtcatgcttttgctttggaatgatgtatgatttaactatgctcacctacctgtattctttcttcttaaatgtcttttaagctcactttaaaaatatttacaaactcatatagcttttaccttctttatcatttattagcaaacttctatccttaaccgagtctagctaaattagatattaattgtacagaaggactaacatcattgtggtgaattgcttaggccactaaaatgaccttcagacacctgtttgacttcagaagtaaaggactgatttacattctcaatgaagtacttcatagtagatactagggagaaattataggaaaatgagcagagtagaagaaagtgttatatagagtcagatgtcacaatttttgattagatggtgatagaactctaataggaaagacaaaactgttctatctgggaattagcaggatgtagaggcttcttaattacagtgggaagaatagatttagaggggctaagaacaacaactagactttcctattaagggaagggcaagttctagaatggttgggataagaaaattatcctgtaagggctggaagaaggtccacgttaaatttagtatccacggaataaagtcaatcaggcaagcaattacattaggggcccagaaacaggctatagaaatccaagtagtctgtcaaaacccagaaatggggaatgagggacaagttgatcttacgggccccgcaggacagttagggagaaactatgagctcaggattccaatccctacttatcagaactaagtagcagtcctgtttaaagttagaataaatttagtggtgatgttcacccagcatcaagtatctactacacatgctttggcaggtctgatttgttggattagacaacagggacatagggtgaactttagggacctagagacgacctatggagagtgaaatgccttcaaataatactaacagggaacactaatgaaagtgtttacaggctggcccagtaagcaggtagtcatctaaagatgtggttcaatgaccgatgaaaggatcatctgcttcaaaatggctctttgactggcttgctgtctgattcagtatcttcagaccttccccactccctgccacttgctttctctctctttctcctagattttatttactctttgaattattgtttctgaaatatagatacggtgcttgggtaaaaagtcttaatgatttgaggttgacatgttttagactgaggcacagagagaataagacacagaacagatttgctttgtgtagggtaggagaggacagaagaaattagacacttagatagatatctccacagattgcaagcctgggttaaaagtagtgagtggtgctgaacatctggggaattgtgaaagctcttgttgctctgagggagtggagaaattccagtaaaggaatgcagagatttggtaagggcaaacttcagttaccttaaaatgttgtccgcgactgttctgtacagcagtaaatcaacaggttaagtaaggtttacattggaaggaaagatgggttgcgactctttcttgtttgtgtatgtttttgtgtgtgtgtgttgtagttcaaaacaaatacataaataaatgaaattagattgaaatccacaaatgggaaggcagtgggatgcactaacatgagaggcactaagtggtcacatgggaactgttcaggtagtggtgttgtcagagtcagatgtgtagattcctaggtaaagggaaggcatggttagacaaagaaaaatgagggacacataggttatatgcattaaaaggatgtagtgaggtgtgccttaaggaattgtaataagtgacttaaggagaaattgacataagattgaggaggtgttcagtatttatagattcaggatatggggctataaagttacataaaatatttgtagcagcaaagggcttgtgtgaaatcattgtacgtgttcagctttgaacccagatcattgctattatcttttctgtgtcaaagagaggtgtatgctgttttaggaaaactgaatatacaaaagtatatactcatatatataaacatacatgttggaagtgatttgttacattagaaaagggttcatttcagcattgaccatgcattcttgggggactattgcctttgaactggcatggccataggggaaatctgatccaagcttttaccaaggcagggagcccatccatagcaaatctgttacataagtattgcctttgtgttaacacttcacagtatgcagtaaagaaatcactgtctcagttttacagatgggaaactaaagtaagaagatatctaaagttatttagcaaactacccccgatttctaattcagagcttttcccagccggctctccagttgctcatcttccaccaatattatcagatgcctctttgctctgagactttccattaggtggggtattattgagacaactggaagatgatgcagctttgggctcagccctgggtttagacattggctctgtcatctattagctacaattaactaaacctctttgagtctatttgctcacttttaaaatggaatcagatgtctactttatttttttctacaaggattaagtgagatactgaatataaactgcctaggacagtacctgacacttagtaggtgctcaaaaaatgtttgattgctcgctccacatatgcctcagttgttcactttgtctatgaatacatgcagagctatcttaatgacagactaatttctgcaacgtcatgtcctttctaaatatgtagttcatttctttttaacacatgccattcatctaagcctctctgtgggctgtaaaagattcataaaattcttgattttgacatatttctagtgatcgttttgaattagagattaaagtttgaactactgcagaactttgcataggaatttgacttatttgtcttataccttaactgaaataaacttgatattagacctttgcttaagttagctgaattaattctgctttaattcaagttcatctctgcagtggaaaatgacaggcattattgagttatatacacttctcatccttgcaggagcaatttaatacactgcagagcctgtcaaaattcaattcaaggttgaatgactaatgcataaaagtcgattccatatcctatcacagataaagccagttatttctttttattaagtagatggggatgctatttggatctaaggtagtaaaagtttgaaactccaagctttgcaaagttagaggagatgtgagtgtgtggaaaactagggagtttcaggagtaacatctgcctaaagaaatgaatgaacacagacagagtttgacttggtcattttgtcctttatgcaagtacaatttccatagcttttgaatttaggagtaaacttaacacaaagccaagagctggaggaataagaaaagttttctaaggctcttactttctagcaatgctgctgtaatctaaatttatatgtgggtatgtatgtgcatgtgtacatatgcatgtatatgtgtattgggggaacctgcccccgatagtcacgtaggttcttttctattttccctaagtgtcgactggtctgagaaataaagggacagagtacaaaagggagaaattttaaagctgggtgtcctgggagacatcacatgtcggcaggttccgtgatgccccctgagccttaaaaccagcaagtttttattagtgattttcaaaaggggagggagtgtatgaatagggtgtgggtcacagagatcacatgcttcacaaggtaataagatatcacaaggtaaatggaggcagggggagatcacaggaccacaggaccagggcgaaattaaaattgctaatgaagtttcgggcacacattgtcattgataacatcttatcaggagacaggttttgagagcagacagtctgaccaaaatttattaggtgggaatttcctcgtcctaataagcctgggagtgctacgggagactggggcttatttcatccctacagctgtgaccgtaaaagacagctgcctccaaagcggccatttcagaggcctaccctcagggatacattctctttctcaggaatgttccttgctgagaaaaagaattcagtgatatttctcccatttgcttttgaaagaagagaaatatggctctgttccacccagctcactggcagtcagagtttaaggttatctctcttgttccctgaacattgctgttatcctgttcttttttcaaggtgctcatatttcatattgttcaaacacgcattctctacaaacaatttgtgcagttaacgcaatcatctcagggtcctgaggcgacatacatcctcctcagtttacgaagatgatgggattaagagattagagtaaagacaggcatgggaaatcacaagggtattgattggggaagtgataagtatccatgaaatcttcacaatttatgttcagagactgcagtaaagacaggcgtaagaaattataaaagtattaatttggggaactaataaatgtccatgaaatcttcacaatttatgttcttctgccatggcttcagctggtccctccattcggggctgctgatttcccacaacatatgtgtatgtgcatacatgtatgtctgtgtgtgtatgtatgtgtgtgcatgcacattagtgtgtgcaaaaaggcacaagcatgagcataggtcctggcactgcaggcaacctgcctgacatttttctggatgctgaaggtataggagtgaagaaaaattcctaccctatggagcttatattttagtggagggagaaatacaataaataataaaaataataagtatattatgttgtatgtctgatactggtaagcgctacagagaaaaataaaacaggggcagaggaaaaggaatattgtgggaggtacagctttgttaaatagagtgagcatggaaggctgaagtgagccatggaattattttggggaaaaagcattgtaagtagaaagagcagcaattacagaagctctgaggctgggcatgctggcatgttgggagaacaccaagaaggtcagggtttttgaagaaaagtgagtgaaggggagcagtaggagatgagatgagggaaaaacaggagtctagatcctgtccgcctatagaggtgacttaatggactttgtcttcttttggagtgagatgaaagccattggagggttttgcaggaataatatgatctgaattctatttctgtggctgctgtgctcagaatagactttagaggaacatagagaagcagggagaccaactagaaggctaggatatgacagtaaggtgacaagtttttcataatgccactgttgaagcatggctacaggaggagaggctgaagtaggaggaggacaagttaactggaggggaggaggtcagccatgaggccatgttattgtaagggtcatctacatgtgtgaggctaaatgttacctcttgaggagatttgctggatatgacttggggctatactcctaagtcttaatgcctgctgtcattgggcctacagaaaccatcaagaactttcattggaaaagactacagcaggctggctggcattttacctttgttgatatgtacccacagtccttctcattagccattttgccagataatacccaaactcagagttaatacaatgtcggtgcatttattttttgttatactttaagttctggggtacatgtgcagaatgtgcagttttgttacataggtatacacttgccatggtggtttgctgcaaccatcaacccatcatctacattaggtatttctcctaatattctccctcctctagccccccatcccctgacaggtcccagtgtgtgatgttcccctccctacgtccatgtgttctcattgttcaactcccacttacgagtgagaacatgcagtgtttggttttctgttcttgtgatagtaatatcagtgcatttatgatgaaatacactcttccaccaatattctctatgtcctgtcttggagattctactgattaaatacatttctcattctcttggcattgcattttcattttatttcttttgatgagaaattcacttttaatagggaaagtgagctttatgcaggcacatttttagaagtaatttatatggataattgtgtgtctttaaaaatttttgcatcatacaaaatgttcttatgtgataaatataagccagggtttcttttatcagtcagcaaatcaaagcatttaattaatttttgtgtgtggagagcacaatatagaactcagggaagagagctacaaagggaacagaagatataatttttttcccatgaaacttatggaatagtttcagcgtatacagagaaatcgagagaacaataattttcaaaggagcccaccaagcggtcatctagccaaattcctggtagaggtgtgaacagaattaggcttaatcacggaagccttcttagaaagatggacattgatggggccagatttttataatgagcttctatcttagaggtacaaagggagaggaaattccaaggagagaatgaaatgagttccatgcagaagatccaaagtcagtatgtttggggtagaaaaatacatggaaggaaaaatttagaagtgaagttggtgagtcttcactgctgcactggggatttgatatgagaatcaaataatgctggataagtagtgtcatataatgaaaaatggtgctgttgtttttttttttggagacagggtactccagactggagttgtagtggcccaatcaaggctcactacagcttcaaagtcctaggctaaaaccattctcctgaatagctgggattacaggtgtaagccaccactcttggctagttttttattttttatttttttttcttttagacagaatcttgttctgccaccaaggctggagtgcagtggcaccatcttggctcagtgcaacctctacctcctgggttcaagcaattctcgtgccccagactcctaagtagctggaattacaggtgtgtgccaccatgcctggctaatttttgtattttgagtagaaatggggtttgctatgttggctaggctgatctcaaactcctggcctcaagtgatccagcctcctcagcctcccaacatgctgggattacagacattagccactgggcacagcccctgctttattttctttgcacatttataatcaagcacagtctgaatgagctgttttaaaattccctatattatgcatcattttactaggatgtgaagcctgtgaggcaggaatttcattactttttgtcatggccagcatctagaacattgtccgcgcatagtgggtcccagcagacacccgctaaatgaattagtgaatgagctgcagagttagccaacaaagggaagcacgttaagccataggcctggtctacaatggattaatggatttcccattgaactttcagaatctgctggccttctatcacagtcgctctgctgcagagcaccatttttgctattataggcagtaagccagctagcaaacagccatgctggggtacttgccaaactcaacaaatgccatttagaaacaaaagaacctctaatggagacatcagccgtttgttaaacaaaccattagtttggaagcagaagctgcacatgtgatgaatctactaatttacagagcattattggacattagttaattgccagacaacttcatgtcccaggatacattgaggaagcctctattactaaggagagattggatgtcttgcctgttaatgattacaggacgcatatacaagaatgaacgagtgagtagctcctgcatcatcctagtgtttcactgccacttctagaattatttctgagtttttatttttaaataaaagttatacttacacgctgaatatttatttatatttatttatttattcgtttatttcttgagatggagtcttgctctgtcccccaggctggagtggcctgatcttggctcagcacaacctctgcctcccgggttcaagcaattctcccacctcagcctcccgagtagtagctgggatcacaggcatgcgctactgctcctggctaattatgtgtatatatatatatatatttcagtagagatgagttttcaccatgttggctatcctggtctcaaactcctgacctcaggtgatccacccgcctcggcctcccaaagtgttgggattacaggtgtgaaccaccgcgcctggcctttgctgaatatttaaatggaacagaaagataaacaattagaattagtctctttacccgaagtccctttccagatgcatttttttagtcattatccacatataaaatgtcacaagcactcctcttgagattttacttaatgccacatttaggagatttttacagcacaaacaaatataaccaattcttatttaatggttgcatagtgctctattttgtgtgtgtttaataatttaattaatgggacagtactgatagttggtatttaggttttttttttaaactgttatgcaaagaacaagataaatgtacctgtaatgtcctatgaccataatgtcatgagtatatttgtaaagcaagttcctgacagaagtatttctgagacaaggaatatttgtgtttaaaaatatgaaactgctatattggcatcttgaatagaaagtagccatgagagtgcctatttctcttcactgttgctaaacttacatattgtaacatttcagtttgtgtcaatttgaaagttaaaaaattatgtctaatttttatagtttgcatttctttaattctgagtaagtttgaatatcttttccgtataccagttggtcttgtatctctctctctctctctccccctccctgcttcactccctccctccctccctctctccctctctctctccctccccctgtgtgtgtgtgtgtgtgtgtgtgtgtgtgtgtgtgaaggcaaggttaatatgccattcaaaagctttgcccatttaaaaggtgtggttggccttttctaatagatatatatctgtggataggacttaggttccatccctccctgctggactgtgactctgtaatgaaaggactatactgtatttatcccacagtttgttaaatgggtagatttcttttatgtatatggatggtgtaaaaatttgacaagaagtcatttggtatagtaagcatcaggaatagtaaggctaatggatagaaaaataatgaaggaaatcaagcagcttaaaggaagtttgcagccagttgaaatgcaatttgctgaaaacttaatgcaaataaataattatatttgcacagtttatgatgctgcatcacattttcactttcagtttctgacatttgtaggaaaataataaaattttaaaatctccttattatttatttgagatctgttactatttttaacattagtctagcaatgttgatattttctttgtaaagggtagtaagctcagtgtgagttcttaaatatctaggaacccattttttccctctgttaaagcatgtatttaattttatgaagtaagcagaaatatagaaattatatggaaaacagaaaaatagaaattatatactagaattttatttaacttgctggggaaattttttaacatgggtagtgatgcagtcattactttgaataaacttatgtatttatttaaatattatttataatatttagaatactttttcagaccaaatacatgttggaattaagtgtattgtacatattctctgctgttgagtgcatagctgcaacatagatattaaaatcttcttttcaagcaataaaaaactttaagcattgccaacataatttaaatgcatatgtgtgtttcattcttttctctatcataaaagtaatcaaaagagtgttagataccataccaattgtttcaaaatcatgactgccctcatttttgtttgtggtcttaaagtataaatatgtgaaggctacatgtaaacataaagagagcccctttacaaccaatagtccttaaagtaatatactggcacatcaaaaacctgacacagtcttaaatctttaccgaaggtgttgtaagaaaaagcaaacagaagaatgaagtcgtatatataagaacatatgaggtaggtaaagcaatcagcattggttcaagacaataaatcagagcaggttacattatttcctggccacaatccttttgaatgaaaagcaaaggaaaagaaaacacaaagccgtggaagcatagttgttttgggttgaaagtgaaagttggtggacctaaataaatgtgaacctgcttggtagacaggcctctcaagtgtgacttgtctgcagtaaatttaacttttaaccacatattctttcccaaatcaatgagatatttgtttgttttatgggctggaaaaacaaaatgattgttttctaaaagccaaaatattttatttcttttctggattatggaaagtaaaaagcaaaaagatgcaaaactgagaaaaagccctagagcacaactctgattaattactatagctaagtgctctttctttcttctttctttctttcttttttcttttttttttttttgagacagagtctcgccgtgtcacccaggctggagtgcagtgccgcaatcaatacccactgcaacctctgccacctgggttcaagcaattctcctatctcagcctcccaagtagctgggactacatgcacaggccaccacacccggctaatttttgtatttttagtagagacagggtttcaccatattggtcaggctggtctcgaactcctgacctcaggtgatccacccacctcagcctcccaaaatgctgggattacaggcgtgagccaccttgcccagcctgctaagtgctctttctattcacgttctaagtagttttatttagagattattttcccttctgcaatttctctgtctagtcttccctgtcattctttagcagccaagatcactttttgtctagggctccaggccctctcagtcatttggactggtctctgtgggcctttgtttccaatggtcaacactttcaatgacttttttgcctgataggtcttcaaagagttcacagaaaatgcatattattaaaaaaaatgttgttctttgcccatttttaaaatgaggttgctttttgcttgttgacatgaagagacacttctcaaaagaagatatacggccgggcgcggtggctcaagcctgtaatcccagcactttgggaggccgaggtgggcggatcacgaggtcaggagatcgagaccatcctggctaatacggtgaaaccccgtctctactaaaaatacaaaaaattagccgggcgaggtggagggcgcctgtagtcccagctactcgggaggctgaggcaggagaatggcgtgaactctgcggggcggagcctgcagtgagccgagatcgcgccactgcactccagcctgggcgacagcgacactccgtctcaaaaaaaaaaaagaaaagaagacatacaagtggccaataaacttatgaaaaaatgctcatcctcactaatcatcagagaaatgcaaatcaaaaccacaatgagataccatctcctatcagtcagaatggctatcattaaaaagtctaaaaacaacagatgctggtgaggctgtggagaaaagggaatctttaaacactcttggtgggaatgtaacttaggttagccactgtggaaagcagtttggagatttctcaaagaactgaaaacagatctactgtttgacccagcaatcccattaatgggtacatatccaaaggaatatagatcattatatcaaaaagacacatacttgcaaatttattgccatgctattcacaatagcaaagagatggaatcaatgtaggtgacgtcaatggtggattgaataaagaaaatgtcgtacacacacaacatgaatactacatagctgtgaaaaagaattaaatcatgttctttgcagcaacatggatggagctggaggccataattctaagtgaattaatataggagcagaaaaccaaataccacatgttctcacttataacagagagctaaacattcagcactcatggacataaacatgggaacaatagacactgtggactacaggaaagtggaggaagaagtgggagatgggttgaaaaactacctacttggtactttgctcactacctgaggtcgatatacccatgtaactaacctgcacatgtaccacctatatctaaaataaaagttgaaaaaaaaccacagctatgcacagagttgaaaaaaaattttgtgtcaaaattaacttgtactaacttataacactgaacagaatctagtttgaggtactaagaaagataagacatgagtttgaaaagagctcctatcagaacagcatgacttcttcgaaaattgaagaaagaacaaacaccagacttattgtgaagcttgggtggaagaaagaatggtaaaatcattgatcctttatgaaaagtttatggggataataccccaaagaaatcagcagtttataaatggataactcattttaaaaagggatgagatgatgttgaagatgaagctcacaatgtcagaccatccacataaagtttccaggaaaaaattaatcttgtttgtgccctaattgaagaggattgatgattaacagcagaaaaaatagccaacacaatagacatctcaactggtgtggcttacacagttctgactgaaaaagttgagcaaactttccacatgatgggtagagaactgttccacccagaccagctgcagacaagagcagagctttcaatggaacttttaaataagtgggatcaatttcctacagcactggttccaagaattgtaacaagagatgaaacatggctttaccagcacaatcctgaagctaaagcacaaccagagcaatgactatcaaacgttagaggtggtccagtcaaagccagagcagatcaatcaagagcaaaggtcatgacaacagttttttgagatgctcaaggcattttgcttgttgaccttctggaggaccaacgaatgataacttctgcatattatgagagtgttttgggaaagtgatcccaagcttcagcagaaaaacccccaggaaagcttcactggagtctttctctaccgcgacaatactcctgctccttcctctcatcaaacaaaggaaattttgcaagaattttgatggaaaatcataaggtatccaccttacagtttttatttgatgctttcttacttattttgtttcctaatcttaaaaaaaactttaaagggaaccaatttttcttcagtttataatgtaaaaagtcttcattgccatggctaaattctcaggaccttcagttcttcagggatggactaaatggctgatatcgcttataaaagtgtcttaaacttgatggaacttatgttgagaaataaagcttatagttttaatttttatcttctaattctattattctataacctttttgaagttccttgtatttggagtactagaagtgcttcatgatgcctgtagcattcgttgcatgtgtatgtggatgagggcgcatacacacacacacacacgagctgaaggtgaatccatacatgtatatgtgcatgagggtacacacacacacacacacacacacacacacacgagctgaaagtgcatccatgcatgtatatgtgcatgagagtgcacacacacacacacaagctgaaagtgcatccatgcatgtatatgtgcatgagggtgtacacacactgacacacaaacacaaacacaagctgaaaatgcttggagttgtatgtcctccaggaagtcatgggctttcatagccttatgtgatgagggctttgaaagtcgagctcccttaccttcagctgagacaaactttataccccagagctgccctgagaatctggcaaagcctgggacttggcttgtcctcttcccctttcctgtcctgcttcctcattcttttcctggtttctctgggagcagtttcttaataaatcactagcacagaaatctccctctcatgtttacttttggggaatctgattaagagagctgggtatattggagcttaccctgagtcaatgaacagtagcacaagacagtacatctgaatgagtctgaactacaatttcaggttttcttctttgtggttttatttggagtatcacagaaaatttgtgaaatgtgccagacatagttgtgctcccaactcacagatgggaaacaaagggccaaatgacttgctccagcttgtggagcaatcacggcccgggatgcctgttcttcaatgtttcatcttgtgctcgctccgcttcactgttcagcttcttcaagttagagcttttgttctctcccagcgcccccatgaggcactgaaagaaaactaggtcccttttagcttctcgaccctgtactgtccaaaataacagcccctaaccccatgtggttatttaaatgtaaataaagttaaaaactcagttcctcagtcagactagccacatttcaagtgatgaatactcacaaccttgcagaaagttctttggatagtgctgtcttagaccctttactcttcagaagtttcaagtatttttctctttgcgtgtatctgctaacttgatatgtttttctttttttaaaacaatcttgggaccaacatcagggtgattgctaccttgaattcaccattacaggcatctgaatctgcataaacacatgctagatgggctttgggtaaaagagaaggggagtggccacaaatacacatgtaattaggaaagaaaatttcataaggactccatttttctctccctgaaatactagtgaaataattcctgcttttgcctaccacacagatgtagaattgaggtgaaattatagaaataaattagagcaccgagaatgaattagaacaattctaaaacttatctttgagcttatttatgtaggcataatgtaagtatatgggatcattagattttaattaaatgttatatgttaattaacagaagactgctattttctacaaaatgaagaatacattttttaaacagtaataaaaagatttagaaaaaaatgacaaacttatgattttaatctttgaatatgtattatcaacgaagacagtcaatttttttgtgctctggagtagagtgaaaaaaacaacagcatcaaacaatggtaaagaagtgaaatgatagggatcataaaattcggcaggatggtgacgcttgctgtgagaatttgaaggctgccatataccaccggaggctgaggaggctttgtgaggtgatgggaagaattagagaagctgcaagtggtaggcatttttggaaatggaattaaatttagaaaccagtgtttttacaatttaaggctagaatgaaaataaattgtttatgcaaaatttaaatagaagttctttctttcctctttataagtacttttaaagcaagagacactcgaattgatagcaatagaacagaaagaaaacattacatattttggaaaaaaattaaagatttgttttcagaaagcccacattacctgccaaaatttccaatatgtaatttcaactatagagatagagatttatcttttgggcaaattacttttttctaaggcttggcaaatattgcacaataagtcacaaaatgctaagatgaatgaaggtaattgaaatcacatttctcagtataatcacatactcagttgagtataatgctggataatgaggacacacacacaaaatatgtatatgatgaaaaaaatcttcatgtttgttaacattttagtttcaatgagatggactcacttgtttatttacttttaaatttgatttaatgaggttttaaaaaggattgatttaatgagattactcaactattccatctaagtaaatttgagacctaaaagtgctaatgacaccagatgtcactctcaattttaaaaagtaagatcaagacttccgtaggtaaaagaaaaatagttactggggaattattttatattatttaaaagaaagggcgctattaagagaaagcgtagctatgtctactgaaaggaataagagaacatgagaaagctaaattgttctgcataaaaaggccaagggggctggggggatggggaaagaggagaggcattacctctgatgattcaggaggtaggaaaggtgcctctaagccatatagagaaaggatgaagaggtaggtggcagctagagaggagaattggagatgggaggtgttccgtcattcagtgttgcatacaaattacccccaaacttagtgacataaaatgaaaatgtactatattcacagattctgtgagtcaggagttcttagatttgtttgggcagtctctcatgtagttgcagtcatatgctggttggggcttcacacacccgaaaatttgatgagggtgctggagaactcactagcatagctggtaagttagtactggctgttgactcgaggcctcagttctccacgtgggccgctgcatggagctgcttgagtgtccacataacacaataactggcttttcccaaagcaagcaatccaagagggcaagttggaagccatgcttccactatatactcttgatcactcagagccagtgctgattcagtataggaggagattactcaaggtcataaaaatcaggaaacatggatcagtggggtccatcctggaggctagccacgacagagcaaggccacagatatatttattagaaatttgaaaagtatttttacacataatgtgccattaaccattcctcagcctcctcactcaattttcagtaaatctaatacactcattaatgttttgtggagttggatttgctcctgaggtctgctttaagtgggcttgagacaagaggagaggacatctacagttttggacacatctgagttaagtacatattttgacatttttcccaaatgaagcagggagtctctgaattacgttataaaaactcctgtaaaagtgataggaatatctaaggtttctttttctattcttcttgcaagtgacagattactctcattttgtcaccacaattacagtgagaacatctaattattttccttcccctaggcaatgtatacctcagggtgaagagaatagctttcttctatatttgaccttttatattggcttgagaccaaaaaagttcatgtgggagattccacctagtccgatttttgccatatacacatcctcagagggtcacttaaaactctttccttccatgcaagagcactttccctcccacctctcttttcctgataccttgacaaggagaaacaagagccatgaggatccagaatgagaaataggaagacttagggaggaaatgtcctaatccacagtcttctgggaagtcagaacttctcttttcagttcagctcatcttctgtttcacagggagaatgattagtcctgaagaattaactgttcatcaaaaataaaatcaagtaaaaacgaaggtaaaggaaattgactctttaccattgtggaaagggctgaagatctgtcattcctatttcagatttagtcagagagaatttgggtaagcattggctttcataaatgcacttcatggcacacagctccatgaatgttctctcacaaatcgtcagtgtgaatcaatgtaatactcaataacatttccctttggaacctgttttaaaagagctattattgtgatggcaagaatatgctaagcacacagactattatccatttgattttctgctgaagagaattactgcaaaggtaccaaagcagtttgattatcacagggagagtttttattttcagctttttcaagctgtgtattgagttgctttgctttcatttaaacattacattctataattaatttacaatacactcagggaaaagactccttggtgtaaagcaaaaagctacaaaaaagtagaagatttaattccctcaaaggcttcaaattaaatttcaattcaatgcaattaacatttattgaatgtctgcagggatcatagcactgtgtgggtactagaattcaaactatgcagaagttcaagagggtttcaaagttaattttataaatataggtagagaaaaatcagaatcatttaaactatattctttttgaagtctagatttcctttgacagattctcaaaatggtgtgtaatctgattgggagttcccttggaatacggcaaagagcacaaaaaacattctttcttgagtcttaaatttggagtaaataaatttttattactacctcaagaaatggcttaaatgatagaagaaactagtttaaaatattttaactaaaattagtgaatgatagtgttgctttcagaaagataccataaaataaaaagactcctgttatacatggaatttaacatttcagatttggaacgtatttactctttaagtgtcattcaaaaaataacaagtagtagtctggttatcaccaggaactaggaataatttggaaagagagtagagatacttttagaactgctggaatttttcaaaagacctaccaaaatctagcaaaagaagtacatcaaaatttctccagagccctccttacctaagaatgtttcatatatctgccagcccttttcctgcaaaagtcaaagatgggtctagatacaaagcagatgcaatgagttcctttcttaggatcaaaaaccacacctcatctgcagacgagatcctgaacacaaaaacactgtttctttgtctatgttttattatcaatttgtcctgtttatcctgtgagattctttcttaaaattttgttaatgtgattctatgcagccataaaaaagaatgagatcatgtattttgcagggacaggaatggagctggaggcctttactcttagcagactaatgcaggaacagaaaaccaaataccacatgttctcacttataagtggcagctaaccgatgagaccctgtggacacaaagaggggaataacgcacattggggcctattggaggagggagggtgggagaagggagaggatcaggaaaaataactagtgggtgctaggcttaatacctgggtgatgaagtaatctgtacaacaaactctcatgacacaagtttacctatgtaacaaacccacacatgtacccttaaacttaaactaaaagttaaaaaaaattaatttaattctgagtcagtactgtttactgaaaagtacttcctttccccctgccctatggtggaaactgccaccactttcgttgtatattagccaactgtatatttgtgagtctgtttctgcactctattttgtgtcatttttctatttgtctatccttgcatccattccattttaactgttatttgttgacccttgcaatctgaaaatcctctaactttatttttcttttaagtttgttttgggtattcttaagagtttttatgtccatacaagttttagttcaacatcagcttgttaatatcaacaattgaaaacaatagcaacaacaataacaacaacaacaaccaaagccaaaaaccaaccaaccagacaaataaacctcttgggattttatttgaaattgcatttaatctatggagcaatttgaggagatctgaagctttacagtattgagttttctagtatgcaggcgtggtgcattttatcatttatatgggtagctttaatttctcttataaatgctttccagatagaagtcttgtgtaagttgcattagatttattcctgtatttgactgatagttttgaagctattataaagggtagaagtaaaaaaaaatccagttgtttgttgctagcgtgtagaaatacagttgattttgtatattgattttgtatctagagacatttaaaaatcacttatttgttctaatatttcacctgtagactctgctggattttctaagtacaaaactaggttgtgtgcaaataatggtagtcatggtttttcccttaaaatctttatagtgtttctttcatttgcattactgtactagctaggatatacagatcaaaatcgaatagatgaggtaaaagcaaacatctctgtatcgttcttgatttccgggagaatgattttaatgctttaccattaagtatggtatttgctataagggtttttgtagataaggattgatttttattatatctattttagttgttaataattgttaatcgttgtttcatttctttttctttagcctactttctttcagcctgagactgagtcctcctacaccctccaacagctttgtaaacagttttgtaaaatgcctcttgattttccacactgtcaaatctgccagttaatcagatccattcctttttttccttttctggagacatgtagattgtttgcactccacctgggtgcttctaggactccctttgccatcattctgggaattccagttgcctttttctgatttccaggggctgttcttggttccttaattttctttcttcttggcttcttcccatgtttccgtggtaaacaactttagccatttcctttgggcacccgagctcacagtgcagcatggagcatcagggtaggtctgtgggagactgatttgagaaaactcaaatgagcagaggggctttaggacagaaagtgaggaggggaaaatgggaagaaacagctgctatgcttcaatccatgacaataatgaggccattttgagtaacacaaaatttggtcaataccatatctaagaatgtattttccataccatttatcaaaatggctaaagcacattaaaaaaattcaagtaaaatattcacagaattcctgaaaaccactaagatttattaaaatttgaaattaattaccaaagattccaatgaacttttctgtaaataattaatattcattcaataaatattaaaaaatattcaatatttttatatgctcctagatgtttgaaatgcataattgaacaaaatagacaaatctctgctttcatgggggaagataggcaataaacatagtaagttactttgtagcataatagaaagtgataagagatgtagaaaggatatggatgactaggagtcctgggcaggatgaaaagtgcaattttaaataaggttgtcagagtaggcttcatggagaaggtggtatttgagcagagatttgaagaggagcactgcaggcagagaaaatagccaatgcaaaggcccaaaggtgggcacatatctggcatgttcagcaacatggggggccagtgtggctgaagtagagtgaatgagagagagcataacaagaggttaggtcagagagatgatgagggctaagccatgttgaaccacactggccatcatagtacttgggcactcactcagaatgaatataggagccctcagtagcatagatttggagcagagtgacatgatctggcttgtattttgaagcaatcacttaggggtggtgttgagaagaggctgtaggggccaaggacaggaggaggaaggccaggcagaagctactgaagtgattctggctggtggctccaatcaaaatggcagcagtgcaagtggcagtgcaggtagtgagaagtgaacatcatcactgctgggtaacactgccctaaaaccaaagtggcttaaaataatttattatcctcattctgtgggctggccaagtggttcttctgatggtttcttctggactcattcatgtggctgcatctgcggcaaggctggctccctcacatggccaggggaccttggttctccttcatccagcctccagcctttcatcccccagtgctaggccagcctccttatgtggtggccttagggagtattccaagagagggagtggggatgctacaaagtacctaccttgaagtcacataatatcatttctgccacattctacgtttttaaaccaagtcacaagggcagtttagatataagtggtgagggaaatagactccatgtcatgatgggaggaatagcaaagttaattgcaaaggaacctgcatcctggggtaggaggagtttgtatccaattttttaatccaccaaagaagtacttagcatgctctttttttttgttttttttttttttttttttttttttttttttttttagacagggtcttactctgtcactcaggcacaatcatagctcactggagcctcaaacatcagggctcatgttgttttcctgcctcaggggctcctgagtagctgggactataggcatgtaccaccatgcccagctaatcagttaatttgtcagttttttgtttttttaaagaaggggtatttttatattgcctagggtgatcttgaacccctgggctcaagggatcctcctgcctcagcctcccaaagtgttgggattatactttgtaagcccaaagtgtgagccatcatgtccagccaaaaagtattcagtattttgagagtataagttggatatgtgatgtgagagaaagagaggaatcagggatgactttgagatttctggcttaagcaactggcaagtaggagtttttaatcaactgaggtggggaagactgtgggtagactaagttttgggtgagaagagcaggattcagtcaggggaacggaagggcaggctctctgtaccagcactcagtatgcagtttcatatcaagtcaaaggctgtctgagaccaacactggtctttgagagtgggaagttcaagcaagcagaagatgacaagtaggtgtcgctggctctaatggaagatgggcaagagaaggcctctacattctagaaagtgaacttgctatgtggtttgcctggcaacggacagggtgaggtaaataatgccacagaagttccaggatgaaggattacaagaggtttgtaagaaaactccaggggtacagtggttcagaaatggacataacagcctagaggaagacctgggagaagcccttgaataaccattggtccattgtgcatctagggtccttaacaaaaagataaaagacaagtgtataatatgttggaaaaaaaatttcccattcccacacaggtaagtgtctacagcaaagctatccctgggtcttgtaaatgtggaatatggcccacaatttaaagtcagcttctttttttttgagtgaggaaaaatctcataaggaaatgcctgatccttctttaggcataaaaagagcatgattcacacccaaggaagagaatgttggggggagtgcacccacgctgtgtgaaacttcattgtcatgcctctgtgtgagggtgtgtggatacagtgtctgggtgtatttgcacacacatttatttcggcaaatattggtaactgcctgattgacctttctttagggcaaggactcagatggttaggagggagaaacaggttgctcctcaggctggtgcacattcttggctacattttacaaataagctgtaaaagatggaatatatttgctggctggtttgacagtctacccagaggtaggaggatggactctatgacctttgaaagtcaattttcatcccaagatttcatgttccaattatggctgatagactatttaaataaatgatggtttttctattaggaaagaaaattgactggaattcattctatttgagccacaaaaatttgaaaataggtcaactcttaattacccagggtgatataatagggaacatcttggatggattatcccaaaccacaggtaattaacaaaatgtgcaaattaggcactgattcatagcattcattaaaatttacatttaaactactacttaagcagcatagatttatagatgagcaactcaacatggtaaaaataattttaagatgaatatacgcattttaaataaaatgtagagttgaagatattgccaaaagactggacaatctgaaatattttcatactctaaaattcagaacatttacctagtgctgcataagacatttggcagatttaaaaaaatctcatttttataaaaggcaagggagagatcaacagaggtttttcaccccctggaaactcctgtgcccgcccaatgctggacccttccctttgtgctggtgttcaggcccacaaagccacctctttctctccccgacacacttctgtgaaaaatgttgacagaagaacaaagactagggtgagtcaggaagtgagaaaaagaaactagagacaggaataattatagcacaatccttaaccgattatggaaaccaaaattttagtgccatttctatcttacccaaggaaaacaatgaaatgaactttactaaaatttaatatgggttagcacataacacatacatttatatataaatttacatacattggctgcggatattaaaccctggctcacataatcttggtcttcctttgtactctattgtatggcatccagtcgtgcacaggtgtgatctgtcagcctcaagcttcagctcctccatatctctatcatctattattctttctctacctctgtccagccatgctcaagcatgcacaaatatggaagtgtgagaaacttgactcaatgggagctgagagccaatggataaatacttaacctttcccatgtcctggatgaacaattctaaagtgcattctacatggttcttcagagggacctcattggcccttattggcccttaatagtaaccagcccaattatgtcccctttgaattggcctctgcccttccctgttttcccttttccagcccctactatcctgttctccttggtaggattattcctgcaaataaactccctttatggaagccattgtcttagactctttttgagtcttagactctgtttttttgaggaagaaaccaggctatgcaagatttatactaaaacatctttatgaaagggtataagacaaatatttttgagactactaatctaaagcattgattgtcaatgtatttgtaaaaaataagcccacaatatactaatatttgtatatgtggcaagctatgtgccacacatgtgctgtttttatgagcacattaggtatacctctacccccttttctcccaccccatgcagcatattgacacaaatcagaaagagtacttctattatggggatgttcttacatttactcaaagttataaataaagctaatcaagtgtaggctgtagtactttattattaataccaaatttctttgaaggcctggtaactaattgtgattcagaatgttttaggtgggatgctttggttgaaatctctaaagcaaacagattcaggtttagaaagtggaactcgatgctaacaactatttttcatacttaagcaacttctcaagttatttacttataagctatacatataactttacatctttatgtaagagattacatacaactttttgccatcttagtccttgctcaaaaacagctcagaggtttccttcatatatgccaagaaaattaaaaaattaagagtaagttaagaaaacagctcaggggtgttatgagaagggtactttacctctttagcatttttcatcaaaatttgtaacttcagtctaatgagaaaatatcagacaatccaaattgaggagcattctacaaaatgtccagtactcttcaaaagtgtcaagatcccccaaaacaagacaagactaaacaagacaagactaaaaaactgtcatagatcagagaagaatggagagacctggtgactaaatgctttgggctatcctggattggattctagaatagcaaataaggtgagtgggaaaagtggtgaaatacaaataaagtctatagtttagttcagcattgtttagtattgtgctaatattaatttcttaattttcaaaaatgcagcatggttttataagtactaacatcatgggaagctgggagaagggtatagggaaatactctgtactatctttgtaactttcctggaaatctaaaattatttcaaagattaaaatggaaatatattttaaaataatgtccaatttaaaactaacaaacaaagcaactcatgtagacaactctggttaatttgggcagactcttgcctgtaagtcttaattaggaaatacttaaggagacatggtctataaaagcagaagtgtgtgtatggagaagtgatgtctactcagtcagaagaaagtgctcccctgagatttacagagcctatttgtaccatgaagacccaaagtctacttttttctcatttagggcatttttggtacagaattatctaatcacttcaagatgccacttggcacagccaataaatccagctctctttcttcagggggttaagtggtagctcataattttttttgcaattatttttctattagcaactttcagtaaatacttttgtaattgcccatgagttgtcaagcactcatgagatgaagttccaactctacagatgaaagccctgtttttgaatcaagcacttcatgagtaaggatttcacaaagctgcaaaatctgctcttgagaacccctgacaactaaatattccatggcttccactgataatcatgctgtcagttaagtattttgctttttttaaacagctgggtatatttttttctctatgaaattctgtgaagagagtttgatgtagcaaatttttttttttaaaaggcttgtcatataccaggaggtatcaacaatcaccaagctctcgtgcattaactacctgtttcacctccattgaggatatgtctcaggtcaataattggatctatgaaacctggctgtgataaataccaaggaattctatgccagttcacagcagtaagagtgcagaagtgccagaagctgatgtgcccaagaactgagcccaagtcttagcacaagatctccatccatcaaataactgtaatttatcacccagactgagacatttctgagagtgaaagggagcttcatgagtaattattccagaacaactggagtatattgggactgtcttagacaaactaaaaggcaaagtcattctactgccattctactcccaaacttctagactctggctgattctctccacagacctcttcccggtgaaaatatcctcctctttgtagcatatttgtacttctactgaatgataaatgattatatgcattccttgtttttatgtaagaaaatacagtttcctgatattgtttgagaattttagaaattatgtcctcattttggtattttaatccattaatgggaaatttcagactggaagaaagaaaaccagtaaccctagggagatatttttatctataccagtacttttggtcactttcaagtctcctgcctaggcagctgtctgatcagcccatttaaaacaatcactgagataagtactaataaaatgaattcaagaaaattgctttttagatgttaagttgataagaatatatgcctattaataagtacctctgtgcttactctgcacagggttatggtatgtacaatttgtgcacatggcatatatatgatcaatgaaaacatgaaacttgttttaacaaaatcagtaacagggagtaacatacgccaaatgtgtgttggagaaaacaagaaccacgggacccagaaaaggagagaaattgaatttgacatgtaccaggaaggtggatggagcttatacgggtggtgtgtatgtagggcagctggcgggtggcgggtggggggtaggttcggagcatgctggcgggaggacaaccagattgtcttttagtctgccaatggtgacataaaaaaattctgctctttaaatttggctgaccaaattctataagatttgaatcacattttcccatcagaaactaattcacatcacaccgaactgtgaaagttcaatctgcaagacagatttgatttaacagtccatgcattccacttgtgtgtgtgtgacgttattgaagtaggtgtgctctaaaggcattttgtagaaatgcctttgtctaaacggtgcttaggcacaacacgagtggccttgatgatgtactttacgctaaggtaaatgtgtagagaagcctcacgtgtgaatgcgtcgtagtaaatccacagcagactgcagatttatggatatcgttattccgttgtacagacggcacctccattgaatttaatgagctgaactaggtgaaaagttcattctaatctcctggtgcctggaactcaagcactccctgaaatcacagaacatatgccttctcttgttttaaaaactgaaggtgactttctgataaacaagtctctcttgagggtaatgacataggaagttattttgaagacgtttccttcagtgtcttgactgaatattaacctacaacagctacctgttgcaaagctgagaggtgatttgtcaaatttaagatcgatggcagatttgctttaattgatttttgttccctagagtgagtttactactttgagaatggcttagattctctcacctatgtttcctttgctattcagaataagcattagcaagtgatttctcttctgcagtcttttacatggtaattctgaactaattctaacatgtttatcgtaattaggttaaatgtttatgaaagacgtctacaaaactaacctgatgttccctccatatttaaaaaacactcaacaatgaatttaggtaaagaagacttttttgagacagtctcgctctgtcacccaggctggagtgcagtggcgggatctcggctcactgcaagctccgcctcccgggttcacgccattctcctgcctcagcctcccaagtagctgggactacaggcgcccgccaccacacccggctaatttttttgtattttttggtagagatggggtttcaccgtgttagccaggatggtctctatctcctgacctcatgatccgcccgcctcggcctcccaaaatgctgggattacaggcgtgagtcaccgcacccggccttttttttgacagtctttcgctctgtcacccaggctggagtgcatgatctcggctcactgcaacctccgcctcttgggttcaagcgattctcctgcctcaggctccgaagtaattgggattacaggcaccagccaccatgcccagctaatttttgtatttttagtagagacagagtttctccatgttggccaggctggtctcgaactcctgacctcgggtgatctgcccaccttggcctcccaaagtgctgggattacaggcgtgaactaccatgcctgatcagagaatacttttgttgttgttattgtttgttcttgttttttccactatcctccgctagaatagaacttttaaggtctctgatggaagctttgaattctcacagtgctgcattcacacatgggaagcacatcagtgaagtgaaacaatgggtatatctcaatggggaggctcctggcattttgtgggtgtgggggacattttgtgtgtatgtgcaagtctgtctaccttattaaaggacttttacaatcactggaccctacactgtaaatgccaggatcacactccagttactgcaaccaccaaaaacatcccaacacagctatctagcaactcttaaggtataactcattgcagatggtaaaagggcagctgctacctagatgtaagtaatttctaacttgaacagtttatgttttcaaagatgactttgttaagtcgaaatgtagaacacatcactctatatgtaacgcagaatataaatggcgactatgtctccaggctggtgacacctgcctggcttccatgacccctattcacaatccctacttcaagttctcagactaagacaacttaattccaatctttcaatctctttccctcttcctaaaataggctcttcttaaagtctctttgatccaggagaatttacggtgccatatttcaggagtatattgatttcagatcagagttttgcttgatcagaacttgttgtggctctcaccgtatccccagtgagctggttcttttcttacatcccagttactgatgtagtctctatctgggtctcatttgctttatgtcctgctttacttctctctttgctgccactgccagactccctgatggttgttcttcatgtcccacggcgccacttgtttgccgcttttgtggagcctttttgttatcaacacctaatggggcatctgattattccttccttccaggctgaagaggccatgtccatctgcttattgcaatttcttcctgaagattgtttttgggtgctttatcaattgtccacattgttctgggaggtaggtctctagctcctgactctttcctaggaagggcttgcctgagcaccaagcgttaacagctatctcactctactgcagacatgacccagcccaaatcaggaaactggataaaaaacatggaaacaatgctgttgcagtatggaaattaaacgaaactggaaacaaatcgaataagagtttctaaatctttaaatctgatgcataaagtagtcttaattaaagtaaaagaggagataaatgagaatttactttaaaaatctgaattttctgagcctttaaggcaaggtctttagaaactggtggcaatgactttttattatggttaatttcccttcagaacttgtgaatttactgttccttcatatggaaattttaacactactcttaggcagatcagacataattaggataattttttgccacacaagtgaaatgaaaagatagatttccctatccttcctacaagataattgggtaaaaaatgaaatagtgagctaaatgaagaaaagttttaaaaataaatgggtgtgggtaagcaaaatgaacagcttgatggggagatggaaatagcagataaggcaccttaatgcaccttattattattttgtgggtaaaataattttgtcttatttgttaaataagtctgtatttgcgaaatcaaaagagacaaaaagataactactgaaaaaagtgaatcttcctcatacctctttaatcctgctgacccagttgctttccctaggagaagagtgtacattgtggatttattatgtatctttccagagatactattagtttgtttttatttcaatagcttttggggtacaagtgtttttcagttatatggatgaattgtacagtggtaaaggctgatatttcagtgtaccagagatattctatgaataggcaagtgtttgtatgtatacatgcattaacacacacatacatatctaaaaatctgaattacttggatagatttatgtgcaattggcactgaagttgtggaggacccgaaggctcttgtcaagaagttcagtaagatggttatgtcaggctttattaaaaacctttattattagaaacatattttctcttttttttttttgagatggaggttcactctatcgcccaggttcgagtgtagtggcgtaatctcagctcactgcaacctccacctcccaggttcaagcagctctcccgcttcaacctcacaagtagctgggaccacaggtgcccaccaccacgcctggctaatttttgtatttttggtagagagggggtttcaccatgttggccagactggtctcaaggtcctgacctcaagtgatccacctgcctcggcttcccaaagtgctgggattacaggtgtgagccactacacccagctgaaacatatttctttatagtctcatctttcagttgcagccatatgccatctttagtgtggataacatcaataaaatggtggtttggttgaccttatccacgtctacttgttccctctgaatggatggatggctatgatatggtgccttgtgctgtccttgggcacaaattttctaatatgtcctgatctaaaacagtttccatctatcttggaatgcagtggttaacctggattcttccttccccattaccctggacattctcttcactgttctgtttggttgaaggcattttttcttacattttatattttcttctttcttagtttgcttcctcattttgttggaacacataactaccagttacgttttgagaaagggtatgtgacaaataaatttgagatgttgtacatcagtaaatatcgttagtttacttttccacctgattgatagtttgacatgtatagaattctatgtcggaagtaatttcctttcagaattttgcaggtatttcttcacaacccttcagcttccagattgctggtaagtcagaagccattctgatgctgcattttggttttgcagtatattatctgttttttgtttttttaattcccaggagctttcagtatcttctccatgtcctcaatgttttgaaaagttcccacctattgtgttgagcagttggtggctcctttcaacctggaaaatcaggtctattagtcctgggaaattttcttaaattattttatttatgatatcctcccacctgttattttgcattctggaactcttattcaaattaacctaatatttgaacatgatactttttgct

SEQ ID NO: 2853 - DNA, 8979 bp, Homo sapiens
ctggaggcagcagcttgcagcacaaggagaatggagaaggtcctgagatgcccacactcaggccctgacactgaagcaggatgtttctctgactcattcacgggattcgtgacaggtgtgcctcctttaccaagcccattgctctcaactcctcacaggagggagcacacaagcaaacaagacgggaactggagtacaggggcgctggaaccagccagcgaactccctgcaggccccgcggcactttcgggggcgggggatggtgcctgcgatccccaaaaccccaaagggcgttttttacagtgctcttttagctctgctgaccgcggatggcttaagtgttaacagctcagtgggccctttgccttttctcatgagtcggctgccctgtgccagcaagggcaaagggccagtgtaacagccttttgtatctgcactcgtggctcctgagctcctgttcggcacacaggaaaaatgaggtcgcaccaacaaactgaaggatggtaaatgttgaggattttattgccaatgaaagcggctgtcactgggagctgaaaaggtaatggaaagctgaaaagcggataaggtgggtaggtacctgaagtctggccatctacggcagctggattcttctccaaagttatactgtcaagctgtccctctgaagccaagccacttctctttgacatccagccgtagtctctgctcctctccaactgagtatgagggagatgtttcctattatccttgataatgtgccatgaacatatgaaaaaacatagaaacatgaagaaaacaagaagacaaaaatcactaacatctggttggctgtatagaaacaaagctgattctgcttgcaaatggatcttacagacgttgtcacagagacaagaaaagcatataaaaaaataaataaagatgagctcctttcaaggtgactgactagaagcagctggtgtgtgctgctctcacaaagagaagaaagagtggtgagtggaccatccaggtggacacattgggattcatcaaggaaacaatacacagaaaacagaagaatgagacaggacaatcattcacccagaagtggcatagagccgggagatggccctcaccatggttagtaagtgagagtccccagggagtcacatttctgccacagacctttgcaaccctgggcccaggcgatcccccatgacacccgtgccccaccagggcctctggactgacatagacagctacatggagtgtgggcagaactgccactcaggcactcatgaaatccttggagcttttcatccccaggcaccctggtaccaatggctgcagctgcggcaatgggggaggacaggctctcttgcatgtcctcagaataggaacacaatccatggggctaagcagtgggtggactgtggggctcttctacacagcccgttgccagactggcctgggatcctagcatggtcacaaaagtcccacctgggctcttgaggaacagatctgtacttccctggcatggaactcctggaggggatgggcaggctgctgtttttgctgctccacagccctcactcctgttgccctcagtcttgggagtgagcacagtgattggggactaacatagacccccagcacagtgtacagacttgcagaaaagcagccagactcttttccacatgggtcctcacccctgctactcttcactgggcagcacctcttgaccttggcccccagcacaaccaacccgcccccacatgaacgctttgtcagtgatggctctgtgtttctctgaggagaaaaatccaaaagacaatccataagccttctgctattgcagctgcagtggtatggcccttactaccttcaggctggggaaagaacgaaggacttggtccttacactggcccctccagcacaccatcgccaccatatggagaagagcccagtctctcttccccgtaagcccccactcaccactgttcaccaggcaaggcccctagttggggacagcagagcagctgtcctacccccggatgagaattcccactgctattggctctatattttcctgaggtgggcctcccagaagcaattgacatcccctctgtcactgtcatggcagcagttctgcccttactgcactcagactggggaaagaacaaacagcctgaggtcttcactcacactcctagcacaacacagtcatgatatggagaggagcccagttgttcctcctggtgagcccttgacctcctacttttcatcaagtgaagcctccagcttgggctagcagcgtagccaccccacccactggctgaacattctcagtagcaatggcttgcgtttctctgaagtagggctcccagggacaacggaaagcacctctcccactgccactgcagcggtactgccttgctgcccttggactggggaaggggcagagaccttgagtgcttaacccacatgtccaggaagtgacagctgccctaaggagaggaggccagtctgtctcctctgtgagacccctgccacccttgcgcatcaccaggcagggcctccaggcatgggttcacaatgtagctgccccaatcccaagcccatctctccaattagtagtggctctgcatttctctagggtggagccccaagagacaagtgaaaggccctctgccacagcaactgccaaggtcccttcccctgttgccttcaagctggggagggaaaataaagccttagctcgcccctagcagcagtgtgcagcccaggagtgccaaggccagaccttaagccagcactggagtgggaaagggagcccacactttcagagcactgagagggagcatggctgcaatcatgaagaaatacagaggagccacgtggtggagcaagagcccacctactggccattacacttcagtgccatctactggatcatagcccaaactccaactccaaaaatgcttgctaatatacccccctctgtgaaaacaacgacaagatttcaacaacaaagaccctgcacaaaacctcggccctcaaaaaacattcaaaaaaggagtctgcactcaattacaccacagttaaaggagcatcagcccacacagatgagaaaaaactggtgcaagagctctaacaactaaactacagtgttttctttcctccaaataactgtactagttcccaaggaagggttcttaaccaggcagaaagggtggaaatgacagagagagaattcaaaatatggataggaataaaggtcatcaagattcaggagaaagtcaaaacccaatccaaggaatctaacaattacaataaaacaatacaggagttgaaagacaaaatggccattataagaaagaaccaaactgatctgatagagctaaaaaacacactaaagaattccttaatgtaattgcaagtattaacagcagaatagaccaagctgaagaaagaatctcagagctcacaggcaacatctctgaactcagtcagacaaaaataagaataaagaagaatgaacaaaacctccgagaaatatgggattatgtagagaccaaatctatgactcactggcatccttgaaagagaggaggagaaagcaagcaacttggaaaacatatttcaggatatcatctatgaagacttccccaacatcgctatggagaacaacattcaaaatcaggaaatgcagaaaatccctgtgagattctatataagaagaccatccacgagccacatggtcgtcagattcttcaaggccaaaacaaaagaaaaaatgttaaaggaagctagagagaagaggcagatcacctacaaaggaaacctcattaggctaacagcagatcattcagcagaaatcccacaagccagaagagattaggagtgtgtattcagcattattaaggaaaagaaatttcaaccaagaatctcatatctagccaaacttagtttcattagcgaaggagaaataagatcctattcagacaagcaaatgctaagggaattcagtaccaccagacatgctctataagagatcctgaagcaagtgccaaatatagaacagaaagactgttactgaccactgcaaaagcacactaaaaacgtagaccattgacactgtaaagcaaccacacaaataaagctgcataataaccagctaacagcacaatgacaggatcaaatcagcaaataccaatattaaccttgaaagtgaaggggctaagtgccccaatgaaaagtcacagagtggcaagttggataaagagcaagaccctggccaggcaggtgactcatgcctgtaatctcagcactttgggaagctgacacaggtgaatcaagaattcaagaccagtctggccaacatggtgaaaccccatctctattaaaatacaaaaattagccctggacatggtggtgctcatctatagtcccaggtactagggaggctgaggcgggcggatcagttgaacccaggaggcagaggttgcagtgagctgagatcatgccactgcgcttcagcctaaaaaaaaaaaaaaaaaaaaaaaaaaaaagcatgatccaactgtatgctgtcttcaacagacatatctcacatggatccataggcttaaagtaaagggatgaagaaaaatctaccaagccaatggaaaacagaaaatagctggggttgacagtcgaatttcagtcaaaacagactttaaaccaacaatgatcaagaaagacaaaggaagacattacagaatagtaaagggttcaatacaacagaaagatgttactattgtaaatatatatgcatccaacacaggagaatccagattcataaagcaagttcttagagacctatgaagagatgtagataactggacaataatagtagtagacttcaacaccccacagacagtatattacacagatcactgaggcagaaaactcacaaaaatatccaggattcaaactcaacattgaccaaatggactcaatacacatctgtagaactctccaccaaacaacaccagaatatatattctactcatctgcacagagcacacactgcaaaagagaaaacacaattagccataaaataatcctcaggaaatcaaaaacaaacaaacaaaaacaaaatcatacaaatcacactctcaaaccacagcacaataaaaatagaaattattacttaaaaaaccctcaaaaccataaaattacatggaaatttttaaaagccctgcttttgaatgacctttgtataaacaataaagtcaaagcagaaatcaagaaattttttgaagttaagaagaataaagatacaacataccagaatctctgagacacagtaaaaacagcattaagaggggtgtttatactgctaaatgccacatcaaaaagttagaaagacctccaattaataatctcacagcacacttagaagaactagagaaatcagagcaagcaacctcaaagctagcagaagacaaggattaacaaaaatcaaagctgaatggaaggatattgagaagcagaaaactgtacaaaagttcaacaaatataagaattgatcctttgaaggaatagattagatagatagacccctagtcagaataataaagaaaaaagggggaagatccaaataaacaaaatcagaaatgacaaaggtgaacactaccactaaccctacaaaaatacaaaaagcccctagaaactactgtgaacacctaaatgcacacgacatagaaaacctagaagaaactgataaattcctgaaaacatacaacctcccaatattgcaccaagaagaaattaaaaccctgaacagaccaataatgagttctgaaatttaatcagtaataaaaagcctaccaaccagaaaaatcccaggaccagatggattcacagatgaattctaccagacatattaagaagacctggtataatccctactgtgaatattccaaaacatttaggaggaagaattcctctctaattcattctatgagcccagcatccttctgataccaaaacttggcagacaaacaacaataaagaaaactacaagccaatattcctgatgaacaaagatgtaaaaatcctcaacaaaatattagcaaactgaattcagcagcacattgaaaagctaaatgaccacaatctcttaagctttattcttgggaggcaagaattggttccatagaggcaaatcaatcaatgtaattcattatataaacaaaactagaaacaaaaatcacatgatcatctcaatagatgcagaaagggcttttgataaaattcaatgtcccttcatgttaaaaactctcaacaaagtaagcatcaaaggcacatactcaaataataagagccatttatgaaaaattcacagccaacatcatccagaatgggcaaaagctggaagcattccgcttgaaaactaaaacaagacaagaatgccctctcttattatttttattaaacatactactggaagtcctaagcagaataattggccaaaagaaaagaaaaaaaagcatccaaatgggataatagaaagtcaaataatccccttttgcagacgatatgattctatacctagaaaaccaaatagtccctacccaaaacctccttgatttgataaacaatttcagcaatgtttcagaattcaaaattagtgttcaaaaagtagcattcctatatagcaacaatatccaagctgagagccaaatcaagaacacaatcgcattcacaatggccataaaaacaataaaatacccaggaatatagctacgcagggaggtgaaacgtgtttacaatgagaattacaaaacactgctcaaataaatcagagatgatgcaaacaaatggaaaatccccccatgcttatggataagaagcatcaatattgttaaaatggccataatgtccagagcaatttacagactcaatgcttttcctatcaaactactaatgacatttttcacagaactagaaaaaaaaaactattttaaaattcatgtagaaccaaaaaagatcccaaatagcaggcaatagtaagcaaaaagaaaaatgctagaagcatcctgttacccaactttaaactatactacaaggctacagtaaccaaacatcatgggtttggtacaaaaatagaaatgtaaatcaatggaacagaatagagagctcagaaataatgccacacgcctacaaccatttagattacctttgacaaagctgacaaaaacaagcaatggggaacggagtccctatgcgataaatggtgtgggataactgactagccatatgcagaagattgaaactggatcccttccttacaccatatacacaaatcaattcaagatggattgaagacttaaatgtaaaacataagactattaagatgctggaagataatctaggaaatagcattctgggcataggccctagcaaagatttcatgacaaagatacaaaaagcaattgtaaaaacaacaacaaaaaacggacacatgagacctaattaaagagtttcagcacagcaaaagaaactaccaacagaatgatatgatttgactctgtgtccccacccaattctcatgtcaaattatagttttctcagtgttggaggaggggcctggtgggaggtgattggatcataggggcaaacatcccccttgctgttctcatgacagtgagttcttatgagatctggtggtttaaaagtgtgtggcacttaccccttcactctcttcttcctgcttctgtcatgtaagatgtgtcttcttcctcttcactttccaccatgattgtaagtttcctgagacctccccagccatgtttcctgtacagcctgcagaactataagtcaattaaacctcttttctttataaattactcagtctcaggtagttctttatagcaacacaaggatagacaaatacatagagtaaacacacaacctgtagaatggtgaaaaatatttgcaaactatgcattcaaaaaaggtgtaatatctagaatcaataagaaacttaaacaaattaacaagcaaaaaacaaccccattaaagagtgggcaaagacactactcaaaagaagacatacatgtgaccaacaagcatataaaaaattcttaatgtcactaatcattagagaaatgcaaatcaaaaccacagtgagataccatctcacacctgtcagaaggactattattaaaaagtcaaaaaataacagttgcagctaaggttgtggagaaaagggagcacttacacactgttgctgggaacataaattagtttagccattgcagaaagcagttcagagatctctcaaagaacttaacacagaatgaatgaccagttgatccaacaattccattattgggtatgtactgaaaggaatataaatcattccaccataaagacacatttatgcataagttcactgcagcactaattacaattgcaaagacatggaatcaacctagatgaccattaatagtgcactggataaagaaaaagtgataaatatacaccatggaatagtatgcagttataaaaaagcatgaaatcatgtctttttcagaaacatgtatgctgcaggagaccattatcttaagcaaactaaagtagaaacagagaacaaaataccacgttctcatttataaatggaagctaaccattcagaacacatggacacaaggaagagaatgttagacaccaaggcctacttaagtgacgacagtgagagtggggaaaggattgaaaaactgcctattgggtactatgcttattacctgggtgacaaaataatctatacctcaaaacttcatgacatgctatttacctagataacaaacctgttcatgtacccttgaacctaaaataaaagtttaaaataatcctgaaagtaggtaactaaagtttagagaaaaactataaaggagatcaagagataatctagttaatggaactgaaataaaaagtattcaaaataactccact

SEQ ID NO: 2854 - DNA, 9032 bp, Homo sapiens
gtttcgcgcacgcccccagggctgacaggtgagtggggctgtctgtccctcagtacttccaggggttttcctatgcagaatttttaaaacgcagcaccccttggtcccggcctcgacattatttctagggatggattgacagaagcgaatcagtttgggggaaggggagctaatggaaatgacttccgagttttccctccgcgggcccaggttgagcaggctttgccaccacggagagccccagtctccctgccgtggctggtttccctcacatgctaaatagactcacgtgggccccaggagtaatgcctgttagtgactgcactgtggatgttcaccggggctcacgcgggccctaatgcattttcggtgcagagacgcgccctacctggcccatcgggctgcgtggtccggggcgcgtgggaggccgccctgggagcagaacgctggggcggggtcgggggcgattcttgacctgcctcttccaagctccccctgtctggtgcactgagggttccgaggaatgtgacgggaacccaggaggctgcgggaagtctgctgggtcccgagggaagccttcggctcctaccgtccgctactttctgcttccacacgggaggctgtcacctgtcatctccttccccacttagatcatccttccgtggtagattttacatcttcaggccgggtgcagtggctcacgcctgtaatcccagcactttgggaggctgaggtgggcggatcacctgaggtcaggagttcaagaccaggatggccaacatggtgaaaccccgtctctactaaaaatacaaaaattagctgggtgcggtggtgcacgcctgtaatcccagccactcaggaggttgtggcacgagaatcgcttaaacccgggaggcggaggttacagtgagcctagatcgcgccactgccctccagcctgggcaacagagactctgtctccaaaaaaaaaaaaaaaaaaaaaaagataccgcttggcatctggaaatgtctgggacgacctctagaattaacctagctcaaacctctgttcccagatcagtttcatcctgaaggcttccctagggatggatcatcaagtcctgggaaactggacataaaatgcccactacttaaataatgatttcccatacgtaacttttagtgacccgagttataaatgttttttaaggaggatttctatctatgcaatgaggggaatttttcaggttcctggttctctttctataaatggtgttttcattacaatactaagggaaagttttgtacgttgaaattaagttaccatagaatttaataaccaaggtgattattaaactgattgagggttggtcttttcccccattgccttcatcgttatttaagtgctttgatttttttttttttttttttttttaaccctttttctaccgttcatatatatatatctagttgaattatttcaagatttcaaggtcagtattgtccccattttataggtgaagaaataggcctagagactttacaacttcaggtgagcaggagataaacaggtaggattcaaggcttaccagtctgattcctgttagaagaaaaacttcagctgaactaaatttaaaggagttaaactgagcagtgaatgactgggcagcccccagaatcacagcagattcagagagactccagggatgcctcgtggtcagaacaaatttttagacaaaaagagggaagtgacgtacagaaatcagcagtgagatacagaaacagctgcattggttacaggggggcgtttgccttatttgaacacagtttgaacaatcagcagtgtatgactggttgaagtatggccgctgggattggccaagactcagctattgttacaggtgcatactcctaaattaggttttcaagcttgtctgcctattaacctaggttacagttcgtacacaaggactcaaatacagaagtacagagtccttctcaggccatatttagtttgctttaacactgcctctcaaattctttctcttataattaatgctataatcctcttaaacatgctctcagttcaaaatgcagatttgcccttttttgtgtgtttcatttatctccacattggatataagctgccataatgcatgtatagacaaaatagaattagttgttataaagtaaaaattttgttcagaaatattattaaaagaagtacatgtattatatatgtaataaacatttaggccattcaagtcagtcacatcttcaatgaaaagccagacactaaatggccgtgaattggacattactatagagaggcagaagggccatagtctttcctagctggaaaagtaatttgctggggcgctgcccggtgcactttgcccccatcctagcaactcgagtgtgctcagcagaatgaagttagcaaaactggttagctcctgaaacagacttccctgtcttggcagattaacaccatccatgagctcacttttccttctaatatctgggattctaatatccattcattattactttcaaaggaattatcctctctttttgaaaagcacaacgttaaagatgttttgacactctttcacagctatcgctttaaataacaatcacaaataaagccaaaaatagtttctcaaggtcatttatctaagtcataagcaataagaaagaatgactacttcaaaaaaagagtctgtctgcttccaagacatgccaggaactcgagaactgagaacaataatgtaaagcttgtgtttcagagttgagattagcattatgcttaagattttctttaatgttttttatgccagctggacgtcttctgttagtgaatttcccattctgtactgggtcatacgaaatgagtttttaaaaactcattaatcagttattaaacaaaacatttttccttagactaatccaaaccacatttgtgatctttttaaaaatcagaaacattaacaaaaactcatttttctaaaaactgacatatttctggagccttgaccaattcattattataattttgagtaactaatagtgattgacatttatgtagtgcttattattgccaggcactgttctaagtgttttttaaaaataaactaatttagtctttgtaacaaccatgtgagggaaaaactatcctccactttacagatgaggaagctgaagaaaaaataagaaatgtactcaaaagttgcacagtcaatgaaggatgaagctaaattcaaacagacattctggctctagggtctgtgttcttaaccactctgcaaactgcctcctagggtgttacatttaaaaatacattcctaggtctggtgcggtggttcacgcctgtaatcccagcactttgggaggccgagggatatggactgcctgagctcaggagttcgaaaccagcctgggcaacatggtgaaaccctgtctctactaaaaacaaacaaaaaaattagccgggcatggcagtgtgtgcctgtaatcccagctacttgggaggctgaggcaggagaatcgcttgaacccagaggcggaggttgcagtgaaccaagatcgtgccattgcactccagcctgggtgacagagcaagactctatctcaaaaaaaaaataaaaaaataaaaaatgaatatacattcctaatttgtatttgtctccttctatcccctttcctcagagactgacatttaaatttacttggcatgaattgtgctcatttaatctggatttcctgaattataagttatattacctagattgaacaaccaaaaataaataaggaaaataacgtcaaccttgtaactgcaacagactgccattagttggttctcttagcggtgcctttgaatattaatattttgcaggtttgtccttaacaggctgtctctaccggaaaaaaaaaacgatatttagtactttttttcttctttttctttttttgagacagggtctcactctgttgcccagactggagtgcagtggcaccaccacgcctggctaattttttgtgttttttatagagatggggtttcaccatgttgcccaggctggtcttgaactcctaggctcaagggatccactcaccttggcctcccgaagcgctgggattataggcatgagccaccctgcctggcctgtttagtactttttttttttttttgagacagagtcttactcttgtcgcccaggctggagtgcaatggtgcgatctcagttcactgcagcctctgtctcctgggatcaatcgattcttctgcctcagcctcctgagtagctgggattaccgacgcccgccaccacaaccagctaatttttgtatttttagtagaaacgcactttgggaggctgaggagggcgaatcacctgaagtcaggagtttgagaccagcctggtcaacatagtacttttaattgctaagacaggtaaaccaggttggagacttggaaaatgcagagacttggcattaggaagaaaaagaagctggggtaaaataaaggaatttgaaaaaggtacaaaagaaataaaaatagaacaatttttttaatatttaaaatgaagaaaaagcaatagcaagtgctacataaaaaaggtctcagagaatagaaaatgtgatttaccaaaaactttcaacctagaactgtaccttattctgcttaccttccatggaaaataaagcagactgtcataaaccaaggggatttctgtgatccctgcccaacctcaagttcccttactcgaaatgcaagtaccctagtgtatttctaagtacttttccttgccaatttagattctaagtactactgtggcaataattagcgaaaatagatactgaggatacaaaagggagacaaagcaaaggtcaaaaccaaagtagttttttgcattttcaaaagaaataaaggaagatgaggacaagtaaagttcgtccttggatctatgctccttattaacaggagggcatttaaacctgtgactttgtagaaagggctgatgagaagtgtgtacaaagttttcatggccaaagataaggctacataatctggtattatgggagaaaggctggagaacacttagctgtgccaaatagttcaaataaaagcttcccaaagcatctcaagcattcaagtgattctgtgtctttgaagtacagtaggggtcaaggagcaagaagtcaccatctccagattataaagtgaaaaagtactcgacatttgcagaaaggaccagacagaagaaaaaaacacttctgggtatatataatatctgcaaccaaacaaaattataaatattttgttgaaattgtgagaaagaccctaaaatatttctagtaacaaggaaggtcacatggattattaaaatgtacccaacattactaatttaggatagatacaatgccatttagtctctataattttatttttgtgaatgtaaaaatatttataaagtttttcaaaaggctccacctatagtgacaatcccttcaaacctattttctcaataatggccctgcagatgaatatccccgggactgtcagaaacctgccttttgtgttgagaaggaactgctatacttctgttaaagcaagtgtgtctatggttgtagatatggtgctggatagaattagtgtagttctggggacaactgctaagccactatgctttacagattctgtaacctgagtcatagggaacgtgggactacttaaaattgttggtgaaagtttatgaaactctggattgttcgaaaaatgctcaaaacaaaaaacaacaaaaaaaagaaacaaccctatgagagttgggtatgatagtacatgtgtgtagtcccaggtacttggaaggctgaggtgggagaatcacttgagcccaagggttcaaagctgtagtgagctatgatggcacctgtgaatagccactgcactccagcctaggcagtgtggcaagaccccatttgtaaaacaagaacaaaaacgtgaaataactttgaaataccaagagttagtgagaagaagctccagggatatgtttatggccaagagaactttagtgtagcagaatagatttgcagagaatttagtataattaaaatacttttttcttatttttagctattccaaacttttaaccaaatcctttttttttgagacagagtctcactctgtcgcccaggttggagtgcagtggcgcgattcggctcactacaagctccgcctcccgggttcacgccattctcctgcctcagcctcccgagtagctgggactataggcgcccgccaccattttttttttctatttttttttctatttttagtagacacggggtttcaccgtgttagccaggatgatctcgatctcctgacctcgtgatccgcccgcctcagcctcccaaagtgctgggattacaggcgtgagccaccgcgcccggcccaaatgctttaagaattattttacatcccttcttaagtaggtaaacttcctgtttgtagatatcatgtcttacatctaatgcagatatcagtccacatcaaacatttaatacattcttaaaaaaaatatgtgaagccttggaaaggaagagagaagttaggaagatactttaatctttccaatttcttaggaaaaaaaggaaaattccattttatatgttcttaattcaatgatgtctgctatgtagtgagcactctgtaaatatttataaaaacaacaaatgaacgaagccccccaaataagtaaatatgtttttttgttttgttttgttttttgagacggagtcttgctctgttgccaggctagagtgcagtggcccaatatcggcttgctgcaacctccgcctcccaggttcaagtgattctcccatctcagcctcttgagtagctgagactacaggtgcatgccaccacgaccagctaatttttgtatttttagtagagacggggtttcaccatgttggccaggatggtctcgatctcttgacctcgtgatccacccgccttggcctcccaaagtgctgggatcacaggcgtgagccaacacacccggtcaagtaaatacattctaattacacctcatttcatccacaacccagaaagtagtatgtaaactgaattcttagaaaaacatttccacgttaaatgcactagggcaggttgccgtataaaggaattctataaacaattttttttttaagagatagggtctcactttgtcacccaggctggagtgcagtggtacagtcataactcactgcaactttgaactcctggactcaagctgtcatcctgcctcagcctcccaagtagctgggactaaggtgcctgccaccacgcctggctaattttttaaattttttgtagagatgggggggtctcattttgttgcctaggctggtctttaactcctggcctcaagtgatcctcctgcctcagcctcccaaagtgctggaattacaggcatgagccaccgtgcccagccacagattttttaaaaataacagttttattgagatataattcacatatcatagaattcaaccttttaaagtatatgtttaatggttatagaatgaaccattggtttatagaatatcactgagttgtacaattgccatcgccccaaaaataaacttaatattactagcagctactttccattcctccctactccagcccctgaaaaccactaagttactttctgactctgtgggtttacctattctgaacatttcatataattggaattgtacagtatttggtctttttcattatctaacttctttcacttaatatgacgttttcagggttcatccatgttatagtatctattccttcctaatactttattcctttttatggttaaataatattctaccatatggatataccatattttgtttatccatatatttattgatggacatttgggttgttgctatttggcaattatgagtaatgctgcaaggtttttgagtgaacatatgttttaaattctcttcattgtatatctagaagcaaaattgctggatcgaataatgactctattgtttgaagaactgacaaactttttcaaagtggctgcgccattttacaatcccactagcaatgtacaagagttctaatttctctacattcttgtcagcacttgttatcgtctgtcttttttattttagccatcctggtaggtatgaagtgttatttcattgtctttttgatttgcatttccctattgacacacagtgctgagcatgttttcctgtgcttagtggcgatttgtatatcttttttggagcaatacctattcagatcctttgtccatttttaaattgggatatttttgtttttgttgttcttgagttgtaagagtcttgatatattctagatataagccacttatcagataaatgatttgcaaatattttctcccattccatgaggtgtttttttactttcttgcctttgaagcacaaacattaattttgacagagatttatttatctgttttttttttgtcacctgtgcttttggtacttgtgatggttagttttatgtgccaacttgactgggttaagggatgccccatagctggtaaacattatttctgggtatttctgtgagagtgtttaaatgaaagatcagcatttaaatcagttgactgagccaggcatggtggctcacacctgtaatctcagcactttgggaggctgaggcaggtggatcacttgaggccaggagttcaagaccagcctggccaacatggcgagaccctgtctctattaaaaataccaaaaaaaaaaaaaatagctggatgtggtggtggatgcctgtaatcccagcactttgggaggctgaggcaggtggatcacttgaggccaggagttcaagaccagcctggccaacatggcgagaccctgtctctactaaaaatacaaaaaaatttgctggacatggtggtgcatgcctgtaatcccagctactcgggaggctgaggcaggagaattacttgaacctgggaggtggagtttgcagtgag

SEQ ID NO: 2855 - DNA, 1873 bp, Homo sapiens
gtctgtgccctggcgcgagccttaggggcgcctccagaaagttcttcggggtttttccccaggaccggcgggtacggcgggtacggcgagggaccaagccggatttgcgattgggatgcagctgcgtttcaccaggggcaaaaagctcctttcctcctctctttcctcctcgccacttgcccttccccggggccacgaggaacaagtgcaagtagctggaagtcgagtgtgctactcaactcaggagatttggagacaaactgaacttccggcagaaacttctgaatctgatatccaaactcttctgctcaggaacctgactgcatcaaaaacttgcatgaggggactccttcaaaagagttttctcaggaggtgcacgtttcatcaatttgaagaaagactgcattgtaattgagaggaatgtgaaggtgcattcatgggtgcccttggaaacggaagatggaatacatcaaagtgaatttctgttcaagttttcccagattatcattctttgggatgagagaacattataaaaccactttgtttattttaaagcaagaatggaagacccttgaaaataaagaagtaattattgacacatttcttttttacttagagaatcgttctagtgtttttgccgaagattaccgctggcctactgtgaagggagatgacctgtgattagactgggcggctggggagaaacagttcagtgcattgttgttgttgctgtttttggtgttttgcttttcagtgccaactcagcacattgtatatgattcggtttatacatattaccttgttataatgaaaaaactcattctgagaacactgaaatgttatactcagtgttgatttcttcggtcactacacaacgtaaaatcatttgtttcttttgactcaaattgtattgcttctgttcagatgatctttcattcaatgtgttcctgttgggcgttactagaaactatggaaaactggaaaataactttgaaaaaattggataaagtataggagggttacttggggccagtaaatcagtagactgaacattcaatataataaaagaacatggggattttgtataaccagggataataaaaagaaaaaagaagttaatttttaattgatgtttttgaaacttagtagaacaaatattcagaagtaacttgataagatatgaatgtttctaaagaagtttctaaaggttcggaaaatgctccttgtcacattagtgtgcatcctacaaaaagtgatctcttaatgtaaattaagaatattttcataattggaatatacttttcttaaaaaaaaggaacagttagttctcatctagaatgaaagttccatatatgcattggtgaatatatatgtatacacatacttacatacttatatgggtatctgtatagataatttgtattagagtattatatagcttcttagtagggtctcaagtaagtttcattttttttatctgggctatatacagtcctcaaataaataatgtcttgattttatttcagcaggaataattttatttattttgcctatttataattaaagtatttttctttagtttgaaaatgtgtattaaagttacatttttgagttacaagagtcttataactacttgaatttttagttaaaatgtcttaatgtaggttgtagtcactttagatggaaaattacctcacatctgttttcttcagtattacttaagattgtttatttagtggtagagagttttttttttcagcctagaggcagctattttaccatctggtatttatggtctaatttgtatttaaacatatgcacacatataaaagttgatactgtggcagtaaactattaaaagttttcactgttc

SEQ ID NO: 2856 - DNA, 1584 bp, Homo sapiens
tgtatttgtaccctagaatatagaaaatgaaatgaattttaaaaccccacaatatacctggcaatccggaagaagattccagaaagtttgcattttctgttgagggactaaacaacagtactttcaaagtaattaatgaacttcttttgtcttttttatttttttaagaaaactggtaccaattggttaccagaaaatggcatgatcttcaagaaaaaaaagttttcctggtgaacatttcctctctccccaacatccttgagatggcaagaggcagacaactcaactaaagagaagaggatttacagcaagttgctgacccagcttacagcacagctgtcctcttccatagaatgggaagaagttttatgcctttatgcttctctgtaccatcaacctcaaagttcggtgggtatctcagagaaagtgttattattagcaaacagtcataattccaagaaaccacttgctaaggggttcctgatggatgattttctctctctgtagaaaacaagtaagaaccttctatcttggggaagtctggcaaatgctccatagaggctgctgtggaagggaatcattccacatcccatgttaggataaggcccgaaaccctgcctgggaaaacaagagcagcacacggagtgggcttcagtcctgtctcatttacagggtcttgaacacgccctataggcttctgggacctgtttttctgtatctgtcaaacaagggggtgctctaacgaccttcctgctgtagcgatcttgcttcactttgggtaaatgccacagccataggagaggaggtagggtctttgtcctcatgggtctcccaccaggcccaaggtttctccaagccctgctgacccaggagggccactcctagcccctctgccaagaatctactttccttccctcattgactgatcatgctcagaaatcagctaatttgggggtggggggcatccaacatgaaagaaacactacaaagaaactcttaggtaagctctctacctctacacacacccatacacatacactgacacagacacatacaggaaccctgaaatataagtattttcccttccatgtatcaaacctcttttgccctcttgaattgccagtgtgctgggagagaattcagtcccacagtggagaagcactgcttccacttacggaactcagctaaacctcagtgtttagggatgaccctgggcacaggttgaagctaaaggtcctaacacacctccattgcagtgcagaaatgcagactttaccagccatgattggggcagtagctaactaaaagcacaggaccaggatccagatccttcctttcttgctcttccacttccactgcctcccccaccctagatgtgttattctgtaacagtggtcgcctgctcgagactgctcatctgcctgcatagagtgccgtggacttgctctgtaatgcactgtatatgtgtatgtcctgactctgtggtttactgcaaataaaaatgacagcaggtggctgacctctgacctcctggtcatttcatgccattgcttgtgaaatcaggattggccattcatgctctgg

SEQ ID NO: 2857 - DNA, 1345 bp, Homo sapiens
gttcttttcctaaaacatgcatcatttacaaaatggatttgcatattctcagtattgttgggacagtaacatttggaaacagtcatttccacagaagagctttgagcctgatatccagtggggggtcatttctgactctgaaaatgagtatagctcaggaggcccaggtgctggggagtgacgccatcagctccactgcaggcctgcttgttatttccagccgcatatcacacctgtgaaagggaaagattcttcccactgtttgtccttctgatagccttctctctggactttgcatttccattccttttcattgacaaactgactttttttatttctttttttccatctctgggccagcttgggatcctaggccgccctgggaagacatttgtgttttacacacataaggatctgtgtttggggtttcttcttcctcccctgacattggcattgcttagtggttgtgtggggagggagaccacgtgggctcagtgcttgcttgcacttatctgcctaggtacatcgaagtcttttgacctccatacagtgattatgcctgtcatcgctggtggtatcctggcggccttgctcctgctgatagttgtcgtgctctgtctttacttcaaaatacacaacgcgctaaaagctgcaaaggaacctgaagctgtggctgtaaaaaatcacaacccagacaaggtgtggtgggccaagaacagccaggccaaaaccattgccacggagtcttgtcctgccctgcagtgctgtgaaggatatagaatgtgtgccagttttgattccctgccaccttgctgttgcgacataaatgagggcctctgagttaggaaaggctcccttctcaaagcagagccctgaagacttcaatgatgtcaatgaggccacctgtttgtgatgtgcaggcacagaagaaaggcacagctccccatcagtttcatggaaaataactcagtgcctgctgggaaccagctgctggagatccctacagagagcttccactgggggcaacccttccaggaaggagttggggagagagaaccctcactgtggggaatgctgataaaccagtcacacagctgctctattctcacacaaatctaccccttgcgtggctggaactgacgtttccctggaggtgtccagaaagctgatgtaacacagagcctataaaagctgtcggtccttaaggctgcccagcgccttgccaaaatggagcttgtaagaaggctcatgccattgaccctcttaattctctcctgtttggcggagctgacaatggcggaggctgaaggtaagaaaattgaaccagatttattcaccaaaacag

SEQ ID NO: 2858 - DNA, 854 bp, Homo sapiens
cccctgatgtgtatacagtctgtcactgactgaaatgttattatgtgctgcatgaacgcatctgttaaatgtataaactaaagagttgaaacaaatcccatgtttggccaatgtagaatctaagtagaaggaagacatagaactaaatttttcatccttttataactacaaatggatttaaatataatattaagtcttctgttcacatagtacatggttcaaatgtacatagaaagtacatataaatatctggaggaagattattccaggtggagagaactgcaagaccttgtggcaagaaggggctcagcatgactgacaaatagcaagaagagtcttgctgggtcttccggactggagtgcagtggcacggtcttggctcactgcaacctctgcctcccgggttcaagcgaagtagctgggattacaggcacccaccaccacgtccggctaatttgtgtatttttagtagagacaaggtttcactatgttcaccaggttggtctccaactcctgacctcaaatgatctgcccgccttggcttcccaaagtgctgggattataggtgtgagataccacaaccaaccccaactaccttcttatcagctactacaattatcaaccttaatggttctaaaaatcttggggttttgtttttatggtagccatggagaacagaaacattttgaacttatcttagtgatcttacagggatagcaaggaaagaatatgaccaatatattagagctatgatactgaattatacatttgctaaaactcatcgaattatacactcgagatctttgaaattaataatatgcaaatttcaccctgacaagaaaaataaaatactg

SEQ ID NO: 2859 - DNA, 31344 bp, Homo sapiens
gtaggagtcagagctctccttggtggaggagatgaacactttaggcttcctgccatcctgcctgtcagaggtgcaggtgggtctgaggaaacttatcttctaatggttagagcagatacaggttgtgctgtgctgatctgctgtgttcatatggcttcccacagtgttcaatgtggtccttgcttttagatgtgtactttaggggtttccacatgtgtccttatacctctcttaaagaaaattcctgctggtttgtgaaaatccaactaccctttgactagggacgcttcagaggcataaagggagtctctataatggcttggccagttggcttttatatttgacctggggagaaaaatcacctgaagaccaggataaggttgtgggtgtacatgcaacattaaggaaaatagtcataaatatgccaaaatatgaattgatctttagttttctttgatctttgaagatgagtaatttgctaagtgtggaagattgaaggaagatttacttttcaaatacaaggtttttaattgcctccttttgtaggcccctagataaatagagagctgaaataaacttttatagggtttgttttagaactggtactttataacctaatattcatcatgattaaatgctgtgtgttttggagacactgccacagtagctcactactcttcctaggctgaatctgctccagtttcttcacagccactaggtgtcagcgttgtcaagcttttacttccaccaaaggtttattccgatcagaacagccagttaaatgtttaaatgaggttgcatgaaattcggtaatgtgctccatgatggatagagtctagaaaaatgactaaatgtctgacttgcatggccaggcctcgagtcgatcacttgagagactttcctcttagagtagcaaagggtgtggcattctcaccattgcctaattcacaagttttggatccttttggatgaaggttttcaaagcagaattttctatttttagttaaatctcattaagtcaacatgatatggtctagaattactgggccaaaaagagaattgtgttctaggtattgctctatcacagatgttacatggacatttaacctttctatggccttattttcctaggggttatatttgttttatagaatgttccagggcaaatacattctttttgcagacacattaatttacatgaaaaaggatacaatgtccatttaagttttgtttttttaaaaaaattaatgatgatctaggtattagcacttgatggttactgagtgctactataacaaacccccagaggatgctgcttagcgttcacaccagagtcactcctccggcctatgcaatttttagtacagttttgtttccaaaaccatattttaccatggaggggtatttgagctggcaggcagtagtcactgtactcttctgttatcgtttctcattaacacattttcagtgattggattcttttattagctaattgtgaatttggaagaatgtaaatgcctcaggggcagaagggtagaactctgggagaatggcattgaggatagatgggtaaattatatgtgcataaagaaaagatgagcacatggagtgtatacatatatgcctatataaatcatctatactatttattaaatgaaaagcatatggcacatggtatgatttaaacatttatgaattgaatctttaaatgcttataacaatacagtgaggtggcttttgttagcaccattttacagatgagaaaattgttaaggaagttaagtaacatgcctaaggtcatggagctaataaggcgtgaaactgggcttcaaatctaaatcaagtctgacttcaaacctggagtgttatgtcttcttgatgggcagggtcaaagggtcagaacatcagctcttctctagcttgatgggatttatcttttatctcgcattctattcctttaaagctccaaaacctgatgaagcacacgccagaaagtgtttttcttctaatggaaaagattcaggcctctgtaaaattgccagtttagcaagaaagtttcctctttataaggtggtattctttgtattagagaattagtcatggtttgttccctggtccaaccatatttatcattccgcactgggacagaacataagctccaaaaggacagggcctcgtctgtcacctttaatgctgtatcctctccagtgctcctaacagtatctgactcatggcaaatcctcagtaaatattattggtggtgttgttgctatgaacaaagaaccatgccaaaaggtttgacctcagattataggcaattaaaatcaatgtgttttgctacacatttaaaattcaaaagagcataagcctttggtttcctggataccaagggctgagagattttcccttgcccctatgtattattgaggttttctcctaacatattttattcttctatccattttttaaaacaaacagaaaatgccagtgttaactctgaattatggatgtccaatgaattgactataattattttattggagtcatccattaggttttattttctgtccccttctatgatatttttaacatcatctttgagagatttctttctcggcacaagataagactactggagttctttgctccattctctcacttctgtttttctgaggttactgtgctttctttcctaggtctgaacttagtatttatttatttaaaagagtgagtgcctgcacatcagctattccttgggtcagggcacaacatctctacattttcctactttcaaaaagactaatgttgaaatagctttgattggaaaaggtgtgagaggaggctgtgataggtgaggtggtgggtttactgggatgaatcagcctaaagtaaacggatgacaaagcaggattaaccggagaatttggacactcttttggttcttactatcgaaaggcaggtacagtcttggagtttatctgcttggactacttggttttcatccttctagttggtgtgacataggaatggtaataacaagttccagctattatatcgatctcagatttatgtattaatttgagtgcttataaatcaagaggtttccttagagctttcgttttgtgaagtaaaacaaaataaggtttgataatgtggactctaatgtaattcattcctctctttatctacccttaaaacttataataacattataaaacacatccatttccagaggcttctgaagtcttttgatataaattaaagttgacattattgagttgaacattatatagactaaagcacatttagacattgatataaaaatatgtaaaattaaattattgtacttcagacctgcatgcatgttggaacacatcacgtatctgattcttgtctctctgatcacggcatactattcttgccttctgacctgtgcacaaggtttatataacttcgtatttagaatgtacagcccgtttcattttacatacttaaatcattctttaaagtcaaactgaagtctagcctccctcataacacctcctcctgtgacctctagtcaatataactcttcactctttgccattcttagcttttatttgtgtcatacaatttagcatttgattgatgatatactcattgagaatccatgtagtacagtgattagagtgtgagctttgtagttacccaaacctggttagactgtttgtactggatacctgagtttctttttaaaaagcatcggaaaaataaccctaacttaaatagcttgctttgaggaaacaatatatcaagtataaagtaagtcctatgaaatatgtataaaggacttaacattgcacctgacatgtgtttagtataattggtagctattatatgttttctgttattctcataagccattttcttaaataggttgtaagttccataaggatatggatatgttctttattttgtatacttctgtgctgtacatagggtccagcactgttctgaacatatgggatagaatgtttttggacatacatagtctagcagttggtgatctatgtaacaaaaagaacatgctgacacctctcaagaagggagctgcaacattttgttctaatatgtttctaaggtgatatctcttgatgggcagttaaagtactgaggacttgtactatgacaatctcttgggggaagtaggttcagtgttctggctaacgtccaattcaggttaataatacattctatatatccaagcttcccttatgcttcaggtattgttcagcacatggtacttttttagtgacgatgctcaggagtgaacaactgctttttttttcttttactaaactgggtgtgtgaccccttttaggtaattccaaagccagaagggtacataataccttgtaggataaaaattgaatttaaaacaaacttttattaaacagaagaaaaataaaaataagttagataaaatttatttgataaaaatgactgcgggttaatatttttcaattgaaaaataaaattctacttgttatctcttatctttttcatgatagccatcctaacaggtgtgcaagacaagagataacaggagttagtgatgatgtgaagaaaaggaaacctttgcacattgttgggaatgtaaattggtacagtcatttcggaaaaagtatagaggttgctaaaaacatatgaaatagagctatcataagacctatcaatcttacttttgggtatatatccaaagaaaatggaatcagtatcttgaagagatagctgcactcccacgttcattgcagcattattcacaacagccaagatattgaaacaacctaagtgtctattaacagatgaataaagaaaatgtggtatacatataagcaatgaaatattatttagccttaaaaaggaaggaaatcctgcctttgcaatagtatggttgaacctggaagacattttgctaagcaaagtaatccagacacagaaatacacatactgtatggtcttacttatatgtggaatctgaaaatgtcaaactcagagaagtagagggtagaggagtgctttccagggattggtgggtggaggaaattagtagatattgatcaaaggtacacattttcacttataagatgaacaagttctggggacctaataaacagcacgagtgatgatagacgtgttaatttaatggtggtagtcattacaaaatgtgtatatatctctcaatcatcttgttgcacactttgaatatattcaatctttgtcaatcaaatatttcaaaacaaaaaataaaattctagatagataatgactgaccacatagaaaatactcttaggcttactctgggaacttgagaactctgaggatacaacaaaacaatgtagggatcctgtggaagaaatgcttagaaaatgaaactaaatagtgctaggcttgtggttgtactatagcatatagagaagaaaaagttgatgagttccgataatatccttcaatcatgtaaggacttatagcaagaaaaaagtagtgaatcagctagaataatattgcactgggaattgcttatctacaaggaccttataaggtagggactaactttccattggggctaacattaaaatggaattgtaaatatattttctttaagacctttaaaaataaagaccaacctgaccaacatggtgaaaccccgtctctactaaaaatacaaaaaattagccgggcatggtggcaggcaactgtaatcgcagctactcgggaggctgaggcaggagaatcatttgaatataggaggcagaggttgcagatagatgagatcatgccattgcactccagcctgggtgacaagagcaaaactccatgtcaaaaaataaataaatcaataaaataaaagataaagaacatgtgtatctggaattgtttagatgcagtctaaggaagggtgtaagtgggagctggactgaatgagtactaaggggaggtgctaagcttctagagcaatagttctatagccatggattaacttcagtgacctttgtaagatgaagtatgttaattgctcaattgggagaagattctttttttccttcttctgtaattaatctaactgtcctgaaagaattctgattgaattattccttttaagggtaagtgaaccaaggactgctatactaaaatattcatgtctgtcttaggtggtattctatttcttatttaccagatcaaataaaatgattttttatgccatttataaacctgtttctgaagatttcaaagcatttcagacatcatttaaaaatttattgcacaggtataaaaaatgttgaattattaaacagtgtgctaagttcaaaccaacccaaacatattctatccactacttatgcaatttcatttttattcaattgtacatagttgtttgtcccaaaggagaaaagaatgtgatgttacatttattctttagttttctgatatagagaaaagaaggttggatgcatcatgcaaggtcatcctgagtcagtaacaaattcagaattaatattcacatttcctaatatccagctttttgcaatagccatttgatcattttcactacttcataaactacagatctttatagggtgatttgtttttctatagttacagtctgaagaaaaaatcttatggattttttaatgtaagaaacttgcctttattttaaaatgaatgatgaaaatgatgcatattatacatttgtcctcctaaaatttgatttccacattggatagttaatggtcatgataactaagtgtcttctattaaattagcaaagtaaaaacattatagagacatcttttaattcctaaggtttgctattctgtttccgtctgttgtctctggggctcagtttattggtggcacttaggtagaaagctgttgagtcaagcgttagctgattttcatgcaccagagaagatttattaatttttacaaggttgtttgctatacagtagtttgcgttgtgggcagcttatagctactttatgtggggaatgtttattgaaacaagttaattctttgttatgggttgtttcaaaatttacaatgctgataggaattccagagatggcaaaaaaaaaaaaaacaacaaaaacaaaacaaaaacccaaaaccaaccaaacaaacaaacaaaaaacaacttcagtgtttgcatcaatatggtgcttatttgtgcatgtcttatattgacatacctaagtccataaggttgtcaataaaagttggtattgaggagaaataatgtgcacatgtaccctaaaacttaaagtataataataaaaaaaaatagacaagttaactctgaaaatgtcttctttagtctgttttgcactttgaaagtgatctgtgcatgaaaagaaggtaatctttcactactaagattatgacttttggtggtttaagatgcaaattacagaggctatgctatactagagaaccttaaaccaagtaaagaatctttagaattcatctaacctaactgttttattttattttattttttatgtttgagacaatctcgctctgttacccaggctggagtgcagtggcacaatctcagctcagtgcaacctctgcctcctgggttcaagtgattctcttgcctcagcctcccaggtagctggaattacaggcatccaccaccatgcccagctaattttttgtatttttcgtagagacagggtttcaccatgttgcccaggctggtcttgaactcgattcacccgtctcagcctcccaaagtgcaaggattagaggcatgaactactgtgcctggccccaactgttttattttaaagatgaaaaaaatgagttgcaaggagattaaatatcttgtacaaggccacatactttgctaatgacaagagttgggacaataacaggaaatgatatattctcacaacctttggttctttggtgagccctctattgatccttggtatctggtttgtatcctgaaaccaagagaggacctatagtatgaaaagcattcttttcctgtttgaaaagctgcatgatgctgagattggactggctgcagaaatctcttctaatgttaaaacaaagccaggacattcagtttatttcactggggttcatggtttgggaggccttgcttatatatggctataatgaaaggctctgatggcagcctttgtggaagtgagccccattctctccagggaaaaacatacttctgctacctcctgtgtcttgaggagcatttcctttgctggacacttgctaggtggtcgagtagtgacattctgtcctgtattcagggacatgtggaatagaggagcccctcatagtccccttaataaaagatgtgggtgcagtcttctctaaaacgcaagcctccagccactctacatttccactttcctactcaagaagaaaggagtgaacttctttgagtgttcacagaaatgtacaacaaaggactgaaatgaggatgcagcacaattgacttttcagtgaagtccacttctttctgattatgcttgtcctccaggtgggagttctgctctttcagattgagccctaggaatctgaagtagaacagaattttctaccaggatgaaaggagtaccagaatgggtatggactttcttgagtctgtaggaaccttgttgcattgggactatggaataatccaggaaattgggtttcatatcaaactgcaggaacaacaaagatgcttttaacatttatctatacatgcgaatatactgtattaggcggtgaggtgccagtaaatgaaaataattcagtagtgcctttttaaaaatgttaaatttttaaatatttatttatttatttttgagatggactctcgctctgttgccaggctggagtcagtgacgcgatcttggctcactgcaatctctgcctcccaggttcaggcaattcttctgcctccgcttcccgagtagctgggactacaggtgtgtaccatcatgcctagctaatttttgtatttttagtagagatggagtttcaccatgttggccaggatggtatcgatctcttgaccttgtgatctgcctgcctcggcctcccaaagtgctggaattacaggtgtgagccaccgctcctggcccttttttttttttaaagaagaaaatgcaataatattacaacactgtagacaaaggaaagacttataagcatcatctggttcagccactttatcgtggatacacaaacaatacagaaagtacatcattttgtagttttctactgcaatggaattttgatttattgacaatttctagaatcccgtgtcgtctaaacctttaaagtatatcctaggcacttaggttgtttctataccttgactatcatgaatgatgctgcaatgaacatgagagtgcagatacctcttcaaaatactgatttcatttcctttggatatatactcagaagtgggattgctggatcatataatagttctatttttttaaaatctattttaggaaccttcatactactgttcatagtggctgtaccaatttacattcccaccaaggttcccatttctctacaagcattcccatttctgattacactcaccaacacttgttaccttttgttttttggtagtagctatcctatcaagtgtgaggtgatatcttattttgttttgatttgcattactctgatgattagtgatgtgagcacctttttatatatctattggccatttgtatgctttctttgaaaaatttctatttagagaagcaataaaagatgataaaggggatatcaccactgatcccacagaaataaaaactaccatcagagaatactataaacacctctacgcaaataaactagaaaatctagaagaaatggataaattccgggacacatacaccctcccaagactaaaccaggaagaagttgaatctctgaatagaccaatatcaggctctgaaattgaggcaataattaatagcctaccaaccaaaaaaagtccaggatcagacacattcacagccgaattctaccagaggtacaaagaggagctggtaccattccttctgaaactattccaatcaatagtaaaagagggaatcctccctaactcattttgtgaggccagcatcatcctgataccaaagcctggcagagacacaacaaaaaaagagaattttagaccaatatccctgataaacatcgatgagaaaatcctcaataaaatactggtgaaccgaatccagcagcgcatcaaaaagcttggccaccacaatcaagtaggcttcatccctgggatgcaaggctggttcaacatatgcaaatcaataaacataatccatcacataaacagaaccgactacaaaaaccacatgattatctcaatagatgcagaaaaggccttcaacaaaattcaacagccttcatgctaaaaactctcaataaactaggtattgatggaatgtatctcaaaataataacagctatttatgacaaacccacagccaatatcatactgactgggcaaaaactggaagcattcattccttttgaaaactggcacaagacagggatgccctctctcaccactcctattcaacatagtgttggaagttctggccagggcaatcaggcaagagaaagaagtaaagggtattcaattaggaaaagaggaagtcaaattttccctgtttgaagatgacatgattgtttattagaaaaccccattgtctcagccccaaatctccttaagctgataaaaaacttcagcaaagtctcaggatacaaaatcaatgtgcaaaaatcacaagcattcctatacaccaataatagacaaacagagacccaaatcatgagtgaacttccattcacaattactacaaagagaataaaattcctagggatccaacttacaagggatgtgaaggacctcttcaaggagaactacaaaccactgctcaaggaaataagaggacacaaacaaatggaagaacattccatgctcatggataggaagaatcaatatcatgaaaatggccatactgcccaaggtaatttatagattcaataccatccccatcaagctaccaatgactttcctcacagaattggaaaaaactactttacatttcatacagaaccaaaaaagagcttgtagtgccaagacaattctaagcaaaaagaacaaaactggaagcatcatgctacctgacttcaaactatactacaaggctgcagtaaccaaaagagcatggtactggtaccaaaacagatatatagaccgatggaacagaacagaggcctcagaaataacaccacacatctacaaccatctgatctttgacaaacctgaccaaaaaaaaaaaaagaagtgaagaaaggattccctatttagtaaatggtgcagggaaaactggctagccatatgtagaaagctgaaactggatcccttccttacaccttatacaaaaattaattcaagatgaattaaagacttaaatgttagacctaaaaccataaaaacactagaagaaaacctaggtaataccattcaggacataggcatgggcaaagacttcattacccaaacacccaaagcaatggcaacaaaagccaagatagacaaatgggatctaattaaactaaagagcttctgcacagcaaaagaaactaccatcagagtgaacaggaaacctacagaatgggaaaaaatttttgcaatctacccatctaacaaagggctaatatccagaatctacaaagaagttaaacaaatttacaagaaaaagcaaccccatgaaaaagtcaggaaaggatatgaacagacacttttcaaaagaagacatttatgcagccaacagacacatgaaaaaatgctcatcatcactggtcatcacagaaatgcaaatcaaaatcacaatgagataccatctcacgccagttagaatggcagtcattaaaaagtcaggaaacaacagatgctggagaggatgtggagaaacaggaatgcttttacactgttggtgggagtgtaaattacttcaaccattgtggaagacagtgtggcaattcctcaagggtctggaagcagaaataccatttgatccagcaaccccattactgggtatatatccaatggattataaatcatgctactataaagacacatgcacacgtatgtttattgcagcactattcacaatagcaaagacttggaaccaacccaaatattcatcagtgatagactggattaagaaaatgtggcatatatacaccatggaatactatacagccataaaaaaggatgagttcatgtcctttgcagggacatgcatgaagctggaaaccattatcctcagcaaactatcacaaggacagaaaaccaaacaccacatgttctcacttataggtgggaattgaacagtgggaacacttggacacagggcagggaacatcacacaccgaggcctgtcggtgggtggagggctgggggagggatagcattaggagaaatacctaatgtaaataacgagttgatgggtgcagcaaaccaacatggcacatgtatacctatgtaacaaacctgcacattgtgcacatgtaccctagaacttaaaggatttaaaaaaaaaaaaaagaaacatgtctatttagttcgggcacagtggctcacacctgtaatctcagcactttgggaggctgaggcaggcagatcacctgaggtcaagagttcaagaccagcctggccaacatggtgaaaccccgtctctactaaaaatacaaaaattagcaggcgtggtggcaggtgcctataatccctgctatacgggaggctgaggcaagagaattgcttgaacccaggaggcggaggttgcagtgagctgagatcatgccattgcactccagcctggggtacaagagcgagacttaggtctcaaaaaaaaaaaaatgtctatttaggtattttgctcatttttaattaggttatttgtgggtcatttcttttcttttcttttttgcttttgagttaaatgacttccttatagattttcaatactaacctcttattggatgtatggtctgcaaacattttatttcattccataggttactatttcattttgttgattatttccatttctgtgcagaaactttttagtttgatataatttcacttatttatttttgcctttgttgctggtacttatggcatcatatttaaaaaaattgtgaaaactaatgtcatagagcatttcccctttgttttcttatagtagttttatggtttcagggcttatgtttacagctttaatccattttgagttaaattttgtttgtgatgtaggataaaaataaatttgttttttggtatgtggatattcaattttcccaaccccacttattgaagagactattttttccacattgtgtatttttggcaacttttcactattgagcataacactaactatgggcttgtgaaatacggcctttattgtgttgaaatacattccttctgctagccactgcacccggccttgatttaattttcttactcattattggtctattcagattttccatttcttcatgattttatcttggtagtttttatgtgtctaggaatttatccatttcttctaagttatccaatttcttgccatataatagttcacaggagtcttttttaattctttgtatttctgtggtatcacttctaatgtttcctcttttatttctggttttatttgagtctccattctttttttgttagtctagctaaagagactgaatatgggaacagctgagactaaggtacagggagctgaagaagagtaaaaatgtcatactttagctctgggttgtccactgtgacttggccaaactgatcatgggactgtctggtattgactcagcagcatttgtttcagaaaagcaagcttagtcacatatttactatacaactagtaaaaattataatctcaaatacactcatattaaatttttgtatccaagctgtacatctctacctgtgttcacaatcagaagacatcacaatgactgttacggtgtccttgtcaggcaaaaagactactgcttcaactacagctgttttgttaatagtagtgctaggagcatgcctagggcactgttggctaaaattcaaaggaaatgttgaggatgcctagctgagaccaacagttcagcttacagcagagctttaaacaggcacacaccagtcatgcagccttttgtagatgttaagctgtttgttaggggctgattacctgagggctaatttaatatgtaatgagaagtttagtttgttctgttattttttttaaggcgtacttatttttgctctctaaactatcatgtttggacaatttcatgtttgctatttaggaagaagctaatcatcttttataccctatctcatgctccaaatgtgacagcagtagaaacacttacactgaaatacatctaggtgagggaaaatgtcaccagaagatggagtagtgttgctggtttgctccatattttgttcaatgatttagaagagtatgtgtatgtacaggtttactttcatacactctagtttcaaatgacagaaaatataaattaattgatattcttcagagtcaacattaaattttagattggatgtctttaaatttttacaatgtaaattgcttttctctcttctgtggtcaactgacagttgcattcattgaccagataaactatatttagcttaacatttttagtatcacttatgggattttagcaagatgccacaatatgaacttgtaatattgcatttcttttttaactgtattattacaaacctgattttaaatcatttttttctattttagttacagcattaatacaggctaaaattctctatataaattctgctcatattagtatagcacctggtagcactacagttcagtatttatcatctactccattataaaacctttgttctaaaagagctgtatgagcctattagatgtatacacaattaagtaggtaatgatctgtggttgcatccacacagcattaacagctgacttgtgactgattttccaagtgaggtgctgattgttgatacggagtacttattggatgaaaatgtttagaatattttgaagaattatttttgtgctttgaagtttaagttacatattttgttttaaccttactgtttgcttaatgaagaaattataatgtttcctccctctcattttgatgttggtatttatctctattgttctaagctccccatccaaacattgggagttactgaagcccttcttggtacttttggtgcagaatgtaatggtccaccacatgtgtcattactgatagtgacacatttatgtcttcatgttaaatttgcatttttaaaattaaaggtaactgaattttagtcattttcccaactttaatgttaaagtcattgagaatagttatgatatttttgaaagtttgataatgatcatctgtgaatttagagaaactaaatatgggagattattctggtaagtatccaatttcagtcttctttgtcagtgtttgaacttaagctaaatgctcatgtttgtaggacaaaggcatttcttctcaccttgggtcagagcagcaagtcctgggaatatgatacagcattatgtgaataaacagaagttttggtaggcagcagtgtacaatttgttaagaaaaaaatcagacaggaagtttttgttggccttttgcccattctaatataaacatacatctataccatatattaagattgggcatagttaagatcaaattcatttaacaactgggggaatttattttacctgggatggaaaacattaaatccaaagatgaaacagaagcaaataaattaagcgtacctgaactttattttaaatttagaggaagctgtctttttggaatctctttgaaatctatcaggaaacatttttgtcttaaaaacagagagtaaataactctgggtttaagatatctaacatgtttgacctttgttatgctaaaatagtgggctagaattggatccataaaaaaatgatcggatgtttatccagggaaggaatcttaagttagacttggtattaaccaatgtgtgataagtaaggtaccacttgtgaacatgtggttggtgctcatgagtaacttgtatcagtcactatgcatttttcttctactccaaacacctggcctagtggatatagagaatgtcttgacatctttgttactctatttttttttctttcttctatgttcttctaatgaatgttactctgtttttttttttttttttttttttttgagatggagtctcactctgttgcccaggctggagtgcagtggtgcgatttcagtgcagtggttcttgccattctcctgccttagcctccggagtagctgggactacaggcgcctgccatcacgcccggccaatttttttgtatttttagtagagatggggtttcaccgtgttagccaggatggtctcgatttcctgaccttgtgatccacccgcctcagcctcctcaagttctgggattacaggcatgagccttggcaccgacctgtttttttttttttgagacggagtcttgctctgttgcccaggctggagtgcagtggcgtgatctcggctcactgcaagctccaccttctgggttcacaccattctcctgcctcagcctcccaagtagctgggactacaggcacccaccaccatgcccagctgattttttgtatttttagtagagacggggtttcaccatgttagccaggatggtcttgatctcctgaccttgtgatccgcccgccttggcctcccaaagtgctgggattacaggcatgagccaccgcgcctggctgaatgttactctgtttttaagcggttttggaaaagtttatttcttactcttgatataagagctgtgcacagtgctgctataaaaagttagtaattttttaatgtcagtaggggatcaatttgagagaagactaaagttgagaatatctaagaatgttggcatatatggaatagatgttatcaccctacattttaaaggtcttttttgtatacattctatatgtaatatgaggtcagtgaacacactctaagatcaagctcttatagtagactgaaaaacttggcaacactgaagaacaattgtgagtatttttagattaagtgaatgacactacaaatattatttttaagatatctggcattaaggcttatttattgtgaaaaccattaaacgaaagagagaaatcacacaccagaataataaaaaaaaatagttaagatagacatataggggcaagagggccgaataggaacagctgtggtctgcagctcccagcaagatcaatgcagaaggtgggtaatttctgcatttccaactgaggtacctggctcatctcattgggactggttagacagtgagtgcagcccacagagggtgagccaaagcagggtggggcattgcttcacccgggaagtgcaagggattgggaaactaccttccctaaccaagggaagccgtgagggactgtgctgtgaggaacggtgcattccggcccagacactatgcttttcccatggtctttgcaacttgcagaccaggagattcccttgagtgcctatgctaccaaggccgtgggtttcaagcacaaaactgggaggccgtttgggcagacactgagctagctgcaggaattttgtttcataccccagtgacaactggaatgccagcgagtcagaactgtttgctcccctggaaagggggctgaagccagggagccaagtggtgtagctcagcggatcccaccccaacagagcccaacaagctaagatccactgtcttgaaattctcactgccagcacagcagtctgaagtcaaactgggatgcttgagcttggtgtggggagggatgtctgccattactgaggtttgagtaggcagttttcccctcacaatgtaaacaaagctgtgggaattttgaactgggtggagcccaccacagctcagcaaagccgctgtagccagactgcctctctagattcctcctctctgggcaggcatctctgaaagaaaggcagcagccccagtcaggggcttatagataaaatacccatctccctgggacagagcacctgggggaaggggtggctgtgggcacagattcagcagactgaaacattccatctgccagctctgaagagagcagcagctctcccagcacagcgctcgagctctgctaagggtaagactgcctcctctagtgggtccctgacccccatgcctcctgactgggagacacttcccagcaggagttgacagacacctcatacagaagagctctgactggcatctggcaggtgcccctctgggatgaagcttccagaggaaggaacaggagcagtctttgctgttctgcagcctccgctggtgattcccaggcaaacagggtctggagtggacccccagcaaacaccagaagcactgcaggagaggggcctgaccattagaaggaaaactaacaaacagaaaggaatagcatcaacatcaacaaaaaggacatccacacaaaaaccccatccgaaggtcaccagcatcaaagaccaataaaggtatataaatccatgaagatgaggaaaaaaccagcacaaaaaggctgaaaattccagaactcagaatgcctctttccttcaaaggatcacaactcttcaccagcaagggaacaaaactggacggagaataagtttgacaaattgacagaagtaggcttcagaaggtggagagtaacaaactcctctgaggcaaggagcatgctctaacccaatgcaaggaagctaagaaccttgaaaaaaggttagaggaattgctaactagaataaccagtttagaggagaacataaatgacctgatggagctgaaaaacacagcatgaaaacttcctgaagcatacacaaggatcaatagctgaatcgatcaagcggaagaaaagatatcagagattgaagatcaacttaatgaaataaagcatgaagacaagattagagaaaaaagaatgaaaaggaatgaacaaagcctccaagaaatatgggactatgtgaaaagaccaaacctacgtttgactgatatatctgaaagtgatggggagaatgaaaccaagttggaaaacactcttcaggatactaaccaggagaacttccccaacctagcaagacaggccaacattcaaattcaggatatacagagaacaccacaaagatacttctcgagaaaagcaaccccaagacacataatcatcagattcatcgtggttgaaatgaaggaaaaaatgttaagggcagacagagagaaaggtcgggttacccgcaaagggaagcccatcagactaacagtggatctctctgcagaaaccctacaagccagaagagagtgggggccaatattcaacattattaaagaaaagaattttcaacccagaatttcatatccagccaaattaaacttcatcagtgaaggagaaataaaatcctttagagacaaaaaatgctgagagattttgtcaccaccaggcctgccttacaagagcttctgaaggaagcactaatatggaaaggaaaaactggtaccagccactgcaaaaacataccaaattgtaaagaccatcggcactatgaagaaactgcatcaactaatgggcaaaataaccagctagcatcataatgacaggatcaaattgacacataacaatattaaccttaagtgtaaatggtctaaataccccaattaaaagacacagactggcaaattggataaagagtcaagacccatcagtgtgctgtattcaggagacccatctcacgtgcagaggcacacatagtgtgctgtattcaggagacccatcgcacgtgcagaggcacacattcctcaaggatggaggaatatttaccaagcaaatggaaagcaaaaaaaagcagggtttgcaatcctagtctctgataaaaccgactttaaaccaacaaagataaaaaaagacaaataaaggtattacataatggtaaagcaatcaacgtgacaagaagagctaagtatcctaagtatatatgcacccaatacgggagcacccagattcataaaacaagttcttagagccctacaaagagacttagactcccacacaataatagtgggagactttaacaccccactgtcaatattagatcaacaagacagaaaattaacaaggatgttcaggacttgagctcagctctggaacaaacagacctaatagacatctacagaactctccacccgaaatcaacagaatgtacattcttctcagcatcacatcacacttattctaaaattgaccacataattggaagtaaaacactccttagcaaatgcaagagaacagaaatcttaacaaacagtctctcagactatagtgcaatcaaattagaactcaggtttaagagattcactcaactgcacaactacgaggaaactgaaaaacctgctcctgaatgactactgggtaaataaccaaagtaaggcagaaataaataaattctttgaaaccaatgagaacaaagacacaacatacaagaatccctgggacacagctaaagtggtgtgtacagggaaatttatagcactaaatgcccacaggagaaagtgggaaagatctaaaattgacaccctaacgtcacaattaaaagaactagagaagcaagagcaaacaaactcaaaagctagcagaagacaagaaataactaagatcagagcggaactgaaggagatagagatatgaaaaacccttccaaaaatcaatgaatccaggagttggttttttgaaaagattaacaaaatagatagacttctagccagactaataaagaagaaaagagagaagaatcaaatagacacaataaaaaatgataaagggatatcaccaccgatcccacagaaatacaaactaccatcagagaatactataaacccctctacacaaataaactagaaaatctcgaagaaatggataaattcctcaacacatacgccctcccaagactaaaccaggaagaagtcgaatccctgaatacaccaataacaagttctgaaattgagacagtaattaatagcctaccaaccaaaaaaagcccaggaccagacggattcacagctgaattctaccagaggtccaaagaggaggtggtaccattccttctgaaactattccaaacaatagaaaatgagggactcctccctaactcattttatgaggccaacatcatcctgataccaaaacctggcagagacacaacaaaaaagaaaatttggggccaatatccctgatgaatatcaatgcaaaaatcctcaataaaagactggcaaaccgaatccagcagcacatcaaaaagcttatccaccatgatcaagtcggcttcatacctgggatgcaaggctggttcaacatatgcaaatcaataaacgtaattcatcacctaaacagaaccaacgacaaaacccatgaatatctcaatagatgcagaaaaggccttcaacaaaattcaacaccgcttcatgctaataactctcaataaactaggtattgatggaacgtatctcaaaatagtaagagctatttatgacaaacccacagccaacatcacactgaatggacaaaaaccggaagcattccctttgaaaactggcacaagacaaggatgccctctctcaccactcctattcaacagagtattggaagttctggccagggcaatcaggcaagagaaagaaataaagcatattcaaataggaagagaggaagtcaaattgtctctgtttgcagatgacatgattgtatatttagaaaaccccattgtctcaggtcaaaatctccttaagctgataagcaacttcagcaaagtctcaggatacaaaatcaatgcgcaaaaatcacaagcattcctatatgccaataataggcaaacagagacccaaatcatgagtgaactcccattcacaatttctacaaagtgaataaaatacctaggaataaaacttacaagggatgtgaaggacctcttcaaggagagctacaaaccactgctcaaggaaataagagaggacacaaacaaatggaaaaacatttcgtgctcttggataggagaaatcaatatcatgaaaatggccattatgcccaaagtaatttatagattcaatgccatccccatcaagctaccactgactttcctcacagaattagaaaaaacgactttaaatttcatacagaaccaaaaaagagcttgcatagccaagacaattctaagcaaaaagaacaaagctggaagcaccacactacctgacttcaaactatactacaaggctgcagtaaccaaaacagcatggtactggtaccaaaacagatatatagaccaatggaacagaacagaggccttagaaataacaccacacatctacaaccatctgatcttgacaaacctgacaaaaacaagcaatggggaaaagattttatatttaataaatggtgttgggaaaactggctagccatatgcataaaactgaaactggaccccttccttacaccttatacaaaaattaattcaagatggattaaagacttaagtgttagacctaaaaccatagaaaccctagaagaaaacctaggcaataccattcaggacataggcatgggcaaggactttgtgactgaaacacccaaagcaatggcaacaaaagccaaaattgacaaatgggatctaatttgaactaaagagcttctgcacagcaaaagaaactattatcagagtgaacaggcaacccactgaatgggagaagatttttgcaacctatccatctgacaaagggccaacatccagaatctataaggaacttaaacaaatttacaagaaacaaacaaacaaccccatcaaaacgtgggtgaaggatatgaacagatatttctcaaaagaagacatttatgcggccaagaaacacattcaaaaaagctcatcatcagtggtcattagagaagtgcaaatcaaaaccacaatgagataccatctcacgccagttagaatggctatctttaaaaagttaggaaacaacagatgctggagaggacgtggagaaataggaaggcttttacactgttgatgggtatgtaaactagttcaaccattgtggaagacagtgtggcaattcctcaaggatgtagaaccagaaataccattggacccagcaatcccattactaggtatatacccaaaggattataaatcattctactataaagacacatgcacacatatgtttatgggagcactgttcacaatagcaaagactggtaattaacccaaatgcctatcaatgatagactggataaagaaaatgtggcacatatataccatggaacactatgcagccataaaaaaggatgagttcacgtcctttggagggacatggatgaagctggaaaccattattctcagcaaactattacagggatagaaaaccaaacactgcatgttgtcactcctaagtaggaattgaacaatgagaatacatgggcacagggaggggaacatcacacaccagggcctgtcagtgggtgggggcctaggggagggatagcattaggagaaatacctaatgtagatgacgggttgaagggtgcagcaaaccaccatggcacgtgtatacctatttaacaaacctgcactttctgcacatatatcccagaacttaaagtgtaatttttttaaaaaaagatagacacatagtttatgccagaaaaataaaaaagttaagatagcttatagaaggttgagtgtgtattacctagaacttctctgaaaacagtaagtgtttatcattggaattatagacaacagatattatatatggcttatgattattaatgagaaatacaatttgtatttcttacttgctacatctcattttgaactgtattccaaaattgatggaattaggacagcgctacaaatttatttcattatttaatgttataagcaattaaaattttattcatatgagataaccatgctctcaaaattataactaatttcatattcagttacctatatgaaatccttcttaatcattctttaaaactgggttgtacaagaggttctcttgggccagtgctggagtagacaacagaggggtgagaacctcctgttgaaaaggaagaaaaattatcatgcaacaatttggaaggtttggattttttttaaaaaggcaagtgcattaaaaaataatgagatagtgtagtaaattatgaaaggctgggaacgtggcttcagtaaaggcagaaagtcctttattattatttttaaacctatctttctcctaaccgtaaacataagccatatattcatgaatacaacccccaccagtgtgtgaggccagtctattaaaaataaaaaggcacataggagtctgtcacaccgcaagatgaaagctgtgttctttatgcatggatatcattttgttttagaagggttgtaaaaaataatacaattataaagaaagtcaatttatggaaagaaggtagactcttcccgcattatgtaaatactttctactagggtgctcgatataagaaatatactacacagcatttcactttcacagaaaatatgtgatgattattcacataataacaggaacttttagagcatgtgaatattcatttatgaattattgacagagaggttggaatgttaggagatagtgcctactggacattatttagtaatacagattttccatctctgaagctgtggaagtgcctactatacaggttaggtctttgatttacttaattcttacaataatcatataatgggaatattattttccccttataattcccatataatgggaatatcaattttctcccctattgggccactcacacaggatgtaagtttcaaatcaggcctaagtaataaaaaatggcaaattcttgatattttggaatgagagacaataggcataaccaagttgttatactgcctcttccatgtcacctcttctgtgcctcctgagcaaataccctccaacttggggagaagaggagagttggataggaatagaataaacttagacatggtttgtttttgtgctggtctaccactactgtctgccactacccgcccattcctccagggtaggagacatgatagaatttactgcaatgaaatttgggagatctgagatggccagtgaatctcaggccctgtatggacctatgactctaaaaaatgcttctaggagtcttagggaaacggagagaatgtttctgccatgttgtaaccttggagtctttttagttctgggatagtgtgtaggggcatcagaaattttgtcttaggtccagagtgtgggtagaagtcagtggagagagggtgtcagggagcttgatcacatggaggagagcaggggaagcaggcctcagtcaggaaacattgtaattttggaagtatacagaggtttagatggcggtgtgtgtgggtacagcactttatcatgtactttgacttttgtattccacttctgccatagccaggtgggagacaagctgttgctttggttagggttgccagataaaataatacagaatgcccagttaaatttgaatttcatatcaatgatgaataattttctagtagaattatgtctcaaatattgcatggggcacacttatgctaataaaaatatttattctttttgaaagtgaaatttaactgggaatgttttatttgctaaatctggcaacacaactctttggtgccctgagccagtgaaggaatcaaactatcctgtgctttatccatctttgaagtttgacaacaggtgggtgccccacaacaggtgttaatattacatttcatagaagaagtaattctcagttcaagaagtaattcttaattcttgatgggttagtctgtctttctgaggcagcccaattaggccaaatagaatggaaaatatttaatccctagaaaatttcgagagggtaacctatttagtagcttgttctagaacacacaaatagtaaatggcagcatcaggtttttgcaggtccaaatagcctccacaatacacattcaaaatttaaaaagctcctcaggaacatatttattgtgtaaagaaaggtgctcttaaaaactgactggtaggtagctgctgctattttctataatgtactcttgtgttatggtcaggcctacaaaagaaaccttacaagtctttcccaggaaacatccttttgaaattaattgaattattttaaagaaataatgagatattacttctttttaacttggcattttattcaaaggatgtttctgaaattaaaccagtgggagtttaaccaaaatagtacagtgacacaatgatgccatttagaagaatgttgtgctgagttaaatagctctaattatcagcaactttcaaattataaagcaattaaaaaaaccctcagttttcttcttcagtggaatccatagtgattgtatgaagcatttcatctggtttggatagctgggtttcagcatctattttgagatcccagagtcacaaaaagtatgctatccttaaacttagttttctcttgtgcccagaataatcctgtattctgaatcccattttcttctgtcccctgaggaccttcctttataggaagttgtattttgcctttactgtcaacttttcatttttttctactcatttttccttttcagcatattaacctgttaaagtttgatccaaacgacatgacgatgctggcaacaacagcagcagcaatggtaaccttctttcaaagcaataccccatccagcgacagtcctgtctttcttcttttcctcatgctaagtttctgaaagattttaggtgcgctgacctgcttactaactacatccatttttggacagaagcgagggagtcgaatgtttcctggagctagttttgttaactggtgttctatttccattaagtatcagatgccacaaaaattccagttaatcatgaaaataattaaaaagaaatgttaatatataccttaaaaaatacatgttaagcatataaaatcaaacttttttttttttttttgagacagagtctcgctctgtcacccagcctggagtgcagtggtgcgatctctgctcactgcaagctccgcctcccgggttcacgccattcccctgcctcagcctcccgagtagctgggactacaggtgcgtgccaccacgcccagctaattttttgtattttttagtagagacggggtttcaccatgttagccaggatggtctcgattccctgacctcatgatccacccgcctcggcctcccaagtgctgggattacaggggtgagccgccgtgtccggcctaaaatcaaactcttaacataaaagctatgctgtacaaatattccttttgcgagcttttttttttttttcccccacgttgagctaggtgaagcttctgaaacaggaaatcaaagaaatctggcctgaaaggcaacccccgccttttaaaaaaacaaaacaaaactacctttaaaaagcacaggcatttttattgcttcaaggatcttcaaaatgcagctaaaattcaagatttagggcaatctattattaacatttttgttcattcaatgaacatgaaatactcccaacagtttaaaattgttaattgtagaggaggggaggtttccatggtcttttctttttctatgattccttcctctcttatttcaatatgagccagcttatttgcctccttgtgaccagctcaacagccctgccagcagactcagtgaaggcatggttttattagcagttgttgggtggatgtaagtatcagtatagttattactgtggatgttttaattatgtgcttgctaatctgtccttagtacttgctgttccctcttcgtggaatgattttcccctagagctcacaggacaattccttcttatcattcagggttcagcttaagtatcacttccttacagtggatttctctgattaatctaatgtagactttcgcctcttcatagcagttatcactgtaggaaattatcttgcacatttgatctttaagttgtttattgcctggcttctccattgggacataagcacattgtctctcttgatattaagtggcactcaataaacacttgttggagaaatgaatgatatgaaaggttaagtatacaagtgagtcagaagtcaaacatttctaaggagaggtttgtatatactattttttattaacttgacttttcacttctcagtaatctatttctgcctttcacttgcacaaacactgttattatgatcacttatccaactgacatttttcagaccttttaacttcaactgttcttttttcctgtaaatcttaattttctttttttttctcccaatttttctcctacatgtctggactcttcccagttcctgtcagagtaaatgttgatattgcccagaacataacttgctcttccttttctctccttctcatttttctttctttcccctacaccctctgtatactctatagagtaaaatcatatacacccacggagtcaataactgcctttaatctaacaattggatgattcccatatctttatttctaccccatatatttctcttcaattcaagattttatccagttacttaatgaggtgttcaagctcaagatgtccaaaatttaaacgtattatatatcatatattgtaaatacatttttatatacatttaatatattatcttttctttcctccattcctatactttttttccacttatattccttgttggtgaatgcctgctaactggttatcttgcattcaaattcacccctttctaattcagcctaaatattattactggaaggattattttaaaatgaaaatctgaacatatcctcaagtaaaaatccttcaatggttctggttctctgttgcctttagaatgaaatctaaattgtataaagcaactgtgaccctttattttcccagagctttgttttcagccatatcagagtattttccgttctttgaatacatcacatttcttctgacttcatgcctttgcatatactgttacagctgcatgattattttcctcctggaattttctgatctggctcttacttgtacttcagttgcatatgtgatggctcctaatttggaggtagatactactttatggtgtttcgaaaggatttcctgtatacttttatcccatcacttgtcatactgtatgtgtttctccttctactgtaataagctccttgaagtcatagagaatgtttcctctctattccccaacaactaggacagtgccagggacaaagttgatttttaatgttttaataaatggttgccaaatgaactatggttgcacagttttgtgtatatctatattcttatttctatctatatctgtctgtaattttggtgaaagtcttcataatcttttgaggctgtttgattcactttgggatattatgctactattttattttgattcactattggtttttttgaggggatattttcaactgagtttttaaaatttttatttctgttttcctgtcatattagtttttttttctttttagaatacttgtaggttgcttaagcctcagcaattctgtgatggtttgggatggtttacaagatccctggttagaactcttctgttaaggttgtaaaagatagtttatttcctcagtagctttcttcaattaagaaaaattcttttgtcttactggattctgattttccctttcttatttcttcttatgttcactgtgtagtttccagagtgcttctccattcctttgttacccttctctctcccaaggcctttctaagaccacctcttagagccccacatactcattcctccttctagtaggctctgatctaccaggactctttttccattatttttgcaatgagagtagaatttctctttatagctgtgattttagatcaattttaaatttcattgctaggttctctcttctgttttcagtatggttctcccccatctcccaccatccctccactctggccccatcttgcccttgttccccaggtaggcttgcaccagaagggtgagaaattccatgctaagagttggtgttaattttttattcacgtgtaatttgaaatctaggttgttctctcttttctagttatgctgacagcataggttttctgtagttttatttattttttatttttatttttggagtatgtgctgggagattcagacttaagcagctgccatcaccttggctatccagaattcgatcataaatgtttaaagggattgaaaaacaatgttttcacttatctcttggtaaaataatttattttctttctttgaaacaaataacttgagatgtttcccaaaattgttgtgacatttctgtttggctacataaattgtctacagcatcaatttaagaaacaaagtgcttaacattaagagaaatagaagatgagatttcgcatcagtttcactcttggatgaattcagattagaacatgggcaatggaaagcaaattagggccttcaaaatttatgaccagtgggaaaatacatgagaataaaattacattaagattggtgctttgtgttaaagatacctgtgatgagttttcttttcaagaggaatgaaatgacctagatacaaaaagacaaatattacatgatctcacttaaatgtggaacccaaagcaactttatctagttacttaatgggcttttcaagctcaacatgtccaaaatttaaatgaatgaatgaatatatgtatatacacacacctaatgtgtgtatatatatatatatataaaatcatgtattataaatatacttaagtatatataaatttaatatatttttatttcctcattttctccatttctaccctttctttccactctatttcctgcctcagtgaatgcctgctaattggttttgttgcattcagtcctaggagcaatagtgagagctaagcagttttaaaacaatttggcacttcatttccatgatattgatttttttccagatacttatctaagcccctgagaaggtgggccaaggtgcttttcttggtctctttccacgcttaaatgtttggttactgtcaaaagagcaaagagcacctgcttctagtgaatacatg

SEQ ID NO: 2860 - DNA, 2466 bp, Homo sapiens
cctagaattgccttgatagagacggatcttttattctgtgttttaatcagctttcaatatattggctgtcttccacaggacactgccctagatcaagacaattcacagaactgagattctggatggcatgctaaggttatctggcccagtggtaagaagctacagtcagcttagcttgctgcattgatatagtcatgtaatgacgtactgggggcataaagaaaaatgcactaaatatgaacttaggggcctaattcccaacgtgtcattggagtcagggacaccatcacttgactggaagcaccatatgtgagccaaggctcatctgactgcagtggtctttctccatgtctagctaatacttgtgaagctgctttaggcatgcctcaaataactgaaaaaaatcacatacttctttccaaaaagggggagggggctcaccgtaaacagtactgtacacaaataatcggagttaatttatgcagacagcttctttaccctaaagctgcggtttgatttggacaagaagttcttcactaatattcacttcctctcacagggcctcatgcagggccttgggccaggcctcaagagaagtccctttctattaatagttcctgccctgccagccttacctatttgactgagtcactttgcttctctgggcttgcagcagcatccagggaggggtgtggtgagagtgcccctgttcccagcccaacagctcctcttttttctcttatgcattggatttttttttcaagaaacatgcttttactttaacaaaaactgaaatccactggtctacgtgatttctaagatttcctatgtgcttagtcacccacagatgaaggaagattggacagcaatgaagttatgaaaatgaaatcgaatgcttgtgactgcagttttcccaaggtttcatagaagtggtctggaggctcttcaaggagaactacaaaccactgctgaaggaaataagagaggacacaaacaaatggaaaaacattccatgctcatggataggaagaatcaatatcgtgaaaatggccttactgcccaaagtaatttatagattcaatgctatcctcatcaagctaccactgactttcttcacagaattggaaaaaaactactttcaacttcatatggaatcaaaacagagcccgcattagccaagacaatcctgggcaagaagaacaaagctggaggcatcacgctacctgacttgaaactttactacaaggctacagtaaccaaaacagcatgctactggtaccagaacagagatatagaccaatggaacagaacggaggcctcagaaatactaccacacatctaccacctctgatctttgacaaacctgacacacacaagcaatggggaaaacattccctgtttaataaattatgttgggaaaactggctagccatatgcagaaaactgaaactggaccccttccttacaccttatacaaaaattaacacaagatggatcaaagacttaaacgtaagacctaggaccataaaaatcctagaagaaaacctgggcaataccatttaggatgtaggcatgggcaaagacttcatgactaaaacatcaaaagcaatggcaacagaagccaaaattgacaaatgggatctaattaaaataaagagcttctgcacagcaaaagaaactatcatcagagtgaacaggcaacctacagaatgggacaaaatttttgcaatctacccatctgacaaagggctaatatccagaatctacaaagaacttaaacaaatttacaagaaaaaaacaaccccataaaaaaatggtcaaagggtatgaactgacacttctcaaaagaagacatttatgcagccaacagacatatgaaaaaatgctcatcatcactggtcattagagaaatgcaaatcaaaaccacaatgggacaccatctcacgccagttagaatagcgatcattaaaaagtcaggaaacaacagatgctggagaggatgtggagaaataggaacacttttacactgttggtgggagtgtaaattagttcaaccattgtggaagacagtgtggctattcttcaaggatctagaactagaaataccatttgacccagcaatcccattactgggcatatacccgaaggattataaatcattctgctataaagacacgtgcacacgtatgtttattgcggcactatacacaatagcaaagacttggaacaacccaaatgtccatcaatgatagtcttgattaagaaaacgtggctcatatacaccatggaatactatgcagccataaaaaaggatgagtttgtgtcctttgcagggacatggatgaagctggaaaccatcattctcagcaaaccatcacaagatcagaaaaccaaacaccgcatattctcactcataagtgggagctgaagaatgagaacacatggacacagggaggggaacatcac

SEQ ID NO: 2861 - DNA, 8409 bp, Homo sapiens
gctggagcgaaagaatgcgggggctgagcgcagaagcggctcgaggctggaagaggatcttgggcgccgccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaacttagcattaccttggtgctctgtgttctctgttagctcagtgtctttccttacatcaataggtttttttttttttttttggcctgaggaagtactgaccatgcccacagccaccggctgagcaaagaagctcatttcatgtgagttctaaggaatgagaaacaattttgatgaatttaagcagaaaatgaatttctgggaacttttttgggggcgggggggtggggaattcagccacactccagaaagccaggagtcgacagttttggaagcctctctcaggattgagattctaggatgagattggcttactgctatcttgtgtcatgtacccactttttggccagactacactgggaagaaggtagtcctctaaagcaaaatctgagtgccactaaatggggagatggggctgttaagctgtccaaatcaacaagggtcatataaatggccttaaactttggggttgctttctgcaaaaagttgctgtgactcatgccatagacaaggttgagtgcctggacccaaaggcaatactgtaatgtaaagacatttatagtactaggcaaacagcaccccaggtactccaggccctcctggctggagagggctgtggcaatagaaaattagtgccaactgcagtgagtcagcctaggttaaatagagagtgtaagagtgctggacaggaacctccaccctcatgtcacatttcttcaatgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatcctccaactgaccctgatcaacgaagagggattcatgtgtctgtctcagttggttccaaatgaaaccagggagcaggggagttaggaatcgaacaccagtcatgcctactggctctctgctcgagagccaataccctgtgccctccactcatctggatttacaggaactgtcatagtgttcagtattgggtggtgataagcccattggattgtccccttggggggatgagctaggggtgcaaggaacacctgatgagtagataagtggagctcatggtatttcctgaaagatgctaatctatttgccaaacttggtcttgaatgtactgggggcttcaaggtatgggtatatttttcttgtgtccttgcagttagcccccatgtcttatgtgtgtcctgaaaaaataagagcctgcccaagactttgggcctcttgacagaattaaccacttttatacatctgagttctcttggtaagttctttagcagtgttcaaagtctactagctcgcattagtttctgttgctgccaacagatctgaactaatgctaacagatccccctgagggattcttgatgggctgagcagctggctggagctagtactgactgacattcattgtgatgagggcagctttctggtacaggattctaagctctatgttttatatacattttcatctgtacttgcacctcactttacacaagaggaaactatgcaaagttagctggatcgctcaaggtcacttaggtaagttggcaagtccatgcttcccactcagctcctcaggtcagcaagtctacttctctgcctattttgtatactctctttaatatgtgcctagctttggaaagtctagaatgggtccctggtgcctttttactttgaagaaatcagtttctgcctctttttggaaaagaaaacaaagtgcaattgttttttactggaaagttacccaatagcatgaggtgaacaggacgtagttaggccttcctgtaaacagaaaatcatatcaaaacactatcttcccatctgtttctcaatgcctgctacttcttgtagatatttcatttcaggagagcagcagttaaacccgtggattttgtagttaggaacctgggttcaaaccctcttccactaattggctatgtctctggacaagtttttttttttttttttttttaaaccctttctgaactttcactttctatgtctacctcaaagaattgttgtgaggcttgagataatgcatttgtaaagggtctgccagataggaagatgctagttatggatttacaaggttgttaaggctgtaagagtctaaaacctacagtgaatcacaatgcatttacccccactgacttggacataagtgaaaactagccagaagtctctttttcaaattacttacaggttattcaatataaaatttttgtaatggataatcttatttatctaaactaaagcttcctgtttatacacactcctgttattctgggataagataaatgaccacagtaccttaatttctaggtgggtgcctgtgatggttcattgtaggtaaggacattttctctttttcagcagctgtgtaggtccagagcctctgggagaggaggggggtagcatgcacccagcaggggactgaactgggaaactcaaggttctttttactgtggggtagtgagctgcctttctgtgatcggtttccctagggatgttgctgttcccctccttgctattcgcagctacatacaacgtggccaaccccagtaggctgatcctatatatgatcagtgctggtgctgactctcaatagccccacccaagctggctataggtttacagatacattaattaggcaacctaaaatattgatgctggtgttggtgtgacataatgctatggccagaactgaaacttagagttataattcatgtattagggttctccagagggacagaattagtaggatatatgtatatatgaaagggaggttattagggagaactggctcccacagttagaaggcgaagtcgcacaataggccgtctgcaagctgggttagagagaagccagtagtggctcagcctgagttcaaaaacctcaaaactggggaagctgacagtgcagccagccttcagtctgtggccaaaggcccaagagcccctggcaaccaacccactggtgcaagtcctagattccaaaggctgaagaacctggagtctgatgtccaagagcaggaagagtggaagaaagccagaagactcagcaaacaaggtagacagtgtctaccaccatagtggccataccaaagaggctaccgattccttcctgctacctggatccctgaagttgccctggtctctgcaccttctaaacctagttcttaagagctttccattacatgagctgtctcaaagccctccaataaattctcagtgtaagcttctgttgcttgtggacagaaaattctgacagacctaccctataagtgttactgtcaggataacatgagaacgcacaacagtaagtggtcactaagtgttagctacggttattttgcccaaggtagcatggctagttgatgccggttgatggggcttaaacccagctccctcatcttccaggcctctgtactccctattccactaaactacctctcaggtttatttttttaaattcttactctgcaagtacataggaccacatttacctgggaaaacaagaataaaggctgctctgcattttttagaaacttttttgaaagggagatgggaatgcctgcacccccaagtccagaccaacacaatggttaattgagatgaataataaaggaaagactgttctgggcttcccagaatagcttggtccttaaattgtggcacaaacaacctcctgtcagagccagcctcctgccaggaagaggggtaggagactagaggccgtgtgtgcagccttgccctgaaggctagggtgacaatttggaggctgtccaaacaccctggcctctagagctggcctgtctatttgaaatgccggctctgatgctaatcggcgaccctcaggcaagttacttaaccttacatgcctcagttttctcatctggaaaatgagaaccctaggtttagggttgttagaaaagttaaatgagttaagacaagtgcctgggacacagtagcctcttgtgtgtgtttatcattatgtcctcagcaggtcgtagaagcagcttctcaggtgtgaggctggcgcgattatctggagtgggttgggttttctaggatggaccccctgctgcattttcctcattcatccaccagggcttaatggggaatcaaggaatccatgtgtaactgtataataactgtagccacactccaatgaccacctactagttgtccctggcactgcttatacatatgtccatcaaatcaatcctatgaagtagatactgtcttcattttatagatcagagacaattggggttcagagagctgatgtgattttcccagggtcacagagagtcccagattcaggcacaactcttgtattccaagacacaaccactacatgtccaaaggctgcccagagccaccgggcacggcaaattgtgacatatccctaaagaggctgagcacctggtcaggatctgatggctgacagtgtgtccagatgcagagctggagtgggggaggggaaggggggctccttgggacagagaaggctttctgtgctttctctgaagggagcagtctgaggaccaagggaacccggcaaacagcacctcaggtactccaggccctcctggctggagagggctgtggcaatggaaaattagtgccaactgcaatgagtcagcctcggttaaatagagagtgaagaatgctggacaggaacctccaccctcatgtcacatttcttcagtgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatctttcaactgaccctgatcaacgaagagggacttgtgtctctcagttggttccaaatgaaaccagggagcaggggcgttaggaagctccaacaggatggtacttaatggggcatttgagtggagaggtaggtgacatagtgctttggagcccagggagggaaaggttctgctgaagttgaattcaagactgttctttcatcacaaacttgagtttcctggacatttgtttgcagaaacaaccgtagggttttgccttaacctcgtgggtttattattacctcatagggactttgcctcctgacagcagtttatgggtgttcattgtggcacttgagttttcttgcatacttgttagagaaaccaagtttgtcatcaacttcttatttaaccccctggctataacttcatggattatgttataattaagccatccagagtaaaatctgtttagattatcttggagtaagggggaaaaaatctgtaattttttctcctcaactagatatatacataaaaaatgattgtattgcttcatttaaaaaatataacgcaaaatctcttttccttctaagggcctttaatatgtaataacaagagctaatgttgaacacaagccattgccagtagtggatgaaaaatcagacactgattttctcagacttctttgctgtgggcgcggccagtgaggcaatgagacacattcctgaaggcgctaaaagacgaaaagttacaaggactgaagaccaagcaacctggaaagaagtcggcctctctctcctgaggagctgcctaccagagcttgggcagccacctccttaggtgttagtgcttagataatgtgtcccatttgttgtcatttcaaagatggttattttctgttctgtatttaccgctgttcttgttgctaccagcatgtacttcacatacagtgcccactttgtgtggtaaatctcatggtctctctcctctctatgtgctgctgagggagctctctcatggtgtctagaagctgctgtccagccagcattcaaggtctcccgagaccagggagggaacccccaacactaccacagtcatgcaaaccagaacaacagattatcaggaaggaatcgggagaaaccaagggcaatgtatatattggttctactgctgtgtctctgctcagaaaggttctttgaggactggaatagtggaggtttggtgtgtggtttgttttttttcccaaacatatttactccttggaagtggttggtgttttcattttttttaaaatgttttttggaccacaaactctctgataatcttatcaaagccctggaccttcctagaaattcatatattcaagaaatatttattgagtgcttattttgtgcctaggcacttggg

SEQ ID NO: 2862 - DNA, 1987 bp, Homo sapiens
catatatacacaccataacacacgtatatacatatatacatatacacatatacataccatacacacacgagcatatacacacacatgccatacacacacatatgtacacatacatacccacaccatacacacatacatacacaccacacacacacatatacaccccgtacacatatatacacacaccatatatacacacacatatacgcacacacaccccatacacatgcatacctcatatatacatatacacacctacatatacataccatacacacacatatatacacacatatacccacaccatacacacacatatatacacacaccatatatatacacatccacaccatatatacacacaccatgcacccacatatatacacacaccatatatatgcacatatatatatacacccacaccatatacacacacatacacatatataaacaccatatatatacagacacatatacacacccacagatagacacacatatacacaaacatacacacaattatatcacaaggtctgattgtattactgagacacagtgaaaggatgttccataacaggaaggttatgcctgattcagtgacactactttttcaatattaggccttatatcagtttatttttgctgttttaacaaattactgtagattattggcgtcatacaacacaaatgtattatcttactgtcatagaggtcagaagtctgaagtgggtctcaccgggctaaaaccaggttgttggaggctgtaggagatattctgtgtccttgcttttgctggcttctagacgccgcccacactccttagttcgtgaccccttcttccatcagcaaagcctgaaaagacaagtcctttttccgtcacaccactctgaccctcctcctctaagtttaaggactctggtcattacattgcgcttgcttctataactcaagagaatcttccgtatgttagaggcagccgattagccattttaagtccatctgcagccttaattttcctttgccatacaaggtaacatatttgaaagtactggaattaccatagagacacatttgagaggtgggcaaagtggcaagatcccacctctacaaaaatacaaaagttagccaggcgtggtaatgtgcaactgtggtcccagctactagggacgctgaggtgggaggatcacttgaacccaggagatcgaagctgcagtaagctgggttcacaccactgtactccagtggcgacagagtgagaccctgtcgcaaaatatatgtgcacacatacacacatttgagaggcaggcctatccattcagagtttccttaatgactacagtgtgcctgctcccccataactatgtttgtgtttggcattttcttttaatttgggactatctcagtaaatttcttatattataatgggattaatgcaggcctgctggccaaaaaaaaaaaaaaaaaacaaattagtccctgaggagctcttagagaaaactctctaaattacccgtaattgtgcgatccacaggtcattactgtttctggtcctcgtttttgtaattaatgtttctagtcctcctctttgcccttaagcaggtatgtgttttctttctggagctggaattttgctaattaatcatgtgactactccagagactctttaaatctagttttaaatctaatctgtagcagcaaattatcaagaaagcctttaaaattaaagattctaaggtggaatgattgcttgaggccaggagtttgagaccaacctgagcaacatagtgagacctcatctctccaaaaatttaaaaaattagccaggcatggtggtgtgtgcctatggtcctagctacttaggaagctgaagtgggaggatcccttcagcccaagaggttaaggctgcaatgagccgtgatcccaccactgccctccagcctgggtgaaagagtgagaccatctcaaaaaaaaactagaaggccgggtg

SEQ ID NO: 2863 - DNA, 6095 bp, Homo sapiens
gtgctgtcaacctaaaggttaacaggttgaagggaccctgggctaaggaagcacaagctggagacaccaaaatggtcttcgcaactcgcctctatattttctgccctgctcctaagccagcctgttggccgactggcccttctccacagatgtcatcttgagcctcttacagagtttcagcactgacattaatgacaagatggatcacctacaggacaaccttggatcctcaaccagcctgattaagcattgacactgcatttgtcaccaccagctctgatggtttggacatgtagaaatgtattgcaggagaatatgcaaacagctgctgtaaggtgagctgatcgggacaactgccagcaggcagaagggaaggcataattaatgggcacccttcagcagagctcagagcagaccaaacgccaatgcagaaggctcaagaaagaggcaaacagactagccactgctccaggatgactgtggctctttatgagtgaagagaaagggtggagactgaagacagaactggggacagtgacaggcttggggaagaacagctgattcagcagtcccaagcatctgaacacaaggtggacattctccagggtgacatcgcaaaatacatgggtgaagacaacctagtggccgtgacttggagcacccttcctcacaatgaaggcattctgggccagcctgaaaaacagcatggaaataaatcacctaagtacaagggacctcggtgacaacgctgtgaacatctatggattccgcattcaagtactttgtcacaactgtctccacaagttggtacatcttctgtacaaggcaaagaaaactctaaaaacatacaaaaagtcaatgttaataatgagacattattattaaacatcaacaaagtgccatgttcttcaggctccctaaggaatgctagcactttcagactataaatttttgtatccacataatcattgggaaaaattaactttaatgaaaataatccctaatatttgtgaagtttatggtttttaaaaagaaatttgacacaagttactatcctcaagaaacacatttttatgggctatctacttcagaaatagttatctaaagaaatgagtaaagactacataaaccattcatgaattttcctaatgtaaaaatttgttttaaaaaacttgctctgaactaccccacaaagacaaaaagaaaggtttagtctttaaaacaccacctggctgacacttataatctcagcactttgggaggccgagacaggaggattacttgaggccaggagttcgaggccagcctgggaaacatagggagagcccatctctacaaaaaatttttttaaatgagccaggcatggtgacaggtgcctgtattcccagctactgagacggctgaggcaggaggatcacttgagcccaggagtctgaggctgcagtgagctaggatcacaccactgcactccagcctgggcgacaggataaaaccacctctcttaaaaaactgtaacaactacaaaattataaaattcacctgtaacataaacatattgtgacaagtattagaagtagtcttatacatatgatgctgttatttgtggagagtcaaaaaagcttactcaaagtgccatcctactatgcctttatctcaaagcagcctaaaataaactcacctataacctattacataataatgacaatagcacagcctcccctattgtcaaaccccaccagactggtacatttgttataactgatgtacttacattgacacatcataatcacccaaaggtcatagtttatataaaggttcactcatggtgttgtatattttataggtttggacaaatgtataatgacatatatccaccattatagtatcacacggaggagtttccctgccctgaaaatcttctatgtctctcctattcatctctctctctctccccaacccctggatgccattgatcaccacagtttggacctttccagaatgtcatatagttgggggcttaaattttgtagctttttcagactggcttctttcatttagtaatatgcacttaagtttcctggaggacgtcttttgaatgtcttttcatggcttgacagatcatttcctatataaatataaaaaaaaacaagtcttacttgatttctgacatggacagaaccttttcccagatcgaggacattctccacaagcaccaacatggcaaacttgctcacatgtgtgattaccacatggcagtgtttttccacatacctaaaataaaatgcaataaacactaatgaaggatttaaaagttaacaaaaaaagacttcatacaagacacaatccatttttcaatcacaaataaacaactgctttacgtccctcatattattttactttatattttatacaggtgtcatacatatgtatatatagatacatatatacatatgtatacacacacatatatttcctatgcaccaaaaagtatattttaaaagtacaatacagaaaaaaactacatgcagctccatatggccattcaccaaggagttctaagtggcattaaaaccatgccaattctaggacaagcaacctataaaatcaatcttacttcctcaattggattaattcaagaagcagggaggcgtgctggttgaagagaggggaaagagaagaaggggacaagagctagcaagaaagagtacaaatgtagtgaatccaaaactcaacaaatagctgttactttgaaaaaaatttttcctctaataattaaaaatgatattaaatttaaaagtagtttcttaaaacatgatataattcatctgagttgctattcttccttgccttttatccaactaaacctgattagccttgctgctttctaggttgtctatgctttctgtactctttaatacccacccctcaaaatgcatataaacttacttgatcacagtgccatagtggacttgcacaacttctttcagctacttttttgccacagacacacttttgtctactaactcttggacaaggctgacagcttcctaaaaccagaatgataaattagcacagaaacataaaagcaataaagattgctttgacttttgcttaaagtcagaaaaatctaatgggtatggccttttacctgcatgacaaggattttcacacttatgttgcccacaaagcaacttctgtccacatggcagctgacaagaccattccttggcactgcacctacgagggataggttttgctttcttacagtaacaagtagttgtgaccatctttggacaaggagggcagggacctagaattcagtaaaagcaaaaaaaaaaaaaaaaaaaaaatctaaagtcagaaactaaaactttcaatttctacacctatcaataatttctagaactttctttactgacactttacaaaaggcaataactttcaatattttctcatggcaaactaaactgtgaattcaacttttacaatttttttttttgcctcaatataagaagaaataatcacccacaaacaatttaaaatgcaatatataactcacctggatgacagaggagtaaacatttatggccacaaggaggtttaaattcacgctcacatacttggccacatgaatgaggcacaagccacggatctaaaggtggatcttctacttttccacaatagcaatagtacctactaggtgtttcagatcgtttgtattcaaacctacattttggactacaaagaagaagaaaattattaaagctaacttcacctttaaaagcaacatgagagacagaaatatacttaacagagtatattctgttaaattagttttatgttaaggaactctgctccatctttgtgttagtgaaaaaacaagatcttattaaaatctatttcaaccatataaaacagcactgcacaatacaatgtgctgagatgatggaacagttttatactgggattgtccaatacagtagcaattagccacatactgtgagcacttgaaacgtggctagtgcttacaactgaggaaggaatcaaatttcttataatttctaaatactgaaacagctacatgtggctagttaccatgaattaaacagcacatatctagaatacagctacaaaaagaaagtaacattagttttctactaaccacctgaactttattgaggaattcactctgcttttcacaaagctcaactttttaagttttgttttgtggtttacaaataaacaaaatatattagcaacaacaaacagaagagagaagtcagggtatagacatgcaataccgcaagaaacatgactacaatttagaattaagggggaataaacttgaaaataaagaatttcataattctcaacatctagcacaaaaagacatataattcttttttttttcttttttgagaaaaagtctcactctgtcacccaggctggagtatagtggcgcaatctcggctcactgcaacctctgcctcctaggtacaagaaattctcgtgcctcagtgtcccaagtagctgcgaatacaggtgcacgccaccacgtccagctaattttttgtatttttagtagatccggggttttgccatgttggccaggctggtcttaactcctgacctcaagtgattcaccagccttggcctcccaaagtgctgggattacaggcgtgagccactgtgcccagcccaaaaaaagatataattcgaatgtgcctaagtcaaagaaaagttcaaataccatgaaagactttaaacttccatcattaaaatacataagtgttggcagtagaagtgttaaccttcagctctatcaaaaatatacttgtagatcatcatagatcagttcattctcaaaagatgctctaaccttaactcccaaatgagtatagttagtatattatgctagaacaagtttcatattaacatttaaatttcttttgtatcatatacaaaatattttcattgtcacgagaacatgttctgtttccaaataaatgccacataaatactcaaaataaccaaaagatatttgttcttgtaatgaaaaatcaaaaacaaaatactaagttcatctgtctgtggaataagtaactggcgctttgttggaagagttcaatttttttttattaaaagaaaaagctagtgtggagggggatatgtatttttaataagcgtgggtatggatgactaataggcaactcaacataccttaacactgcccatcagcattgaaactgaactggcccagtgagggtaatatgtgcaaacgcatgagttttattttaaataatgggatgccaacaatgaaatgtaattatgctagatcttcttcattaaaaagcagtatcttagtagaaacctatattttaaattttttatttccataaaataacttaaaattattaacattttaccaagttctagctccatcttgatgaggattaaacaaaatgggttcttaaccagaatggtcatttattttcttaaaaaaatatgaaatatggaatgcaaagtatatggcacagctgattaaactgttgttccttttaaattagaagttaacagtacattttttttaactgatcctttcctcctctgtggcaaaacgactacttaaaacagaagtgagaagagcgagggtaaaaaaatatatacataaggtttaaatctctaaactaaaacctggcttaattccgtacctattagacactaaaattcctccaccaccagtaaataatatgcaggagcaaaacaaatatactttgaaatgttaaacagtttccaaaaagtgtgtattcaatgaaaagaaaaataatatttctaaaagccaggtcataagagataactcaggtggaagaatagaaaaagcactgaatttaaaagtaagaaatcctaggtttcaaattttggctccactacttaagagtgaggagtcagaagtcatttcccttcaattaacttcaatatccccactggtaacaggagaataaaatctctcacagattgctgagaattatttttacatactcttctaaaagtaactagcacatctaaatgtttttaaaaactacaccactggccag

SEQ ID NO: 2864 - DNA, 2819 bp, Homo sapiens
gttgtattctcacagagggtgaggacttttctggtatgaggaagagtcatggttcgggtcggaaaatggcacgaggaaagagtttatgaaatgacttcagaacaaaagtgaagtggtggcaaagtgctggaccagatgttagaagtctccaatttgctctcgacaacaacaatccacaagtaaccctgagaaaagtcatctctgtttccccactggtaaataatggtaagaaaaatagtgcctagtggggcttacgtagaggactgggaagctgaactgtgaaaaatgattccaaggtttctggtcaccatggctactactcttttgtacccagttctttgctcctcaaggagccttgttttctatacttgtgaatatttcaaccaactaataaagatttaatggcaatgtgtaaagttactttttctccctggacatccatttcttcattttgtgaaatcagaacatcagactcagtttgacatgaacagacttttctcaaaagaagacaaacaagtagccaacaaacatgaaaaagtgctcaacatcactaattgtcagagaaatacaaattaaaaccacaacgagataccctgttataccagtaagaagggctattattaagtcaaaaaacaacagatgttggcaaagatgcagagaaaagcaaatgcttatacactgctggtaggaatgtaaattaatacaacctctatgaaaaccagcatggagatttctcaaaaaaacaaaaatagaactactatggaacccagcaatcccactgcagagtatctatctaaaggaaaagaaatctttatgtaaaaaagtcacctgaatgcatgtgtttatcacagcactattcacaatagcatagtcatggaatcaacctaagtattcctcaacagatactttgataaagaaaatgtgatatctacacaccaggggatactacacagccatagaaaatgaaatcaatttgttatttttaagggttttctttttaaggctgtgaagttctttcttcaaatgaacactttcatttgtccttctttgtgtctctacaacttgtcgacattctccaccgatgttaccactcacctctcacttgcattatggaagaagcctctcaatggacacacactacaatataaatgaatctccaaagtatgctaagagaaagaagccagacccaaaagtctacatactatgtgaatccattcatatgatagtctggaaaagacaaaattacaagaagagaaaatagatcagtggttttctgaggttgggtatggagggaaacagttggctacaaaagaccacaagggaaatttttgttgtgatggaagtatcctgtatcttaattgagatggtggttacatgacggtatatacgtgtcccaattaataaaactgtacaactggaattggaaaactctactgcatataaattatatatgaatatgcatgactttaaaaaggtcgttctttaaaggtcaggtctttcaatagatgattagagggtacaaatatatagttagaagaaataaggtctagtgtttgatagatcagcaaggtgagtatagttaacaatataatacatatcaaagtagctagaagggaattattcaaacattcctagcataaaaaaacaggtaaatatttaaggtgatggatatgtcagttaccctgatttgatctttacacattatatgaatgtataaaattatcacatgtactccaaacacatttatatcttttatttatcagtaaaaaaatatatagaaaccaaattgatagaaaacacatacttcccttttctctagagggagacagtatctctatattccaagaatatgcgcgatataaacatcctttgaaagataggagaaagggtagtcttgttagctttacttgcaagatttgtggagatgcaagagacttgggaagatcctttccccaatacaactctccaaacctctagtcttttttcttctttttataagtttccacacacagcattgacaaacctctagtcttaatggttcctaatttgttaagttggcctttgtgtttatgaaagttaagaaagttaattttatctcaatatttctggcaaattgtctgctgcctgtgtgcagaaatgtctttttttccccccgaatgtcctttttcttttgttctgcctagaaaccatggaagtaattatttagacttttttttggctttagggtggaaagaataatttcagtcgagcagtatctgaaaatatccccaaatatgtaaaaatcactgactgcacgtgaaaactgatgtgtggagactatgttgaacctaaatatatagttacctagaaaagaatgggctaaataagaagtgtcttgcacagtactttcatttttacatagaaaatatttgtaaatatgtttattagtgcatacatacattcttaagaatgataaattatctaaagtttggtaatactatcattttgctactttctataatagatgaataaatctataatctacattaacatagttatatagatctaatgccaacattatattactactgatttcctagaaatggagaaaaacaggtacaagatgtgtgttttttttgttgttgttgttctgaatttgttgctaatggctcacacctgaaaacaacaggaattacatcatccttcacattctgattagccttctttgcagtcagacccagttactgatttgaccacagaacctgtgaaaggaaaggctgagccagctcttcttcctccacccaacatgccagcttccttcctccttcctacttgcagac

SEQ ID NO: 2865 - DNA, 7672 bp, Homo sapiens
ggcaaacgtttatctttgctcaggcctgggtgcacgctaacctcggccaaatctctgaatgttcaaacatctgccaaaataccacatttcgacaatgggccttctctatagagatgaggttacgggggcagtactgggatgctggaaaaccacttaaactaaactgcgggaaggggcagggtccaggatcctgactttgagtgtaaggggtggggaaggagcagggggcagctccttgccatacagagaggcctgaggaccagctccctgcttccagagccggagcggggagggggctgctgccaacctatcttggcattctccctttcgtccttggggtagatttcgttgtaattagacaagttgtgacaaatagcccattggtctttgggctggagaattgtgccgagtcctgcctggaaacccagccttgttcacttgggagccataattaggcaagagaacagttcatgagccctttgattcaataaagacccttttatgatgttggtttttcccagaaaaatcataccactttgctccatgtattgcatttagatgtgtaatcatattagagctaagcagcccaggggactgaagttgtgtagctggggtttaaagcctgttacccggtcttcagagaaaaacagtgtcctcagaaaaaaagaaaatgacaaggaacacttctaaagattttctctcttgtcatctaaagaacattttctcccttcagagtgagaagtgacccagggggaaaaaccagaaagtgaaactaacttgacaggccagggcagcccctggtgcctgccctctgcagtcctgtgtcggcccaggccacgcgtgcccagcatggtcgatatttgtcagacggatagcacgtgtccagccaagggccagagaaaatgcccccatcctttccacaaagagttgtggtcagcccactggggtctggggtggcagggctgcagcaggtggcaggggcagtcagccctgactacatatagccctggagcttgcgggcagctttcagctcgttgggaaggtgtgctgggcctgcgacattgaccggacagttcttccaggcatgagagggatgccctgcccaggtcgctgtcacaggcacaccccctcccaccagccaccctcttgccttcttaccccaagaccatgttgtcaggcaggccaaaagcatttcccaatcatggagtcagatgtgtcccagaaatctgccctgtgcccaggagaggtcgaaatcgccagtggaatcaagaacctctttcccaatttggggtttagaaatctctggcaatgaggaaatttctggtagtcatttgtaagagttactctaagatagagggtatgacatttcagaatgctaaaattttgttgcattagaaagggggaaaatccgtttacttcccaaacatctggtgggagttatcaccaaaatatattttcagatatcctctaatgcagaaaaactgtattttataggacgtggtttatctgtttgtagataatgtgattaaaatacttttttggaagaagtgctatttcttctggatactttacactttttggaagaagggctattaagttatatatatgtatacattgcttccccccccgccaaggagtataattagagcatctgaaaccagattatccaattagtacatttttctaattagctgttaggatttcgtgatgagataaattattttagatttccaagtggaactttggccacagggaggctctaaggaagtacacaggggagaaaaataatgggtttttaaagttttgactccacccactcacctgctcccccaaaaacctaatgtgcctgcccatgaggcagcaacagtgaccagaaaacagtttcttttccttgttctgagtaaatggagttggaagaattattcatttatattggcttttctttgttcctggtaatgaagcaggcagacaggggttggctttaaatgctattttttctacattttcatcagtcatattagtagctgttctttggcagaaaaaaaaatctggtgatcaggattaattcagaacctatttactgtgagccttgtatgtgctttctctgtgccaggtggcaatgaagaccgtctgtcagggggatcggggggatgtcctgtcaagacccaggggatgaagtcaggactgcattttgtaactgtggttgatgcaggcccaccatcctttgtccaaaattctggatacgcaagaaaactggatactgaacgttgtttttgccgctaattgaatgggaagacctgacccaaactgacagactattggagtccatatttatcctggggagtgtgaatactcatgggtttccctgcagagatattaatgtttgattatgggtgctgccttgctggggtgttacataatatgtggcataggcaccacattccctttctaaaacttgaaaagttctggaacacatggcctgaaggtttggagtaagagaccctgccctggagtagcgtccacttaagactacagcagccgtgtgctcagagtccctgctctgccagggcccgtttccagccataggaggagcctgaaggcagattgagagtccagctgaccagtgggtgagatgcccaaacagctgtaccgccaccagggcaggtgacttggctgccccatgaccctcagaggccttccctcaccaggtgccaagcaaagattgttcagaagcagattctgttctgctgtcattgtgaatacatcaatgaatgagtacatctatgttctaataaaactttatgagggccaggtgcggtggctcacacctgtaattccagcactttgggaggccgagatgggcagatcactgaaggtccagagtttgagaccagcctggccaacatggtgaaaccctgtctttattaaaaatacaaaaagtagctggacatgatggcgggtgcctgtaatctcagctatttgggaggctgaggcaggagaatcacttgaacccaggaggtggaggttgcagtgagctgagtttgtgccgccgcactccagcctgggtgacagagtgagactctgtctcaaaaaaaaaaaaaaaacccaaaaaacaaaactttatgaaaacagatggtgggctgggatggccctttggccagagtttgctgatgccttgtcaaaacgataaatgcatccttaaacatactgttttcttccacagactttagccctgccatctgcctgcctggtctgcttgtcttgttccccacccctggccaagtggagttgccttaaagagataaaagttgtgcctctagtgtcagtacccaccccttgcttggctcctccagatggtctggaaacatagatggaaagcaggcgctgccctcaccgacctggcctcggtagcaggagtgtgtttttgtgtggacaactgcagttgggcccaggtccagccttgctgacggctactcacttgggcctccacccactgatgaattttgggggcagagccaagccccaagatatgttggctggcagcctggggccaggcagggctgctgttgtgggagcccagtcccaggtgggtttgtgaggtgtacggggagtgaggggttgagaatgagtgttttcagagctgatgtgttcttagcaaaagaatttctggcagattgattatcgtaaacccagcggctctgatggatgagtttcaggtctcctggctttgtccagcaagggcctgcgaggccaagacctcttttcactgcatcagaagtttaaatccagttgagccctctgacttgcacctctgtagtggtctggcctggggaagactggctggggtggacagaaggagggcgggaccctcagagcaatcacccctgacctccaaccctggccaagaagggccagcccctgcctcagcaccttctctctgtaggcggtttctctcccaagacatttgagacttttgccctctgcctggtcaccttctttcctagccaggatagggctggtggatggttttttccttaaagccaattccaaacaagggctgatatttagttggcctttctttttcttctctcatggttttgtgggttgctggcactttagggactctgttcagagtggagcctccttactctacagctcgctggtaagccctggtggcccatcagcccacagaagggggcatgatgcacctcagtcgtcagcgtgtgcccagcccagggccatgcagagtgagcactcagggaaggcgcatggaactggactgggtggctggtgtgtttggtgataggttaaaagtgtcacatacccagcacggtgtgaggagctcctccagccactctcaggggcctgaccctgcctccttgattttggaggagcctattaacaatgcagattccagggccgtttgtgtgattgtgaggcaggtggccccaggattgtgctctggttgggtggaccaataggtaaagcacagtgtgatgagctttgggatgggggagaaggaaggggctgtaacccagggagagtctggggtcaaggaaggtcacccagaagaggtgagctgagtcttgaagaacaaagcaggaatggtaataatagctaatcttgattgaacgctttgtgccaggcacagttctaagccttttccatgaatttcagtcctccagacaacccctgaaataggtagtaaccccagactcacacaggaacagacaaaagcactcggggttaagttgctggcccgaggctagtgagtggtgagctaggtcttgcctgcttattgcacggcaccacgtggggtaaggtgtgccaggcagcgggagcagctcagcacagtgatgcaggtgtgctgttcagtggttcagatgatgcagaacctagtgtggggggactgcttcagttctgctttacaggtgccagaatgtcagtttgagagggctgaggctggagctgggcacacttcctcacagtctgaactggaaggagcgtggagtgttggggagaagatgcagtgtcagtgcccagggtgcagcgaggcacgggctggcaccctgacccagcccccttcccagaggggaagaattccccctgcccttggggtctgaggggatccacttttgttaggagcctgctacacactttgctttctttcgatccttacattgcccttccaggtgggcttattattcctattacagataagagagctgaggctgggaagccgagtaatttacaggacagattccagctgtgccggggccttgggcaaagtggcctggagacacgtttcctgttgctgggtgacattccacaggtgggaggccaggacctcattccctaggggccttcctggtctgggccctgatgccctgagttgaccctctactgccctggaggctcacctgggcctcgggacagaagggattgtcccattaaggagaatcctctacgagtctctgattctggaagctcttgttttttatcctcccatacaaaaaacaaattggccaccagtccttctttttggccactgtctcaccatctccttcacccaaccttggtttctttcagcctgtgcttcccagcagagcctgtgggcttgttgatttgaacccagaaaccacctaggacattccagaggtctgtctttgttgcccattgtagtagaagggtattgggaggacctgcctgaagctgttgctcttttgctaagggcagggtgggatatggccgagaattggtgggcgggcctgagatccattcagcagcaccccagggcgtgctgtttctcacaggttgcagcctcttccagcccctttgctttctgtgacagagctgaaagtctcatttcctctttggctttctcctgtctgtgtgccgttctttaagatgggctggagagagtcggggcagctcttctcccgggttttcaggcctggctggtgtttttgcctgaatcaggcctggcctcaggcctggttacaagaaggttggaggctggctgtcttgtgttcatgtgtcacgccaggcctgagaccatcattgtctctctgagatggtccacgcccctcctgtgaacacaggggctacagactatagtatagttcttgccacgttcccgagttttgggggctgctctccacattgggattccaccaggatgctggtctgcagtttcctgcaggcagaaggcgctgggttctgagttggctttaggtggaacccaggtcattcctgggtatgccttgggagggcggcgaggctggccgcagctgggcccggcatcggagaaaattgtgtctctctggagaccctgcagccttcccacccaccagggagctttccatgggctgtggggaaggcgtcagtgtcgggtgagggaacaccagcttcacctcggctcatctgggcgtggcagacgactgcttcctcacctggagagtgttcaaggacagcaagaaaaatgagggactttcaggggcagctgtgttttctgactcagtcataatgcccctaaaaatccttattgttcttgcagtgtgcatcgggcagcggccagcaacctgcctctcacccacctggcccttctgggaggaccgggacttcctggggtcagattggaatgtacgtccaaaataagagtgaatggggatttgctgattattaaaacaattttgtttgcgtgcatttttagcatcttctcttctgggagggtcgggatggagcccaggagggtggcagtgaaggggaaggtcatcttccgggtcagtgatgttagaggcaaggacaaggagtagaggaggctgtctgagacccagtagccattttgagagggtctttccccctctactgtgaccctggagcttgcttttcctccatccttatttcacttcatggatctcctccattctcagcccctacccctgccctatccagccccaccctgcagatattttgaccagccaaggcttttggaggtcctgggggattgtcgagaagcagaaatacctttttttaaatttaaatcaatttgtgatatgcctgccttccccaacaatgccagtccaccaaacccgaagcaacagaatcctgctctccaggggagactgggggcttgcagttggacaaagtgacaagcaggactcgccccagtgggtccactctatgtcttactgccctcatgggtcagcaggggaagtttacccttgggtctctaggtgcagctcaaaagctctcgtcacttgaccacgtgtgctcagcatttgcagaagtccaactgccacgatcttccctgcagcccagccctggctctgtggacagttttgaaggagctgggtttgctcaggagccttggcttttttctgcacagggcaaggacagctccaaggtaaagtttaaacatgatggcatttatcctttcttggtaagggataggtggggctcccatgaaatgctattctcgcaacctccaacggacaggggtgttgcaaaggttccttcatccccgatcagcttccctgccatttgctcccctcaaccatcccctcccatggggcccctttctcctgcccttcattcccctgaacctccttgttcttacatgtgttcctcattcttttttttttccttcttgacatagaatcttaactctgcc

SEQ ID NO: 2866 - DNA, 2444 bp, Homo sapiens
cctccgcctcctgggttcaagtgattctcctgcctcagcctcccaagtagctgggattacaggggcccaccaccacatctggctaatttttgtatttgtagtagagacaggatttcaccatgttggccacgctggtctcaaactcctgacctcaagtgatctccctgcctcagcctcccaaagtgctggtattacaggagtgagccatcgcgcttgacccacttaagctttttaaccaatctggtccaccgattgacttgtgcacgtccttaccagtcctgagtaggacatcaaactgcaaccttggtgtcttgggcaagaagcaccaactgaatgatctagcctaaccagtcatacccaaaagtaatctgtgtgggagaagagagcagctgcttttaagccaataaaattcaaggcaggtaagacgactgggtagttatgacactgctgtctccttctcctggtaaaaatgcttacccgctgtggctgctccctcagtgcttctacctggtgcctgacctttcagtcttcctaataaatctgcctgagcttcggtgcctcctcaggtgtcacgaggggagtttgtctggagaccctttgggagctgatgtcaaatgctcaacaaatgttctgttaagttagtgctgcagtagtctggaaaaggagaagattaaaggaataaaatatgcccccaacagttttggagaacactagccagtggggactctgctctgtcatctaaggtgaccatatggttggctgataaatgataacaattttctgtaacacgtgggcttttcatcttcccaacagtctggaggaaaaatattagatatgatgacaggagcagtttttaccatgtcgttaagggccccaaatgtagtttttagattccatagacactaaatccagcaatgccacaagaatgcctgtgcaaacaggatctgtgttgatgcaggctttaaaattttttttttatttctgatatatacaaagaaaactcacttcatctagcttaaacaaataaggttattttgttaggaggatacaaagtatctagcagaatccaagagagcaggtgttgctgggtctctcaagggacctgccaccaggttcccacagggcatcggccaccaaggaagaagctccctctcccatctttcgcttcctgcatttatttgctttattcttccctccatacagcctgcctttctctgcctctcctgggcttcacatgctcagttccagacctgagcaatgattgacttgctcttggtccctgttataaattccaagggaaaataatagaactggcctggggaggtatgtagggtggcctagagcatcatggcttcagagagggacgtaattctgggtgggagttaataatctcagaggagattgtggatgatacagacaccaatagcctctgggacctctctgatctatgacagaggtcgatttctgtcagggcacaattgctttgcattacaggctaggaatctgcaagtcagtgtttctgcttttttggaggtttacttcatatcttcactgggtactattgaagaggtgaacactgggtataaatactgttcttattactgtgttacagcacgcacctgagaagttctaagaggcgattctatccaggtttaaataaggagctttgcagaggtagtatatctcatgatcatgtatttgagatatctggcagaaaaaatgggtgtgttcttgactgtccctagtccttgagtttggaggcacttctcttctatccttccaaggctctctgctattcacccatgccctcttgtcaactttagtgtccacaagtacctgatagggacctcaccctgcctaaagcaggatttttggattcttgccttggtttctgcccagtgctgttccccatacttgagattcttttaacttccttccgtgtctctaactcatacatatcatttaaggtcaagttctgtaccttttgtcatggttcactgggcttccttactttagaactcattcagtagtgattcactgaacagttacttatacagcagagtgctggctggttatgttagttcgctagggctgttataacaaaataccacagactgggtggcttagaaaacaaaaattgaggccaggtgtggtggctcacacctgtaatcccagcattttgggaggccacggcagaaggatcacttgaggtcaggagtttgagaccagcctggctaacacgttgaaactctgtctctaacaaaaatataaaaaattagctgggtgtggtggtgtgcacctgtagtcccagctactctggaggctgaggcaggagaatcgcttgaacctgggaggcggaggttgcagtgagccgagattgtgccactgcactccagcctgggcaacagagtgagattccgtctcaaacgcctccacaccaaaac

SEQ ID NO: 2867 - DNA, 9870 bp, Homo sapiens
acaaaatggagtctcttatgtctacttctttctacacagacatggtaacaatctgatctctcttttccccacggcataaggacttaatttctctatacattggtaatctctccttttttttgccatttttctctgtctggatcatctctaaacatcatttcttctcctccttatgccacttggggtatcatcaaaaactggcatagctagatattataatatctggataaattcaatatttttaacatagaggtgattatgatttcgtcttttatgtttttagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggaggtctgtgatcaattaccagggcactttgtaaaatagttcagcaagaatttctgccctgtcattgaacctttcatcgaacctaggcattatgattattacatttacatatattattttgcctttgtagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgtatatttgatttttgtttttaaacgaaatgtgttcagatggtattttgagcactcattcagttaaatgatggtacatttgaagcaggatatttccctgaccccttcacaggactcgagacaggggtgccttgtttactcagcctgccattctcaactcctcctgggagggagtgcacaggcaaacaaggcaggaactggagtgtacaagcactggaactggctggccgctttggcatgggcaggaacaaactgtgcaggccctgtggtagcatccaggtggggttgcctgcgattcctgaagccccagaagatgtgttaacagtgctcttttagctctgctgtctgtggacggcttaagtgttaacagctcagtgggccctttgccttgtcatgtgggacagctgccctccaccagcaagggcaaatggcgaatgtgagagccttttatatcggcactcatggctcccaggctcttgtccggtgtccaggaaaaatgtggtcacaaaaacaaactgaaggatggtaaatgagggggattttattgctgatgaaagtggctctcagtgagaaagggagctgaaaaggggacagtggggtaggtgatcttcccctgaagtctggccctgtccagctggattcttctctgaagttacactgtcaagctgtccctctgaagtcaagctgcttctctccaatgtccagccatagtctccactcctctctgactgagtcttgggtctttataggcacaggattgcaggcagggcgggccatgggcagtttaggaaaaggcaacattcaagtaggaaaacagggatataaattctcactttgggccggggtttcaggcatttcagcttgagggtagggttttcactggggactcacccttttctacctagaatttctctgcctcctgtctccatcatatttaactgacttttcctttcaaatctcctttaaaaatgagcaaaggtacatgacactttgtagtaaaatctgtaccagtgttggaaactaggatttccacctgtcagaagcttataagaatttagttaatctcttttgtaatgaagattgagttgaaagatgacatgaacaacccacaatattcttcatgcaatggaaaagtatgcttaagcaataagggcatgtggaagagtccctctttcatattcagcacaattcttgtaacagcagctctcctcatggtgttagtgccctagacctcaatagctccaaatggcaagcggtgagaacattagtatgcaggagatcttcaggaaaagtcaagtctagatgatctcccacaagtctaaacaattcaccagatgccaagttccagtgatgaggtgtacccatggaactcagagcatgtgcttggtacagatggcatgccaagaaaagtggaggtacttgcatagctgaatcccaatggcattgttatgccagttacagaagagggtgggcataggatttccaaactggccataatgtgccaaaactaacccaaaataaggcttagagtactgacattatctctgtgacagctaaattttactttcattatttctctctctctcaacaggattctggatctttggttaagcaaaatgaaactaaactgatctaaacatttctttcttcaactctgcaaagaagatctgagcaaaaccccacatatcttctgcagaacctatttaaatactagacaaatatcttctcattacataattacatacagaaaataatcacacatgaaaaattcgatatttaattaagaaaataccaggaattgtttttcaaagtttaatttgtaatctcaatgagatttgaggaaatgttgcatatttttttatttctaccatgtgagttataacagtgaatggaaagtcactgcgtgtccctgactagggaaaatattcaggaggaaaagctgcaatggatggggcatggaggtatatttttgatcttgggaaggaagttctaggtaggtggtcagtgaggaagggggagaaggagggaggaagaaggaggggagggaggggaggaagacaagattaagggatgtcagtacctctcctatgtacctcttgggggagggttgaggagtgaggggagtgtaagtgaaagtagagacaaggctgggagaggaaaaaacaaaaagcaccagccacaggcaattaaattgccagaaagtcagtgtctgggctcccggcatcaagttagctagctactctatggataagtactgaagctttaattgcatttgggctcaaaaacaacaactgtaactttagggtaactagaaaagcctctgtagagaatcgctgccatcagttaagaatggaatgatttaaaatgtctctgggcacaatgaagtgctcctagagcttaaagtgccagaaaagtgtacagggtttccctccatgtcctgcctctctcctttactgtctctagcccagcatacaccgcctgagtttctagggccatgttcctgcacctggtactgtctccttcaagctgtgtgttcctccttgtgccttaatttcccttagttgtcaatagtatcgttgtcaattgattatgttatctacctcataaggtcagtatgaagattcagtgttctaatgcaggttcagagacctgagcaggttcctgcaatagaaccagtgtaaaaaatgaaaagggctatgtgttggtaaagatcaatggttttcagaacacagagaagtgtctcaaagccagtgaagaatatttggcctaaagtaaatttctgtattgtgatttgaatagcaagcaaaatccatttaaaccctagcaagaatactatctcctcaaaaaaaaaaaaaaaaaaagtccatgcaagatgccaagctagggaatgatgctcatctcacagaagtgtagattaagggaaattaaggcacagggaggaacagagtctctggcttctgtgttagagccttttttaatcttagctttatagtgtcaaaatgtggcaagctattttaagagaggaacaatagctgggcgcagtaactcatgcctgtaatcccagcactttgggaggccaagacaggtggatcacctgaggtcaggagttcaagaccagcctggccaaaatggtgaaaccctgtttctattaaaaatacaaaaattagctgggcatggtggcaggcatctgtaatcccagctactgggaaggatgaggcaggagaattgattgaacctgggaggcggaggttgcaatgagccgagattgcaccattgcactccagcctgggtgacaagagtgaaactgcttctcaagaaaaagaaaagagagagagagaggaacaataatctgggcccctgaaaccagatgaaacaactgacaatacagagtctgaactcatgatttacaaactgagagggccatggaatgataaggaacaagtacaactggtcacagagctctgcacttaacaaccctccacacacatacacacaccaagcattcaagttaaacgttaacctactgttaatgtttatatggtagaaaacatcagatttatgccaaaatgcagattataaatctacccacattgaattctgaatagatttggaaaattgatctgcttgcctactaagtacaatttgtttctgcctgtggattctgggggttttccatcattaacacattgaggttattctgtctggcagtgatagggaacaaacattggcctatttatttcagcaaaggagttagttgctaggaaacatttcaactttagtcaggtattgccaatagactgcaaccacctgaaaatatcttagagaaattctcggttatattgactttacagagttaattagatcttagtctaccacccggtccactcgggcttctataccaaaacaccttagacagggacagtgtaattataaaggactaaaatttgttaattatagttcacgaagctgagaagtccaagatcaagtcaccaacagattctggtgtctagtgagggctgctctctgtttctaagatggcaccctgttgctgcattctcacatggcggaaggcagaaggtcaacagggacccaaccgagcccttttaaaaggtcaccaatccaattcatgagaatggtgccttcatgacttaatcacatcctaaaggccccatatctgaatactgtcaaaatgggtcttagtttccaacaaatgaatttgggggcacacatacctttaaaccatggctcctactaagcacatttctgttaaatcatactgcctgaattctttccccgttattgcaagtcacaagcagaagataatttactcgcaaaattattttttttgcaaatctatttcagtttttatgaataaagacagattcactcaaataattcacataaatgtatttgtaaacgttatacctgaggaggaaatgaatataaaaaaaaaaagttgattgatttaagggcactgaaactgctcatcaattatttaacaagtacatacggagcttctacactgggccagtagttacgctaggtacgatggtctcaataagcaacaaaaattattttctacaagatgcttaaggtcaattatacatatggaatgtttgattataggatccagagtactatggagaggggtagtagggacactgaactcagttttaatggtcaggaaattaggggaagtaacttttaaactaagaaagtttgctggacaaaaggcaagtgagattatttcaggcaaaggaaagaacataaacagaagtcacctcaggggtctgaaatgtggctaggccactggttttgtgttccttcgtgagtgaaagacatgcagggggtaggacatctaaagagtggttagatcatacagtgccttagccacattaagaagttcaggttggggccagacatggtggttgacaccagtaatcccaccactttgagaggctgaggtgggaggaggtaggaaagatcaagtgtcctttcctacacatagttctctctcagtctctaggaatcaggtggtggacttctctaaagctgcacttttttttttttttttcccaagcagcatggcttgcctgattgttctctaggaactagtctagccttttcagatgagaaagttactttgtctacacagaagttttctcatggtgatttggtatctccctcatcaccaaaacctggatacatggtagatggcctaaaattgttgaattatctatctttcaaatttacagtgtgaatcgatttacgtttcaggtcctgaaagctatcaaaataaccaaagtccatttatctgaggagatggtattaataattagttgtgtaagtaaaaaagtcaataaaagatgaagcatatctgtaaaaaagatgaatatatttaaaataaattaagggtgaattttattattttgttattattatcatatcatttatttatttatcaatcttttaagtaggggcaagggccaagtgtgggtctactattctgcactgtctttcttctataaaaatacacagtttatttttgtttcaatagagccagaattctaagacactttcaaaggtatcttagtgtagaccagtcaatttttaccatgatttttcagtcattcatatttggctcaccctttactaactcagtagcaatcaactttactgagtagacttaataagcattttaaaggaattcagattaacttacatagaaacaatcttttatattaatatttaatcaaagcaagtaaaaatatttactttctgtaactacaataatcttttgtataaactgatttacaaataaatacaaatcacttttagttggtgtagaacttttgagagagtagacgtaccctagaactagagagtcaatagggaccctcttaatgtaatagtcaagtgtattcagcataatttgagctaataattaggttttacagagagaataggaaatgtcaacccaaggagttgggtaaattaagatcagttaagagagtatctatattgactttctttaataattattttctgacaaggaaaacaatagtcaccatcaatccagtaggtaaaataatatgacacttttttatacgattcatggctccctcaagaacttatctgctgcaaaaagtaaaggagaaagcaggaaagaagaaaggaagggattaaatgaaaaggaaagaagaaagaaaaggggtttttgtttgtttgtttcattagaagtcaactaaaaaatatagaagaaatgacgaaggtaggaaatgaccatttgacagtcatcatcacaataattttattccagcaaggaaacatcggtggctgctaaaattactgatgaacatttaaggaaaagcaatatgcagtacttacattgtctcaaagtagcttcttataagatacttattaatttcaaaaaataaaatagtgagtaactttacatttactgcatgatacaattcagctgagctgcctgccatgatatgaaaaagatctccattcctccagtttccaataacaagtttttttccactcatctgaaccttcacctgaagtgcatttaattctgtatttctaccatcggtctcttcatgttgatgtaaatcttctctaagatgatcaacattttcttagagaaaatacataccatgctcctcacttccttttgtatacttatcagtcattaacatccatatctcttcagtcttgtcttagttggcacaggctgttacaacaaaatatcataagctgtcttaaacaggagacgtttaattctcatagttctggagcctgggaagttcaaaatcaaagtaccagcagatctggtttctggtgagggacctccttctgtcttggagagagccaccttcttattgtgttctcacatggcagagagtccaagccctggtctctcttcctcctcttataaggacactcatcccattatgagacccccacctttataaacctaattgacttccagaggccttgactccaaataccaccacattaggggtgagagtttcaacatatgaatttggcaggagaggtacacaaacatttagttcataacattccacccctggccccccatcattcatgtctttcttgcatgtaaaatgtattaattctatcccaatagtagcaaaatccataactcattctctcatcaactctggacttctaagtctcatttaagaaacatctaaatcagatatgaatgagactcaaggtacaattcatcctgaggcaaaatttctttccagctgtgagcctgtgaaaccagataagttacgtacttccaaatttcaatagtgggacaggcatagaatagactttcccattacaaaatggagaagttgggaggaagagaggagtaacatgtccaaatcaagttcaaaacctagcaaacaaatgccattagatcttgaggctcaagaataattctttttagtttgatgctctgtctttgagacccatgtcctgcaaggcttttttgggtgggggttgtgccctcaaagctctgcaatgtgagagtcacatccacccccaaggctcagctgagtgaattctcattctccaggctccaggctgccactgtctagcctgttgaaaccaaggcaatggctctctcccccattgaaaaccaaggagacagacctgatgacctctgaattgccctcaggattactgcttttcttatcttcaagagtagtacacatctgcagctaaatagcttgatgttctggtactgtgggctgtaagaagtcctgtagcttctttctattgaaactgtttccattgtctttagctctgtcaatctgaaataatcaaaagaatcagaattcagtcttgaagaatttattctagcaaaaagtttggaatgatcattagagaaacattggctccagaaaatgaagtaagttccagtggagtcacagattagaaaatgagtcaatgaatatacttgatgcaaatctcat

SEQ ID NO: 2868 - DNA, 1189 bp, Homo sapiens
agcatggccaggggcggggcttccctgaggcgcgccgagaggcggtggcccacttccggcaataatcgcctggtcgccgtcaggtgccggcccaggtggcaggcgcgcccgttgggcactgggggacgcgggcgcgtcaggtgaagactgggggctgcaggcgcgctagtatcttaaatagcgaagatggagaaatactcaataatgaagagcatgaatatgcatccaaaaaaagaaaaaggaccattttagaaatgacacaaatactcaaagtttttatcatgaaaaatggatctatgtccataaagaaagcacaaaagaaaggcatggctattgcaccttgggagaaacctttaatcggttagacttctcaagtgcaattcaagatacccgaaggttcaattatgtggtcaaactgcaggacaaattcgagcatcttaaaatgattcaacaggaggagataaggaagctcgaggaagagaaaaaacaactggaaggagaaatcatagatttttataaaatgaaagctgcctctgaagcactgcagactcagctgagcactgatacaaagaaagacaaacatctaacaatttggacaagacagcaaatgctattgtcgaagttttctaaagaagaatctgaagtgaaatgacatcaagagacctatcaagacctgtatccaggaaaagaccaaaccaatgcagaccaaaccaatgcagaactcctatgtgctgatggtggtcttacatttccctaagtttctgccgactaaactgtgcacacgttctcgggacctcctgaagctgcgtcacaggcactaatcaaagaacacaaccaagagtttggccttttcttcagcactgggaattgtgatccaaagcttttcctgatgaggcacaaagttggagaaacaaaacgcaaactaaacaacaatgaaacagaacagagtgaatctgctgtagctcaagagaggacgtagctgcccccactccgcatccccaggctcgggtttgccttgctgacctctgctgccacctggtgccgcacagagaaactgaggagaaaccacatcagtctccttcagcctcagcttcacatctgtgggtcaagcaaccctttcagaagctgtataatgtgggaaagctttcctctcaggaaaatgcacacatccaactttgagaagatgccc

SEQ ID NO: 2869 - DNA, 579 bp, Homo sapiens
cagttaccatggagaccggtagtaacaccagttgtaaacccaaggccaagagaccatggccacgttagcccggctgcaagctaggtcgtcgactgtaggaaatcagtactactttaggaacagattttattgcatcatatagtaatcttatcatggtgccttccgttcattatcagtgttgtagatccatttagaaaaaaggagaatgatgcagcagttaaaatccaaagctggtttcgaggatgtcaagttcgggcatatatcaggcatttaaacaggattgtaacaattattcaaaaatggtggagaagtttcttaggcagaaagcaatatcaactaactgtgcagacagagtctcgctctgtcgtcccagggtgcaagggtgcgagctcagctcactgcaacctctgcctcccgggttcaagcgattctcctgcctcagcctcccgagtagctgggactacaggcacgtgccaccacgcccggctaatttttgtatttttagtagagatggggttttgccgtgttagccagatggtctcaatctcctgaccttgtgatatgcccgccttggcctcc

SEQ ID NO: 2870 - DNA, 4943 bp, Homo sapiens
ccgggattggtgggaggatcgtgggggagcggcagctcaggacggaatacggcaatgaccgccccggtcgcgagggtgaccctgccccgggctgctgtgggggcgcaagaaccctttcactttacggcgagattaagctcagggtcaagttctgagcaaaaagtgtcaaggagcctttttgcaacctcctataatattgaaacagattctgtgccctttaaaggagataataactaacatctggggagcgctttacaatttagaaaaggcctttcacacacaggcctgtttcatcttcacaacaatcttataaaacagatatattgttcccatttcccaaataatgaaacggaagcgccgaaaatatctcctatagggctcttcaaactgtggtcaacttagtaaatgatgttgacagtggaagtgtgatcattttattttcctgcctttggaattgaagattgtaattttgcaaaaattttgttgaagatgatgtagctttggttcagagagctggagtacaatggcaccatctcagctcgccgcaacctccacctcctgggttcaagcgattctcctgcctcagcctcccgagtagctgggattacaggttccaagtctcttcttcggcctctcaaacatggtaccatccctaatgaagtcaacgggtccagcatgacaggatggaagtacaagtgtcagcacctatgtgagtcccaagaggggaaattagaaacaaaaaggaagaagaggacataggccaggcacggcggctcacgcctgtaatcccaacactttgggaggccaaggtgggcagatcacctgaggtcaggagttcaagaccagcctggtcaacatggcaaaagcccatctctactaaaaaatacaaaaaattagccaggcgtggtggtgggagcctgtaatcccacctactcgggaggctgaggcaggagaattgcttcaatctgggaggcagaggttgcagtgagctgagatcgtgccattgcactccagcctgggcgacagagtaagactctgtctcagaaaaaaaaaaaaaaaaaggaaaaaaaaagatgatatagtcaaagaaataacattaaatttcttataatttaagatgaatgatttcagattgaaaagtttataaaggtgccaaagagaaaaggaaagatccacactagatacattagaatgaaatgtcaaagtaacatacataaagaagaaattctgaaatcttctagaaagaaagaacatgttatctatgaaggaacaaggatcatattgatattagatttctcaacagcacatgtgctgcaagaagacaaaggagtaatattaagtattgtgaaacaaacctagagcttagaatttcatatttaaaattctaaataaattatcattcaaattgttatagtttgggggccaggtgtggtggctcatgcctataatcccagcactttgggagactaaggcgggcagatcacttgagctcaggagtttgagacgagcctggcaaacacggcaaaaccccatctcaaaatacaaaaattagctagatgtggtggtgcatgcccataatcctagctacttgggaggctgaggcacgagaattgcttgaacttgggaggcggaggttgcagtgagccaagatcgtgccattgcactccagcctgggcgacagagtgagactcggtctcatatatatatgagactgacaaattgatacagtttggatatatgtccctgccccagtctcatgttgaactgtaatctgcaatgttggaggtggggcctggtgggaggtggttggatcatgggggcagatttccatgaatggtttaacaccatcttcctggtttgtcctcatgacagtgagtgagttcttgagagaactcatcatttaaaaatgtgtggcacttcctctctttctctcttgctcctgctctgggtatgtgacgtgcctgctccccctttgcctactgccataattcagagtttcctgaggcctcccaagaagataagccgatgccagcaccatgcttcctgtaagctggcagaaccatgagtaaattaaacctcttttttaaataagttacccaatctcaggtattttttatagcaatgtgagaatgtgctagcacacaaatatgttaccacttaaattatcattcaaatataaaagcatagtaaagctgacattaagcctcaagcatacaagttcacagaaaatttgtcacacaaggacccacattataagagaagcagaaattcatactgctttaagagatatcagaggctgggtgtggtggcccatgcctataatgccagcactttgggaagccaaggcaggaggatcgtttgagcccaggagttcaagaccagcctgggcaacatagtgagcccttgtctctataaaaaataaaaaaattagccatggccctggtgtggtggctcacgcctgtaatcctagcactttgagaggccgaggggggtggatcacttgaggataggagttcaaaatcagcctggccaacatggtgaaaccccatctgtactaaaaatacaaaaaattagccaggtgtgccgatgcacgtctgtaatcccagctacttgtgaggctgagggaggagaatcgcttgaacccaggaggcagaggttgcagtgagctgagatcacaccactgcactccaatctgtgtgacagagtgagactctgtttcaaaaaaagaaacaaccacatgtggtggcatgcgcctatggtcacagatacttgggaggcttaggttggaggatggcttggacctgggaagttgaggctgcagcaagctatgattgtgccactgcactccaacctaggcaacagagtgagaccctgtctcaaaagaaaaaagagagagggagcaatatcagaaggtatcaaacatgtaagtaaaatccaaataaaagaaccaaagaaaagagaaatagaaactatttcaattacaactcagaactaaattcctagaaaatattaatatgacatgaaagcatgctaatatatttattttgcacgagtaataatatggatttgacaactttaaaatagggagaaaataaataagcttatggtgttatcaatcaggagacagaaattataccaataatttatcaggaattttttttttttttttttttgagacagagtctcactcttgttgcccaggctggagtgcaatggtgcgatctcagatcactacaacctctgcagctctggttcaaagtcattctcctgcctcagcctcccaagtagctgggattacaggtgcctgccaccaccacatgtggctaatattttgtatttttagtagagacagggtttcaccacattggccaggctggtctcaaactcccgacctcaggtgatccacccgccttggcctcccaaagtgctgggcttacaggcatgagccactgcacccagcaggaaaaatttaatataaaggttactaactaataaaacatggttaactattaagacagataaaggataactctaaagaataccagaacctgggcacaagggctcatgcctgtaattccagcactttaggaggccaaggtaggaggatcacttgagcccaggtgttcaagaacagcttaggcaacatagtgagaccccatctctacaaaaaattaaaaaacagccaggcatagtggtacatacctgtagtctcagctcctcaggaggctgaggttagaggatagtttgaacctaggaggttgaggctgcagtgaatcatgattgtatcactgcactccagcttgggtaacagagtgagaccgtttctaaaaattaaaaaaaaaaaaaaaaggcagctggatgcagtggctagcacctgtaatcccagctacttgggaggctgaggcaggaggatcacttgaggtcaggagttggagaccatcctgggcaacttagcaagatccctatctcttaaaaaaaaaaaaaaaaggaagaagaagaaaaagcaaatgtaaacagcatgactacctctaaggctgagggagaacatccaagggagtaacagacttggaagagatctcaaccctgaggctaaaattcagacccccttggagaggacggggctgtagctagatggcagagaaattatatgtgtaaatgacagaggaattcactggagtgctgcagatagaggtggtggtgcagctgcaggtggggatggtgagctggaagccatctactggggtgaggtggaagcttattggagagtgagtgccaatggaactccataggtgacaccataagaacaaaatctacaacaaggagatctaggaagggcagctactgcctctctgctatgcctgcagtgtctctctagtgccctctgctgataagcctaacattgcaccagctggcaaatgagaaatgttcatgggatccagatccagatcagttaactccaaacaagaaaaagaaagattgctttggactaaggagcaataaattgataactggcacagtgttaccctcccttttttgtttttgtttttccattcacggctatactgtcaatatccattcatgctctatatgtatgattattggacattctatttttatacactccctggttttcttttcctttcattgttttggggctattttatagctctgaaagttgtagaaaactaataacaatgtaaaagatttttagttcatagaaatgaaaattatttgtgtctggtggaatatagtagattaaccaccctgtggttagaccattttccatcttttaaataaatgcattctagcattccttgttgcctatttatgtgtgtttttttgaattatcctttgatctagttgtaacatcttactggttccctcattaattaatgaggtaaataaaacctatcacacatattcattttgtatttgtatgtgag

SEQ ID NO: 2871 - DNA, 4730 bp, Homo sapiens
attttttctgaaagttttatccttaatccttgaaagcataatccagtttagagttcccagtttcctgagcattggttactatggtctactccccacatcccgaaatgatgttgcactatcttctttctccttttacatgtttggccaatttaatcttaatattttgaatttgatgcttttctcttttctacctattcttcctaggttatgattttattcatattcacaaataaaaatattgcatctgtaataataatttgagacgaagccattactctaatcctgattttttgcctgcgccacagacacaaattccagatgacctgtaggacaaagcccatgtagattttcaatgagcttttcatctcaacatgttcaaaactgtactctttatctacttattgccactatctactcccacacctattttcttcctatgatgcctgctttatcaatgtcacaaaatactctattgtaaatagtcctggaaactccaagacatcattaatgtgaatgtaggaaagagatgataatttaagttagaaaaggttggtcagagaagctgccatatggtagaatataggcgaagtaaaacaggtgtagaacaaacatgagccaatttaaaatatttcttctccagggaacttaatgtttccttgagaatttatgcctgtggacagttctattactactactcaagctaccaactattatggcagatgatgaagatcatacacactttgtgaggtgctgctctgagtgatgtatatgcacttattcaattaattcttacatgaggaaactgagactcaaagacatagaataatttgcagaagtttacaagttgagacttaggactaaataacttcatatggaaagttttgtttttaagaaaaggaagaagcagatcgcaattctacaggtacattgttatttaacttcaagaagaaaagctatctagaaacagccttaaattataacaaattgttctcatctcactttgcctcctggtctcattagaactagtattggaaatcttgtcctgtggttctatggccagcttcccttaccctactgagaaggtaagtacttaccagacactacaactgacaccagctctcagatttcccctgctgccctgctatattcaacaaaaaatataatagaataaaagctaagcaaccaaccctaactcttacaccgagttaacctgtctctgtgtaacctgtttgagtatttacatatacaggtttatttacatttacatatacaggtatatgaaaataggattttaattcaaattcctaaaattaaaaaagattgatagagcatgagcaaattatgagtttgaaaaatccccaatcattttcagcaacaattttcatgtttacatatgcccctgtattctctactttatgaattataaactccttttgcatactttctctctgcaggaaaatggatgcaagttttaaatatagatttatgacttttatggaaaataataattaggtagttctgtagccttgggcaaatactgtaatttccctgcacttcatttccttatctttaaaataaaggtatcagaagagattatcttaaaatgtccctccaagttctaccattctgtgatacactataaaataaactaactaactgccatttagggatgtctccaataacgtgacatatatgagttccatttacagatgactatgccctttattgaccttgacatagcctctccagagttacacattatagtaagagatgtatatgcatttagctccatttaacattatggcatcagggaaatgaagaattggagctggaatccaattcttgatattttataatcactgcttctaaaaatctatacctagcaataaaaatgtaataaatacctttttttttgtgccacccggttaaaagttagttccaaggatgttacaatgaagctgtctgtacaaataaatctgaaaatgaaactaaaaagatcataaagaaagtgtctgtttgtatttccaagggtgaatcggcctggaagctgttcattctctcccaagcctgaaacagcggataaacgaccccacctcatgctgggaagagagagcttgggatccctggcacgtgagaaccagagcctggtgtagatcagagctctccatccagagtgtcatgacttagctgcatgctttcaccagcagggaggagggaactgatactggaggtaacaaaggcccagttttgttttgttttgctataatctcacctgataggaaagaacacctgtagatatgcaaagctgattatctcttcataaaagatggactagcctctacaaggacagtaatgttgtgcttgacagagtgacacaggccagtgatggagcagcagagtcctccaagggaccatgagaaaaacattacctggccacatgattgcgtgacaaggcaagggtccaactggaatgggggtgcatgagaactgcttttgtgcctagatgattaaaaaagggaatgtggacttaagtgagaatggaccaggccgtgcagaatgatattatacagaggaaaggaggtctttataaggtgatgcagtaaaaaacctataaaggtttgggagtatattatcagtgataacagctttctagcgtatggagtagttaatctttaagacatgattactgtgtgcagagtgaatctgagaactattgaaatgtcagaaaggattgaattgaagccacagaatgtcatgacacaaaaactgttaactactagttttagaattcctattaagaaaacagtataagaaaaacaagacaatgtctgtgtgaaacagtgatttataaattttggtaagcaccagcattacctaaaaatttgttaaaaatacaattgctgaagccccactcttggagatgatgcagcaggtgtgcgggggagctgtccagaaggtgtgtgcgcactccagattagatctctacggcccaggctcattttccttacatacacatgctatttatagacacgtgggctcatgcactgagaggctgctttcttctgagtaccgaaggaatgaatatatacaaaacgattaaaacaatcctggacacgttgtaatcacttgcaagtgttggctgtacatgaatataagcattcattcaaagacaaatacttattgtcatgcatgcggatgtgtatataaatacatttgtctaagcaaatcaggtacacattaataaagtggaagcaaggcttttcaatccctctcaaataatactttattgttcactaagctgtgaatttttaatatcttgagccctgagtgaagaccagaaagcaatcagaggtcactgcaagtagctcaggctgagattccaacaaaagtgagtcttgtctgtgacagttacacaaattacattttgcctgtcatcctgctttgaataaatatactgaaatatgagtgaagacaagatcattgttcaataagaaaaactgctttgctttgggatatttgggaaattacgtaactaccattaacatattagatctgtccttttaaatttcttcattagctccaactactgcagtaaaattctcatgtgcaatttaactgcagcattaatgaagctgattggtctataacatgcagggccagttttatcaccctttaaaacacctgaattaagatgtttttatcccaaccactgaagaaaagaactacttcaatgcatgatccctaaaaagaaaaaaaaaatggagaaagttagcctaattttactcttgataagatctttaaagcttgaaaatcacaaaatgtaatcaaaaactactttttaatttccccaaagccactgtaaaacctctgcaaattatattcactatgagtgtgattttgcaatgcgggagccacaccgggggaatgtaacatcttttggagctaggttaacgaaagtagcctgggtagcaaaaagttggcctcatgtaaattcccaagatcaacagtgtaaagaacttaccggtataaaagaagttgagatttcatttggaagctctaaaattaatgtattcagtaactactatatgtttagtgatcagtaaagagacaagattttaacaaaatttcttataatttcatgaaaatcacacaacaaataacaatagctttaacaatagaagggctgtctctcagttgtccagttcctctctgcttgctgaagtaatatggtgactacagacacccatgagccttagagattttaaaacaagttgactaaaaatgtgatatatgccaactttgacaaagaagggaaactatcaccacatgcctgcatttttgttgaccaaagctttttacttctcacttgaatctcatttttaatcctcagaaatatactttcctcctccatcatagtgattcataaccttctaaaaccttacgattctgaaaacccacacaaacacattgggacctctcccagcccttgactcactgtcagcattctcaagatgaccacaatgagcagcattgaagagccagcgttcaaatgcttctcccacatgggagtcagtattctgcagagatggataattctcagaccaccacttagcttcctgaagccagcaacctatgtcaaagatcttccaacaaatacaaacctaaatatgataaatgtatggaggagaacgtgtgggctcaaagaactcaggcaacgatgaaaaactggg

SEQ ID NO: 2872 - DNA, 3128 bp, Homo sapiens
agcccagagttactaaggaggtactccgcaaaagataaatggaaaaacaaaaggtcatgaggtcccaaataacaaggagcaactgaaatagaattatatctgccggtcacctggttccagcttactcagctgctaaaaacatttgcatcttacaactgcttatcagtgagagcctcagatgaagccacttacgtcgaacagtggttctcagcgcatggtcctcagaccaacatcaaggtcctctcctggaaatttgtcaacaaattcttttgctcccttgtagacaaactaaatcagaaatcctgggggtggagcttagcaatttgtggtttaattatccctccaagttagtctgatacatgcctaattttgagaaactctgatagagaagaaataatgcttgtcttaagatgaaatagaccatgattctagacaactcttgttaacagggtggctttggatcagatacttcatattagttgctctgtcttttaaaacttaagagtagctaccttacagtgttggtgagtattagataagtcatgtgtattcaaaagcattttgtacacagaaagctttcaaggtatgtgttctcaccacacacaaacaaaataagtatgtgaagtaatgcttatgttaattggatctatttagccattccacaatgtatatatatttaaaacaaaattttatacgcgataaatatatacaatttttatttgtgaattaaaataaaaaaattgtaaaaggctttaagccagtgtaagggattattgtactggacaggctgagtctcaggatacctgagggaagctgcccactaccccaacagcccctattactagaagaccatgaggcacaccacaaaaccccactccaatggctccagagtagacgagctacagacagccgtaggactgtggcataacctgatatacacatgcacatgcatgcacacacactgaactaggtcagagtttgtattttaggacgatgaaagtgctaatacaagaaaatgaagcagcaggtggttgaagctaaaaataaaagtctgccttgagccaacaggggacatggcaaggtgaaatcataagaaagtagaaattttaagaaaaataagaaaaataatatagagaggctaatatctggaaagaaagagcagaggagggataatgcagagttaccttaaaagaccagcaagccagtggcccacaaaagagagaagaaagaggagctgatcccagaagcaatctcagcttctgatgactttccagtgccaacttgaagccctcctattgaatgactctttcttttaagtctctgtttctttaaagccaaaaatctcagttcaacgcatttttattattatcgtgtttagactgcagaagagaagacttacattggcaaggacatagaagaatgggtcattgcctgcagttacatgatgagctatcataaaagctagagaatgggctttttccatatatctccagaagcctagtccaggagaaagagataaaggttataatccatgagggcttacacaaggaaggctttctaacaactaaatgtaatcaacgatgatgttcgcctcatagtacagtgatttctgtggcaatggcaatgttaaatttgttagagggaaactgtataaatgcctaaggtctcttcctagagtaagatttgatattctgttgaggaatgacaaaattgggtcctgaaagaatcaacaatatgggtttgggtatatctgagaatggcagcaaagagagtatccatcctccataatatattggagctcactaaaggtaataataaaatgtggcaactggggttgagatggagataatgtggctaaactggataaaactgagaggatggaaaaaattgcagaggtcacctgttcatcataacagccaagaatggaagcaattaggggactgacttcttggatttaggcagtaattttttgttattttggtcttgattgtgcatttgatgaatttctcaaccttctacccacaactttattctacagctccttttacctcaagtgggaagcaagtgttcttgcttcttacttgatttcagctttagcatcctcatctgaaaggtgacaggatcaactggaggacctctgcagtattttagagcagccttaatattggataaatcattgtttgactcagttgcttttgcccactcttttcaaggttctggcgctgtactaaactcaattataattcctctctcttgagacagaggtctccaggctgagttcactgtttctgatacctcctattagcttgttcccgatacctcctattagcttgttccctctcactttacaagggcttaattagccattataggagactctttccaaatgcaggctttgcaaaatgattagtgctatgggccgtacttcaaaaataaaattgcatttaggataattttctcatattttaaaatgttactttcatgataaaaaataatacaggaaaacattcttattgcttcaaaaaatccaaactgtactacacagtgaaattactgcttgactctgacccaattatattcaagccttctgttaataaccatttgcaatgttttatacataaatgggatcatcctgtaacttatttatttcacaatacaacatggggctctttaatgtaagcaggtaaagatctgagaataaggtaataatttttaaacacaattttacttggttcagtcatttactttttaagaacctactatgtgtttggcacatcatttactttttaaagacctatgatctactaggtactgggaaaaggaagctgcagactctgcattccagggacctcctggttcacatggaaagctataatagaagctattcagcggtactgggaacacaaaggagagcctgattgattaggtctcaaagtgtccaagagtttccaaaaacagaactgaggaccctagaacgaatgcagcttactgggtaaacactctctttgggaatgattaagtctttctcactgtctaaaatctgtctctttcctgaaagatatttggcaaaccctacacattgcatatttcctagaacagaatttgcccatttttaatcctaagtgaac

SEQ ID NO: 2873 - DNA, 26940 bp, Homo sapiens
gaaacactgtaaataacaagaatttaaaagtttgtttctgacagagtttctatctatattttcctctgcatcgtggtattattcttggaacataatatttgtctctgactcatttgagttaatttttgtgacttagcgaactccttgtctgtttctacagacttccaaatatgaaggtggattaatttttagttttattgctttttacatattgttccaatgcccatatattgccacaatcaacttctattctatgagattcaattaccgaaagcaatgtgaagatcggaggaataatttaatttactatgggagatttaagttttaatccaaatatttcaaggccatttattttcaatgtatgtcttttaatggtctatttggagatttcagcattctcaattcatacattataagaagtagatttaggaaatggccagaagaaaacttgaaggatcctaacaaggaagatgcattttgttaagtacaaaaaagatttattactcaaatcaggctacatttaatatccttgcttatcttgtggaaattgacacaacacatttttccatattttattcttcaaactccctgaagcaatctattttcagatgaaggtgaaggaggaataatgctgtcttcagcatcactgtgatttcaaacctaaaattatatttgccgtgaattctagacacatttgtaactaataagatgcttaatttaataattttctctgattccatggtgacacattcaatgaatactgggaaatttaaaaaattgcaggtctcaggtgacataaaatgataattaaatgtgtatacttattttttatgtttcttaaaagattttggggtttgacctgattaaaaacagtggaaaaatgagaaccacttgtactataatttaataaaatatcctaaaaaaatgattcagcaggtcaacatgactggttgacttatcaaatcacatgactatttccacatgattgacatgttgctttccatctacttaaaactaataagttgagtaaagttattagtaaaacaaaaaactatttgccacatatgttgtacaaagtagagcacatgaacctctataaaataaggctttagtgtttgttagaaattcacagggtaaggaaccgggtgcagatagaggttagccagttgctcagtctgccactggaaggaggtggagatcaaagctatggtgccatttatctcaaacatccacatgtaattcctgacataggggtaaatgcaaactcacctgtttcttgctgaaggagataagcacaccagaaacaacagcactgccaagcagagctgaacattttatttgaaaatgtgtacaatgtgcaagaactgacttcgtggtgcatttacggacccaaccatcaaactcaaaactagtcatgtaagagtatcccaaggtcagcaagaacaatcagaggaaaaagtgaactcaaagagtggattttatagggctgttcattgtgaatagtgatttattttattttctaaattttaaaatgtagtcccgagaggcagtacaggagaaatgttaaaagacagcattacaaataagctaaaacattaggtgtgtatagaaaagtaatctttgtcaattgctcccaaggtgccttggactgtccaaaaaactagctacgtgctcattccacttgcccacacaggcaagtcttcagtgcaccttgcagtttattcctttcatgatactcaagtctgaactaacccctttacttagctaagacatggttacgctatatctctagccctccacaccactctcttagaatttccaaagtgagcgttctcatatttaaaaactgaatcttggtttctacgtgattctaagattatgaaaacatactcctctctccctggccatgctactattttcctcagtgtttaggagtttgggctggtgatcttggccaaattatccaatttttctgttcctgagtttcctcatttattattttaaattttatttatttaaatttattttatttacttatagccacatctttctgatgcctcatttataaaatcagggtaatacaacatatttatttggttattatgaaaatttatcaagataaattttgcaaaatatttgtaataatatctagctcatagtaaattcttaatacatacttaacagttactgttgtgttgtggctgctgttgttattgtccccaaataatggatgtgtgttaacagtggtagagtggagataagacattgtactgtaaattcactgagaacttaaatgtagttatttatctctatataccttttcattaagcattgttttacacaagccatgggttctcaataagtatttttttaacagagtaaaactttgctgttgaacctaaaaatataattcagatggcaggcattttaggccagtccagaaaaagagaatgttaatagattcaagattagaatatataaagcggtggccaagatgtgtaactcagtgtgagtcataaactattcagcagctctggcaagttgatgggcaaatctggaatctgcaattctacctgctattaaaacttgatttttatgccatgctagactatgtagttcccactaaggtggaggaagtggggttgaaagggtgatgacaatactcaagtagcttaaaaagtttcaaattaaaggcagtgaaatgtttatgatggaatatgctcaaggttgtttttctcatgtttctggatatcgggttatcttttactgtcagtggtagaggctaagatgcacactttctcatctccatggccaggaatgagtagtctctcttttttgtggataagaaattgctactgattctagaagaaagcctccaggcaagtttgtcttctcctctacactacagacaatatctaggcagaaaaccgcactcgctgaattgatatgcctggtccaccagatgctaggccatccaaagggtatcagatcaactgtcagaagtgaggagctaatatttaagcaatgcatctgcttgtaatacctgactctctcacttctgcttgtgcgatcttggtaatgttatctttctgggcaaaactttgctcatttataaaatgggaataataattatgtctattctatcagattgttatgaagattaaataagtaagtcttgtaaaatattaaaatagtggttggcctgtatcagcactcattcagtaatggcaaatagaattagcttttaatctcctccagaaaaattacttgctggtaatttgattgttaaatattgtaaatcatacaattaggaaggtcttttactttattcacacttttgcattactagtcacctaatcttatatcaacaccctaatttagcactgaataaaatcaggccttctattttttatttgcagctaagtttgagaaactgtgcctggagaggggatagagcagttttcagtttcttccacatctcctatctcccctaaaataaatatcttgggcaactcacccagcccaattaaaaaggaggatttcgtgttacagatggccctttattaattatgatctaccataatttacttttaataactcaagataatcatagaaacgtagattcacaaagctgaacagggctttatgttcatctagttcagaattcacattttacacttaagtaaatctgtcttcatttggactccttacttaaaccacttgcttcccctttactttgagggagagagtttgacatgggcatcctgcttcttagccattgcttgcctgcctgtgcttccatttacttatccagagagtgacagtgttacaagcaattcaggatgaggacgttaatgagcacactttgccaaatgcatggtgcttcacctaactcaacttagccattgtataatcttcaagtccataggcacattttagcaacataaatcaaggtgaaacatgtttgtttccaaaaaacaatactattcatgtaaatattaatctctcattgatcttgaattccctggaatttattaatttgtgacctagcctgaaagttccctgaattttacatttccttatcaatacctacatctatatataattgctgtttgctatctgaataattgggcctcacacattacaatgtggagggttttcagttcagatttggtgtaacataatgaagaaaaaaatgactaggcatatcatgcatgtaatcctcaaatagatgacaaaaatccaattcagtgtagagtaactgcacacaccagcattaacagaagtccctagtacatacaagacaggcctctagccagaggaaatgtagtggcccagatagtgaaaatgacaactttggcctgaggtaaacaggcagcatactgttacattctagacacaaggcaagcagctatcgagaactgcagcgtttttctaaagtgtattcatgcagttttaggatatcatgacttttcagaaggagggtaatgcattctgataccaccatcttagaaaagataagagattacggctttacgtgcctagaaaataggaaaggaagatgttattattgtcttaaatattgaacacagtgtattttcacattgtcaaaaaataaaatatgcatattttgtgtgcatacaacacactttctaatagcaactgaacacatcaggtattatttaaaaacttcctctaatttgcaataataggcgataatgggattttcaagattaatatgctaaaccattgaaatgatgaagcagagcatacatatccccttgtagtggttatttagagatagaaaacaaatgaatattacttttttttactgtatatataaaaggtttattttctggcactgattcttcttgctaaaatactgtttaaataaatcaatgtgtagggataatggctaccatccaaagaccactatattaacatttatattaagaatacaaatgatacaagataattaggtagtttcattttgatatgtgaatggccttgcaatgctttgtaaaacacagacagacattactactgcgtttttataaatcacagatgcagaataatacatttttttctaaactacagggcatgtactctttttataagataatatttaattatttttcattgaaaaataaaaattgtacatatttaccatgtacaacatatggttttgaaatatgcatgcattgtggaatgctaaactgagataatttacatatgcattaccttatatacttatctttgtgtgtgtgtgtggtgagctcacttaaaacctactctcttagcaattttcaagaatacaatacattgctactaactatagccattatgttgtatatctattgaacgtattcttcctgtcttaactgaaggtttatattatttcgccagcatctctccaacaccataatcccaccccaccattctactctctgcttctatgaggtcgactttttaaaaatccacatataagtgaaattatatgacattagtcatcctgtgcttggcttctttcacttattcaaatttcctaatgaaatagctgcactattgttctttgaattatagtctttgttgatgtcactgtgcaatactacaaagaattgttatgaataaatgggttgttatgaaatagttcagtggaacactgaactgggttcagttcagagaaagaggttgttacgaatctttcactgactccttaattctcaagtctttatgagaagtagctctcagctatagctgccaaccatattagtataatctggaaaaaaaattctttaaatacctacaacccaatctcacttaatgttcatttctcagaatattagaaaacaaaagatacaaaaaataagatctgagttaaaacctcaatatattactaataccaaggataagtcacttaatattttaagcaaaacattaatctgtaaaatgggtttcctaacttgccaaatgctaacttcttatagggataggtttatgtgaggattaaatgaggtaagggatgtgacagaacttgaaaaagcacaaattgctatgcaagtgtaaggtcttattattgtaattaaaattaacgtaagaaattgaatgactactaagccagtccttatgtgcttctaaaaaaaatctgggcaatttatcaacatatctaaagtaagtattaataagcagagggtgtatgtagaatgactgaagaaaagatcagaatttagggaaacaatgctatttgaatggagactgtatatgtgtgggtgggggagcacttctcagcagaaaactgcattgccccatacaggaaagtcttccaagcattacttaattctagctttttattgactgagctaattttcaactctataagtggtaggtctctagtagacctttgaattatgtcttgcatagtagaggttcaacacacttcctttccagtctgtattaagaccagttttgccaccctttacatatttctttcaacattcctgatctataaatgtgcctgcttatacagtcctctttgaaccagttataacatgtgtctggcaaccacattaaatgagtagatattaaaatgtgtttattttaaatctgtatgagagttacaattttttccttttctgaaaattatattttaacagcaccaaggaagaaatgtcagcgaaagagagggcagtcaattatcatatgaacaagcaaaactacaaagaaaaagacatgtccctgagaacaaaggagaaaaacgatttggagaaatagctcaggggtgtctggtaaattgaaagaggttaagaatgtattgcatttagcaaccaagtaaccattggtatctttacaagagtattttataacatattgaggttaagtacaatgcagactttagatgagcaggtgagaagtggcaaaggaaagcatcaaagcaagcctaccttttctttaacttttctttttctgaaacttactcttctgtatctgtaaaaataataaatgctcactgtaaaaaaatacaaaaaagtaaaaaaagaatgcaaagctcttctgaaagtatactgacttgaacatctttccatacattcctctaaatgcatataacttaaaataatggaaccataatgtatctacctactattaggtacgtaacttaattttgtttcatcacttaatcttcctagttaaactttttgtatttatttcaattttgacagcttagttatgcgtcctcctggcaaagaaagggaaagtaaggagatagataatttgaatatatgtacatgcttctcttattcttataacactcacatctgtatgacagtttatagttcacatagtatcttcccatgatttattttatttaatccttaaactctatgagataagacaaggaggcatttttgtccttagttgacaatgaaaaaaaataaggattgatatggtgaaatatcctgctcaaagtcacaaaactgttactcaagtccttcattcaacaaaattatgccagagaccattaaaataaaaatgattagaaagtgatatttgctgttctctctgtaattcaaaatttattgagagaaaagcatataaataagcacaagcaaatcattcagaggtcctataggagatgcctaaacaaggtaagagagagtagtcactttttttgttgttgttgtttgataataggctatgccttgcaaagcaaaatagaataattgtatcattaactggagagagagagagagacagagagagagagagagactccagtttaaaggagatctggtgagaaatggggtaatgcgctccttagggacttcttcttgagatatgtacttacatagaaagaaataaacttgatgtcaagattttactgaatttttgtgaacaagcagagtttgtggacatcttttcaaggtaaaagcctgtcatgtagacaaaatgaagatgagttagagagctttaccaaaacactataaagtatgcatgtcatgttcttcaatttcaaagattcatgctgttcattctaactcagaaaaacaggcaattgctaaagaaaaattattttaagctgaaattttcagcaagctcacagtaatttcaggtatcttcataatggtagagagggcaagatgcatcaatatgtaaactggctcaaagactggagaaattaatatttaagcaggcgactgaagtctaccctgttcactcaagaagtgaagaggcaataacaggtaatagaacccagcaaaaacaaggtgccttgtggaggtcatggaaatggaaaagaaaaccagtgaaataaaaaatttcatgaaaaaggttctagtctgaactgagagaagccaatagtacactgtagaattggattcagaattgctttcaaagttttattctcctacttggatatgaaattttttttttcctttcaaataacaatatggacttctagttttcagtttagcatgtaggaaatttgaaagtctttgttctaacagtaagtaaaaaacggaacaaaccgtaaaagcaacaactcttcttagagtcatcacagaaatgaggtcacagggcaaaccactaaaccccaaaatggagagacagacaagtggatgcaaaaaattacaacttaccaggacagaaacccataatcaaaaacatccttagaaaccaatgacatagtagggaaaactgaactgtaattgatgagttgctggaggcttagattggaaaagttggagagttgaaaactctatggaaccaagtaataggagggccctgacacttttgtgagctttacttcttagagctctctatcaggtttttacagtgcagatgcgagaaaattccctggtgtttccagcatggtaaaaatgtactcacttttaaataccccagagcattctattcttcttaacgaggcctgccctcaagagaaaatatttcaccagagcgtaacctattgcgattttatcagagcccagctgacctgaggaagtacataaagcaaatccagccctctctagctttcacatgggtgaaaggaaatagtcaaattcagcctgttctagcctttcaaatgagagaagggaaatacacaactctagccaccccctccgcctcagccatctggtcctacttttgagtgggaggaggactgagaagcactgatgaattttatggttcaggggcataggctcactaaaaagactgcaagttaattataggactacaaaacagccccttctctccacttcaccaccacatccctaaagacttatttactgcagttccctgtgccctccttcatgtcaggatatccagaaaaaaattgcaaggcaatttaaacacagtttaaagaaagagcaagattcagaaccagtctcaaaaatggcagggatgtcggaattatcagaccatcaatttaaaaatactaagattaataagggctctaatgtacaaagtagacaacgtgataacagataaatagtgcagaaagagaaatgaaaactctaagaaagaattttaaaaaacggctagagataaaaaacacagaaacaaagaaagcctttgatgggcattagtacactgaacatgagtgaggaaggaatctctgaacttgaagatgtcagtaggaacttccaaaattgaaaagcaaagaagaaaaaaagaacaaagtatctaagaaccatagacaactttaaaaggtgtaacatagtcagactttcagtaacaacatggttgaactcaatagcatgataaaccaactcgataaaattgatatctgtagactactttatctaacacagtagaatacatattattctcaaggtcacattaaataatcatcaaaatagaccatattctggaccatggaaacagcttcacagaattaaaataatataaattattcaatgcctactctgaaatcacaatggaattaaactagaaatcaataaaaatgatagttggaaaattccaaaatacttagagattaagcaacacacttctaaataacacatgagtcaaagaagaaatctcaggacaaattaatacatattttgaattaaatcaaaatgaaaacacaactaaattcatgggaaataacaaaagcatacttagagggaatttgtagatttataaaagaagaatttataaaagaagaatgatcttaaattaacagtctaaggttacaccgtagaaaactggaaagaaaaagaacaaattagatctaaagtatgcagaatgaaagacataataaactgtagatcagaaatcaataaaaatgaaaattaaaaaatcaatagagaaaatcaatgacactaaagtctgattcattaagatcaataaaattaataaatctctagccaggctaactaagataaaaagagaagggagcaattaccaatatcataaatgaaagagggtatattactgaagatctcatggatattaaaaagataataaaagaatatttgaaatagctgtactgtgtcaacacattcgttaacctagatgacatctacctattccctgaaagacacaatctaccaaaagtgacacaaaaagaagtagacactctggatagcctatatctactaatgaaatagaatcaataataaatgcccttcaaaacagaaatcaccaggctcatacggattcacaggtgcattccaggaaacatttagggaagaaattttactaattctctgcaatcttgttcagaagataaaagcagagagagcacttcttaacccattctataagaagaggatcaccgtaataccaaaatcagatgaagacattcttaaaaaaaggaaattagagactaatatctcccgtacatagatgcaaaattgtcaacaacattttagtaaatcaaatctaataatgtatacataattgaaaaccatgaccaaatggaatttttctcaggtatgcgaggaaatttcaacatttgaaaacgaattcatttaattcatcacatcaacaggccaaagaaaaaaaatcatatgatcatattaatagacacagaaaaaccatttcacaaaatccacactattcatgataaaaacattgcaaactatcaatcctatgcagagaagaaaaataaagaaaaaggaaaataaataaaaagcatacaaattggacaaggaaatgtaaaattatatctgtgtgcagatgatataatttagtatgtagaaaaacctaaaaaaaatccacgaaaaactgttacaacaaacaatttcagcaatgtttcaggatacaaaattaacagacgaaatattaagtgtttctgtacactaacaaagaccaatcagcaaaagaaattaagaaaataccaattttagaaataaattgtcagtataaaaattacagaaaattacaagtgttaaaacgtggagaaattgaaacacttgcacactgttggtgggaatttaaattaattcaagtactatgaaaagaatatgaagtttcctcaaaaaattagaaaatggaattagcatgtgatatggaaatcccacttctagtcatatatccaaaagaatttaaagtaggatctcacagaaatatttgcacactcatgttcatctcagcattattcacaatggccaagaggtagaagcaacccaaatgttcactgacagatgaatagatgaagaaacatgatatatacacacaaagttatgttattcagccctaaaaaagaaaaaaattctgtcacatactaccatatggatgaacctccagaacgttatgctaagtgaaataagccagtcacaaaaagtcaagtactgaatgattccattcatatgaagtattgaaagaaataaagatcacagaggcagaaagtggaaaggtttttgtcatgagtgggaactgggtgatggagggtgtaagaggaattagtatttagtgggtatagagtttcagttttgtaagatgaaaaagttgtagcaatttgctatgcaaccatgtaataataaacactattgaactatatactaaaaatattaacaaaatacatttaataatgtaatgttatgtgttttattaccacaataaaaattagtcaactgctttcctatataacaataataaacaaatgggatttgaaattaaaaacacattaccattgaaaatacctgctctctcaaaatgaagtacttaatataaatctaaaaatgtgtgcaaagtctatgtgagaaaatttacagaactctgattttaaaaactaaagaaaaattaaatggagaggcatttcatgttagtggatagaaaaactcaatgttttcagtatgtcacttttttctaatttgaattttagattcaaaacaatccaaataaaaattccagcaagttattttgtggatatcaataagctgattctaaagttaacatacaagtaaaagtaccagaacagaaatgcaatattgaaggagaacaaatttgaaggactgacattattttacttaaaggcttattagaaacctacagtaattaggccaggcatggtggctcacgcctgtaatcccagcactttgggaggctgaggcgggcggatcatgaggtcagaagatcgagaccatcctggctaacacggtgaaacaccatctctactaaaaatacaaaaaaaaaaaaaaaaatagccgggcatggtggtgggggcctgtagtcccagctactcaggaggctgaggcaggagtggtgtgaacccacgaggcagagcttgcagtgagccgaaatcacaccactgcactccagcctggggtgacacagcgagactccatctcaaaaaataaaagaaacctacagtaattaaacagtgtaacattggcaaaataattgacagaaagatcagtggaaaatattagagagtttagaaatagatctgcacaaatataatcaacttatttttgacaaggatcaaaggcaatgtaatggagagaagatgggcctttcaacaaatggtgctgaaacaactggatatgcacatgcagaaaaagaaataaatctagatacagaccttacacacttcacaaaaaaattaactcaaaagggatctcatacctaaatataaaacgtaaatgtaaagctcctaggagataacatggagaaaatttaaatgatgaatatgctgataactttttagatacaacactaaaggtaggatacatgaaagaaataattgaaaaattgaactttattaaaattaaaacttctagtctttgaaacacactgtcagcagaatgagaaggaaagcaatagactgagagaaaatgattgcaagaaacatgactggcgaagggctgctatccaaagtatacaaagaattcttgcatctcatcaatgtaaaaacaaactgattaaaaaatgggctgaagacataaaaaaacacttcaccaaaaagacacacagatgaaaaataaacatgtgaaaagatgcttctgtgttttcaacatcatatatcattaggagattataaattaaaacaatgagataccactacatacctataataattgtctaaattcaaaacacaaacagtgtcagatgctggcaaggatgtggagaaatagcaagcttcattcactgatggtgggaatgcaaaattgtgtggctactttggaagacaaaacactttcttacagaactaaatatatttctaccatacagtacagcaaatgtgctcctttgcatttacccaaaagagtagaaaacttatatccatgcaaaaacatgcaaactgatgttgacagatgtttggcaacataattgccaaaacctggaagcaaccaaaatgtgcttaatcaagggaatggataacatgccttagtacattccaacaatagactattattcagtggttaacagaaaggagttaccaaccatggaaactcccatgaaatagtcaaactcatgtcgtgggggtttgttgtacagactacttctttacccaggtattaggcccagtacttcattagttatctttcctgagtctctccctcctcccactctccacactacaatagaacccagtgtctgttcccctctatgtatccatgtgttctcattatttaattcctacttataagtgagaacatgttgtatttggttttccgttcttgcattagtttgctaaggataatggcaaccagctccatccatgtacctgcaaaggacatgatctcattctttgttatggctgcatagtatttcatagtgtatgtataccatgttttctttatccagcgtaccattgatgggcatttaagttgattccatgtgtttgctattgtgaatagtgctgcaacgaacattttctgcatatggctagccagttttcccagcaccatttatggaatagggagtcttttccccattggttgtttttgtcagctttgtcaaagattacatggtcataggtatatcatcttatatatcagctctctattctgttccatttatccatgtccctgttttagtacaagtaccatgctgctttggttatggtagtcttgtaatatagtttgaagtcaagtaacatgatgcctccagttttgttgtttttgcttagtatagtcatggctattcaggctcttttttggttccaaactattttaaaatagtttttatttttctagttttgtgaagaatgttgttggtagtttgaaaggagcagcactggatctatagaatgctttgggcagtatgggcattttcatgatattgattcttcttatccatgtgcatggagtgtttttccatttgtttgtgtcttctctcatttctttgagcagtgttctgtaattctcattgtagatatctttcacctccctggttagctgtatgcctccgtattttattctttctgtggcaattgtgaataggactgccttcttgattttttcttggcttggctgttgttagtgtataagaatgctagtgatttttgtacattgattttgtatcctgaaactgttgattgtttatcagctgaaaaaattttgggcggagactatgaagttttctagatagagagtcatgtggtcttcaaacaaggatactttgacttcctctgttcttatttggataccctttatttctttctcttgcctgattgctttggctaggacttccaagagggcatccttgtcttgtgttggttttcaagaggaatgcttccagctttttccctttcagtatgatgttggctgtggttttgtcatagatgactcttattactttgtattacgtccctttaatacttagtttttgagaatttttaacatgaagggatgttgaattgtattgaaagtctcttctgcatttattgagataatcatgtggtttttgtctttagttctgtttatgtgataaatcacatttattgattgacgtatattgaaccaatctttcatcccatggataaagcccacttgattgtggtggataagctttttgatatactgctggattcggtttgccagtattattttgaggatttttgcattgatgttcatcaaggaaattggcctgaagttttcttttttgtgtgtgtcttggccaagttttggtatcagtattatgctggcctcataaaatgagttagagaggaaagcttcctcctcagttttttggaatagtttcagcaggaatggtaccagctcttctttgtatgtctgatagaattcatctctgaatttttctggttctgtgctttttttggatgctaagctttttattactaattgagttttggagtttgttattggtctgttcaggaattcaattttttcctggctcagtcttggaagagtaaaatatactgtttcataagcatgttattgatcagcatttaataatcaatatttatattctgggaggagataaattacctctctcatttttttttctgcagcacatagaagaatacctcagacatataaggttttccatttcattttaatacataaatcagtataatactcattacactaatctcacatgtatacttatatgtgtattttagataattctgtacagattaatgaaaagaaaacatttatttattcatccacttgtgactaaggtatccatctgttcaacaaatgtttattgaaactatattgttccagacattataatagtaatgaatgcaggaatggacattgtcttccttgtgtttttagtataaccacagatataccattaagcaactattaaaacagagagtgataaatgctataatagggaaaaaacaggtgctgatacccaaaagccctataggttaatttggagtttcagagaaggtttttaccaggaaataataagttgacattaagaacaaaatgatagtaagaagttacccaaactaaaaggtagcagagaagcacatcaaatggccatcccacatagagatatgttgaatgcacacgaaaaagaaagaacaatgaagagatgaaggggattgagtgtgacgagatcagagagaaagaggtggctagacactgggcaagtcatggcttgactatgacagactctataatcaaatctggaagtaaatattttaccctaaggaaagtggacaaagattagagtataaaagcagaaaaacatatagagacagggtgtccagtaagaatatatgagaatattcttgagttaaataatattagctttaatggaaatgttggcaatgaaaatggaaaataggaaaatgtataaataagtagaaataaattgaacattcgtgaacaattaatggatcaaagaagaaaccaaaaaaaaaaaaaaaaaaactaagcccaagttagcagaaggaagcaaataagatagattacagtagaaataagttaaatagagattagaataataacagaaaagatgaaccaaactaagagctagtttgttgaaaacatgagtaaaattttaaaacatttagttagactaagaaaaaatagagaagacacaaataaataaaatgagaaatggataataaacctggccaggagagaaagatattagtcctgaaagtaggaacaggaagcagttaaatcccagatgaagcagcacagctgagtgactttccctgcttgcctcttttccctgcctgagaaggaagctgagagttttttttcttttcttttttcttttcttttcttttcttttcttttcttttcttttcttttcttttcttttcttttcttttcttttctcttcttttttccctgccctgggacctgatagcttcactgatgaattctaccagatatttaataaagaattaatatcaatcttttttcaaagtcttccaaaaataaaaagaaaggaaagaagactttcaaactcatttcacaaggctagtattaccctgatactaaagccagacagataaataatttaaaaacacttacaggccaatatctgtcatgaacatagatacaaaaattttaacagaataccagcaaactgaattcaacaaactattaaaaggctgatatactgtcatcaagtgggattgattcctgaaattcatggatggttcaatatacacaaattaataaatgtaatacaccacattaatagaatgaaggatgaaaatcatgtgatcatctcaatatatgcagagaaagtatttgataaaaagcaacatcctttcatgtaaaaaattatcaacacattatgtacaggagaaatgtacctcaacacaacaagcccacagctaatatcatactcaatgttgaatgttgaaagctttttttctaagatcaaaaaacaagacaagaatttccccacttgcaacttcaattcaacattgttctggaagtcctagttagaggaattaggtaagacaaggaaataaaaggcatccaaaatggaaacgatagagtaaattttttctgtttgcagataacatgattttatactaagaaaatcctaaagacttcaccaaaacactgttagaactaataaatgaattcagtgaagtcacaggatacaaatcaacatataaaaatcgattgcattcctatgtactaaaaacaaactatccaaaaaataaattaagaaaaaaattcattgaaaataccactcaaaaagaataaaatacatagcaataaatttaataaaatgaatgacatatctgtatattgaaaattctgatattgatgaagatttaggaagacaaaaataaatgcaaagatatcctctgttcatagatcagaggaatcaatattgttaaagtgttcatactacccagaaatgtaatctctatcaaaatttcaagggcatttttcactgaaataaaaaaaaaaaccaaatcctaaaagtcacatggaaccacaaaaaactaaatagccaaagtcgtaagaatggcaagaaaaacaaagctggagatatcaaactgcttgatttttaaatatactacaaagctaaagtaattgaagcagtatggtgctgccatacatatggggatatacactaatggaataaaacagaaagcctagaaataaatccacacatttatggttaattcatttttggcaaaggtaccaagaacacacagtgaggaaaggatagtctcttcaataaatcctgctggaaaaactgtatattcacatacaaaaataatgaaattggatctttatcacacactatttaaaaaatcattgcaaaatggattgaaggcccaaaactgtaacaatactagaagaaaccttagggaaaaagcttcaggatattgatctgggaaatgtttttttggatatgacctcaacgtacaggcagcaaaagtgaaaatggacaaatgggattatatcaaaccaaaaatcttctatacaataaaggaaacaacagagtgaaaacacaaccaatggaactgcagaaaatatttgcaaaccatgcgtttgatgagggtttactatacaaaatgtataagtaacttaaaaatttcaatagcaagaaagcaaatacactgattaaaaaatgggcaaaggagcagaatagacatttttcaaaagaagacatacaaatggacaactggtgtatgaaaaaatgctcggccttactaattagggaaatgcaaattaaaaccacaatgagatattactttgcaactgttagaatggctaagatatatacatgtgtgtaaatgtgtatgtatgtatacagaaacctgggtcaatgtacactgagtgtcaaaagtgcctttttttggccagttaaatgaccctttgtatataggctgtgtgtgtgtgtgtgtgtgtgtgtgtgtatatatgtgtgcatatatatgtgtgtgtgtatatatatataacacaacagaataccatgctttacatgcttaatcttaaacacaaagaagtcttaaacacaaggaaatcttgtcatttgtgacagcatggatgtacctggagaacatttttgttaggtgaagtaagccaggctcaaaaagcaaatactgcatgatctcactcatatgtggaactaaaaaaagtcaaacttacagaagcagagtagaatggtggtcttcatggtctggggtgtgggaaaataaagtgatgttggtcaaagggtacaaagtgtcagttatgcagagtgagtaaatcctggagacctaatctataacttgatgaatatagttaatacactattatatgtttaaaatttgctaaaggagtggatcttaaatgttctccagatccccacacacactcaatggtaaggatcttagataatggatatattaatcaatttggttctggtaatcatttcataatgtacacttgtatcaaaccattctattatacacattaaatagatacagttttttgtcaattatacccaataaagctagaaaaaaaaaaagaagatgaaaatcatggagttttgagagatataggatttacaggttgacttgatgtggatatacaaaataagagagaagtcaaggggagctccctgtttctggctttgacaatgagctggatgctagtacccttcactacaaggagaaatcaatatgtattacaaattagctacacaggaacgggttgacatcacatttgaacctgttgtttgtgtaatacatccactggtgacattgaatgaagggttgggtttatggttatagagctcaggaaatacagattttggagtcttagccttatacaagaacactgaatccttagaaataaataagatattccagataaagcgtgtaaagcatcgcaagtgaggctagaaatgaggaattgagaatgccaaatgtaaagtgagttgcaggagaagagcctgcttttgaagaatctgtgaataaagtgcctcagaatacagagactataggagggaaacgtctgcagtgatatttgcttgaaacaagttaacttttactttggcttatgaataattggtgtccctgtcaagagcatttcccatgaattaattatgagagaagtcacacaacagtagttccagaaatatgtgagaattagaaaatgaaggctgtaaaatgcaacaagctattgaatggacaggaatcttagaattttaaagtcaaagaaatgctgaccacagttaagagatatcagaagagaagaatctgtggttatgcaaaatagttatacaacagttatacaaaggccagctggctcttattaaatagaaaatgagggaaaagtggaggaatggcatgcaatattcaaaaactcctgttgctttctacaattatcattgaaagtcacatagtacatccttactaatgtttagtgtcttgtccttatgtgatatttgtaagagcatggctcctttttctgtattattgaccagccttcacattttatttgggagtataatttaattttataagacatgtggaaaataaaacttttaccaaatagtcttttaagaatctaaatggatacagttaactgtttccaacgtgaaacctcactgattaaacaaacatgtattgagtgactgctaaatgccaggtactgaacacatagaagaaaataaagcattttttaaaaactaaacaaacaaataaaaaactgccccatggtgttaacatacaaccttcacttataaaattttatgtttaccttaaatttcatgtagtttcataaacaaatccattaaatttcatgttatgtgatgagacctgtcatttcttattcttttccctaaccctcaatatctcatacagttctctgagtaaatggaattaatattaaaatgacctacttaattattaccacatttactaaaatattgggaattaaataattaaagatatttactaatatgagaattggattggtttcaaatatgaagtagccatatcatctgactatattttatgtaagttgagctggcccaatttgtgataataaggacaaaatctcagagatcctctaagggagaacgcagtaatctttattaattccccatctttgattcaaccattttgacttatttttcctatttttagaaattttaaggaaagcactttaccataagttgaccctgattagtaccacttttccttatgtgattctccatgaagttacagaaaggacaataataattattaccatttactttcactgttattttacaatgaaacacaatctgtgaaaataaaaatgaaagtcctatctaaagtaaatatcttctccctgctacaatatagattgtggtttaattttcaaacatatattttaaattcatatttgaagtgaaaactgttttttgtttgtttgtttgtttgggggatgcaaaatttagtagcacaaataacctttacatgtttccaatgaactagcatagatgagtcactgaggtaaaagctgtcactattgagtttgtaccaactctactgtaaacatagaaaggttataatgtggtaatatattgtggctaaaagacaaagtttagcaatattatgtatttgaaagtttaattttagtttagtatatttttcatttcataaatttgaagtaaaagtagaaaggaataatgataaaatgatgaggttctcaacacttcaggcaatttggaaattctctaattagcaataattgcagaatcagcgcttactacacacttgaaataaatgcctctttaaacaaactacaatttaaatatttctcatacaaatatagaaaacaacgttgtcttaaaaggaaataaaataaaaacgtactgataagctgctgagttaattgctgtgttcaaattatcctatctatttttacctttaaaaatgtatgccctactcttttattaccatctgcagagatgaaaaactataatttttgcacttgaattaaagccatgctcacctactttaaaaataataactgatacttcatgtctcatgatatcaaggaaaaagtagaataaatccatattaaattaataataacataattaatgtatttatgctaccataccatattaagtgttttgagaaaagggacaaaatacttctagtttattgttttgattgttggaaggatccagaagcaaataatttctaaatagtagttttttcttatttcttaatttgtagtatttactttttttcattgtggttttgattttaagtttattagaaatagaaattataatgttgtgtttcagggtgtatgtaaggtattaattttagcttgttaaccaatgagtgcacttttctttttcctgcaacaacttgctctctcagctggacttctttctatctaaccagatactttcaagatctgggagcttcaggttccttgctcccttggctttgccgttgataacttcctgtccaatcctaccaaagtctggaactggaacatccaagggttgcccttagacgccttctctactgagaatggcatcatcatcaagcgaggccataggaagaagtgtttaaactataaactgaggaggagaaaatatctaggaaaagagaagaaagttggcaaaaccatggtctccttcttcctgaatttgtaacttggcctacaaagaaagcatcagtcctactacacaggaagagtcaacactcggaggaggccttctgcactttgtcctctccttcttttcactcctcataatgggaaagaaataaataacaggatatccagtttagactgaggatcagagaagtcctctctgaggaagtgcctcttaagatgatggctgaagaaggcatatgagttagcccaatggacaatgaaaggaaaattactgtattacaagcagaaaaaaacaacatgtgaatgcctggaggccctgaggcccttagactctggcagttacggttgttgaaaatttcaaagatggtgtcatcgtgaagaacatctggctcttgatcccagtgcttggtcccacagattccattcaggatgctatgtgacataaacaccaggaatgtgctgtctgaggactggtgctctgggctggcagggaagctcggtatgcgcagattgagcacacatgttgtagctgacccatttgctgctgtaattgaaagttcacacagagagcagaaatgtggaggaaatgcaagttacctgttcaaccgcctggcttctcaccctcaccgtaacagaacacttataaaatgggtgagaatttcgggtggcagcgccaggaatatctctggaagcatgcgatgagttgtgtgatgaagatggagccccttgtgctgtctctcctggacacgttatctatgatgatacagatgggggcttgagaaataactggaattatcccactttacagaggaaggaatagaggctccaaaagatgaagaaactccctcatattaccacagtgagtaagcaacaaaaaatggccactaggctcccaagttgtttgcagattatgccatgctgtctttcaccatataataaacaaaatagatgaacacacaccaagtttcagtgatagaagatgaaaaaagtgataaaaatctactgtacaggatggtgccaatagtaaccaatactgtattgtaaacttaaaatatgctaagagggtagattttatgttaagtgttattttcacatgcactcgtggaattataataataaacagagaagtggaaggatcttttggaggagagagatatatttgtggcacagattgtggtgacgatttcaggagtgcatacttatctgtaactcattaagttgtatacattatatatgtaacattatatatgtcaatcatacctcagtaaactggttttaaaaaataagacttaaaaatatacaaattaaaaatggttaaatgtatactccttaagataattacctagaagtgaaatactaaccagtgttccccaagattagacgtaatgagtcccaccctatcatcttctacttgttttaaagggtatccacagttctagtagggcatgcaatggcactgctcatagtggaatcagatgggaaatatggagaataagacttgaaattgatcatttgagaaagggaagccattcctggaatccatgaaaacactacacaaaacattaaatgggtttgataaataacagaatccatcatttgtgtttaaatggtgtgtggtgaatgggattccttatgttgtgttgctttaatatttggtatgcctttggctttaaattgtaacacttataagaaaagtacaatttttaaaaacgtgggtgtgggagggggaaggaatctgttttcacatcacatctaagatcatgtaaaatatgggagagcacacaacattccctcggatcattgtttcttagggattcttgatttggtagaatcattcaaaggtagcctcaggcccacaaatcacttaataccaccaaaagacgtatacatgaggttgaagagcagaaaacaatgaagtccttctctggtatgtcttgcaaactgcatcctccaggttcttaggtgactgtgaagacatgactcccaaagatgctggacagtctctgacccactgttccccatggtttgctgcagagacaacaattttctacacactactgtgcctcctacagtatggctatcagaatccccttgttcttttttaatgttctttctaactagtttcatacacatagacccatacacatacaaacacacagacacacacacacaaacacacacacacacacacatacataccactttgttttctctcaagtgtcattcaacagtgtgcctagtgataatgaaatcatcttgtagttaccagtttttagaaaaattatttctgttttctctttcatttgaaaaatagctcccaagagctatgaatcaattggtctcaaaatcctggcttcaagtgttccttcagctttggcctgaaggaaagcagcccatctgggtttgcctcatcatgttcagttccacacattccccccaggatgccatgagacatgagcaccaagaacgtgctgtcggaggacttgtgctctggtcaggcagcaaatgcccacagcaatgacttcatattctggaaaagagcaatgtctaactttagtcggagaagcatcacaattaatggggcctcctagatttaccatgagcgaaacaagaaacatatgtaacatctgggtcatggcgcttcacatagtgcttactcagtgatgacagctgttttatggtttcatatttccttcttaatggggctatgggttgccattttcttctctggctgacacaccgtcttctttatatattgtatatttttatatgttactcatttccctttttcttttccatctcaatctttctccttacctaccaagagtcatgtgttataaatgcatcacaccactttctttgtaaaacccatcccagtttgcttagaatcaaatcaaacttctggtctgaccatactccacccacatactatgtcccttctcctccaaacttgagtcatactggtcttctctttgtgcttctcatgtgccagtttcattttcagctcagctctttcacaggtagcttctcgtactttgaaggcactgcattcatgtctctccaaggttgtctccttctggtagtccagtccaacccctgtgttatctccccacggaggctttttcagccaacccaagaacatttttccttaccctacaattctctgtcatgtttcctttttcttttttcttactcttggctttcttgtcactcttatgtagacacacatatatgcacacctgttctctgaagctgtccgttttgcttataacttcactgtttctctctactgtaacctagatggatgccgactgggaacttcctgtctcatttacagacctactcccaatgctaggaatagctttggtcaccaatttagtactcaatatttgttttaagactgtactcctctttaacacttattactatataattttatggagaatcttggggctgcatcccaatcaccagactttgaatctcaatcagaaatgtgaaaactcgtgccaatcatattttgtctagttttatggaattgaggacatttggagcaaaaaagagacataaatttaccaatctaatgctttcattttttgcatcacacacacacacacacacacacacacacacacacacacaaggtagcagagattgttaaactttgttgagcttctataaagctaactagttattagaaggatgcgtgttcaatatgtatgagtttggggtggctgaggggttgttaccctggctgtcagattctcttctacatccacactgtaacccagatcctcaagcagcttcttcatctccatgatggcaaagtcagccccatttcttggaggcagatggtcaaactctttattgcatatgatgagaaccaggcgtatgcggtcctttctctcctttattggatagatctgcaggaggtggagatgcagtgaatttaatttattcaggtttcttttct

SEQ ID NO: 2874 - DNA, 7158 bp, Homo sapiens
actgcagtggcagacagcaacttttattttccccagccaccatagccccactcaatatgacatttagacagatgagccagcaatacagtagttacatgtgtctgggatttgttttttaaattatatgtaccgcttttaatagcctgattacagctgttcagtaagtgatgcctctagactgaagaggaccgaaatgagaagcaggccagctaagagggctgggagcagcacgttccccttgttattgccagctagtggggagagaacatatggccactttacaaagttaagaatcacaaacagcagacaagaatgaatgattaatgctggagttcctggagtatgggccaaagaagttcccccaaaactattgtgaccatgaaatttggaagccaagcataggataccaggagaggttggatagaagcaagatttatcagaattagccttggaatctctgactcaagtatggactatcatcagccattagcaccagacaaaatgcagccactgacaatcttctgggatgccgctaagtatacttgacctaacaactaccagtaaaactttctgacatgtgctttgattctagattatcaactaagaattcagggaaacattctactaaataacatgtcctatgtaagtgagataattataacagcctcctcactaggttatgggcccccaaatttgtacttttcagatctttcttctacgttgcagtcagacacagatttgatcacgccacaccattgctcagaattctttggatgcaacttactgcctataggatgaagaccacactcaggcatttccttgaatgctgacacaatcctaccccaacctacctcacgatcttcctactgcatgcatgctcccttcagatctaattggctttttttcactaatgcctgcacttgacctaagtgaagattctgaagcaggagagaaactggttttctaggcctatcttgagtctcttttatcattgaccatctttcgctaccacaaaagaatcatattctattgcacaagacctagtgggcctcatttaagattttgaacattattccaacaaaattcctaaaattttaagtttgtacttatatcataaagctagaccttgcatttaaaactcacctttagaaaacttgctttaaaaaaacaaaaacaagtaattttgatgaatttggaaattctgtgacttaatcttatctgttatctgagtaagagtttaagcaacagtgacactggaaaataaaatgatatttatgtataaaacaatgataatactatagaatgtcatctttcagggtaacatttgttgagttacagaactgattcattgattgcactaaagttataccattgaataacttgcatggagggaaaccagaattataaccacgggtaaaaattgatatattagaggtgaattttggaagaaataaaaatgtagaaggcaattataaggggagcacttaaattaggtatgaatggtttatgctattgattaaagcattttaaaaatcaataaaagaacactttgtaccaagtagctttcaggaactttcagggaagaccatttgattcagttcaaaagtcagaagcctctgccctaacaggtaaaaagcgtggttccatctcctttttaaaaataaagcaaataactacaatttagagtctaaaatcaagcattaatgatctgctccagtcattttttaaagaagcaagctatattaaaaattttgatacttaatgtgaaaattatatttttatttatattttactacatgctgttatcttctaataacaattcatgcctaatttatgtgctccccttctaactgctttctatttttttgcttcttccaaaattcatccctaatgtatccatttttacctgtggttgtaattctgatgtcccttcttgcaagctattgaacagtataaattttattatcatttttaaaatttttttatgcgttgatattaaatgtttatatttgtaaagtacatgagatgttttgatacagcatgccatgtgaaataaacacatcatggagaatggggtatccatcccctcaagcatttatcaacagtctaactgtcatgcagttataaacttcttaggagaaggatctcttgtgttatataaattataaaatttaatgccatatccttgtacaaggtaggctaacaatgcctactttgaattgtactatattcattcaagaagctttttaaatctcaggctttctgactctttgttctgcatttctcccctttcaactaaagaatatattttataggtgagctacaggtggttgtatgtatgcatctgtcagtcttattcctaggaacccattcgtgatagctctgccacatccatttgacaataaacgactcaagttcaagaacgctaactgctttcttgtcaacttctctgaaagtatgtttaaaacacattttcctgactcatacatttagcttagccaggtcaccaccaggcccggccttgaaagcagcagatgttgacgggttaataaaaaaaagagtatcatgagaagtggtgaccaaagccctctgctcaaaatctatcctaaaaactatggctgacatacttgtgaagtatattaaatgagaacctttcttgctatctaatttgggctgaaattccagagccaagaactctaagtaccctcacattctaaaatgagttgcagagtccttgcaggcattcacagaaggagactccaaacagccttggtgactcctaggtatcacctaccctaggaaaaacctacactgccagagtttggtgcagcaggacaatgggtggttcctttggaaagggtgacctcaaagaagactttggttctcttggactttgcatgaaagtaacagccacaggacaatgtgaatccaacaaataacatctgtggaagtggacttccagaattcaggcatcaagtcataagcaactggccaaaagaggcagcacctatgttggaaaaagtcagtgagaagtctcaggaaatgtgtaacagtgtgtgcatgtgtgtgtgagtctccaaaaacttccccaaagattcagggaagaaggcaatgatttgaatattcaataaaacccaaaggtcacttctgtctcataaatctctctctgaacctgtttccaactttggagaagccagtggcccaggatgttggaaaaaaaaaagtgtggaaaagtgagtggggacattggtaaaagttgaactgtgtcttccctaagatagggaagcaaagaaatcagaaatgttcattcgaatgagagtttgggtgtggaatattaaacagaactactctttctattaactaaaatatgttactgtttattcatacctgagagtgactggaaaagctagaggacctgcaagagataactcatgggtagagaaaaatgaacaagcagctccaaatgatattgaaaaaagaaataaagcacttttggaattttgtctctaatacaccagtttgttccataaatttgttgtatttatttcttagttttgtctaatgcttggaaggcactgttaaaaaaaaattatctatgctgagccatcatacctgaactatcagaactccttcagttgcaaaacaaaacaaaaaacaactcaaactagatttaaaaatagacaaatgtcttggtccacataacttatatggcttcgtgcacaattgaatccagtggctaaagtaaaccattaggattttcttactctgtttgtcatctctgttggctctctttatgtctcctacagatgctttcctctctgtgattttgcatctgttattcctcagcaacaaatataaactattagagaactttcttggatcatgtgcctatcactaatgcaatcactggaaacaagagaagggggtctctgattggccacctggtcctatgcccacctctatgatgatggtggcactggtggcaccatgactgatgttctcaccaaacccacatggagttgtggaaaagtggatggctggaactcaaaagaaaagtgaattgctgtaaccagagaggaaggtaggcaaaaacaacagatattccctacaattacctaagcttgttgtacattacagtgcatagctagccagctgggagtctaggattaagcttggatttctgccctcaatgagtaaaaatatctgggtagaaaacagaagattgcagcaaaatttcccagattatgttctatgatgttttaagaatagattcacaatttcttttacactcttcccttccaacagaggaccattattctgtcctcttgagggtgggctggacctcatgactcacttttgataaacagaatgttgtcagcatgatactatttgacttctgaggctaagtcattaaaaaaaggatagtttctgcttgtctctctcctatcacttgctttgagagaagccggttatcatgtcatgacgactcaagcatcttgtggccagatccacatgtaaatctttctaaactgaaatcttttgccaaaagtcagcatcaacttgccagttaccttggaagtcaccttggaagctgctcctcctgccccaatcgaggtttcagatgactacagtcatggtgagcatcatggctgaaccttatgagagagcccatgctaaaattatccagtaaaactgcttctaaattcttgatccatagaaactgtaagaatagtaaatactgattgtcattttaaatcactacgttttagggtcatctgttgtgcagtaatagttaaataatacatgggtatcccccaagatgataacagatgctctatgaaacaagtcaggtaagtgtggttaagcatgttttagcagctatctttatcatgggacttctcagaaccttaaaaggtaatataattgtcagtttccagagggagagaaagagagagacacagagaaagagagacagatgtaatatgcaatttcttaaacttctttgacaaaaaaatgcctttatttttcatggaaaacctattaatatctctgaaattctagtgtttctaggacatttgaaaaactctagactagatacatgtactggagaagattacccgggacatttttgcttcttaaagagcaacatcatatcttaggtaaaaatccgaataacagattaacaggtccaggattaggatgacacaagtgaggtactcatctcagtaaccacatttaaagaaatgacaaaaagctcagtagtcaaaataaaaatactgtattgcaacatttttttaaaaccaaaatttatgtatgaaaatccatgatgaacaaaatatcaaaattttaaataaaggctaatttaaaatcagtcaaatgttatttcattggtttgtcttatgatcctgcattagtatgcaatgaaaacagttatttctgatcagtcctgattccttgtccacatcgtgatcacattcccctccagtcaggttaatttaacaatagtgtgcaaagagattggcaatacagtgttttacatatattcacttttagaaatgtagtttctattaacttttgcacttggttcaagttatgaaaaaaatattttggtaagtggatagaagcgcgtagtttcccttttgcttaggttccaacagggctcagaagggcatcgtaggccagtaacctttccagtcaaggtacattatatgatataggtatcttgtattctgtgggagtaggagtaggagttttcaggttttctcgtaaagttgacaccacagatgggcttttatttctgaagtttcttaagcaggatccatgacatcatcctgaagctttgagtgaatgtaacacagggcagagagttctgatgaaaaagaaatatctagaacccataaggagatcaagcctgatcagcagcaccatagacacgcaaaagcatcttgcacagcactgtggattaaattttatggtcttccatgcaaattcattgcacaacaaaaatagtttctcatttgtctgtttgttaattcacaaatgaaaaattaccacacagacatttttaacattgaaatgatgccttttttgtctttttctttctttcttcaatctcctttgtgggggcccaacatgtttcacacacattaaaaatagaggtttgcttggtttctcttttgttttccagattaaaagcaaaaacaaaaacaaacctcttataatataaaaggatttaaatcaccaccaagatatgaattacatctgcacgatcagcctcctgttgctatgtatttgataaaacagaaactaatttcactacaaatggtggtttctcttcaggtgttatttcactgctcctaaagcagtgtggtatatatgaaagttattttaatttttttgaatctgtttagtcagctctttaaaatctcctctttggtgaatactacatagtgaaatataggatcctttggcttgccttattttcaaacttaaggtggaggagaggggtctgaacatcgtgacaaaaagagctttaatgtaatgcataaataacattacatatactactgcaaaattgcctactcctctgcagcaattcagcactgtggcatctagttttttagccttaccatatggaactaatcttttctcaagcaaatgtcaaatctataataatcaggtcagtgctgttcatttctcctcccaaccagtactcacctcttgctgagaaggttgagaactagctctgctctaattacaggtgtccatgaaagtttctctcaccttttcttattcccttcaactctctctgacttgtttcttatccccaaaatgcatagtagaaatagtcctgtcactcagaggttaataaacttcctaaagagttagatagtagaaattttaggctttgtggtcatatgacctcagtagcaactacttggctctgccattatactgctaaagtaaacagataacacaaaatgaatgggtgtggctatgttccaataaaactttatttataaactttgaactttgctgaacttactttatggttctatctttgctaaaatggagcagtccacagaagaattaactctttaactaccaatcagtattattccttacagagaactgaatttaacaagatgaccattcagg

SEQ ID NO: 2875 - DNA, 912 bp, Homo sapiens
cgcttaagggtttcaaaatgaagggcatagattttttcattctatcaacccacaaagagtatagccagcatactgaaatgcacattggttgaaggttaaggacttctacaactatctctgctcagctgaaagcggataatgaacaagaacatcaatttgtgcaataagcttttgactaggagataaagtcttggaatcagctttgtgggggcagaacgaaaaagatggatttgatgtcgtgaaatggcaattctaaaactcaggagatatgttggtgtttctgagctcttactccagtgtccacttgtccatagaatcacctttcacttctggggtcagaggacagctcctggaatgatctctcatcttacggcaaaaagatacagtaacttagcagtctgcaaccaggaagaagtcattcaccagaacctgactatgttgggaccctcatccctgacttccagcccccagaattgtgagaaataaatttttgttgtttatcatatacccagtctatggtgcttttttatagtgccctgaactgactaacacatacctcaatcttatactaggtccttcctttgaatatcttcaaagccttctagaactttttttttcctatcaaattacttaataagtcttcattttaggtatactaatacagcagctgtttgaaatatatatatcacatgtaaaagcatggtgttcaaattgagtgccagaaggtttttactcatgaagaatggccagggaacagtaaagttaattgtaaaagacataaatgaatattcattattttacctaattatggcatacatatgtcaattgaacattctgaccataagtgaacaattgaacgtaactgaacattcattgttttacctaattatggcatacatatccaaattatat

SEQ ID NO: 2876 - DNA, 3467 bp, Homo sapiens
gttggtgtcacccatgatggtcccacctctgtcactggccatgaccagctcatccaggtgacactcaggctgctcctgtctttttcagctcccaactctacctcttgccccactgaggaaagctggtggtcggggctggtgatcatcattgccgtatgctgtgcctccctggtgtttctgactgtgcttgtcatcatttgctacaaagccataaaaaggaaaccactgagaaaagacgaaaatggcaccagcgttgctgagtatcccatgagtgcttcgcagagcaacaaaggagtagacgtgaacaacgcagtggtgtgagtctgcaggccctggacccgctggccagagggacaccttggtggcactggtggacatgggaaagcaggtggacatgagctaaccctgagcttgtccaggacttcattgcctcacaggccctgagcctcccgaaggagaaaccattgtcttcccaggcttgcccctggtcagcctgcgggcccaggcagctcggacaccaggctgagcccggcgcagcacctgggcagtgtccccaccccaggccctccacatcctcctccctgtctggtgtctggtctgtcgactgcccccagctgctgtctaaagcatgcgcactggcgaagccagagggatctgtctttctactgtggcagggaggcttccccctttagccaaaagaaagatggtccggagcccactccctgccggaaaacctctcctcctcccaggaagcctgcctgctccactgttcacattctcaacagaagccatcggcacagccagcagacagacgtcccctttcaaaggtgcttcccacacatctgttcatcgccccatctgcagttgttgtcaatcttcagggcctgccttctccctcctatccccactgacaccctacaccctaggctcctgactgcctgccatggagggctgtgagtccagcctgcagaatcccctcctgagcagacacaggagtgcgtttacactcgggggcagtgtctggccttccgggggcaaaacgactcactgaacccgcagcccagggccactgggcaagggcagaggccactgcacctgtcctcagactcatccccacacttgaccccataggaactgatgcatctgtgtgagccaggccctgccttagtcagcagaggccactacttgtgccaaatccactgtgggcctgctgtaccaggctgatgctggccaggcgctggatgtcccccacagtcccctgaggcctgactgttgtactcaggccctctcccagagtcctccatcatctccccattttaccctaccccgagccccagtcgccaagaaggaggtgttgttcttccagggtcttcctttcaatgtctgtttccacagtctcatgctatagaagcgctgagccctccagcgtggttggaggatcaagggatgaaatgggacaggaggagaggggtcctccaggctggtgacccctgccctgttggcctgtctcccaagtggcagccttccctgtgggccacatcaggaaacccacggagacagggtgattttgcatctcctggaaaatgagtgggacactcctggccccctggctctccccaccacccctacatatgtgctcagaaggagcccaatgcattgaatggttccactgtcgagccctctaagacctggtttgcctcctaaacctccagtgtgctcctctgataggtgtttaagctacaggtgagactttgaagtccagagaagacagacacacctgaaaaccggtccccatttgggccgaaccttaaaaagcccattgtcccagagtcctagtgcccacggagctgtctgtgtgtcattgtcctgcccaggtcatcaggtgtgggctgaggacaggcccagggcataccctcccataaaggggttttcttctttcctcatttccttctatttgaggacttgtttggggtttagatttgaattttgcttcccctggacacctgggcatcagcatagtgccaccccctgctcctgacctggccagtacttcacagtgctcttgaggtgcggagccagctgacaaataggccagagggtgtgggccagcagcaggttaaagggggaaacccagcagaccccaccccagggcactctcccctactgccttcagccttctggtgcctgttgaacccccaagctgtgccctaagcagacccctgggcaggaccctagccctaagcacacaccaccctgtgctgcaaccatgagaaagtgcccatgccttgggctgtccagaagctcaggagtgatcagagggcaccttctctaagaggggaggttcctggctaagggaccatggagtggtgggcagcctgaaggggctgggcacagcccagctttgcgcacactcgcctggtcccatcattccctaccttggcttaaacctaggaggcctggattttgcagttagcctaatcttccagccccaggcgaggctccctggtgaggaatcagctgagccatcaccacgttttggggcctgtatcctcttccctgagccgctgacgcatccagggctctagtctgcacataaattccctctcagctgggcttgtaaaatcccttctcaccccagttagcaaaaatcaagggaagagcctagtttttttaaaagattcacttaatatccaccccccacctcaagcccaagaccgcccattcaaaaaacaagtatacggcacagcaagggagacccactagattttgagcttacagagacataagggtacttaaaaccctgccggcctagtatttgagcttagaacttttatttaaaatgagccggcagtctctagacacacaccgatcctcaggctagtccgagccctgaggtcaagaatgaaatgcacttcccttctcattttctcaaatagatcttttccagccgtctcacagttgaccccaactttggaactcagatcataggatctcccagaggtttcaggtgttcctaagaagcttctaaaggaagttttggaagaaagactaataggtgtaaacatataaacatatatattatatatagctatatatatttaaagagatctctacatatatatatatatataaatacaactactgtactctctgcatctgtacaaagtatgagttaaactgcccaggtagtgtgagatacgtaatgcatgaatgtgaatatcctgaaatctgccttcttagcaacgtgccgcgtgtactggagagaggacagttgctcctgggagttctctcaatgggcaaatgtacaagttgatgccgtcttatccaccaacaagccattaaggttggtttcctgctgagacttttgtaccggaagcgagaccggcagcactgggggtgtccatatgccacttatgaggaagaaagcaccatgacttttttattttcaataaaaatatagagatgtc

SEQ ID NO: 2877 - DNA, 6984 bp, Homo sapiens
gtataatttgggttgttcacaaaaatcatcgtgtttgtttggcgcattcaatttaaaagtataactcaactcacccattcattcagcacatttatggagatggtgtgggaggcagagtgctcagcctgaaataaaacaatcagcgcaaactcgctaattgaacttcatttaaaacggttgacatttttcttacaaataggttgacaagctgctgaacctaaggaatccagcatcttttgattcttgtgggttgtattggtgagtctgtttcaggttactgggaggaggcaggtctggcttgtctttagtgacaggcttttgttgcaaggatgcgagggaatgaagggtgcagggaaaccgtattctccctgggtcccagggcttcccaggttggactctgcagaaactgtgactcagtgttgtttgggtttcaggctgagcttgaataagctgccctttcagtatgcccttcatagtcctgtatccccaaagagcatctgattgtgtcagcttgtctttgttcagtaagaagtgaccacatagggcagggcgtccctccacgccatctctgaagcataaggtcattacgacaattaaacgagttaaatggagagtccttagaacagtgttttattcaacacatggtgagtggtgaatcaatgttgtcattcttatgaaacaagacacaacgcaagaccctaggatgagagtgggagagtgcaggaacgaagtgtaaaatctaaccaacgtttgaatattctgattcaacctcatccagatataaattgttcaagagcctgctctaaaggtgatctgggctttagagtggaggcaagttcagaagagaagcagcatgaccatctcttaggtttctgccttgggatcatgggcccaagagagttgcaccagcctgaattggttgacaacacaattcatgatgtatattgacaaaaaaaattccacttatacatttagattctgcaaaatgttgagttttatttgatctgaaccatttgctagagagtatttggatagattcagatgagggaaggaaaagaaaatggctttgccagcgacgtgcagtgctcagcggagctcgggggagtcaggctcacccagtgctcagtgccccacatagatcacctttgtggagcacatagtatgtgctatgtgtgagcccctcaactctcacattctgaggggaggcactgctattaatcccattttacagagggggaaactgaagcatagagataaacagtctgacaagagccaatgttcgtacccagcagtctgacttcagacacttttgggtctcaagagtctcgatttctagttttaatttaacagcatcactgtaattggtgaagtcttttgttcttctttagatctttggaagaatgctcagcttcatgatgtcacagagaagcacagttgattgtgctctacctcagtgtcattttgatcttccatgttatgaaaagcgttggtccgccaaccatgaattttacctgagcccttctatgcgccactcacagtgccatgtgtaaagcaattgtatgccacccccatcctctgcctgacattcaggaattttacagctgatacattgtttagggtatctgcgtttcctttttctatttttctatagaaaactgattccaaatcacaacttttttttcttcccccaatcccaacatgtatctgtaaatgtgtaattgttgtgagtcacattgatacttcttttagagattcctgtgtatattccaattcttgaaagagacctactcaaaagattgcctcatggacaaatggcataacagccttaaggatcttaaggaaaagcaaaataaaattaaaaagacttctgcccatgcgtattgtcaatcatggacagagatgttaaagaaaaagtgctctgttcttttgcaagaccttggatccttttttctggcattcttgggtcattttcctctaagtcaagtctttcagagtatttagcaggcagctgctgatagtatttggttcacagaggctgctgatgatgagaaaactttctttgtggaatccaaatgcctccatggaaggacagcttctgcgcagacgatgctgaaaagagctgtttgaacttcctttatccttatattccttatgtaagctcaaggacatttgtttgtttctgtgtttgttcttaaataatgttttaagtattttcctctttgatgtaagagcaacacatacttattattgtggggaatttagaaaccacagaaaacgataaagaggaataaaaaaaatcattgaaaattctcttctcccactattaacctttggtatatttccttttggtctttttttcttgcttattattatcattagtgtttataatcattataattacgtatccaggagcagataaaacatacaatttcatgtctagttttttccaacattacttaatttctccaaaaacatcatttttatggctgtgtaatagctcataatgtgagtataccataatttctataaccatataccaattgttggaatagtttaggtcgttttcagtcttcacaatagagtatttaatgtctgcaatatgcttcttacataaaaggatatagttggtcagccgataacatttggaaattaatacttcactagagagtatctgcaaatgacttttccttctcaaactaatttgctagatagaaagatgtaaatgtttatatagaaagctattgtctagcttatatctatctccatcttctctgagcatctctctccctatctatactcacatacccacaaatacactaagttattataaatgtgtatttatatatttagtagtagcatctgcttcacataaacattatctaactttgagaaattaaatgatccctgcagagttccaaaagttgggtcaattatatgtgtgcgttattatttattctattatttgctacaaatcaagctcagttgatcatttccatgtcattagaagataagtgtatctttctgagggctaagggtcatgctgagctagaaggttgcaaggctggagaggaagtgccttctctccagcgtcagcaaaggctgcggacaagcagggcatgaagcagggcatggagaagggtgagccagctgcccagttggctatggcactgagtgtgtgaaggagggaagagagaaaggagattgtgctggtgaggagagtcacacaggaagggcctaaaacctaggcctttggtgtgcacttcactctgacagacagtgggaagccacaaggcttgagcacggaggagagagaatgaggttggctttagcagaagtcatctggcaataggatatgaaatgaattggagcagagaaactctggaaagacagactctggggagtggatctgcaagagggaagaagaccaatacttactgagctcctgctgagggccagacagcatttcatgtaaactatctcattttaccgcctgtccatagagatgggaaaattgagacctgttgaaagtcacagggcagaaagcgacagagacagtgttaaactgaaaactgaagctcaggctcacttgactatgccgagctgcctgggttcaagggaagaagggcagagtcagagcagaggcagcatctccaggggccgagaggaggagctgcaaaatctagttactgtagaggcaaaatcaggtgaacttggcaacctatcagaaatccagggacaaaaaggaatgaaactcaaaatgtccctgagatttgggggacagacagattgcgaggatggtgatgccattgtcatcaataggggatgtgccctttgatagtgaagatgagaaactgggttttagaagttctgaattagaggcacaggcagaccactcaggttagcatgtccaatcagctgtgagagatgtggatcagaagcccaggagaaagattggcaccactgatggagatgtgatagacataagatgcatagaaatgcacttctgattcatgtaagttacaaatatatatgaatgaagctaaagcacaatgtaatattataagcttatataaatgtaaactctcacctttcaatagggagaatattctttttaaattctttgttgagtcataagatctgagagccagaaggagccaggtttctgctttcttgcagttccaaaactttgagtcttgctgtgtgttctcttgtgctgagtcttctgagcaggcaggacagtgagttccttgtttagccttgttaacttcctcaagaacatgtggaggacacaccagtgagtccgtcctattcatagacatcggaggtgctgtcccaagtccagagacattcccaccacctctacatccaaatcctacaagcacggaaggccctgactctttttcttttccagtgacagagaccatgtctccagaaggcagaaataaatcttgaacttgggaattattttgtgctactgagtaggaggacacaggaagtataaagactccatgagctagtttcagagaaatatcttgcctcttgctcctttaggaatcacctggagagcagaacaggctggctatcaatatataaacatcttgccttaaatattttacccatcatactttaaaaaatccacgatccatttagttttattccaacttggaggtaaatcaaacacaccgtttcctttgggagaactgaaaaacaaaggctttgcccaaatgtttctcattttgttctggattttcacatatctgccaatgaccttggcctcattagtgagcaccttattcaagcaggcttcgatagcctgccacagaacaaagacaacatcaagggcagagggagagattggcacacatggggctaacggggtggggatgcttgtctcttgtagaaccagacacagagtacataacgagcatttacttaacaaaagacccaacagcaaaacaccggcaaaattcaacagtgactgactacacgtgaagcatgaaaaatgtttccagtcatgtgagacgcttcaagcatagaaagcaaaccatgcaaaatggaaagcgttggaaaacataaaagcaaagccattagacatcacttttgaacaaaacaaatagaaaagcctttctcatcatctgcctgtaagtgagctgtgtacagtgcactgtcgacggttcctggcacatagtaagtgctgagtaaatgtcagctccttcctcccttgctacctcatcatccaggagagacactgtgggctgctagtcattcatgctcctaccaaatggaatagatggattccttcatcccatagagatttagagcttctgctatgtcttagatgctgtgagagacacaaagaagaaaaaaatgcagcctctgttctccaaacaattggatgactgcctaagatgtgggagaacagtaggaaagaacacaacaagagaaccccaaggctttctggaccagcggccttctcaagacagaagggctggtgtcttacccatctttgtctcttcagggcctagaataatacctgactgagagatagacctcagtgaatgaacaaatgaatgagtcagtgaatgaatgaatgaatgggcactaagtgaggggtcccacccacggtgatgctacatgattggcacttcttacagaacgggtgattctagaggagctgggagtgacttgggaagaggaaaggtgcctctcacctgtaaactcatccacttttctccctaccccccacctagcaagctgtgttctctcttgtttcactctccactagcgccttccactgaatgtgcctgtgtgggtgtacctgtacattgcgtgtctgtttctaagcctttttgagcacttacatagcagttactttgtgccagcctctaagtaatatgcaagtataattctcataacaatcttgtgagataggtactattattagaccttctcagagctgaggaaactgaggcccaatgatattaaggtcacatgactagtaagaggtagatccagagcttaagtccagacagtctgactccaaagcagtgtcctttaccgctgaactctgctgtccacgtttatcaagtagaaccaggaagagcttccctcagtttgcctgtggtctgctatattgacttggatgagattcagagcatgggaaaggttaagtcccaggtattaggttcatcctctctgctaagtctttctcctcttcatagaaatatacttaagtcttacatcctttataaaaaagagaagtcctccctgactctgtgttccatccacactcactgctgctccatttccctcctcttctctccagccaggctacttgaaagcatactagttaggagtgactttcacttccttacctcccactcatccccagtaacccaatgaaattgacttccactaaaagagcccttgacaaggtcacaggggacctcttctagttataaatctagtaggggccacgcaggaaaaaaaacatgctgtagtagaaaccatgcttcctatcattagcacaatgcctggcacacaatcagcactcagcaaattgcagttgaaggttttatgatcttatgtcttatttgatcccagtaacattagccatcagtgaaacctgttagttccttcacttccatggtgacccttatgctaggtttgccctacacttttaggtcatctgggttcattctccttctcttcttcttcttatcccttaaatgtcggtattcaaattctattcttacccttcttatcttctcactttatgttccatctctcgaaaagcaggcattcaatcctacagctttaactacgtgattttcaagtcagtatctcaagtaataattgctcccctatgtgctagacttgtacagccagtgccataaagggcatttccaattaggtgtgtattaggcacttaacgaattaaacttgacaaatttctcttctcttatgagatttgtccttccatgc

SEQ ID NO: 2878 - DNA, 6021 bp, Homo sapiens
ctgcgggagctgcggcagctgcggcctctgggatggagagcaatacatcatcatctttggagaatttagcgacggcgcctgtgaaccagatccaagaaacaatttctgataattgtgtggtgattttctcaaaaacatcctgttcttactgtacaatggcaaaaaagcttttccatgacatgaatgttaactataaagtggtggaactggacctgcttgaatatggaaaccagttccaagatgctctttacaaaatgactggtgaaagaactgttccaagaatatttgtcaatggtacttttattggaggtgcaactgacactcataggcttcacaaagaaggaaaattgctcccactagttcatcagtgttatttaaaaaaaagtaagaggaaagaatttcagtgatgtttatactaataagtttgctagtacagtgtcagttatttaaagtggtaatgcccgataatgtcttttaaatgtttgaggatgttttaaatacatgcattgtcttcacgaagaagatgtaaaaataatgaacaataaattgcggtggaaacctcttcttcccacttgccaattcttgagaaaaagggatggtattaaaaaaatgaaaggttggagttgtatcaagataagaatgtattttattaggaatttagatatgaattttacaaccaagagctagaaggtaagcatttggaattctttatttcctattcaggagttaactctttatctcacatagtttttaagtggtaaggactgatatttgatttctctttaaaatttaaggcttttgctgatacacttgtgaactaggcaggaatatcttatacgatattgtgaaaagccttcacactttgtacttgtagagtaatagaagtatattaaatttttagcatggaatgaaatttatcttagagaaactaaattactcatttaatgacttaatagttcattaagtcattaatgacttaatagttcatttgtcattaaaactatacctatgggcagaaattaaaaggagaagatttcggcattgtatgaggatgaacttttgaaacagtgtagaaatgtactttagttggcatgggatggtggctcacgcctgtgattctagcacttagagaggccaaggcgcaaggatcacctgagctcaggtgttggagatcagcttggtctacatagcaagacccccatatttacaacaaataaacaaaaattagcctggtgtgatggcacatgcctggagtcctagctactcaggaggctgaggcaggaggatctcttgagcccaggagtttgaggttttatatatatatatatatataaattttgaggttttttatatatatatttttggaaagtagaactctccacctcacaatttaacttgagtacatttcatatatatatacacacacatacacattttatatattaaatgtacttgaattagattgtgaggtggagagttctgctttccagaatttatgtgtattttatttatttatttattttgagacagagtcttgctttgtcgcccaggctagagtgcagtggcgcgatctcggctcactgcaaactccgcctcccgcgttcaagcaattctcctgcctcagcatcctgagtagctgggatcacatgtgcccgccaccgcacctggctaatttttgtattttttagtagagacggggtttcaccatcttggccagactggtctcaaactcctgacctcatgatccacctgcctcggcttcccaaagtgctgggattacaggcatgagccaccgtgcccggccttatgtgtattgtaatacatatatatatataaattctggaaagcagaactctccacctcacaatttaactcaatttccaagagcctttgaacacttaatgtgttcaatactgggaatactattcaaactgatttcaattcagctaaacttagcaaacaagatttatcctataggaagtcttactttacaatgattgaagacgttcagtacttcattaatgaaatcgtctttccagcttcctatcaacaagaatttttaaagtgcctactatacaaagcattttcctagttgatcccacagagtcacttggggcagattaccagatgctgagaagaaaaaacccttcatcagaggtggaggaaaaatggatttcaagagtgcttctggtttttgtcaggatggaccagagaatctggaacagtcctgaagaaaatagctggtggcttccttggccttttgccatcaatgatgcttcttacttggatttaaactgccattaggaaacctcttgatcaagaatttagacaagaatttcattcccatgtgataatttaggttataacactagaatggaacaaagagtagaatgtctttagttctttattttgcattatgtcataagaaagttcttgctatgttgtaaaatcgttgttagattcaggcttttggggattctgaaaacacattttgttagagttgaagtctattacctgagaaaggtaaaattgtgtcataattgttcatcatactaggtattaagggtagagacaagttacttcaaggtatagaaacactgaccagtactcgactgtgaaaaacatctttacctttagcattttttttttgaaacagtctcgctccgttgctcagactggggggcaatggcgcaatctcagctcactgcaacttccacttcctgggtacaagcgattctcaatcctcagcctcctgagagtagctgggactacaggcgagcaccaccacacttcgctaattttttgtatttttagtacagccaggatttcgccacgttggccaggctggtctcaaactcctgagctcaggcgatccgcctgccttggcctcccaaagtgctaggattacaggcatgagccactgcacctggcctgtgaagaaacatcttttatcaatgcttcctagactggtaggacatagggtgagaggcgagtggtggttcgttcttgattatgttcagatcttgaaagaattcaacattagggagagaagccttatcaaaagcctcaaaaactctactgaaggtaatatgatacctgattctcactatggctttatttaaaatagaagaaataaacccttctaatatctgcatcttagtcttctgaattaaactcattgactaataaaagatttttactttggagggtttagcactgcatcaaaaaggaagcagatctctcctatttgttaaacgctaaggaatgaaagaaaataacaataaatctgacctctttttgtcatatggcacattaaatatctttgaaaaaaaccccaaaacaataataacaaaagcttgccgctctaaaacgtttaaaatatcggacacaataataaatttttaaaaatgcaaggctaagcaggttttaaaaagtatagggactctccaagaggaaaacaaaaccaggagcagaatccaaggatatagggaagcactgaagccagcagctcccttactgacagtgccaatcgtggaatgccaacagctttagttttaactgtatgcaaggggctggttacaaagctgggggttaagggagaaagatttagataggagaccacagcataccaccactaaatcttcagttaaaaaaattcgtaatatactttcagagcatagctgatgatttgccaagacagacaagcgttcagatcactaaaggtgtaaccattaggtaggtgacttaacctcccagaacttcaagtttcttataaaatgtaggtaatagtactttcctttaggatttactttttgaggaatggagataatacatgtaaatctttcagagtggtttttaatagacaatacataatggctatcattaatcacaatggttcaggtatgtgtgttttcttgtggacccatcagggttttccaagattcctgcctgtacccagccaagaatttagggggcaggggaagcctctggggtttcgtgttgtcttggatattgatttccatttcttctccctttccataccttacagctggataaaagtaagataatggtgactaagaaaaacttgtaatttttttcctcagtccttatttttacattttttatttacatttttttttttttttttgagacagggtctccctctgtagcccaggatggagaacagtggctctatcatggctcactgcagcctcaaactcctgggctgaagtgatcctcctaccgtagccttctgaatagctagggctacaggcacatgccaccatgctcaactaattctttttagttttttgtaaatatgggggtcttactgtgttgcccagcaagatccccatagttacaactttttagttttgaactcctaggctcaagcagtcctcctcctttggcctcctgaagtgctatgattacaggtgtaagccacaatgcccggccctttattttaagatctgaaatacgagctgtttactggagttcattaatataaaaaactaggccatttttcactttatcattagataatcaatttacattttaattgccaaaatatctgtaattgaaaagctgttgaagaaaaaaagggatcttctgtacctggattttactgtttactgataaaaaattaccatttgaacaacatcttttaaagtcaggttttcttcataaggtttaatattgttaaaatttattaaatctagtatgtataatttgtgatccttcttgtacaagtgttgaaatgagtgctgtaaaatcaaccaaatgttttgaagttttggtgaatatattctgatgtaacttgctttcagttacccacagttcagatcttagaacttttcagaaaatttttatgggaattgagagaaaaatgtctgcaaattggcactgaaacagtgtttttatttgcatagttgactttttgtgtttggatgataacttttgccaaaggcaattttgagtagatcttttcacaaaagaatcctattttaaaactttaaataatttgttttcattaaatctaatcattttgttataattgaattccatgggtaaagaatctttaacttcatatacttttaatacttacataaaactagatacattaaaaggtcaatattaattatcaaaacttaaattttaccttgttcaaatacaagattactaaaggctttagattttttaaggcatattataaccttaacattcgtatttcttgaaagagatagacagacacttgtttaatgtgcatagagtttatttggtacatctatcaatttctacaataactgaccaaaaacagttcacacagtgtccacctgcactccatgtctaaaatgatttatttagtagggtattttgcaaggctagaaaggagagaaaggatttcacagtatcagtgaaaactgttttatcatgaaacaaatgtaatacattaatatattcattcattctctattagaaaacagcaaaattacattgttagttgtattatttacagtgaaaacttggaagacttgacaaagcatcagttagtttatcaacagacctaggaagctccctgtcccctcctttcagggtcctttccttggaaatgaaataaacttaaatcagattttacataactttaagcaccagcttgacaatttaaagttttatttcagttttataaaatactcctgctttgaaaggcaaagtgaatgtaaaaatgtgaatgtaattaaacaagtcactggcctggaaactttttattgcaatagtctttatgttttactactatattcacttcttggaatgaatttgcttgtaggtttgaaacaaaatatttgccttttgtcttgaaaaattcccttaaaaaattaattatttttggaactgtacaactacattttcattcgatgttaaatatgcaacttggtccttggatatcatgttacaaagtccaacctgttggataacttgttatagaaaacaataaaaaaccttaaactatcataaaatattact

SEQ ID NO: 2879 - DNA, 1427 bp, Homo sapiens
gcagagatgaaaacatcagtcaggctctggggaatctgagaactctggggctggtgctagctcctctaggttcagcatgacccacagctaagcagaggagcggaaggatggttatggagagtggaagtcctagacaagaatgaacagtttacagccacttgtagaactgtctgtctctttccagtatctgaactttgacgatctcaaagggcatctctgggaatttttgagtgtcagcgtgccactcaaagggtggcgggaggggcacctagcagtcagtgcagcaaggcagacaggacccgcatgccagcaccctgcctgtctgatgacactgattccgaaaggggcactttctcatctatttcctgctttggaaaagggcactccggtcattccagtcaccgaaacaagagattttggaaattcatgccgggcagagtgctgggcatggggaatttggtggctggcaagacaagccgcttctgtcctcaaggcctgactctgaggccaaaccatcactgagtcagggcccccagagccctgcatgttgaccaccgtgtggatggacaccatgtggatggcctctttcaacatcttctaactcagctttctcctgcagccagtgagctctctccagagataagtgcagtcatgcccttaccatctaatacacagcagtttttcatcactgacagaaaatgtacaaccttaacccatcatgacttacagccctccatgtctgatcgtagccccaaacacaccatacctttcacatccgcactgcatccctgcattgtaccaccagccagccaccttcctcctcccttacccgctgggggatttgcacagtcgctgtagaccccagcctctgtgtgaccactactttgaagacttcctccttcaccctcttaggaatttagcctttctcacctaatatttgtctccgctcattgaacatgaagtcatggtttctatgctggttgttattctttctgttatttacagtgttttttttgttgttgttgtttttttttaagaaaagagtgtgttagaaatactttatacacaccacataaacttgaagtctctctgaagaaacgtttatggtttagaaatttatgatacgaggtttaagatagtctatttcatctgatgttttgcctttttctcatgtcaagtgttacctcactgttatgaatgttgccacactggctttatatagccaccatctatcactcttctgtttgtttagtaaacatctatctccatctatctgttatctatactctatgaatctattgcctatctgccagtcacctctcatctacctatccatctcaatgtttgttttgactcatttgaaaataagttgtcaacctcacaaccacaagaaaaagaaatcttgcttccatctcaatcccttttgt

SEQ ID NO: 2880 - DNA, 4119 bp, Homo sapiens
gactatcagtgtgcagatatgcatttagaagtggcctctatgggataaggtagagtcttgtctggagggttgatacctttaacatgacactgtagaggaaagcagcattgataataatagatattggggaaagactaggttggaaaagaaataagtgacaccagatgattgacatacaacatgaagattttaaagcctgagttgaaactttcattataattaaaaaatatatattattatttgttctggaagttgttattgttgttttgttgttgtctgttaagcagggtttttgaagggacctgattcttacaggaggagaaaggagtttactacagttaagagtctaagagaaaaatctagggtggatatagaataaagtttcttcctttggatgcaaaaagaagaattttggctgatcactgaaggatatacttaagccagttagaaaataacttgctcccccaaagatgaaggatatatagaataagaagccttgagctggtcagttaagcaggcaaaagaaagagaagagagaggtgagaaggcaggaaggagaaataaacgtggccatgaatgctgaaaccctctgtatacttgtaatttgccctatttgcttgatacttgtaccttcatattcttcttgcagctataaaatcgcctgagcactttaaaggcacagatgagtgcaccgtgctggaggagatcaggctggcaaggaatgaaaatcatcagtgaaaggccagggaagaaccccgggtgcattgtctttagataagaatctctgctttctgaaatgcaagacagacagatattgaaagaatagcaaagccaactggttcatcctaagggctatgtttttaacatagatgaattactagtcaaggagagggttacatcaggagggttggaagggaatggagaaaagattcagaagaatgagcctggaaatgaaaattaaaacaaagagatgtcatttgtcaactaccaaattggtgaagacttacaaagaattacagtacccagcattttctaggataaatgaagaatgggactctaatttatacattactagtgggaatattcatcagcacagactttctggactcaaatttggcaatgtgtgcagaaagccttaaatacgtgtactttcaaagccattgttttagttaggattagttcagctgcgtgtgatagaaaaccaacttctaaaatgactgaaacaagataaaagtatatttctctttctctctggaggtgggcagtccagggctggtttggcagccatagaaggtgatatggacccagagacctatatctttttgttcgatcgccccagcaaagtcttctcatatcctcggtggctcctttggctccaaccatcctgttagaactctgcctgaggaagaccaaaagcagactttacctttaaataacactttgaaaagttgtactttactacacttttacttctagctcaatgcctagagcttctggttgaaaaggtggctggaaaaaaatgtagcctttatgtaggcatccatgtgctcagcaaaatttcagtgatcaaataataaaagcaaggaacaacgagtgagagcagcagcctctgacctattccacttttatttatataaggaagtactcagaaaacaattcaaaagtgggtatacacacatttattgcagcactatcataatacaaaaaaatagaaatcacttaagaccccaaaaaggaagtagttcaataacttataatacaaattataatacatacatgtataggatactctatagccattaacatggtatataaaaggaccaggagctgtggcttacacctataattccggggctatgggaggcaaaagcagcatcacttgctaagaggacttcaggaccagcctgggcaacatagtgagacccagactctaccaaaagttaaaaaaaaaaaaaaaaaaaaaaaagccaagtgtggtgctgcgcacctatagtcctaactactggggaggttgaggcaagaggatcatttaagcccaggagatgaaggctgcagtgagccatggttgtgctactgcactccagcctgggtgacagagctagaccttgtctctaaaacaaacccaaaccaaacaaacatggtatataactgaatttcttgatgtgaaaaagtaattgcgatgtgttaccaattgaaaagcagtttacaaagtggcatggctactatcattcatgtttgtaagaaaaagtctaaataaataaaagtcagaatagatatacgttaaaatgataatctctattgattggaggaattgttggcaattttaattttcttctttgtactttgtaatttctgaatttgtcaccaatgactataaatgtatatttaaaaaaaatcacacaccaggattctatacctattttgcactgccaaagatacacctttctttaaaatcttgctatttctcgaactatcacagtatttgctcctccttccacttttgactgtttccatactaatcatttctaaataaaattaacacatcaatttccctataagaacaactcttaccatactatttctgttaaaccataaatactctggaattgcttcttgaattaaaataaataaaattttctttccttgaacttcaaagtttttcacttgatactcaaaacctactttgttcatttcatcatgccaatgacatcttccctgacaaatgtgttattagctggtctcaaatacttccagtctttttctgcttccaggtctctatgtcagaaatactcttctttctctatctttcaatgttaaaatccatcttccataatctttaagatccttctcaaatagtgtctcccctgtaaagcaattccagtagatgtaatctctacaaacttttcacagttgcaatggttatcttcagtattatgtaaaagctattttgaggcttgtcttcttccttttgttagaatcttgcaaattctctgaagcccagactttaagttattcatctttgcatcctccattatacctatcacagaacttaagtacaataggacctcagccagtgttccaggaaataaattaaattgaatgaaatttccatacagtgataagaaggagattactgctgcccacggggaaaaaggagaacagaaatgggaaagccgtattgagaggatgtttgagaactgtgaaagacagaaagcagaccagattgccatgcctaaaccactttctttgaagtttatggaagcaccactgcatttatgccagaaggtgaaagtccagaacaggtgctttttggtttgagaatgagtgttctacatactggcctgtaaggcagtgctactccaagtgtggtccacaggctggcagcaacatcataggggagtatgttaacaatgctgattctccagccccagctccggactctgttttaacggtctatccaggcatgaattctactcaagtggcctgcccctcagcagaagttggacaggtgcttatgttgcaattaacaaaaaggatacatgctgggtcctgcagtaaatgtctcccttggatcatgaagtctttttaccatgttactggaacacagaagggtactattgagaaccaactaacttggagccgtgtatgagccactgggaatagactaaatgagataatcaacgtcttgatctcatattctttcattctacagaaggaagcaggcaacaggttgcaatacgaagtggagttaaagcaactagaaggaagtgtcagtaaccaagctgagagaggctggaaggaaaacaattcatgcagcagaaaagaaagccttttgagcactgtgatgtcagaaggtgacttggaagatgatctaaatgttaaactggcagtgaagcaacccaaccagcaagttgcttttgctgttgtcttttccagatgcgcagaggttgtagttctgctcccctccccgtcaggtttgtgctttttgctattctctaccaagtcatgcatgtgttcacctctgctcctttgcatagcattctccatttctaaagctcgctccttggcactaacctcatttaaatcaaacacatttctctctaagtccctttctctatg

SEQ ID NO: 2881 - DNA, 9689 bp, Homo sapiens
gaatctttgattaaagtcgtaatcgttgccgattcagtaaggagggggagttggatgtcagaccagacagggctgtgagtgcagacacacggagagagtgggttcgggtgcacacacagactggcccttactgtgttagacacacaactaattagtaccagggtctgcacaggcctccactcccttgagtttgatggggctgggggccaggcagtccgcatggctctggcagtgaggatgggcaggtagcaatttccccaactgagaaccctgggccttggcccatccccagatctgcaggtgagggactcgctggccgagcctctgagccagtgcaacaccccatagattggggtgaactggtgtcaaggcacgatgccactctttgagcttctctcatctgattccctgatggaagtgcccctctcatggcatgggtgcttcttgcaaatcttccacccatgagaaagtcactgatcagaccccagcatccgctcccctcagagccctaaaaacccctcagagccatcagaacagatgagaatttatgtgggtacaggggcctaactttgggaggggggagctttggttagtggcccgaggaggggagagacaggagagagtaaaatatcattttaaaaaggaagtgaaggcacaggcatgcgagtctataacgagaaggacaatttatgcccaggcacgagcgcagtttgacatggggataatgcaaaaacgtaggtcattgtggatgacttaaaccttcagcagctgaagaaaatgtatgaaatgcagaggacattacacggttggcagccccgcacatctgcagagggacaagtgaaatacagtgggccattctttaccataaactgtggttgttggagatgcagcccagagaaattgtaattacagtgacaagacgaatcagcgatatttaaatattcatgaacaaagtctggggtgatcaatctatctttattgtctgcgccttcactcctgtaataaataagtagctggagtcctcacctttcatcccccaagccccccactttggatatgaaaggcaagatggttattctccacaccccaacctctcatgctctggagatttaagagtgggatcctcaaaaaagaaaaggcagttctctccaagtttcatagacccaccatttcctgggtctgttctggatcctccctgtgcgatacactgaggctacaaggatgggtgaggcttgcttcttatcctggtggtgcttccatgctggaggtatggtgggcaagccagtagatacagcatagtgtgtcagcaagctgacaagtatatggtaccctgactctagagccagacccaaacctgaatcccaactcagctccttacttgccgtttcaccttagggatgatgtggaagcatctcatttttttctcaactgtaaaatgagactaatatctttctttaagtttgttgccatgatcatctgatgcgatcacatcacacatctgagtgctcaggaaatgtagcccattttaatgcgaaagtggcataaaaatgataccacactaataacagaacaaaattctgggcatttcttctctttggggacacagaagaaagtgtgattcattctgcctggggaactaaagggaagcgtccacgcgggggtatcatatgagctgggctttgaaggatgattaggagttcaccagggagaaaagaagaaatcgagcagaggaaacagctatgtaagactgtggaggaaggaaattggggactgtagaaggtgtttgggggacaatgtgaagttcctcaaattggagagatttctttgaaggttggggagtcaggctggagtgactttcacccttaacctaaaggaaggggagaagaggtcatctgagaagcaagatggtgaggtctcatgtatccacaagggggcttgctttctggggactgctgtccatccctgaaccaaatgggctctctttcccaggactggcccttgccccacagatgatcatggggccacagtaaagtatggtcatgtgtgaagacaggtattgcttgtttattcaatggaggtgtggccgtggatccttaagttgtctttggaggtggtgaatacaggccgtcgcatccttctcatgcacagaatgtgccctactgtcccctgaagagggggcagggagaggcaaaggcctgatccagccccttgtctccacaggcgaccacccctacgagtgtgagttctgtggcagctgcttccgggatgagagcacactcaagagccacaaacgcatccacacgggtgagaaaccctacgagtgcaatggctgtggcaagaagttcagcctcaagcatcagctggagacgcactatagggtgcacacaggtgagaagccctttgagtgtaagctctgccaccagcgctcccgggactactcggccatgatcaagcacctgagaacgcacaacggcgcctcgccctaccagtgcaccatctgcacagagtactgccccagcctctcctccatgcagaagcacatgaagggccacaagcccgaggagatcccgcccgactggaggatagagaagacgtacctctacctgtgctatgtgtgaagggaggcccgcggcggtggagccgagcggggagccaggaaagaagagttggagtgagatgaaggaaggactatgacaaataaaaaaggaaaagaaaaaaaaaaacagaaggaaaaggaaacctggtagctttttggccttggattctctctgggctccagatgacctggatgccaagccactgcccctcctctgggggcctccaccctcctctcccggctggaggtttgcctgattttctgggatggggttgggtattttgttcactcaaatggtggcacatttttctccttccttcacccagaccttcttttatgtgtccagaaatggaggctagaaagcaggtgagaggtcctctggtcagagccacacggtctgtgccggccttcctccaccaagacccccaggagatgaagggagggaggaggtgagccagaagggcgctcccctgctgatgggtctgggctgggtcactagctgctcaaaatggcagctctagtttgctggcggctgactggggaggagaagggctctgtttctcttcccaccactcagcccacctgctgctttcctctgctttgccacatctgggtgtcccccggtggtctctgagagcctcaggacccctgcccctcctccagctctttgttcccagcctccccttgactcctgtcctccaagtcccaggggagtcccagcccctcagggacctggcggtgtctccatccttctccggttccctagtgggatagctgcctctgacttcagggtccctcctaccctcagccttctgagaacacaaaacaaatccaataccccaccctagtccagcaccatcgtgagcaagattcctgctgcgctgcttccaaaatggaaaagcatcacaactaaatacctaatatcctaccaaacaaaccacagtccctacgtagccctacttcagtcccaggagaaggaatccatgaatgggctgaggttccgagggtaggttgtggatgtctttctctagaggggtcccacacctggaaaagaggacacccagcccgtgggatgagggaagctgggcaagggagaaagttgttgagtcacactggggaccccagatgtagtgagctcagcaagaaaagccaggtccagagagagtcgcacagaattcctgactcacagcgcccctcggtccacagtggagaggaggaggaggaggagcagaaggagggggaggagctgcaggaggaggaggatttgaaagcgctttggccttgtgttatgttttgcttcttttctgtgtcccctgttagcacattgtacttgaattacctcagttttttgtgacctcatgagctttcttaacctctgtatctctttttcggttggggcttggaggaatggggagggtgttcttttctgtttcttgtgtaaattaatagttgtttttatagacttcagctggtcaagaccctccccgtgcccctggagaccagcctcccagctggcaggaactgtgcaggaggagttgatactcaggatctgaatgtgagggccgaggagggcgaagagcgtgggtggggaggggatgttgctttggggtctcatggtccccagagggcactagggagtcacttttggctccgctggtgcatgaagtcacctgtggccaccatccgttccgcctaaaacactctggagagaatcccacctttcttacaatttgctgggccattgaggtttgagggcctgtgtttggatccttgcaactgtgtggtctcacctctgtgcgtgcattctcattgccagaattggtctattttcacggctggtctttggggaggggggcgggatccagcctttgttttgttgtgttggggtgggggtgttgtttttctaaaagctacctcttatgtttgtccagttgttcttttgttcctttcccgcctcccattctgctgctcttcctccctcttttccccaacctcccccgaccctcctgaattttggaaagcacatttgcaatattcgtgtttgctttgggacggaccctccgtttcatctcatgctttatgtgtaagagttttttattattattttttctttcctttctctctctgagaaagttgtggctgcgttttgatcttaggttttacaaagtggtttagggaagcggttttggggagaaggatcacgaggaatgtagggaagccggagggatgggtgctgctgcgacgacccccccgtccctcggccccagccctcctgccctccccttcaatctcatccaccaaatctgaaggccttaaaattgtgtgttgggaggatgtgaattgggaggacggtgtcactagactgtggattagggatggtaaagtagggaggatgctattttgcaactatagtaacgacttagtgttttggaaaggaaaagaagttaaacttgaaatacgtgactagaacagttgtcatgtttataatgtgaaaagggtgaaatcatttgggggaggggccgtctgtaagaaatcattatgcactatggcttcctcctctggtctgggaagaagcggggactggctggccctcaggggatctgtaaatcccagaaaacagtatttttaacagcaagatgtcattcaacattggtggggaaggaagagaaaaaaatcaaactattccatagaactagctggccccctcactcccatgcccttcccactcagcctgggcccctccccgctccattcataaaagctgagagggttgagctaatcttcacaaattgtaatatttttgtagtatctgttagttccttcgtcagttctgcagaaccttgccctttccttttgtaatgtgaataggaagacaaaagacaaaaaaaaatccaccaccaccaaaatatccctttgtacatgtatgtgcgtgtgcgcgtgtgctttgtgtgtgtggttgtgtgttaaatcatgcagtattgtcgtaatctggtgttgcagcaatggatggtactaaatcagcacctggatgccccacccaaccccgtgggccctgcagaccccagtagggaggtatggggagagctcaggggagtgtggtttctgagggctactgtctggggacacctctgaacttactgtaccttcctctccccatgaagacacctgaatagagtctaacatgcctcttctccaacttcctacctacaacaacagaacagttctaatgttgcacggcctagtggccagggggcaagctaagaggctgtctggaggctttatatgtgtctggagttaaggggagaggaggagggtagacaggggtctctccccaggtgggatctgaatatctgtcctcccctcttcttcatgccacctgactccttcggccccctggctgcctttagctgtggtactgctgacaaccctgcttgctactgccttatccagcacagtgaaaaacttctccagcctggcaaggccacgttggttaatagtccctttcccatgtccagctcctacaaatatgtcccttaatgcatttggtgacatttacacctcatgtgctctttccctattcactccttcactcattcaaagcattaaaatcctatgtatatataggatagacaaatatatagatatatagatatatatatatatagcaagagattgatataaaatagtaaatatcattgctgctttgggctgctttggaggaggaggccatgaatatggggaaggcagatctggggtgcaggggtaggtagggaggctgggggacccagtgattcagtacaatccaagggatgcaacgcgggcttgtttaatctttgtgcctgaacagtttttccatgttgagaaaaaaaagaaaaaaaaactgctgcaatttttcacaagtgtatggtacctttctggatgctattggtacaattgctgtggatggaagagggccattgagcttacctccctataggggagagagcagaggtggggcagcctttcgactctgtccatgacggctggcagggtcagggtagtttctgggcctgcttcccggcaagccgagctagggtgaaaactgggggcgcaccaggatgtgagacagaaaagcagaagatgagactctgttcattcacttttcctaggcccatcctgtggtcatctttccccctcccatcatacctcctccttcctggagcctctgccggcttggctgtaatggtggcacttacctggatatttcagtgggaggatgaaaggcgagactcaccctacgcggtgggacagatggggagaggaaaaaggcagagatggccaggagaggggtgcaggacaaaccagagaggttgggtcaggggaaaagggtggggagaaagaggggtgcaggccctgcaggccggttagccagcagctgcggcctccccgggcccttggcatccaacttcgcagacagggtaccagcctcctggtgtgtatcataggatttgttcacatagtgttatgcatgatcttcgtaaggttaagaagccgtggtggtgcaccatgacatccaacccgtatatataaagataaatatatatatatatgtatgtaaattatagcactgagggccctgctgccctgctggaccaagcaaaactaagccttttggtttgggtattatgtttcgttttgttatttgtttgtttttgtggcttgtcttatgtcgtgatagcacaagtgccagtcggattgctctgtattacagaatagtgtttttaattcatcaatgttctagttaatgtctacctcagcacctcctcttagcctaattttaggaggttgcccaattttgtttcttcaattttactggttacttttttgtacaaatcaatctctttctctctttctctcctccccacctctcacccttgccctctccatctccctctcccgccctcccctcctccctctggctccccgtctcatttctgtccactccattctctctccctctctcctgcctcctgctgccccctccccagcccacttccccgagttgtgcttgccgctccttatctgttctagttccgaagcagtttcactcgaagttgtgcagtcctggttgcagctttccgcatctgccttcgtttcgtgtagattgacgcgtttctttgtaatttcagtgtttctgacaagatttaaaaaaaaaaaaaaaggaaaaaaaaagaaaaaatgaatttactgctgcaggtttttttctctctccatgtgtcactaagtgaagtttgtgccttctatagcaaagagaatattttttacatcctactaacagtagatttttttgtagtgaacattttttgtatttttatttataagtctcataagaaaaatagcaatgttcagttgtataccttgaatctgcagttagaagagaataaagttaattcagttgtctctcgcttgaagcgtcccacctttttattgaagtacttggttttgttttgttttttttttttgttttttttgccttttcttgtgtggggaacatggtagaggaattaagatttttgtgtggggactgggaaaaagaaagctctgtattacacatatttagacttatctatgtgtcacttttatgccacatttacaaggcacagatgcactgaataacatttttctaatactttttagttaaaaaatgttaaatacgttaatatcgtatgatccttggtacaatgtgctaggtaggcacttttattcagcaagaccaccatgtaccagttactgttgtcggcgctgggaattacagcaaaggacaaacagacaaaccctggccgccctggggctaccatgcttgagtcggaatccgtggtaacttgctcaggattgcacggctggtgagcagcagtcagatcctgataccaggccaggttccaggggtctcacgtcttctttagtctttagagagacattttcaactgactccttagtggctaagcaagcttcagaaatttctcaacaagaagcttccacacaatcaaaggttctgtagcagccaagagctgttgcattgttaaaggatttcactcaatgggtacgattccctccctgtctcatctccctgtgtctgggccatctggccccctcttatcggggatagaagcatcgccctatctttagctgtaaaaccaaagccactcaatcctagacgtggtgcttcagcacctctgcctgaggccgtcctcactgcctgtctctcctcaagacccaagccatgattgtcgtgctgggtcactccaagacccgggtctgtctgaccctggggttgctgagcagaaaccgcctggagctacccctaccaccggacaatcttcccaggaggaggtccagcccctagaagttggctttctcctctccctctttgccgtctgctgtgctttcttgacccctcctgcccctcatctttctcccaatcttttttctctcctttccactcctcccctctcttcctcatctgtggtcttttctcctttctttttgcttttgtttctctgtcccaccttacctctccacatatttctcatctgggaaaccagtccttaaccaaattctgtgttttgattttgagcagtttcccccaagccgtcctgatcctggcggcccctgcctcccccacactctactccaaccccctcccccagctcccctcccctccctcaggcctcagctttctcttgacagatgggagggcagtgagcactccctctttaaaacaacatttaatcgccgttttctgttcttggacatcaaagctggggcttaggcgctgtgctggggtcgcggcggcgcgggcgctgggggagaggagacggtgtgaagggagacctgctgattgacatcggctctggccccactatctatcagctcctctctgcttgtgaatcctttaaggagatcgtcgtcactgactactcagaccagaacctgcaggagctggagaagtggctgaagaaagagccagaggcctttgactggtccccagtggtgacctatgtgtgtgatcttgaagggaacagtcaagggtccagagaaggaggagaagttgaga

SEQ ID NO: 2882 - DNA, 976 bp, Homo sapiens
tttaattttttgtagagacaaggtcttgctatattgaccagactggtctcaagttcctgggctcaagcaatcctcctgcctcagcctcccaaagtgctgggattacaggcatgagccattgtgcctggctgtcatttaatcttcgcatctactctatggtgtagataataggaattagtatcatactgccaattatgatcacgggatctagaggcagctgatctgtgttcaaccccaggtcagcaaaatattggctgtgtggccttgggctagttactttacctctctgagtcttggttccttcatctgtaaaataaaaataatcacaccagcttaatagggctgttgcaaaaaaatcaaataaactgtatgcagaaggacttgttgtatagtaaccatttgtttacttccacttttcagatggagaaacccagtcctagagaggcaagctgtagtttgggaggtcggagttcacccaagaacaatctgcagctgcctctgcctttcctcttgttttaaaggaggattatgaggcttgcatacctactgcaccaacccatacgaagtcaatgaacaggatgaggccaagtcaataatacagatgaagagcagtacaaccatgtcttcatgccttactgaaaagcaaagatgtattttatatctggattttctttgcactgataaaacgatatcagcggtatatagtgacttgggtgtcactgtatgcatgttttttgaaatcctaaaatgaaatgtatttatctcccaatcatctattgaataaaagacaattgcttctgatcccaaacacttctcgtgaaagcttttactcattcaattcgtgtaacaatgagttgaccaaggcagacaaggaccctgtgattatggccctagattctagagggggaaaatagacaataaacaatgaatgcatgatggaattacagtgacagtgttctgaagacactaagtaaag

SEQ ID NO: 2883 - DNA, 5628 bp, Homo sapiens
ggacactgaggctcagggagctgggtgatgtgtcaaaagttgcccagctgcagagtggcaatgctggaatttgaagccaggcttttctgattctgaattccatgttttcttacttgcctttttcttctgctccagcttgcagtgcctcggagaggtggcgctggctagcctgggacttccaacatacagcctacattgatggcctgagacttgtggcaaaaaagactttcaaaatctaatttgctcacatacatgaacacctgccaggaaggaatttgaggcctttgttctaaacatggaaaagctgagttcatttgccccagagggggcacctgcagggaaaaggaaaaatggttttaaccctttccttgagtcagaaaatgaggccaccagattctcctttcatccttcaagtatcagaaaggtctgtgctgtgaattccacagatgagattcattgcaagatgtgagggcagaggaaatccatggaaatgaaatccacattcaaactggatgcatgcgttcagcaactggaagctgagttcatatttcattgcccaactaccctgaccacttgggaatcgcaggtttggaaggacccacagccattctgtggaaatggatctgctttcaggaccgaatctcagacttcttggggaaggtttcagtggctgcctttgctgtgcagacctggagatgggtctgatgatcggacacctgaattatctgtgtggctgagtttcaagaagacctgctggggtgaaatgaaaatggtgcctactagaagccccagtggctttgctggtggagatttgctcctccactggctcttcttgtagacacacgactgctacagtatcaagggtctgatgcagacatgacaatgtcaagaggaagaggagagcctcgctcttcccaggcttttgcttttaagagcagaaaaactttccccagagttccaccagctcacttctcatcttacttctttggccagaactggcccttgtgcccatattgtcagtcaaatgccgacaaaggaaaggggccactatgagtggtttagacttggattggatttgtccttattggattgtccttaagtcctttgaaaaagaagtatacaacagaatgaaatcttgactcagctttcaagaataaagagggtgagatgactgatggatggctagcaaaatcagatgtgggctctgtcctcatggagcatacagtcagaaggggaagatttacctaattacactaacaaacttataactgtggtcagtgttctgaaggaaaggaaatccagttgtatggtaacgtataacaaagaaactgaactaggatggagatgggggtggtaagtgtagttggggaagccagggacatgatctgtaagatggctggcctggattcaaattccactccacttacttgctgtgtgattttagattagtcgcttctcctctctgagctcaacttcatctataacaatctttcctagggttgttaaaggattgaatgagccactctatgtaaccacttgacacatattaggcacttcagtggctccttttccagattaaagaaggagaaaacgtgtatgtttggagttagcacaagacaggatgattcctcatgtttgttttggaaaacaagtcttaaactcacagccatgacagagtctgacatcatcagacatcaggcgtgttaagaattgcactcttaattgaaaatgtccagagtttgtgattaattgcaatccttttcagatcctttccctaagaatttaatttttctccccacccacccggaggtcaggcttttaatgtaacaagtacaatcaatcttccactgaagatggcctctctctagtgcaagctggagcaggactcatctggattagaagcctagacggtttggagtcacctggtgaggtttacgtgcacagctggggcccagcctacctaattaggaccagagagtggttgagaaggggaccggcgcgtattctaggcgccctcctccagtgtctgtttctaataatggcagaaagtagcagaggcggcggggtgagcttggagcgtggtgacatcatccctccagctgttttacacatctgtgacatggctcattaggactctcttaacacctcatccttccctgctccacacagctccagttgcatgagaaaaggtgctcttgcatgtgaggggccccaagactggggctgacttcagggtcaaagattcgcttgggcactctaccagtcatcagaattttcacagagacacccccccaacacacacacccgcagcatgcgctccttgaaagtgctaatagcttcaatatgaggctggcacttctgcatgactgttggtgttcagggccagcctagtcttggggagtaggccatctgtagcagctgcagaaatgtttttgcttattttgagcattctaagtttttcctagccatgaataacaacaatcgaataaatcatcccacagtgtgtaggatggtcgtttttttgtttttttttttcagcaagaacaacaaaaaatgacatatcatgtactatggataatacacataaaaaattccgccatatttataggcagcagttaactaactatatttagatatttgaaactgtcttaaatcagatgaatgataaaagcttcctggatttcagtggaaagcctaaatgactaaaccaaaaaaaaaaaaaaaagttttattactatgaagtatagtgcatattctgaaataaaagatatgtgatatttataaaataaaaagagaaactttgtcaatagacagcatcatttaataaagcagggtcccagatttacagacctttgtttgagttctaaaatttactaggaaggagggtgcaggggtggaagccgttcattgtagctctttaaatttcctcacttttgaatggagatgataaaatgcccctcacagggtttttgagaggactaaaaatataaggtatggaaagtgtttagcattgtgcctatcacaaagttagtgcttgaatatattagctattgtcattaatactattgctattcttatttcttctacaactgttattgttgaaatgcgaagtcaaaatggtacatttttatcaactattaagtgctatcatgtttcaattaatacataatgttattgattagaagatgattatagtattgtctctaaggaagaaaaaaggctgcctgttaaaccatggtttaacaaattctggagtacgggcgcagtggctcatgcctgtaagcccagaactttgggaggccgaggctcacgaggtcaggagttggagaccagcctgaccaacgtggtgaaaccccatctctactaaaaatgcaaaaattagcctggcgtggtggcgcacgcctgtaatcccaggtactcaggaggctgaggcaggagaattgcttaaacccagtaggcggaggttgcagtgagccgagattgtgccactgcactccagcctgggcgacagcgacagagcaagactccgtccgccccccctcccgcccccaccctaaaaaaagaatcaaattctggaaagcatcaatcatctctcaggcctttgaaaatgatctaattttgtagatcaaaccctctgtgcttgcaggtaggctcacgaatgcagaaagtgcatgctgtgagccatgctgtacacctcctcattgtccatttctcttctggtatctctcaaggtgtgtggtcaggttaagagattgagacttaagccaggcaggtgttacttcctctcaccatgacaaaacctgggacaatgagaagaggatagattctttcctcccgagggtgctgaggcaggatcagaatctctccctcgggtctgaaacagatcatatagaaggttcaaagctgcaagaaccattctgaaaccataagaatcctgagaacgaagcccacctcatgctaattgtggagaccaagcttatttgagtttacttgagcccttggatccagccgtgcctgaagactttttaataacaggaataaaaaattctattttggataaagcactttgagttggattttctattacttgcagcttaaaagctgaaatggtcctatgtgataagggaatgagacgatgattttgagcatttaatctaacaagaacaacaatactgtgcctgaataccacaacagggaattaggtgttgccttctgacagtatataaaagaactcatttctatcagtttcctgtaatacccatcagaatttctgtctcagaatttaattttctgagttgagctttaatgccatacatggacagtcatatggaattccagaatgtatttattataaaaatatcactgaagatattgttacatgtatcactcagtggtgctttcataagtaaacttctttcagaattcagtattaggagaaacctgagagaaggatatactcttctcctcttctgaaaatatgtgaataactaatcttacattcctgaggctgggtgtggtggcttatgcctgtaatcccagcactttgggaggccgaggcaggtggatggcttgagctcaggagttcaagaccagcctagggaacatggagaaaccctgtctctaccaaaaaaaaaaaaaaaaaaaaaacaacaccaaaattagccagacataatggtgcacacctgtagtcccagctacttggggggctgaggtgggagaatggcttgaatccaggaggtagaggttgcagtgggatgagatgatgccactgcactccagcctgcagaacagagagagtctctgtctcaaaacaccgaacaaaacaaaaaacaaataaacacaaagaactaatcttgtattcctttttgctctggctggctggaagctcagaaccagattaaaaggtcaatttcaagttattcacactaccttgtgattggttcatcttccttttctttggttcttctgtgtatcacacacatcacatgtttttgttttataccaccccaaattcttaatggaagaagcatgttataaacaaacaaataaaatgtgtccataattattaccattgtaaaagtgattatagaagagaaagagctggtaactacgttaacattttctctaagttgaaactgaaaaagtaggcagaggctctcaaatccaggtattgctatgaattataggagctttgcattttcattcttctgatccacacagctctctgtttaatctaacagctggggtccctgaggagatgaatgctttgctccgtggcccaggggtaaaaaagtgatatgaatctgacgggctttggctgcttacttgctatcatgggaccttggacaagtcactcagcttctcttggtctgttttctttggtgtaaaagaggaaatgcttgctacaggaagctgtcgtggagagtgaaggagattccggatgcatggtatctagcacagtgtctggcagattgagcctccaaaggccaggctttgtcttccttatgcagagtgccacctgcttttctgtaccaggggcttctgtctctttacagagccacacagagtcggatgtgactgctgcatcatattggattgcactctggccttgtgttggtcgatctttac

SEQ ID NO: 2884 - DNA, 6030 bp, Homo sapiens
attgggaggggttgcctctccctgtgtccacacatatgccttgagttgctcttcagtgaatatcacttttcctttcatgttttttctacatgctattatctgtatgaaatgaagaccaagaaaggatgggaagaaggagaagaaaaattttgatttatctcagaaactatactccgaagtgagagtcctggttgcagcatccttcaccgaagcacgaagcagaatcaagctgttgccatgaagcttgtttcaagagctcagaaatactccagggactcctttactactgcttttcaaagaggcctttttttctctcttctccttttcctgcaaagagggttatatccagtgctcaaggacatgggattatcagcctaaggcatgagtacatgctgtggaaacagaaatatgtatgaagggatgtatgaaaccacagaataaatggaatccacattcttgaagtagctacaactctacttgagggaaaataatgcttggcttcaggtatttggaaatactgcacattcgggctaagaatgagatgaccattttctcattttcaactaattatttcaagataccaaaacaaaacaaacaaatgccattggtgagtacctgctatatacaaaatgagctgtatgtagtgaagtggccaggaaaggcagagttcacagccataggtagggcaggccctggccaccctttaggggagcaagaaaggtaaaccaggtggatgaaacatatcctatagcatattgtaattggtaagtggatgcaagtggtttcttagcaagtcagaggcatcgggctgtctaaaagaggtaagaagattatactgacagagaggtggagcaaacaatgaggtgtctgggaggaagcatttgaagagctgcaaggaggtctgatttatggtagaaaaactgagtccccaggaactggggaagtgactggcaagaagaggacagggcttctagtctagaggaatcaaggcataggacatattgcttacctagagattcagtcaggggtatgggatccagcctgggtatagtttttggaaggctgcttacttgattgggttggagtgggactaacagcaagtgtgatttgatgctgacccttcagtactggcctgcgtagcttacaacagttaccctgtctaagaaggagattgattccagaacccagaataaagcagagaatgcagatggtggtcacatgggttcaggtaaggagtaaggaaagtcactggcccttctccaagtgctgtgcaggtgcaaaagttatttaattttctgtttctctcttgaatgaatatgctacctatttggtggtataacacgtaaactcattcatattaaatgtcaatacatgctttaatgttttaatcaataaatgtactaaataatttaaatttacaagggattttggaaacagatccaactttaagcatggcaggaaattgatatttggacaaggaatgttagcacattcttagatcatactcagatttaaggtaagactactctatttttcaaaccaatctaggtatataaaaccaaatctagttagaatgagaatactaaattaaacataagtttgttattcagatattccatgtagaactgtgggatgaagtgcaatcagctgtgactggttggaataaggacctgccttatcccatggagagttagagaatctgttccaacaaggacagaaggtccaggtgggaagagctctggaaaacaaaactctctgacagcgctcttgaaagctctgctggcatcccaaggcacgtagatagtacctatacatctcatcaggaacatggatggttctctgctatcagctgaagtgctgtgaccacaaaactgaaaattcccattctgtgtccttgccaataaagaatgtccatcagagcacgcccagtatcctagctccttatccagactgtgcttctcaatgtgacaaggaagactgcaaccctatttgcttctgataaccttcctatgactaaggtaagacagccttgggataaagcaagttttgtatgtggcataaaagggaaagagaatgagcctgggcacatcaaatacttctgaagtctcctttacatctgaacttatgaaaatgtgagaacatacatttcccaattgcttgagccaatttgagacaggatttctgtatgtttgtttgtttgtttggctttttccagcccaagtcctttatctggtacaaatgggttggagagattagtaactgtaattgacattcctatcggatgctgaaacaattcattagaaagccagggatatgagaagattgtctggagaagggggaaaagtggaggttggtgcaaaaggcaccctgtgtctcaagaaccttagcaacagttagccagtacagtttcacggttgcagtaggtggggaaatggtaagcatatgtagtgtttgggttagagggtagagaagaaatgcaggtaactaacatttattgagaatttagttcttggcactgtttccatttcagatatgttactacatttttgcctctcaacagcactaagaagtacatatttaaagagatagaaacttgagactctgagatattaatattcccacaattactcagctagtataaaactcctctcccatccacagtgcctctaagttccttaccatctatagcatagtttaagaatttaggaagtcaaaaaagtacagaatacatgtttaaaaggggtccatcaaaggtgctaacatgaagacgatgtattgttatctcccaactctaaggaatatttgctaattcagaatagattcagaataaatcattcctgaatgcttcagggtttttgtgctaattgttttaatgtaatcatagcagaacaccccagatattctaaatacttatctcaggactcagttatctgaaaagtctcatcacgaagacctgtacatgctaatgcttggtaactcagggaagccttcttacgtgaccaacaccacaaagccaggtggagaagatcccagaggtctctggtgcttgatgtgtttctctaagttttgctgaaataatttaaaaaaagatgaagtgggagaatttagagattattacttacataacatcataatttatctcctttgccaatatcctcttcttcaaagcaaagatttttaaagatgagtgaataaagattgattatacaaggttctggggaaggagggtcaagatggtatggtttgcatattgtatcactttttttccccctcagaatcattttatttacttctaggaagctgggagtgtgactctagaacaacacagatttaaactatgtgagctcacttctaggcagattttttttttaatcaaagttacaccccatgtgcctgcctctcctgccttcctttccaccacctccatatctccatatacaacctgagacagtaagaccaatgcttcctcttcctccttctcagcctattcagtggaacgatgaggataaaggcctttctgatgatccccttccatttaatagtaaatatattttatcttccttatgatttttaaaatgacactttcctttctctagattactttattgtgtgaccacagtatataacacatatacaaaagatatgttaattgactgttaatgttattggtaaggcttccagttaacagtaggctgttagtagttaagtttttggggagtcagaaattgtatgcaggttttcaactgtgcagggggacagagcagccctcaacccccaagttatttaaggggtcaactgtacttcttccataaaatgtctgacaaaaataaaaatctaaaaatatttactttcaagtttttgggtacttaatcattgacattgtaaggagataaaactttccctccaaaggtttgatgattaagtttattaaataaactgacagtggacagactaacagaagaaaaggcatacaaatgtattatgtgcctgagggcatcaaaggaaggaaaagtgagtaccccataacctaataaaatttaaaagcttatgtgccctcctcatagggaaggtgggggggggcatgtaagcaacatagagaaagttaacgattttgggggaagataaataggtaatagtttgtgacaaagattggttgtttgtgacgctgacctccaaactcttctcttgtgatacaattagtcttctctggttgagattcctggggaggacactcatgacaattgtggtttttggaggatctatctttaggcagctaaaaggaagttcagagaaagccccttcctatacttcgcaggagaaaaaagaggtaagaggctttggttctgttttagttccaagcacttggtatgtcaaagcaccatacttaggggtattgttttctgagtcctaacaacattgaatatttctttgcaaatgaattatctgatgtgtttccattctggtgtcctatttttaagaacatcttaatatgttattttctttcaaaaacttcatggtgcaattgcatgatgaattaacaataaaatgtttctccgtgatatatatatttgttgctgttgttgagatggggtctcactctgttgtccaggctgaacttgaactcctggcctcaagcaatcctccagctttggcctcccaaagtattgggattacaggcacgagtcactgtgcccagcctccttgaccttttttataaggagcattagtcaaatttaattttgaatgcactggaaagttgtcctaattaattcggattaaatattgcctgatcatatataaataacctcttactatgtttgaattatgttaaaaacttactagaagtaaatcatgatttattagataaaaaagtagtatgatgtcaaaataacataaaacaagtacaaaacagattttaattctgatttatatgtgcttttttaatatatctggagtaggtacttagcaatttttggccctctggaataaaatataataattcatttaatcacatgctagtttttattgaggtctagaaaatgtaaagtacttgatcaattgattttacttttaaaattggttctttttaagtgctcagagtttaaaacattactatctgcgatgataaatacaggtcttgccatcttgatattgattgtttcagtggaagtgggtagtgtcttgtaggtgactgaaaatgaggcaatagcaaggaatacttgccctcaaaggatacagatggttgtaaatcctcccaggggtgcactcaacatatccatctcttaaaagtctgcttccaccctgacctccctaaggggcccaacagttgtgatgtttctgtgtgggaattgtattccatcttcctttctgatggctcctccccttcccttggccacttcagatagaggtgcaggacattgctgaagtgagcatgctcactagttggtacagcataagtttccaggagcatagagaatttgaacaaaattttaagattcatttttcctattgctaaagtcacatttggatcatgaggatcttcttcctttttttattttctcccttattatttttattatcttctcatattcctctccacctcattgcacctttcctctttaatttccttgaaattacttggtaaggcagttggtacatggaatatatattttacaataaaattataaatggtggttaaattctatactagctcatacatggatttttttcaatgttttttgaaagtgagccttatttagttagactagaaaattaattctatgcaaatatatatatatcccagttaccagctggccagtaattttaggtatatggacatcctagaaagtgctagttccatggggcagtaagtatctttttcaaatatgagtaaactgtcttaagcaaaggagagaaggaattgagaaaaatgctgaaaataaaaggaggtaatatttttaggttgaatgatacattagtagatggtgtttaaagtcttcagaatgtattgcctatgtaactgtaataacc

SEQ ID NO: 2885 - DNA, 1288 bp, Homo sapiens
gttgtttaaaagtgtgtagcaccttctccttctctctcttcctcctgctctggccatgaaagatgttcctgcctcccccttcaccctctgccatggttgtaagtttcctgaggccttcccagtcatgcttcctgcacagcctgcaaaaccatgaacaaattaaacctcttttctttataaattacccagtctcaggcagttgtttgtagcagtgagagaatggactaatacagcattatatgtgatcaataggtatggggttatatgaaaaaaaaaatccaaaatttacaatatacaggaaaaagatgggtgacattctgtaacaccctagcccaagtattgtttggtaattatttagtactgacccctaagtacttcgttgactcactgagaatgtgcatagtaacatgtagactttgcccagtggagatcatttctcttaagcagaaaatataacctcaaagtttatggtttgtgactttgtaggacattagtttgtaactatcaccaagtttattttagcagacctttgatgagctgactgtagaatataatctccattccttggagatataatctctcttatatgctataagaaagaattctggccttcctaccatcttactgattccgccactatttagtgggttgaatgagatctttcatggctgtttattttgtgtgtgtatgagaaccttgcttttaagttttttggaaaattatatgttattagctgttgttgcattttaacaatttagccatggaaatttatgggacttaaattaggcttgactcatgaaggccacgttaaggaaaaccttggttgtttttctgtttattgttttctcacactcctaagcttctttttaagtgatgtcagtgactgatctcagtgctgtcaacttctagccttggctctctattctgtaccaagtatcttatattgtacttcatttgcattaggagatcggagttctttaattaggaatggaatgcaacagatttggacaagtcaaggacaagagctttagagagaccaaagagtttttcactgttaaagtgtccagtatgtagccgagaaccatatggagaacatcaaatacagtggaacaaatgtaactgctattgatgtcacactttgtgaagtagtctttgttgcttaaaaagggtgacatctagtggctaaacatgttatttcaaataaataatatcgaaataacatttcttctcatggtccactcattcactctttaacaagtattttgaagtatatatgtttgaattatgt

SEQ ID NO: 2886 - DNA, 14244 bp, Homo sapiens
gttaaacggcatcttccttggatggtctcaggatcacagccttctctaaagaagtattcctctccaaagagctgcaggccttcaacagccttattaggtccggaggcgggggcccccggggcgactcgggggcggaccgcggggcggagctgccgcccgtgagtccggccgagccacctgagcccgagccgcgggacaccgtcgctcctgctctccgaatgctgcgcaccgcgatgggcctgaggagctggctcgccgccccatggggcgcgctgccgcctcggccaccgctgctgctgctcctgctgctgctgctcctgctgcagccgccgcctccgacctgggcgctcagcccccggatcagcctgcctctgggtgagtgccggggacccggggacgcgggccgggggaaggaaggctgccggggacgtgcctcgtgcggaggtggccgtgacaaaggaccaaggaggggacctgtcggaggcacgggatccattaggaccccttcttttttcaaggcgctgcgcggagggagggagaggagaggggagctgtggggccgctggcccctttcttcagttttctttctgcgtagggatggggtctagcccgctctgtcgtcccccctagttcccttaggaggatgcactttcggcggggtccgcctgcccatctacttgtctttgatgctgaccagagccgaccgcggtgccgcccccgagggcggctcggggtagagggaggccactgcttgcagtcctataaacactggggttctggtattcccagcaagtcgcagcagggccgggagctgtggtgggcgggcaggcgcccgatcctccctctccgcccctccatccctggcttgccagtgcagccccaagccccagcatggagagacctccaggccctgggagcgaccagactgcggatgggggcagctctgggcgctgacattcccaagtcctgggagcgaacagactgcggatgggggcagctctgggcgctgacattcccaagtcctgggcgcgacccctcctcagagtgacctgggagtagcatcctggttggctgggttcctttcctggtcctcacatctgcttctgtggccacctcctgtttcagccctccgcccttccctctccttttcccttccatccggttgcttctccagctcttcttggggcacttgggctttagattcagagggtcctggatcccaagcccatttcttccactgggcaagtaagtgccttctgctcccagtgccccacctttctcatctgcaaaataggcagtcgtaggtgccttgcaaggtgtgttactcgggtatgaagtttataagtgcccaacagatgtatccgcaagccctttaacttgttggttgtcatattgtatgacttggaataaagcatgtatgaattagaggttacagactgaaactgtcccagacttccatctcctcacagcatccccacctctaaaagcatcctgtttacaaagggaaatagtagaatcagcacttaaattaaggcagggccctagcggcttcaagtaaccctacctgaacccctgtctgaaatactgcagatgacctgggttcaaatgctacctcagccacttagtaaccatgtgaccttgagcaggctacttaaagtttctgggtcttgatttcttcatctgtaaaacaggtataataacagaacctacctcaaggtagtgaggattaaatcagctcgtgtttgaaaagtcgttaggacagggcctggtacgggaaccgctgaatgagtgttactcagctcagagtttacttctgtacatcttgcccagatctggggtgattctgcctggggttaggacagggttggggtgttagtttgactgtagccccttgggtgcttcagcttgtgaagtcaggatgaacaggtgtaaccagccccaggcctgctgtcttgctacttctgttgtggccacaactccctttgccctcagaccctctcatttttgggagaaggcagggtgagatgggggcagatgctccaatggactccacttatggccttgggaaagctgggccagctcatgggaccatgtcaaaagacggtaggtttcatgtccaactctggaactggatgggacaatcacagggtagctagaaggcaaaactggagagcagcgaggggaatcgaggggacctgcttcccgaggagcagctagaatacttggttattattaccaatgcagctgcaggacctggtccacttctacaagcccgtgactgttcccaggcttctgtcacgcaccagcattcacctgtcagggctgccgtaggtgggcttgcattttgtgcattgtaccaaggtgcccagctgagggttgagaggacctgaaatgcagtccacactcagctctccaacctaagagtcctggagcaaaagaccccttctgctatgttcttggggctaggtctgcccggagtggcccatttttccagtcccaccaaagccctggaatagtgtagtggcacctagctacctgaacttgtgagcacgtatctatagtcgactgagttgccactataccctggagtgccccctctctgggcttcctcctggccctcatacccacctcctactcttacctacgtgcaggtcctagggctggctgggagtccgagaggggaatgccctggtaactgaacaggctcacccttgagtgtggcctaaggcggtttcctgcctcatcccagggggctcattagatgttcctggcagtgtgcccatcctgggcaggctcgtggtgaccatgggacgccgggcccagggccctagtgccctcccttgcatgcatcttaggagaaagagtcatggaactggatattacacacccctctttcctcctgccactcactcctctactgaattcccacccatgccccgtaaggacccagatgcctagggacagtggggctatgtctgtggtttaaaacaaaatcccttgaagtggagcgtccagcttgccctgcatctggggtccttcatagggaaccctaattattgttgatgaacagcacattcctggggtgcttaagatgcagggagccgatttgtggcctcgcccagtggccagtagggagaggaggatgaggggacagccactgggggctccacagtcagctggaaatctctgaaaggaacacttcaaagaagtgtgtggaatttgggttctcttgcgttggaactaccatgcagagctccaggaccaaagcctcggtcaggagcaggagtggtgctgagtagaaacaatggcgcccagtgcttcccagcctggccacgtggggagaaacaaaacacgcctcctctcatggccctccaaagtctttttgggccaccttatttggacacttaatgggagttattattattgttattttgagatggagtttcgctctgtctcccaggctggagtacagtgatgccatctccgctcactgcagcctccacctcccaagttcaagtgattctcctgcctcagcctctcgagcagctgagactacaggtgcccgccaccatgcttagctaatttttgtatttttgtagagatgggatttcaccatgttgtccaggctggtctcgaacttctgaccttaggtgatctgcccatcttggcctcccaaagtgctgggattacaggcatgagccaccacatccggccttaaagggagttattaattccctcctgccccagaagtgccgggcgggaaagctctggacgcagtatttctgaagcagattggacagaaatctgcaggcctgcaaactgcagtcaacaaaacgccattgagcagagagaatggagcatttggcacaaatcagctgcttgccctctggccctggaggaggcagccagggtcaaggctgccctgggaagccctgatgctggtcgcttgttgagccctcagcccggttactggcttccctccttgacatggtctcaactggacatgagcctttgtccccagctctgtcctatgggccagcatctctttggctctgcagaggtgagtggaaggcgctctaactgcggatgctcagagcctggctttgtaaagtagcttgccacccttactaactgcacaaccttgggcaagctcctggccttctccaggcccattttcacattagcaagagaggaataatggccatcttcacagtgttctgagaggattacatgaaataatgtatgtaaagtgtttggcatggtgcctggcacatgctgcatccgtagtaaaaaggtagcttctgctctggtgtgctagaaaccccctgccagccttgcttggtgaggttatttgcatccatttttgtgcacactggtggtatgcaggccctctgctaggtgccaagccttgtcaggcttagtgcctgccctggtagaaaagacaaagcaaggcccccaggagctgattggaggtcattaccaggggtcctgcttaattatagcccagttattaagtgctcctgattcagccttttcaaagtcctcctttgcctgaagaacctcctctgcatggggctggaccatgcctctccctgcctgcccttcactggttctgctctgccttcagcacaacccacatccagctggtgttgaaatacctctgtgccaacccaggagagcgctaaacttgcacaacttttggggcatatctggatataccagcatgttcatcctctaggcaagagacagagggtggcacggggcctggagaaaaggctagactcgggtcatgtcatcaatcactccttcctttatcttcttagagcctgttgcctctcactccacccccatgggtgctcaggctggcgcaggactcagggggcctctgatgtggccctccctggggatcggggcaacaggaacaacacaacgcgagactcctgtggtcgaggcctgccttccctcagattagctttttgggaagtctgctcccttggactgcattctccatgcttttccccagctggtttccctgcccctcctcttcacattctgacctccctgtgctggatgtgggacagctatcctgtctgtaagataagataattaaaagcctggtggctctttccctgctgccaccaagtcatgcagagacggaggctcaggctcagttgcgttcaagattcggcttcacccgtaacccactgccatggccgaggaaggcattgctgctggaggggtaatggacattaatgctgctttacaagagctgttgaagacagccctcatccacgatggcctagcacatggaattcgcaaagctaccaaagccttagacaagcgccaagcccatctttgtgtgcttgcatccaacggtgatgagactgtgtatgtcaagttggtggaagccctttgtgctgagcaccaaatcaacctaattaaggttgatgacaaaagaaactgggggaatgggtaggtctctgtcaaattgacagagaggggaaaccccgtaaagtggttggttgcagttgtatagtagttaaggactatggcaaggagtctcaggccaagcatgtcatcagagagaacttctaatgcaagaaatgaagaaaatatctttggctcacaaaaaaaacaaaaaaagcctggtgcccacagcggctctatacttattagctcaccatcgaccctcttctgggcactgaatactggaacactaaggggtggctcctgccctgtggcagagatggtcacagaagagtagagtggctacagagtgatacacagaggtggagtgttctgtccagctgctagagttctgcctcccaggcctgtgatctgacttgttgtgcatggaagctctattctgcactcctggatccatctggaagcccatcctgtagtcttaacaggcttccgagaggtggggggcctgtggcgagggggtttcagtggggatggtaggtaggagacagaagccatcattttaccatactcctaaagaggagccaaattagccaactcgtgtcctcttttttggcatcttttggcccatcctctaggaagggggccaactggaagagcaaataaaagcggccattgcggtgcactccctgtgtgccaggcactgctgttggatgtggaagtgcattgctttatctcatgcagatgaggaaaccaaagctcagtgaagctaactcattatcaaggtcatgcagctatagaagagtttgggaccaagccttgggccacagttctcgattcagcaaccacattctttccattagaacagctgcctcctgcttcacctgtgaatcgtacaaaagcagcaagatgacccggctcagcccttgaataattgcaggttatatttttccatctgttaaagaaatctgttgaggtcagtctctggacggggcaggggatccagccgaggcccctggttgcatggccatagttgggaagagggcagagctggcagacatgtggcacacaggagactgaggcacacatctcagacagaagtttgcaaactgaagggtagtgggccacagccagcctggagatacattttgtttgacttccaagttctttagaaaaattttaattaggccaggtgcggtggctcacgcctataatcccagcactttgggaggccgaggcgggtggaccacttgaggtcaggagtttcgagaccagcctggccaacgtggtgaaaccccatctctactaaaaatagaaaaattaactgggcatggtggcaggcacctgtaatcccagctactcaggaggctaagggaggagaatcacttgaacctgggagacaggggttgcagtgagccgagatcatgccattgcactccagcctggaagacaagagcaaaactccatctcaaaaaaaaaaaaagaaagaaaaattttaattagttgctgatatttaaaacttaggaaattttacataaaaatctaggtttccagcttttctgaaggtctggtaaggttggacccccattccgtgtagcagcacgtgtctggggcctaagtcttgcgtgtgaaaaagggctagagtaaaagtagaaggcaagaagcaaggggaggagtagggagcatggggagaacccatcttgattattgatggtcactgacccctaatctttgcagagctttgcactgccacgtactgtgtttatttagtcttctcagcaatcctgcaaggcagccctctcaggactgagaatttgttcggggttgcacagtgggtcagtgatcaagtgaggattcacacacatgtcttgtgccccttccagtccgtgaagcttgtttcttgtctccctaccatactttcagctgtcatacttccacctgtcatacttaattctttttttctttttcttttttttttttgagatggggtctcactctgtcacccaggctgcagtggtgagatcttggctcactgcaacctccacctcccaggcttaagcgatcttcccacctcagcctcctgagtagctgggacctcaggcatatgccaccatgcccagctaatttttgcattcttggtagagacagggtttcatcatgttgcccaggctggtctcgagctcctgtcagctgttatacttctatgtgttcagtgcttttgggaggggtcagagtggtagcagtgcttctcagacacacttttgtgagtgtgatgcttcaggacctccacgttgccccatttttatctggggcccctctctgggctggagcactctcactgggactgtgtcattcatttgtttagtcaacaaacatttatggaacaactgctgggagctcacctgaccagttgatacaaatatgaataagacatggtcttgatcttgaagatgctgtcagcttggtggaaaagaagagcacaaagaccgggcgcggtggctcacacctgtaatcccaacactttgggaggccgaggcaggcggatcagctgaggtcaggagttcaagaccagcctggccaacatggtgaaaccccatctctactaaaaaaatatatatatatatacaaaaattagccgggcatgatggcgggtgcctgtaattccggctactcaggaggctgaggctgaggcggaagaatcgcttgaacccaaggttcaaggttgcagtgagccaagatcatgccattgcactctagcctgggcgacagagcaagactgtcttaaaaaaaaaagagagaagagcgcagaaagaccctcctcatcatcatcaaacatcaaacattgccatcatccgacagtgtcaccagtgcactacaagacgtgtgaacaggaaatgatgggcatacggagaagggcccttgcccagccggggatccaggaaggcctcctggaggaggtggaactgagccaagtctcaaaggatgagtgtgagttagtcaaaaggaaagccttctgggtggaggggacttcctgaacagaccggagatgagagaattgggcccttgagttgcagttccatgtcacttggtcgaaccaagaggtgggtgggtggcaagcactagcaagttaggagcttggacgacggggtgctattgaagtttttaggcagaacagtgacggctcccagagagccctctggctgcagcatagcagctggcctggagatgggaggctggttgggaggctgctgtgatggtggcctaggtgagagaggatggtgccaggctcaggactgcggtagtggggatggtgaggggaatggatttggaaaatattgagagaaaattggcaggatttgattatagactggacttctgaggaaggaggatggtgagacacccaggtgagtggtgccacacacaaacacaaaatgccaagccagggagtgggactggaagggggcggtgaggtggtgggaggcacccacagaggcccttctgcactgtggggtctggtgtgttggaggaagatctgcacttggatgaggagatttggggatcgccagcatccgcgtcattgaagtgatgagcatggacgtgtgacccaggggcttgaacggagttaagaagagcagggccaggagcagacagacctagagagcaagaacattcaggagcaaagcctgaggcaggagggtggtcatcaacacagatgctgcagccaggtggcccagggtcgggcggcatccccaccactcctcccggggatgacttgcacctgaaacagaggtaataaaacacagcagccttgtgaggatgacatgacttaatccgtttaaagggctgagaaagtgctcacatactttagctctttgagggctagaggcccagaaggcatgtgagggagacacggagtgatgcttgagactgggggcacaggtacctagaggacggggtggcgtggcccgtgtctggggtctgtcagcgaggcgatccctgggctcttggcagggctggcactgctgaacgtggggctggctgaggcccaacttctgtggaggagtgagtggaaggtgagaggcagagatggcatggggtggctgttctctttgggagcttgtctaaggcaggtggagggaggcacaaaagtttctagaatggacattggaacaaaaactgctttctgacaggtagagttggtgacataggatttggtctctgaggagatggggtgggaagttgaggttgtttatgcctgatgaccccgatttccttggaagaagtggagacatctataaaagcaggaaggcagacccagggcagaggccctagaagccgggttgttagaggggagccagcccctgagcagagggactgagcgtgtccctgtgtagacctgtgagcaggcaggcggcaggcaggctcctaaggtgacggcagtggtctgtgcacccatggcacaggccctaggtcgggactgggactgcctgggggttctggcagaggctcttcgtctgcccacttggggctgtagcaatggctttccggggcatgccccaggagcacagatgctgtgaggccaggttcccttgccctcgttgccactttcttggtgacctcagtccatgggaggacccttggcacacaatacccccaacctctgcccagagtccctggtcagggactcgactctggcactgggctggtgtcagcagaatgtggccccctcctccatgctccatgaggaagaagtggctgccctgcccaacacgggccgtgtggaggaaggaagtgcacccaggttggcagtgtgtcccagtttcctgctgactgtggccccgtcagcactcctgccctggaggtggggctgctgctggggtaagtgggtccaaggttctggtgacttatcgtgacatccctggggacgaagggctacaacagcctttcaggaggctctctggggacttgtcccgcccagacccctctctgagagtgggggaggccactggctgcctccttgcattggaggccccttccccaccgactccacagggaagctggtgttttctggcctgatcctgctggggcctgtagagggtgggatgttagggccaggtcagcgtcttgctgccgtgcccggagccacagtagagagaaaggtggggtggggttctgagtcacagcgctgctgcagctagctggctggcctggggtggggactaaccagggtggggatggtgctgagccctattcctgtctcaccccagagagctccaggcttccggctgagtcacagggaaggaggacccttacatggggctgagggctgagtattcccacatcacttcctactcagaaccccacttcctactcagaaccccacttcctggggtggggagtggggaccctgcaggtgactcttatgtgcccattccatgtgccgtctccctccagggagggacagggcagccccagaccagccccggtctgcctttttgaaggatgatctgcctagtgggatgcactggccttggtgaagcccctggctgaagcctgtcggggtggagggagagggttcaccctgaatgggaaaaccggccgcagcctcggcgtgccctgctttcttcatactggactaacccactggatagatggatttagaggatgtccgagcagcacaggcagcccaggagagcgagcgagacactctttgacacaagggagagcataaaagcttaagactgaccccaaggtgcgccagcccctcgcaggaagtaaagtgcagaaacacctccacccctgcacaaagagcacctaggagtgagtgcgcaagcgtggacaagccctgcggtaccgtgtacacacacacacacacacacacaccacaggcaagctcaggcagggtccttcacagacgtctgcagtcactctggaggtgacccaagcacctgggcccttagacagtaacaccactcacaccgagcacagaccagctcgcgcccacaacacgagcctgtgacacgcaagtctctgtttctgagctgatgccgtctggctttggccatgagaccctcgtgtgaccaggtgcgtgcctaagttagaatcgcccaggctaagttcgtgaaccccctggatgagggaggcccgactcccgcaaggagccctgcccttctgccagctctcaccgggccggattttcctgcggggcttttggattttgtttttgagtcactcattgagtgttggtcgcgtgccagacaccatgccacactgcaaaccatgtgcaacgttgttttagcaaagctgtctcagtaaatgtgggttattatgtatattattatttacatacgtaatctcattttttctaataacaaccccatgaggcaaagtgttattattttccccattttacagataaggaaaacggggctttgagaggttaagtggcgtgtcctggtggcacacagccagtaagtggtagaggatggctttgaacccaggtctctaactctactctgcacaccatggctttcagtctgactctcagggcagagagatgaggcaagtgtggaagggaagccccagaaggggaaagcctggttaaggggcccttcacccccctctccaaggcacattcccctttctgtccctttgtcgtttcattcactctactcccagcatggctggagggcttgtggctggctcgtttggaggcctgggctgaaccagggactggctggtctataggtttcccctccagccggctgcactctgtagtgcccgaggcaggtttccaccccttctcccaggcgtaagtgggattgagttgccacctgggactgaggcttatctctgactcttggcatttctttgtctggacagattccaagggcggtctgctgcccagacttacagggcctgcccaggtggaaacgctcttttgcaggtagataagcacgggcaaccagcttatctgaaccagcccttgcttccagagaactatggaaaaatccaaaagataagaagggaccgcagtgtctgtcttggtctcactcctcttgagactcctgtgatctttatatgtctcattcctcccgtgacatgtatgagaaactgcagctcattgagacgatgtctctgctgcctgacagaagggcctacttgagggccgggctcggtggctcagccacctgacccccgtcatcctgttaactagtgtcacccccacccgagggcttccttccccatttgctgccaggtgtaaagctgagcttcggctgggcgcggtggctcaggcctataatcccagcactttgggaggctgaggcaggcggatcacctgaagtcaggagtacgagagaccagcctggccaacatgatgaaaccctgactttactgaaaatacaaaaattagctgggcatggtggcaggcacctgtaatcccagcttcttgggaggctgaggcaggagaatcgcttgaacctgagaggtgtaggttgcaccattgcactccagcctggacaacaagagagaaactccgtctcaaaaaaaaaaaaaaaaaagggctgagctgctgggcgtggtggctcacgcctgtaatcccagcactttgggaggccgaggcgggtggatcacatgaggtcaggagttcaagaccagcctgaccaacatggagaaaccccgtctctactaaaaatactttgccgggcgtggtgacatatgcctgtaatcccagctactcaggaggctgaggcaggagaatcgcttgaacctgggaggcggaggttgcggtgagccaagattgtgctattgcactccagcctgggcaacaacagcaaaacaccatctcaaaaaaaaaaaaaaaaaaaaaggctgagcttcccccaaatggctgatatgtgttcctccttatggacattgaggatggagtagcttcatttcccatttttctttggccaccaggaggcccagcactaaaggctcagcccttctctaccagctgtgcgaagactcattgacctactcgtgaatttttacttccttgctgatggagatgtttttcttcagatttgggttttctctgctcctgattttaatgtttatatttcactactttcttttcttcatgtctccccaccctttatggaaccaggctgggggtatgtaaaaacactccacaggtaaacacacatgaagtcatcttcacagctgcttgattgggcgtgttgcactttttgcttcctcagcttcgtgagactgtttgtgtggtcataacccactggtccgctacaacgtgcctgagggtggtcagggtgctgctctttgcttgtttttgtgttctcatcagctgcttagaattttaaaaataatttctctccaaaccctttagttacccaaagcataaacagtaccctggtgggtaagtgtgtgtgtgtttctttttttttttctttgatttatatatttcacattatataaggataacctgcttattagagaatctaaaaatgataacaagtaaaaaagaaaagaaagctacctgtaattctaccagggagcccatgttttagtgttttgtgatacatccttctggatttttttcctatgcttatatttttcccacaaaaaatagaatttgaccatacatactaaatataacctgaattttcacttcatggtagataattcgtgtctttccttgttgttattctgcaaaaacaaaagctacttaaaatgtgtaccaaggtctgggcgcagtggcccacacctgtaatcccagcacttcgggaggctgaggcaggcggattgcttgaagccagg

SEQ ID NO: 2887 - DNA, 606 bp, Homo sapiens
cagacggaagtgagcgacacactctgcgtcctcgcctcaccagatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgcagttgaactatataaagttcattgcaaagcagattatcttgtttttttgcatagcaatcaaagttgaaatttgtttgctacatcaacaaattaaggacattttcacaaactgagaaataaacaaatatgcca

SEQ ID NO: 2888 - DNA, 2632 bp, Homo sapiens
cagaaaggaggctatcttaaaggtgaaacatccataaataaagaggcagctcagaacgttcctgggtatggcaggattttgcaggatttggatcccaggatttgggcttattactaagccattgtatgaggccctagcagagccagagcatgaactgctaggaggggtttgcacgtaataaaccatacctgctgttcttatattaacaatcagggttagctgaactgcaagttcaaaagatttaccaacaggctatctggctacataatttcaataaccccaactactcaagccatttgggactccatcaaagggtacctaccaagtgtaacatggttcctaacttcctgggacctttaatagctatcttattcctactaatctttggtccttgtttgtttagcttccttgtagtttgtgtcttctaggtcgcaacagttccatgtcaaaatgatggtcatgcaaggattccaattaactgctgccttggattcagactcttttgatgacccctgctgggaacacataaaccaggcagacagagatttccatgccctcactaggcagggccatcacccctaatcagcaggaagtagatacagaagactaacattctccctcattgacccttaagaataaagggatggaaatctctgcagtggggaaaatgagacaggaataatacagggtggtcgcaggagaatagaaaattccaggcagcagtttcacatgactagcaaaaggaaactgttaaaatagctgcagaagctacaggctgataagactgtgaaaaaccagggtgtggaccaagctggctaagaccgactggacaaaacatggcactggaattgatctagttttcacctaggacctcattatatgctcattaacacattaaatcacacacccacctagcaccatatcagtacgggaacacctataattggtataaaaatggatatcatcacagttctgagatatcctcacctttttttccaggattcttcctggctaaagaaacccataaaagtggaaaactcaaactccacagtgcaaatatctcttgagtctgcctgcactaccctttcttgaatgtgtattgataagactgcagttgacattttaagaaatttaaatttcaacctgaagtcaataaggacacctcagaagttttcaaaggaaggatggagtctgttgaaaagaaccggttggtaaaatgagaaaaaatggattgaaggagacccaagtgaccacctggtaattacttcaacagcagagcgactcatacagccggcagtccactttgttcttctatagatcctgcctgtggtgttggatctaacagcttcttccctgacccaagattatgaaggatttctcctgtgttctcttctaaaaattttacatttaggtcctgggctttctctgctagaagaggctgaattcctggagtacctagagtacagagctggtgaatgacctcttatctccctgctctagcctgtcctatgtaacttggtcccagccacctctcctgtggacttttccttcttctgagcttttccagatgctgggctgagcacagattctggtttgatggcatctagtctgcaggaaaacatagtttggctttgaccagcacctgatagactcttctgctcttttggactagtcttctagacactaatggcagtggaatttgaccttctggtcttccttttatgtttgctaaaataaatgaagccagtaatcccaacagataacccagtattcccaccacatggctcaggactgcccccattcgaggtctgtgatcctgagcatctttcaccaacaaatataccactactaatcattaaggtgacggtttactgaaatcctgctgaatactaagccaggtgctggttgtttcacataacttatctccaatcctttcatcattctgcaagatagtaattagtattgcaatttaacatttaaatggaggcccagagaagttaagtaacttctcaaggtaacacagcacaacacatcattagcttcctttcataccttttctttatttcttcctgattcttttctccaaatgtatctctaaggagctctccttagccctgtcctcctctctcttgatgatttcccctgtattatactttcttctggcttctgctcttatatctatgtggatgacttctaaaatggcagttccaacagtggcccatctacgttgtccaagaaaggcctttagaagtcccattaatgtcttaacatatcttaacctatcacttgtctttacccttaaacctgctctttctctgtctttgagaacatgtccactctctggcactcaagttcacagtcttggtattcttatgggcagattctccttttcactcacctactctgacactcagtcactaagtctggcccttctcctccattctcttgatggtgagtcctattcagtatctcattatctcccacctggctgattgcaatagctttcttcaaatctctctgctgttattctccttgtcctcctccttcttagaccctgtggcaagattttgtcttggaaacacctccttgcctcaggagccgctggtagaccagcagcctccatgatccagcc

SEQ ID NO: 2889 - DNA, 11713 bp, Homo sapiens
atataaactgtttagctgaacatataagccatcttggtttttaagggccttagttacgaagatgagattatcatggaagcaaactgtagaactttgaaaattttgaactcagtaatttatctaatctgtggttttgggtaacaatcctagatcacaaaattcatgagtttacttttctggaatctgcttagtccttttgatctcctatcaatataaattaaatgtctatattgaacttgtttattatacatactttctaagaaggagtggagcactttgcaaagaagtcatatacaaacagactggtaaagcagaaattaaaagagaaagtaaatatgataaagagaaaataggagccctgtctattcccaagtgagagaataatttttattaagtggtacattatgtaatggaccagttctcaacagtggcttcgtaacgtacacataggcagagttcgtatgacaggttttacaaagacctttgttcaaagtagaaaaaataccactgaagcactaattcaatgaaggcaattatatgggaagattaaaatgatgtagtctgcatacaaataatctatgtcagaagtgggacaaagagggagatggtcacagaccttatgtccatggatgcttgtctgtggaggcatggcccagttcttatatttgtaaattctagtgcagtggtagtatattggaagaaagaggggatgaacacattatctatttcttgtgcattattcacccttgccaaagccctgctagtccatagaatgcccagtcaatattcactgttattcaatgataacgattattctgggttatctagtgatcctatgtgcacacataaaaatctaatttctccacccatttgtcaaattgggtattagttgtttacattgcagttcaagtggcctttatttgttgttgcaaaattagaggtcctgtgtccaagcctcatgcgtcaccatttgatgtgtgttgttctgagatctgctatgcgcagtgacatacccttgctccatgtgctaaatataagaatgttgaatgaaccctcctttaccaacgtgatttgtgtttgtcgtttgctcacaagacatagaaaatcttggcaatatctatttgggtgatgccacatctttgctcaagtgcttgtggccatgtgtcatggttgtactaggggacaaagaaaactttaagaagagagtagtgctgatatccagtaaacttgcaatgatgcgtgctcatggaggcacagatcacatgggtgacaaaaatccaccattaatcctcaaattctatttttaaaatttgataagaaaagccatttgaaaaaaacattatttttaataactaggaactgaatgaactgatttagagctgacttactctgtgttttatcaagggggtagttacaaaaaaattgagtgctaaaatgctaaaagactagttaatgacttggatgagtactctttgaatatgttgtaactaattgtatataatagcagcatggaggtaaaagtgttaccatttaaaatacatatatacacggctatatctcctgtagatttagaggattccattacaataaaggtgctgctaattcttcagtaattgaataaaatttgaacagttcatcgttaatatccctgtgcctcagtatcctacaatcttttgtgaaataagtacatatgcccttttatgcagtgtcacagcagctagatttaccattccattacacaaatgtggctccttaataaactgctctaatatgtctttccagtgctggattttgatagcttttgctaaatgcagataagagttaaatgttctttgtccctttgtttttattcaaatgttttccttctaaattcattttcaaatttattacagaagaaaagcaatggggcaccaaatggattttatgcggaaattgattgggaaagatataactcacctgagctggatgaagaaggctacagcatcagacccgaggaacccggctctaccaaaggaaagcacttttattcttcaagtgaatcggaagaagaagaagaatcacataagaaatttaatatcaagattaaaccattgcaatctaaagacattcttaagaatgctgcaactgtagatgaattgaaggcatcaataggcaacatcgcactttccccatcaccagtggtgagtgttgtgtgtgtgtgtgttaagctttagtgagattgaacagggctatgttctgcctatatgcattaagtcaatcagaaactccttaaattgaagcctgcatatggtcaccatatcatgaattctataaatctaagaagctcattctagcttgagaaaattgtacttattttatattgcagtccttgtgcttttcaaaaaggtgaaaaatatatggaaccacattttcttttgacttattttcctgcaagcattttaaaaagaaaaaaaaataaaaagattatccagaattatctctcatgcagacttagcaactagaaacaacatgaagttcacagatttgctaacagtgatttttaaaaacacatcttagtttccttttttatgatacaccacatgaaaatacgtggaaggaaactggttattttttgtattgctatgctctaaaaccaaaaactaatccaaatcatagtctaaatcaaatttaaaactcatatccttcattctattgtattatcaaattgacttaaataatctcatctttaaggtacctcagatataagtattgtcctatttatattgttcaagtaggtattttcctacagacaagctaagatttggggtaaaaaaaaaaaagagattatttttgcacaatttgcactttcattccccaattcccagctactaagtttctttaattgctgaattctgggttccaacatgtacagccttttctctgtttgataaatgccaccattgttttctaaaaatggttgtgaggaacagatgaaggctctcaaactggcagctaatgtgttcttggcatcttctttagagagatgtgatctcgtacagcattccccctgaacagagcagttaataaatgctgaaccattttcgagatgcttcaggaaacatctcaactaacctttctaaatgaattgtaatcatccatcttttgagaataaacttttgcctccctgggatgaaaagtgtctataatgacgctttctttagtgtttaatgcttataatggacttgatcactactgttggtaacaaccaaaatgattgctaagagaaactaaccacagtaaataatatttaaggtgatttttaatcatatactcccctgctactttaagatgtcttcttgaaaagggaagcatgaaatgtattagttttcttttccttctataatggaaggtgcagattttaaagttacatattggcctgtgagttctagtaatggtggtattttaaaagcacactctttcacttttcagtggcatctttcaaattatttttcacttactgaataatattttttactgaaaatctccttaaatgtctaaaaccagtttacagccatgtctgtgcagtttattttattcacttctctgagtttgttctctgtgtaataaactggccctttggaagctacctggggtaagtaaaagaaggcaagttcagaggattaagtgaacacatttatgtgaaagcaaatgtaccggcacagtcccagaaacatagtggatgtttgccggaatgtagctgaatccaggaaggaagagattccctcttttgaatggaatatgtatgcctaagttttctggtagctattcctccaaccagatacattgctaaggatgcagcaaaatgtggtggtttactctaagctcttctcaacatctatttttaaggaaatatattgacatgatgtggttaagattctgatgaaaaaatgttaagggaagcagagtgaaaactagatggagacacccagagagagtgacctcggagttactctgtttctgcaaaccaacaacgccacagaccaagggaccctcagctcccattcctgcacccacacctccagtttgttccctgtaatgtgagaacctggatctcctatttttgtgattcctaaatatttataatttttcatagttggtgtggaagagtgagctgttactactttaggaaaaggtgagcaggtttctggatgtacatgagtttaaagagaggttgtaactgaaaacatattcttggctttagaatctttgccctctccttgataacccgtgtgtaaatatagatagatatagatatagatagttttgttgttgttgttgtttagacagagtcttgctccgttgctcaggctggagtgcaatggtatgatgtcggctgactgcaacctccacctcacgggttcaagtgagtctcttgcctcagcctcccaagtagctgggattacaggcacgtgccaccatgcctggctacttttggtattttcagtagagacagtgtttcaccacattggccaggctggtctcgaattgctgacctcaggtgattcgtccgccttagcttcccaaagtgctgggattacaggtgtgagccaccgcacccagccatgtacatatattttataaatgacatatgcagcacttcctctccagagccagataagcagaaataacctaaaatccagctggtgccatgatcaaaatgacaatgattttggactttcatgtctccagccaaaagagcagacaattatacatctatactttcttcaggcactaaaaaggaaatagggtctacacaagttaatgatatatcagaatattttatttaaactatggtttttatactacaaaagcatcaatcattacattaatagaaatgaggaaatttcaaataataaattattcataacaatggtttacgttggacttctgatttatgtttcttttgaagtttttaagataaagtcgtgcctcacttattcttttcatttatttgttaatatgtatccatgaactataaccaatttgatctcttttatcatgaattggttttattatacttgaatagtttcgctatatatattgggcggtcaaattaacgaatgaaatgaaatgggaggaatgaatgaatcatataattatatgtatatacaatataaacttatctgaaatttacttctcaagacaaagtgtcagaagcaagacaaatcaagattttaattgctggcaacaatcctattgtacagttagacaaataaacaaaattttagtccagattttgccttagcccttgattttgatatagaaataaaatataatgttggccaggacaaggcagagcaccaaaaaggcagaaggctaatgcaggagttaactcacaggtaaaggataataattctttttcttatcatgttccagcctgctgataagataccaagcttacagggcaaagaatgaacatcacccaggtttgccatctggtcaggttgatttggcatctgtgtaagttagaatatttgttaagctgttttaacagagaccaaaataataatggcttaaacaatataggtggtttctttctctcccaagtgaaagtcaaagctgatagacagtccagaggtaaaagagtcttactccagtggtcattcagaaacccaggaattttctgcattattgcttctcgtttcctagagtagcactgctgccttaccactgcaagtacttccatgcaccagccttgggatggaggaaagaataaataaaaagcaagtggttttctttaagagtttaactcagaagttgcgcgcatcactaccacccagatcccactgccacaatttaatcacatggacacattcactgcaagggagtctggaaaatgtagtgttttgctagataaacatgtagtagccagctaacattcggggttttattactaaaagacaaaagaacaaatggctattggtggactttgacagtttcttccactgggtcctgaattatattgtatctgcatcttaaggttagaattaagtaatctcagattatttcagagagttcattaggaaacgggatttcttcccatatatgttttaaaatattcccagtacctattaaatccagaatgttctaaaataattttctaatcactaatttataaatactagtgataccgtgctgcttgttagctaacaacaggttgaacagagacactccagtgtccctctgtttatgcaggttcactgttttttaaggcaggctgttccattgctgaaagaaaagtcttccttttattaaaccaaatatgtaattttgtccttgattgtagttgtactctttaaaggatgaacaaatggtaaagccccttcttttaccagtgagttttcaatgaagcagaatgactccaactccaagttcagtgtgcaagatgttttttaaggagtgaccttggacttaatacctgtgatgtggggtgggcagagggagaagttgagctgctttacacaacgaacaacagcctgagctgatcccagggaaactcaggaactagtaggagccttcagagttagtgtgagtttggctaagatgaataaccttgatactgctcaaccagtcagtgctctgatgtgggccacactaggaaggggcatgcccttgggttaggtagctctctgcagttgaggcagatcctgaggtgctgacagttgaaggctgccaatagccctcccagcaactggtgcaaggaaaccttctgaagaagattctgcatggtgcattttggtgtccatcccaaattctctgttcttgacataaggcctagtgtgtcattgccattcaattaatgcttgcaagtgagtgagtgagtgagtgaacaaatacatgaatggaaccaggctaaggacacagaaccatggcatgtcaccaccctccagttttacaaccatccactgataacacccttcagcctcctttgttcaccacacaatgattctcctaactgtgccctaatcctgggcacatattttcattctttttttccagaacaacactgcgtttgagagacctggggtgtctatggcattgcctagacctaccaggccagaaaccctatcagagagagtgataggttcagtttgccctgtttctttgcgctggcacctagggttatcaccttcttttccaagtgctttctggctatctgtttaaatattttgttctagaattttgggttaatcacaagccagtgtgtagtaacagaaggcacatatcacatagattcagattgtcctgggccccagcccaggtcgaccactttctacctgtgtaaccttagacaagccccataactgttctgatcctccatttctgccactgtaaaggaaggatgataagaatccttaaggactttttgtgcagaagatcctaataacagtacatgatgtgtaattggtactctgcaattgttcatttcttcattacttaacctagattcttttaaaaaaaccacttctccttttttgagggtcatgctctgcttccccatgttcagccttctgacctaacagcatactgtgttttcatgtcctgggttaaaatgtatctacatctcgaggctagaattctgttaaagcagcttggaattctcttgcctgtctcagactttaattctgagccaaatctgatctgccttttagaggaactacttttaagttagttttctccatcttggacaattatggttgatttctctttaaacacaaacagaaactttgtacataccccctgaaggaactgaggtacagtgggaaaagtgccagccctgacctcagcctcttgctagcagtactgcttaggtaaggtacttaaacctcagtgagagtctcagtttctttctgtctgaaatgggacaaacaaacagctaccttacagggtggttgttgccatggtcatctctttctgctagtgcagtgtaaagaccactctccctaaaggaggagatagagacagatgcaacacgaacagttctgtggtttgcttgcctttacaccacactctttacatttagggtagaagcaaacctccattatatcatacaagaaaaggctttgttcttaaagagtaaaataatttttgaaggaggctaaataaaataatcagtgcaggaattaattataaggaaatatgacttcacacacacacatgcacacacacaaaaaaaataaccaaagtcagaattcaacatacaattgaattgaattgaatacaattccctttaagataatttgagggaaaaagaaatgacacttactccaatgatgtcccaattactcaaacaagagggttctacctccttttagttgatgacttttggtatgttgaaaacccagtgccttggtttcttcatctattaatggggtgactcccatacctacttcattgggctattttgagggttgaatgatttaatgtatgtaaagtactcctaatagaagctacatgtaaagattgtctcattgctatagagcctagggcacattttaaagaatatcattaatagtgataaataactcaaatttccaaaagtaatttagagccaagaccagtaattaattacccattaattacccaaagcatcaaactgggaaaaggtgttttttgtgatgccttttgaagacaattccagaaggaagtatccctaaattgttttgagtaccatcaacatcccctgaatacatatggtacttcttcgggagacttattgaaggctaacattcacaatggcacacttcattgtgcatcatggataattgactttatttctaactcccccttcaaatcatttcacaaaatatatgttgagcaccttccatgtagcaggcactgagagctaataccagaaatactgaacagtctgagaaaacaacatctagtagcaaccagaagctgaaatttttcttgtggttcaaacgcttgcctgtcttcacttcagtttcctgattggttttctgcagcccacattccccctggcctccatttctaggtctcctggcttgctcacccttcctagggtctcagatacggacatctccattccttccaaatcccacacggagcactgtctgacacatctgcaccatgtgctgtgctcagcaggtaccttaaaacctgtggctcccatggcttttgtgggagtgagaagacaaatgctatggtttaatctttgatgtgatcttttccttttataatgtgctcccatggattcctttatttttgtttttcagagagccaataatcccttctggcttaccttgagaaggtgtcttttaactacaagcattttgttccttactgattaagatactgtgctctggagtaagtcagaactaagtttgcattctgactttccgtttattatccatgtagccctgagcaaattgcttaactctttaagcctcagtcaaggcttaatcgagtgtaaaataaggttaataatactgcccacttcataggatatttgtaagaattaaggaatgcatataaggtgcttagtactttgtaagtaaatttatgtaaggtctaaaagaggtgcttagtaaatgatagctattattaatcaggataacaataaaatatcaaagtcatcctttaagctcattgatgactttgagaacttatcatggtgatgaatttggtagtggcagctgtgaacacgagtgctgtgtgtcacatacattaattcattcatgctcccaacaacctgtgagatcagtactattgatatccccactttacagatgagaaagttgagacattgagggatttattatctcactcgaagcatcacagctagtaactgaagttgctgggatttaaactcagaaagttctgtttctaattgagaactcttaaccactatattacactagttttgatgaaagccattgactctctttctagaaaaaaaagttcactagctcattcaaaatattttacatacaatttctgaatgctcacatgaaataaactctttgaaggatatcgatggatgctcaaagggcccataatcccagcccaaagggcccacctcacagactttctccccactgagttcatccacatccacccatagaagaccatccagtcttctatggtacagcacttcctatattgtaccacatgacaggagagcgaggctgagttgacaccttgccaggtcaggcttaaatgctgttgtgtgatatgtgatttctcatttattaaaattatcttattatatatgcagattgtttgcacttttgttttaaatgttaaggaatgatgtccattttatatggctcatttatttcagttcccctaatcagttaatcaattggcaagcactttttatgtcaatggcatattataataatgctatgttttataaatgcccagtcatgatcaaaaggatgaaatgagtagcagcactattaagcaatctgggaggtagtgatgcccctattttacggagaaaccagcacagaaagatcaagagacaaggataaatagaatgaacacaggcttttgagtatatatcttattatctgtgtggtcataggcgagttcctcaactcggagcttcagatctcatggctgtaaaatgggaaaaaaattgtgtctaccttcttatgacatgagaaaatattgtaaaatacccagttcagtgctgtctcccagaaaaggtgccattaaatatcaatcaccttctcagctttgctttccttttccttaagttcagagacttgtaggaggcagaaggaaaataaaaatagcgagggaggacttgagcaaactcacaagggctgagagaaatgatgtgagagcaggagctgacctaccctggcgtgtaggctagtgccttctcccttcctctggaaagtaagtggtacagtgaagtaaagaatctgacattgagtcatgaaggaacaattagtttaatcttcatcctggagatttgcaatgcataactttttaaccaaaaaaatatgaggagggggaaatagctttgaactggagacagtctggtgttgtttgcctgttccatgtggcccacccacccttccacccccaaattagcctgccagagagcaaaattcatgaatttgccgctgcttggtaacaccaccccctttcctgtcctcacttcagcagaaggttcagcaccccattgagttcagtgaaaacaaagagtcatcagtggaggaggtgagctccagtctcctacacaccagcattctctcctggtagaagcagtgcacagtgcaaggagaggctaaagattgcatgcattctgatgcaaggcactcagcccagacctcttatttagtaaattagaaggcagaggttcagcttgagttctactcatcaaggaaagcttcgtagggcaaatgtgatttgtattggtctataccagggatatcaaacatggggcatataaactgccactccatccccaaatcttccacagacattgccactaaatcccagacatgggcttagaagccagccccctctagacagacctgcaggcagctggacaaaaatcagctagagttaacacatgagacgcaacttttgtttttcccaggactcatagaggatagatgggaaaataggtggaaattttctttttcaaaatatatttttttcttctcaacattttaataaaccatggactgtg

SEQ ID NO: 2890 - DNA, 6361 bp, Homo sapiens
ataatatatatacacataaaacaacacgttgcccctccccaggctagaaaatagtaagtggagatttataaagtagtaagtgcttgcctggcactgtactaaactctttctaaactgcattgactgacttaattctcaaactcattttatgagatagggtctattattatccccattttccagacaagggatctgaaggtcagagaggttaaggcactcacccaagggcaccactgggatgagacagagccaggagtttctaccccagcagtctggctgagtctgggccctcagcccctgccaggttgcccatccctcagatgtggcagtgtgcctggcacccttcgcccctccccagcccctagagggagccatagggctttgtctcctgggcacccccgtttctagtcggtaaaaaagtggttcagggcagggagtgtagagtgccagggctcagcaggaagcacctgctctgacttccattgttatgacaggggtcaccatggcagaggcacagggaaatgactctgggaagagagggcagggaggtctaaggctgttctgactgaggagatgctgcgtgagctgggcgggaggacaagtaggagctgaccccaggttcctcagtgggggacgagtggaagctgaagaccccatctttctgtctctctctggcagttactaccttatcctcagctgtggggacgctccaccccagccggacagctggagggggtgggggcgggggcggggctgcgccccccctcaattccatcccctctgtcactcccccacccccggccaccaccaacagcacaaaccccagccctcaaggcagccactcggctatcggcttgtcaggcctgaaccccagcacgggccctggcctctggtggaaccctgccccttaccagccttgatggcagcgggaatctggtgctgggggcagccggtgcagccccggggagccctggcctggtgacctcgccgctcttcttgaatcatgctgggctgcccctgctcagcaccccgcctggtgtgggcctggtctcagcagcggctgcggctgtggcagcctccatctccagcaagtctcctggcctctcctcctcatcctcttcatcctcatcctcctcctcctccacttgcagcgagacggcagcacagacccctggaggtccaggggggcccgaggcagggtccaaacctgagtgagggccagccatgcctcccctcccattcctctggtccctgccttggtcccttgcctgggaagagggcgaggaggccagtggtggggacgcagagggtcctcagagcaggagtgacaagggaggaaagaccaaaaaaacaaccaaccaaaaaaaaaaaaaaaaaggaaagaaactaaccaacaaaagagaaaaccaaaaataatcacaacagaaaccagctgccccaaaggaaccagaggtgaaaaacaaacaaaaaaaaaccaaaaacaaaccaaaaaaaaaaaaaacccacaaaatcaaacaaaccaaaaaaccagtcgcgagccagacctcagcgtgctcaccctcactgctacgacgccaaataaaaaccccagccaggggcggagaagcctccagcaggtcagacctcatgccaccgagccctggctgtgggaccaacccccaaccctgcctcccccgtgggggctacagaaggaaaaagagaagatgccagcttcctaatcccagcccccagccctgggccagcgaagacagggcacagcctgggcagatgggctggggcttagcaccacccaccaaatgttcttttccagaaggtgaaagagaaagggcctgaacaaccttacaccaaatattcagtagcttcatccaaaggatgtacagaatttttagcattgtgctcaacagaatgtgtccctaccatgtgtccccttctcccctggcccccagctctccccacctgggcagggggtcttgctttaacctcctccctccccccagcaggggagagttcaagggaaggcctgcggacaacttttcatcccctgttcctccctcttttcccctttgaagggtgggctaggccattttgccaagttctagctctcacaagtccctcctcaaccctgtcaccctcctctgctctggaactgactccctccccagcctatgggaaggtggaaatttcaggcaagaggggatgaagacattcagttgagggcattcagttgtctttttccatcctgtctgtttccctgaaaaaaaaaaaaattcatattccagtgcctatccgtgggatccttcacgttctttgacattaaccagaaaccaaaaagagaactcacctcgcttttcccaccctgtgcccctctggtactggcgaatgcctctccctccccccacatgcacgcacgcacacaccccagtggtggggttcctcgagatggcatccccatcagggtccatgtggtggggacagtgccacagcctgtggtccccatctgagagggcgcggtggtggccaccactcccacaagacctccacaactcttggctggaccctgtgtttgaccagccccggacacgtctccactgacgacggacagaggagagacaccactgggagccaccctgccctcctgctattgtggaggccaacaaagttttgaaccgaaaaccaaaaaaacagaaacaaacaaacaataaatttaaactagaaaaaaaatttatatatatatataaacatatatatatatatatatataaaagggaaagaagatgaggactcttcaagaataagatggaaccgcgaggcggagccaagcccctgcaccggtggtccaggcccttgttccccaaggcggatggaaggacggatgcttctttctcttcacaaatacctcatggacgttgtctttgggaaagccggagggggcggctggggcagggcctgtccctcggccagggcagatggaagcgggtgggcggggctgagagagggtatcagggacaggggtgaagagccccaaactcccctcccaaatcaactgaaaaagctttaaaaaaagacaggaaaaaaaggagtaagaaagcaaaaagaacagatgaaggaaaacttaacaacttttgggtggtttgattcctcctttgatttctttttcggttctcttttgtctgacctctctcctcccctccttcctctctcctcccctccttcctctctcctctcctccttcctgtctcctctctctccctttgctctcctctcttctctctcaatcttgttctttctgtgtctctcctcaaaccaaagtgttgcagtgaaggacacgagccattgaaatcagggtggggcctgacagccgtagtgtggcccctgccccttgttgggcaggagcagagagagaggagagccctgagaccgcagggctttggcctgggcagcttccactttctgccggacactctgaggagaggcagatggagctccaggcctcagcgttctcttttttccttgtctcccttctcccacccgggaaatgaaactgttgggctgggcgacggaggcagcagagactcggccattgcaggggcctctgggtgccttgtccgggcagtggtgaagtagccgcccctcccaccccggcacgatggggcctggcacctcgtctacccaacctcaccggaatgtaagcatctccgctgaacgactccctgcccttaccctacctctgagtttgtccatgtttatttcctgaagagagaagggactggcaagagggcttgggccccagcccaagggtggagagggggccaagggctcctgaccaaataggaaggacatttgagcagagcaaaatgaaaggaattacaaccaaaaaccccctccgagaagacaggcagcatggaaggcatggtggagatgactcaaacaaaaactatgattctagaccaaaaaggaaaaaaaaaaaaaaaaaaggaaagaaaatccaggactcaccaccacccacttcatcctgcttcctccccatcaagtcccaccacctgggacctctccccaccccagtatgtgggagtggggtaaagaggagaggaggagcagggggcagggatggggcagatgccctgatgttggtggagggacccctgtgcagccgggggtgctggggaccctccccatccaaccctcacacctaggaaaagaaaaacaagaaaaaaaaattcctgggagggggaaaaataaccaaatcccaagctttaactacagctgtgaaaccaaatattgggaagggggtaggagggagggaggggcaggtgagccccaggtctccccctgggcccccctcccctgaggactcgagataaggcaccaaatacctcatagaactttaatgttaaaaaaaggaaaccaaatatcgttggctgggggccagccagggcaaggggctggggggctggagggagccagggttgggaaggtgatgggggaattcatgccccccacccccatctgccccttacactctggtcccccgtctcgactccgggaaacaaaactatctcatcgtttttattttgtggtctgtacagagcctgtgtccgtgtgtctgtgtatgagcgagagagttggagggctggggagctttatgtgggggatggggagggcaaccccaggctaggctatgggctaggttagatgtccgaggttgggggccaagggcctgggctagaaagagaggagagatgagtgggttggagcagtggggagccctctgaatttctcttctccccaaccctgacctcctacttaagggagggacagagactgggtctaccctaatggtgggccttttcattgtgccaaaaaaaaaaaaaaaaaaattgatgccagtaactaaaccacctctctctgttctcttctggggggtggggtgggtgtgtgtgtgggggtgggtagggatggggaacccaagccccagtaggagttggggctgagatcaggaggaggggaaggatatgagttttccatccatctccctggagaaggccatgacgggctctccaagccctggggagatctggcgagggactagccaagtcagggtgacctcttgacctgactagtttttctaacccacatgaacaccagggtgcctctctcttcctctagcccagggtagggggacctgagtgagagagagagtgagacagacagcaagattgagacacgcgggcccccactggtctctgagtgggaaaggcaagtgcgagagataaaggcctccaagagaaaaaagaaacaaaccaaagatttaaccatttaaaaaaaaaaaaaaacccacagacaactccgctacctttttatatgttggaaaaaaagtgaaaaaaaattaaaaataaaaataaaaaaaaatacacaaaaactccaagccgcaagtccttcatgcggtttaaactttgacctcagcagtctccaaagcaagacgacgatgacaaaggcggaaacaaagaaaaaataatgtatatttttaagtatttgtccttgaattgttagctccttgttaaacaaacaaaaggagagaaaaatccagagagaagtgttgctgggatggagacaactatttactatgtctgtgacccctcccttctgcctccctccccttcctctctttcctgtcctctatccttgctgcccctcccccaatatgtcccccaaacccaggggctcagtatttatttatttatataattgcagggtgactgggggcctctctcggcaactcgtagagagcctttggataatggcagggtggggaatgggcgaggagtctttgggaagagcaggggcctgaactttcaactcctttctggcctcttgtcccactgcttccaccatcaccttccaaatccagggctgcactagggcaaggtgaccaccctacttggtaaagacctgattggcgcagcccattctggtgtgggtgtctttcaccacccagaatgaccaggttggaatgggggtgggtgaagttggagggggtggcaagtacaaggcaagggtgcccaggaaccggcatccagaaatcagccctggagtagacctgcctttcctccatccttaccaagttagcctccctttcagttccgtctgacccctgtgttggtagccccttccttcccttcctgtaccccctccgtctcttctcgtggtagcgggttagtgtttcagtgttcttaactccaatctgcttgttcattgtacaatgtgcttcttttaaggccccatttttgtaacttgagtgtgtcattcatctgaacaacaaacatcaaaaaataaaaaattaaaaactgtacagagagaaatg

SEQ ID NO: 2891 - DNA, 2473 bp, Homo sapiens
acggagtcttgctccatcacccaggctggagcgcaatggcgtgatcttggctcactgcaacctccacctcccaggttcaaataattctcctgcctcagcctcccaagtagctgggattacaggtgcccaccaccatgcccagctaatttttatatatctatttttttattagagatggggcttcgccatgctggccaggctagtctcaaactcctgacttcaggtgatccacccgcctcagcctcccaaagtgtcaggattacaggcatgagccaccgcacacagcctaaaatactatttaattcacaaatgatccattcacttcagaacaaacaaataaatgaaaatagctccataaccacagatgtgacaactcctcctggggcactgtcacccaatctttactcaaatgaatgcatgcattcccaccagaatacaggatgtggggacgcgtggctccattcacattagtgccattctcagaagcatgactaggtgggtggctcctacagatgacgtttaactgccttcatcttcacagaggacagcaatcacctcattgagctttatagcttacagaggctaaaaaccactctacggaggaaatccaggatttccagtggtactacaggagatgaagctgtacacaggctactgaggactgaaggacaacttacttaggattcggaatgactacccagcttgtgagtggactaaggcctttgattctcctgcttcttctcctccctccttgatcttttaattgctcataaaaactctatgaggtcagcagagcaagatgcaaagaatgtgtccaaatagtccatttggtttcttttgagtcaatcgagttaaagtgttttaagagaagatcaaatctattggctaacaagaggaccagaggtcatgtgtggattttgattgtccataccatgcgtgtccaaaccagaatgagactcacagaagcagagaataaggagctatgagagaaggaatagaattgtttttcagctttacacatttgagagatgcagaaaccgatgcccagagagcataacggacttggtcaacgtcacagaacttgtttaaagtaggataaaaaagcacgaagtcatttaatatttgataactagcatcaagtatgttatattgaatatatatatttatattaaataataaaaagtttcatctaaggctctatttttaaataacagttgttttccattatagatctgcaaagacaattttataagtcatctgttaataatatgttatttcaaagcaaactatccatcaggcaatcataaagtatgctaggaggtggcatggcttttgtttcacagaagaaaacagagtgagatatatttgatgactgaagcatagaagttcctttgagccattagccaacctgctactgttcccgcaaagatatcttaaaggactgcacaaagtgagcacaactgttcctcctgggaggtagaaagcaggaggggacaggcagggaaatatgaaaaatgaatctttccatcccctcatttgcttgtcactgtacacactctcatgagacataagacacactcttatgtctggaaggtgtgatttcaaattttacacaacctgaaagaaggaaaggttctctgtcgacactggagaggtaatagggcttggcatggggagagatgaaattcgagttacacttgggacaactttaatttcaatttataataaaactctattacaaggctatactacagatagtcagtagaagactcaactcaagagcagagagggctctggagaaatgtagtagacatggaaaatgacttttgcatgggagaaagaatacagagaagaggaaaaaataaagcctccagcagtaaaccaggtcttccttgaccctcagaaaaatcaagaaaggaatattaacagtactgtggattgaagaaaagccaaataaaccttccgcaataatagcttgtcttatagatttgcaaaaagtaatcactggagaaaatgacagggccagcataattccagaggaaagtgaaataagaaagacacctttcattttctctatggggacagaaaatatgtggtggcaatgtagggttgtctcagaaatcttattggccacatttattcctctcattaaatgttgatacgtgtgacacataatatgttctgttaattaagcctcttaacataacttcgtggacttcagaagtttgtaggactcaggggaagaagattctacaacccagcaaacttccaagaaagcaattacccagaagagtttatccaagtgtgcgtggctgacaaagctgcctcaccatttcagaacagtgcatctgcttctctaactgaatgctggctgatccagaggaggaggttcaccccaggattttgtggtatcaggaaaaggtacctcaaggaatgggtaagcagaatgtgatggaagcttacccagaaatac

SEQ ID NO: 2892 - DNA, 819 bp, Homo sapiens
agaaaattgtgaccttccattagtttcttctctcattagtccatgcacacggggcatttcctaaccgaatgcagctgggcagaattaggagggagggtgtgttcctttattcaggaatgtattcatagtggcccatatggggagtgggtgtgggcagtgctaagagattctgaggaggaaggtggtggtgtgggagcatcattgaagtggagccgtgaagcagaggtaggattttaacaggtggaatggaaaaggtggccttccaagaacgtgtgtgacataagcacacacgcatgtgcaatagtttggtgaagtggatatgtgaggagagaggggaatgatcaggttaggagtgatcagccctacatgatcagaggtggggcctccagcatgggagacttacgtatagggctgagtttgttttggaaaggtcacttcgaggggtggttggagtagagtccattcagaagtctcttcataaccatgaccttatttggcctgtgctctgttgactgcccccagacagttaccatttactgagcaattccagatgccaaggttcattaggcacttcccatgcaagaacactgtggagtcagcaatcgatcctggtcttacaggtgtgtctgtgtctgggaaaatggatggccgtgtctgagatggttttcactgctgaaatgaaagcttcatttgtaagccaatcctttcttactccccctcccttcagatgccattgtctccctcattcctttctgctgtcatctatggggaggttgaggttgacactttatcactctcacatgccagatagaattccag

SEQ ID NO: 2893 - DNA, 1486 bp, Homo sapiens
tactctccaaagactgattgggtaggaccagggcattggcatgttaaggctcgccagggaattctaatgtgtacttaaggtcgagaaacagctttcatcatcacaacaacctgcaaggtagggatttttagcttcattggatagataaagaaaatagggcccagggacaacagacaacttgtgcaagtacaagatcagggacttcaaccttggatctgtctggccaccaatccctgctgccaatttgcttcacgtgtgtttcatgaatccgtaggtaaagagtaaacagacagagcacacagatgaggaaaagggagcccagggcagcagcaccccacaggagcttcgtgcacaggaggctccaccaccaccctgagcctgctgtgcagcatgggggtcacctgcaggaacccaccagggcagagcctcagctctcagcctcccggaatgaaccatgaacccaaagcaaagagcagaactcctttgacacctccagcttcacagacaaagatgaatctcctaaggcatttctgaaacatgcagttctgaagtctggccagccacaccaaagagcttttcgcaagaaggcacaggccaggtagaggcagctgtgcagtgggaggactgtgatgttttggactagaaaataagacgcaaatgaggccaaaaaaacacaggcactgcataaaggtgtcttctccccactttataagccttatgtgtgataatattcaatgccacagcaaggcaagcaaataggtccttggagggagggatagctggattttaatcctggctctacactaaggtcttggactacttactgcaggtctctgagcttcatagttttatgtataaaataggatgaagaccatccccaaatccacttcgatggtgagaattaggtgacatgacagcagaagggcatttagagtttggcacagaagggatctcaacaaatggtagctgtgtttcatcgttcatttgagaactgatgtttggatccttttctgcatcttgaaatgtcccaaaatattcctccttaagccctgcagttggatactcattgatacttctctgttcaatttatactgcgagcaggggagggaggcttgagcttggttccatgaacgaggttgaagggtgtaagtctcccagcttcatttctgtctcctcctcacctggggagccatggccaattctcttcccaggtcacttgacttctccatgaccatgactttcaccttctgcattttggaacaatatactcatgaatgctaagaagcttttgtttctttctgcctgtgctgagcctgtctactataaaagaaaaatcacaatggttgtcatagttatgctctttgcttcctgagtggaatagcaccggtttttatgttacattatactatattctggatctctctttgatggtgggttatggagaaggtttgccaattctttcttttacaattctttttaaataaat

SEQ ID NO: 2894 - DNA, 1114 bp, Homo sapiens
cactaattcactcactcaacaaacccttgagttcctaccatgcttcaggcctgaagggataggtccccagggctgaggtctctagggaaaggccttttcccagaaggcttgtaaggtcctccatcctggccattgttccgggattcaacctccttcctctcctcttgtctctagctggtgaccattcagagctgtcccagaaccccaagcaggctgccacgcagagtgagctgcactacgcaaatctggagctgctgatgtggcctctgcaggaaaagccagcaccaccaagggaggtggaggtggaatacagcactgtggcctcccccagggaagaacttcactatgcctcggtggtgtttgattctaacaccaacaggatagctgctcagaggcctcgggaggaggaaccagattcagattacagtgtgataaggaagacataggcttttgtcctgcctcgccatcggagctctcatgggccccaggaagtccagggacagctcccttatacctggcccacgtccttctcagcctgccctcgacaacagtgaccaacagacaggcagctgggtttcccaggccatccctctgttgccatcagcttgattggcttccccgagggccagcagggctgggggctccggagagcagcaggaagcactcccagccaccagtgcctgtcacctctttcccctttgcccctgcttcatcccagctctgtgtgtggaggacaaagcttcttcctgcgtggctccaggaaaagatgtggctcacgtaggtggcacctgccaatagctttgtcaatcacagccccataggaacgtctggaattgcttgggagttggggagaactgtcaagaagagtgaagagagtgccaaagcggagatctgttcacctgggggccatggaggggggacccactaaagatcaagatcaaagattctccccatctcacagacaaggaaactgaggccagagggaggagagaattgctcatggctccagaactggtggcaagtttctctggactcttaggtttatttttaatatgaaatataaaaacagtttcaaatatcttattgagggagaagtaaaaacttatttaaacaa

SEQ ID NO: 2895 - DNA, 471 bp, Homo sapiens
gtcaaggtggaaaaaaacagtcgtgtatgcttctttaacatgacagcttgcctggcctattttctgtcctttcttatcataaacttcctactgcctgctcctggtttgcactagtcattagacatggaatcaggaatacagacttccaggaaagagtccttcatatcatgaaatctgcagatgacacttcaggcacctctgctatcaggattcccctgggccttgagcgactctgagacatctctgggagacttgccaacagagactgcagccagagcacccacaccagggagcagattctgaagcttctgttgctggagcagttcctgaccatcctgcctaagaagccccaggcctcagtgagagagcatcatccagaaagcggaaaagaggctgtgacctgcttggccatgtagaagagaaagactgatggatcaagacagcagatcagaatctaaggttgaagatatg

SEQ ID NO: 2896 - DNA, 633 bp, Homo sapiens
agaaaatactgtgttgcttagccctgagattcttcaggagcaggtcacccctgtgagaagatcaccttcccatcctgtgggtatccacctcttcatggcttattcctaaaagtctgaagactctaaatttaaacgtttttcttcatttattcctaaatgaagatattctcctcatttaagaaactgcttattttgacaaaatcaggagagattttatgcattatattcataaataaatctctctatgttgatgaagaaaagttaaaaattttaaatgacatctgtagcagccctcagcgcagtttctcatccgtgaaaactcagagaaagaagaaaattctcaacgctgacaaccacgactgaagacaacctcgtgtttcgattaaaggtttgcaaaaacgttgctgactacagggcaggtgatgattaatagaggaaaaccaatcctggaaacactggctgatggagagagcgccagaggaaggggaggatagttattcctctttgcccatgtgcctgctgtctcagagacccagaatcttcaccaaccataagtctaagagcacgagaatgaggaatcatggcacaaaaggatgagtggtattggctccagatctatagagcactaagggg

SEQ ID NO: 2897 - DNA, 18532 bp, Homo sapiens
gatccttcgggcagccgcgacttcggcttcgcgagtagcattggttccttgggtttatttcgttttcctctctcttctccaccttagtcgcccctttcgcgctgcgctgtagcgtgctctcacagcctttttgccttgaactgaatgcaggtgggaaacaggtcggcgtgccgaaagacaccgagtaggtagaaataaggcaaactcacagaggcgcaacaggtccggtcctccgtggccagggcgagccgcggccccgcgtggcgcctcggccgttgccctcggaccctgagcggccactgttggggccctcgaaagaggtgtcggtcctctgggagtcggaagagctgtctgggtgggtttcgtcttgctttttaccccaccgccacccagtccccggacggagggtgcttttcacttccagctgggaggagagaagaaagcggggatggtgcacgcctgcgggtctggacgctgagcaaggcaggggtccgtatccgctcgtgggcttgactccaccaactagttgtgcagccacagggactgaactttggaggaatcgacctttttctttccttttaggattatttgaggtgtagagggtgggaagcgaagccgagacggccgaccccgccacgatgctgctgaagaagcacgcagggaaaggagggggccgggagcccagatccgaggacccgacccctgccgaacagcattgtgcccggaccatgcccccgtgtgccgtcctggcggccctcctgtcagtggtggccgtggtgtcttgcctgtacctgggtgtgaaaaccaacgacctccaggcgaggatcgccgctctcgaatccgccaaaggggccccttccattcatctgctgcctgataccctggatcacctcaagactatggtgcaagagaaagtggagcgacttctggctcagaaatcctatgaacatatggctaaaataagaatcgcaagagaagcaccttcagaatgtaactgcccagcaggtaaaatggaacttatttaacaaggtttcctccagagcagagcattttaaaacaaaggtcctgtgtctgtcaagtctacctgtaataatagtaaagaaagaatgcagacccaacttgctttaataaaatcaacatgtctcattcaaaaggatggcaaataaagccccaaatattattttaagcagcataccaaggcctgttatgggaaagcaaaggatataatcaccaaagaaaatataggcaaggtgatgtacaaggacaaacttcttagattcacagattgaaaaatattcttcaattaaattgtcttaatgtctacagtgaaaaggactgtagaactgttagattctgaattcctggctcgctcttattgtgttagtgcagagtttttttttttttttgttttggtttattccctttggcatacgtttatgttagtaaaccaccttcacttcctttcctgctgtttctgttctattaaaaagattccatctcctatcctatagctagagatgatgactgaaagaaaatgatttctttatcttgagcttcccattacaaactcttgcattctcagtgacttttgaagaagaggctcttatatttttacctttttttcctgtgtagcttcagggaactatattaaaggcagcatattagtagaaggacagagaagaaggacatcatgaataagacccctgggtaatcattaaatcttccttcatggacctttgagggcttggtagatatcttagacctaacaatttagaagcccttggaatatggccattggaaacatctagtggattcaactcatgtaagtcatgaaaaactcccatgagttgagatgtttatttcagataaacattgttaatacatttatgaacatgatagtttcttttatcatcactcatggaaagtgagtctcttaaaatttctttagtattaagcaacatgatacttaggtgcttatatatgaaaaggcaagttcttgtattttttcatattctgaaacgtttccccctcatgataacttgttttggcagagctacacaaggcaccacatttagaaattttaaatgtcaactccaggttgtaccttatacaaattttactatttatattctgttaaatttttgaacataatagagctatatctttaaaatgaagcccttttgatcgagaagacatatatgttaggtaccagaaaaacagagttaacctttgacagtgtaggtctcattcttagttgttttatgttggaaaatatctcagaagtcagatattcaaggaaggcacttttctagtgtgggaattaactcaaccacctcatcagcctgtagggattatttaaattcccaggacagttggtgcaggacttcactgatcataccacgtagagtccagcatttttttgtatacaatattcttactagctctgtgaaaaatagctagtgcttaattaatagaattcttaataaacttagtaaaaatagaaaagtgacaaccacaacattgagttctattttttgagaagatataattgtttcgtgatgtttaatgtaggctagctactgaagtctaacttgcaatctaaaagaaatctattacatttaaaatttactgtatattatcttagattattttggaccatttttcatcttagcatgtgaacgtaataataaatggagatttcctaggcttttttgttggctcccactaatagctgctttacctcttgccaccaccagagctccacattacatcagtttttacctggcagcttccaaggtaaacatttgaaggtgtgcattctaatatgcagaatcaagcaggtttcttgctgacaaactgctattatggaaatactcccttttgcttgaggaataatcagacatcatcaaaataaggacattacgttgaaaataatatcttggggaaaactatttatttctaatacggccagtgaggagttgtcttagggaatgaatgggctgaccaagaggattagaaaagagattcagcacttccacctggtttggctctagccctggtttgcagtgactaagagttgtcacctagacatctgtttgtagggcagagtgagacaagtctgtgacctcagctcagttcctgtggacagatgcccaccccttgaagttaacactcttgttaacagttttagtcacagagccaaggactgatagcaaagaagcaatgatgtgttgtttgtgttcactcatttcttttgatagaactcagtcccagtgaggtttattcaggtaggctctaagggtaatcatagaatttatagatatatttttatgcacaaaaaggaacctctgtgagagagagatgaaaaggacaattttttaaaaatggcttctaatggcaggggatgtactctctaatttaattttcacaatgaccctgactgaagtattagcagtctcattttacagatgaggaaactgagactcagagaagatgattaacttaacatggtaaaggcaaagtcaggattcatgcccacatctgatagaactaaaagcccagtctaccaaggaatagagaataagtataggttttggacctggataattccggattggaatcctggatctagtactaaatagctgtgtacattggtcaaactaatgaacttccctatgttctaatttcctcatcggcaaaaaaaaaaaaaaaaaaaaaaaaaaaaagaaaaggaaaaaagactaataataccttccttagggtaatagtttacctaaatagtctggtatattagtggctatccattagacaatagtaattactattctttttagtatattatatgctacttagctctgctgtgatctacagagacacatgaaataggtgggaaaactgagacctggagatgttgtataatttgctaaaaacccagtggctaattaatggcaggtttggactagaacactgtacttaattaaacaaatgtatctgtagattattcatgagataatcatactagtcagtatttcttggtgctatataaataaagattggttcttttttgatatttatataagtctcctaaattattcttacaaaaattgcagggaaaacttttgaccttttaggtaaaccatgattgaagtggataggacctgggcttaaaagaccatggggatattaaaaaatatctttacagttttaataccagatgtttacaaaaagaagtagcttaattatgtgactccttttcaattttaaatagcctattgcagtaaaatttttaatatttacctattttaagatttttaaaacagattaatagagttgggcagccatcaccacaatccagttttagatcatcttgtcaccctgggaaacttgcatttatttctttcatgcagtcagaaaagctctattttaaaaaatatttggtttaaagaaacccaaaatgataattttaaaaataataatcttaaaatttccatacaaattgaagctgtgtttagcagaatatttggtttagcagtaaccaaaccagagaaattcagctggcatctgtggcttggcctctgtaaaattcaactctaattggaaagaataagttggctctttgctatggctgtagaatttagttttgggttctgttcttggagtcctatataaaatatgcataaaccaggcatatctatgagaaggtttttatgtttcaactgataaagaacattgggaaccaggcagccaaccaaaagatgtgtagattacaaagatttctgtatcttactcatcagtagtgttgcctgcccaggatattaggtataagaacctctgtggtgtaatgaacgaagaatgtggatgcggaataaagaatccaaagttctaatcctggctttgtcattaacttattatgcaattttgggaagtcatttccaagaacacctcttagagtttctattttcatatctccaaaataggagtgctggacaagaatgattttgaagggcatttgtcagttcttcaggttaaatgaaaaggctgctgtatgccaaatactgtgctagacattgggaaaatgttgatgtacaaggcagacttggtatcttccctcaagaagcttacattttgatgaggatgacagacaaatctttaaaaatgatgtgaatgtacaggtatgacaagtgcaaccaagaaaaagtatagtgtgctttggggcagatgactaaaatctcttccatttttgtaaacccaaagattttatttttcttttctctggggaaaataaagaaaaaagtataattcttttctagaatttcacaatagagaaaatctggtttccgatgaaaataaaaactctagcaatggataaaaagctgatttgccttttaggtctccaagaatttatgaacagatagaggtacactgatacctggtatacttaccccatgtgaaacaaaaaaaggcacttttaatatataaagggttgttgtagacaggaggatgatggcttattcttctacttttctcctgaaaatagggagagttaggttgaataaggagagaaactttttgtctggcttactgaacagtaccactggacctggctcctgtacatttgtgataatcattcaatgtaacacagctagtcatttgcttggagagtttaactagagataaaaaagatacactaggtaacttctgaggtctctctatacattccaagtccatgaaaatgatggtgtacaaaataagaatacatgtaggcaagcgattcacataggcaagcaagattcataaatgcaaatgatattgcccctggtgactgacctcgttgcctatgttctcatttttgggtggaaataaatgttagctgtagcttgatggttgtgtactctttcccattgtataagaagaacctttaaattacctttctaacataaatttactttctcacataaaacttgtgtttcctagtatacatggtttttcacttatgctatatgtttttatcttaacactgcacaatctatggaaagagtgcatcaagtaaggggataataatgtgtagattttcaattatgtaaggtaaagcatagtcagaaacagtttgcagaaagaaatcaaattaaaatgctataaattttatttaaatgagaatagcaggcattcctctcttcttataaggccaaacaatacaatgtgacatctgagtgccttcaagcatccatgttaaattgtttcagtcctaatgagtacaacagtgtggatctaacacttttagttggtccaggagtgacagctggtaaaaatgcccagtcacccaaagtgccaatgacaaattgcctcttgaagcaatgttcttgtttcttagcttctcttgtctacaagtttttaagaagctaattcttaaactactcttttctctttcttaccttaataattctattttttcatgagctgggaattacttaaaagaaggatacaaattctgcatagagtttaattcattctagctcattcaaattatatgtagacataagaagcctctcagggccataatatcctactgtgcttctgattgctttgtaattgtgcaaaatcaactacatgatgttaatgaaaatagtatctgaatgtcaggcttaggtctagggatggagaaggggcatcctcttactaacaggattaggtgaatggagagatgatggggaaatatgtcagaatcaggactgctttgcagccctggggggcatttcctgtttcagggaacctcacaagacatttatccaaataacatcaatctatgttatcctgagtggaaaccgtccagaacctatcatgaaaaaggtttttatttcatactatcactttataaacaattatttggtggttttaaggaagctgagaatgtgaaaacaatgtatgagtcaatccgggctgcggctatagcctagtgtgcaatggttaaatatagatgcatccccagcctccctggtttgccaatatgggtgaagttccatgtggtggtttaacgcaccatgatatttagcaccttttccctggtttgtgttaaaaattactgtagtatgcccacatactcaattcttagacatggatagttactgcttcatttgggatttattcagaaatcttgcaattaagaaatattattttaaaattgactgttttaaaaaagttaagtatagaagagtgagaagcagaagtaagtggaaatcacttacaaattaaaattgagcacttttcattggcatcatatattcctccaaatgactattctgtgattcatttaaatgaaaggagccattgaggaaatggcaccagatggcaggcacctcccctttgtgacctctaggaggaggaactgagctgaatagcgtacttcctctcttctgcctccttcccagttaaacccctagctgacttctatcttttgacttctgtttgcaatgaaaaagattcatggaggaagcaaggaatttcttccacctatatttgaaaactctagtgtcctatcagctttaagatatttaaaagcatctagtagatttcacatttatattagtcaaatagttcatttagtagataaattcacagatatgaagtttaagctagtgtcccagtagatagaataaatgaactaaatgtaattgaacttacctgttgaggattttgtacttacattttggaatttctcaaaatccagaatcatttggaatcactgtcatgcttttgacataatgtcatctggagtcttcatttcaatgttaagttgccacataatatgagatttgaagcgcattttttatttttcttcatattgtgttatttagtcttgttgctaaattcatctttttgctataaagtcatatttagtagatgtagaccttatttgtcatgaataccaagactatgtctgttcatttgcgtgttaatcatttagattttaggagctctagtttcctggtttatgtacacaatgtttttattcttgtatttgaagtgtggtcagcacattttaaaacacaattttcacatttaggctaagtggctgagtaaattgtatgaattgtagccagctctagtttgtacattatggtaatattgagagtcagaatctgtctaactaaaagtagctggtcagggaaggggtaaagtctattttttcccttgtttaccaaagagttcacgtgtaaggagagtaaaagaggggaggaaaaagccccctttatccccttagctctcagaatcatatttctttatcatcatacttagaaagcttgatattttagagttcttattgttatataattctggacaatagttagggagccagaggaattctctgttatagctttgtattatacctccatttttgatctttaagatgctacagtgaaatatgtcaggaaaattgatccatttcttagcattctgatgtcttaggtcaatgctgggagctgtcaaaggttaagttgtttgtattacccttccaggaattatgaaaccccaatttgtcatctcagggactccagattccagctggcattttaagataatatatgatatgatcataagatgaaagtgatttccacaaaccacattcaaaaaccaatgcttttactttaaagtcatgccagaaatgctggccggttctagggctcctaagtgaactttggaacactaaaaatcattttttactgaaagaattagggcacaaggtcagagcagatgatgttcaaatggaaaaatgcttcttaaataactgcttttctcaggatggttatcaacttgattgggaatcaagtgggttaagtgggtcaaggatccagtgacttttgtgggcagatcctgacacatgctaactggtaagtggtctcatggtataattctgttctactaccagtgtcacttacgggctctccaaacccccatagatatacttacagtctcttcccagataagcggtctcatggtacagctgtattactaatctcacttgtgaactccttggcaggggctctggtttgtatctatgtatctctagggctcatcgtagagctctctatagaaagttctctgtaaaacagcaagatgtttatgatgaagatctgaaaatgtgggttgaggcttttaatatggtgcatctctttccatgcattactattctcatccccatgccttttaaacattttctctgagaactttgtgagccataacatattaaaactaatacaaatctcggagattaattagtacagggattttataacatttctttaaaaggctgaaccttttttaaaaatgaaattatatgagaaaccccataatatgaaattggaagcaatgttagctacactgattgacctcagagactagagcaggcagaagccaatagcctccatgctttctttctgctgcccacctctctccccgatgctggcccctgaggcatctccaaagaaccttaggactccataggacactattagaaaattaatgcaagtccaagccccagaggacttacacttgtcaacacagaagtgatctttgaaatactgtactgtaagcatgactagatgatggtagtaaaattatgtattcaaattaaagtctaaaagtgactattcatataatatcatctctttaatgggtcagagtattctagcaaggaagctgatgtaataatagtgtcacaggaaagctgggtaaatgcactgtgtaactgagcatggtactgttcgttagaaaaatctacatctcacttcatcctttttcttaaagtcacttattttttaagacttcaagtgacaatattgttcttgttcttttaatgacaattttctgtgtttcttcaaatttcttcccttatatttttacttattttttaattctagatattcatatggagctttattaccaagttacagcaattcattcttttaaaatgtatttacttaaagcacttgattttttgatgaatagttaatatttagtccacaaggtagtatatgaaaaataactctcccctaaattatgttatttatagaaaatatacgttataagacttctaggatcttctaaagatacttctaagatctctgagactttcttacttgatttgatttttggttgtgtataaaaatgatgatgtttgtatattgaaatttaaattgatggcacaatgagaatacatgaattgcacataagtagtactaggaagaagtctctaggaattaacaggattttagccaatagtgagcaagatatacaatacatttcacatagaaagtataaatctggctgcaatcgtactgtaataagtactgcaaaagaaaatttgaaagacaatactctacctcgcattgaaatgaatgcccactgtcatcagcagcactgtttactgtatgagtagctagctgtggacagttgtttggctaagtgaagcaccttcgtcacttgtctggtaggacacagaatgacacagcagttctacaagttatcaagtgttgatgagcaatttattttctctttaatacacagtctcaaagtatggacttcaaggaagactggaagagaaaatgacttcttttttaactggttactttgtcttctgcaaaaagactatcagtaaagcaacaaagataggaaagttgaacaagtaagaaaggctggaaagaccatataggccaagcttgtccaacccatgtccctgcaggctgcatgtggcccaggatggctttgaatgtagtccaacacaaattcgtaaactttcttaaaacattatgagtctttttgcaatttttttttctcattggctatcattaatgttaatgtgtggtccaagacaattcttccaatgtggcccagggaagccaaaagattggacgcccctgatacatgccaaccaaagctattataaactacaaaaaaagagacttaactaaacaaactgtatttcctaaatttccttcccaacccctatagacatactgacaatttcccaggattttaagcagcaagtctgacaagtgtgacttagtactaccatacatgttaagcatctggaagtttttaatttgaaaaaccccaaacctctagcattgagaaattccttccataaagagaccaggacttttatgtacttgcatataatttcctctgtacaaaattatttaatgatccaagctttagctatttctgaggacactttcctgaatattggcttggttctgcaaccaagttctatatgaggaatgctatatattggtggtaaaatttatttaccatttttggaattttaaaaaaaaggttcatttatttttatagcaaaaaatgcccttgaatggagaagtctgaggtatactttctgtattctgtgggtgagttcatgacacattagagtcagaatgtgttttattcttttaagctttcatctttttgagcagaaaacccttgcttccatcatcaatcctcaagaagaaatctcagaggaattgtataatcagtaacatgtatcccctgtatatatgtatcatacatcattttttctcatcattttcaagttattacatctgtacttttgtttatttttaatcatatactgctagcattttaaacattcacactgtttcacaattataggatgtgatgagaataatgttcattggattcctaaaaaaccaagagtaaatacagcaaacaggcccttaatcaacaagcattgccctaacgtgatccgtggttggcaagcagagtggacaggattgtctttgggaggtagccatatagctatgaaactacaaaaacagaggatgttctatgttcctaaataagaaccccattctactcagggggctcccctatcttccctccctttctctagcatggatagaacccctattttgcctccattctgttgatgacactttacctggattactgtcagcttctgatttggagcttcatcacccttgggtcccaaagcctctagacctttcctgggtgatagctatattcatgattcaatttagcagcataactgagaaaacatcaatggcaaatatcaatatttctcctacatttcaaaaagtagctgattattttctcaaaaattactgttaaaatataaatttcaaaaaagaaaattatgagtttcatacagatgtaaaattaacaagtgttaaagattttacttaaatcattaaagaaggaactagtaaggtgttataaccagttcaaaggagagtttaaaaacatacatatttttagttcaggaatattgaaatagatgtacaaagggaggcaaaacggactttttcacagtgggaagtcagttatactcagagtttgcatgtctatagataaaagtaattttgtttttctattaattatctacaacttacacagttataaaacagctctcaaagaatcagaatcagatacataggaaagatgtactgtagacaatgcagttttccataggtgtacaaattttttcctacattactaaagcaactacacaggaaacagttctttaggtaagcaaaaaattttgtatatatatgtgtgtgtgtgtgtgtgtgtgtgtgtgtgtgtgtgtgtgtgtatatataatttagtattcctggtagtaatgatgattgtttattattctgtttcctttcatattcctaacctatggatttgggggactgaatgttttcatttctgttaaaattagttatttaaaagacagttcctgtgagtttggactttatatactttatctgctaggcccatgcggtggtgctaattgctatgcttgcattactggtgtgatttacatcagtgtaaaatggaaaattgtaacactgacaatttgtttgaggcagacaccactttggaagacactgcttcctgtatttaggtaccaatgaatagttccactaatgttaaagaaggagttgctgacctcactttgtgttttggaaaattatgtacaggcagttacattagcctttctcccttttctgtacttccagggaaccaccctattaataatagtgcccattataaatatttaatataaaaaaaccagaaaagtaagataacaaaggggttaaagagcatctttgatcataatggattttgcagggaaccacattgtgattagaaaagaaaatatttgtgagtaaatcaattccatgctcctgtcttatatttttgactgtgtgtatttagcaacagagcaaacagagcatgttataccaactccattactgtatttaaaattttgagctcataaatgatatttgtttcataatctacaaaaatatctagcctttttctttttcactagcaagagatgtagaggaggaaagccttagttattcctgggcctgagtaaggctgaggaaggggaaggactgaaggaactttttgaatggagaaaccattcatctgtagactgcatttgcctgatatgagcatatggttgcctctgggattttacgctgctattttggccctcctggctttgacttcagatatctcatctcctagtttatttttttcttggatacttccagccagttcccatcttactcatgcatgtgttgttgcttcagacaacattgtttttaatccatacttcgaaagatttgtttgcctattcttggcccatatgtctcccattggtctgccttgtttgatcttgctttacctcttctacccacatgcaacccactttatcagctcctcaaacagctcggccttaagcttcctaggtatgtggatgctctcctctgctcttgcctgtctcagttgctgccaccttttggctgaggcaacttggattctggcagaagaatggctgaagctagatgatggccttgcctatacattctaggaagaaagtatgtcagaataggggctatgggtgaggggaatccattgaaactacaggtgggttggtgggttttgtagggaaatatttatcttcatttaaaagcaagttacattctggttgtctcctactactaggtagaggagggactaattataaatattaaacattttagatattagtatttaaaaatgatatattgtggatggtaactgacctctggtattacctaatgccagtcgactctggcaaaggtgaaaggtcatgtatatagcagcctttaaaaattttttttattcaattaactaataaaatgtttattgtgacttactgtgggtgaaaccctgtgccaaatgcctgactgtttagggaaataagtaggctgctaaaccctacttatttcttcacctaaacattagatgaagaactaatggtgtcagataagcagactgaagactgcaatagaattaataattacaaaagtatggcctgtagcaaaccgtatccaattttaatggacttaaaactacaatgataattggtatttgaactcataattccagtttacttttcatgacttcaaaaatagtaacatgttatcagagaaattggtatttggatttttttgtgtgtgtgtattatgatactttgcagaaatgctgctaacacaccaatgagatggtttttctggagataaatgatctctgccagttgttaggtcaactgtcacatttttaactcctccccaagatgccttctggcagttattggagccttgctggccctcctaaatgttggatcagactctgtggtcatgttttctagcgaaggcagaatctctgggtcttggttagactcccttgggttgtgagaacagagatcgaattaggtggccttcagtaacagtggtatatagattttcaaccttcccattattgatattttgggttggttacttctttattttggggggctggtctgtgcgtcataggatgcttagcagcatcctttgtttctatccactagatgccagttgcactccttggcttccataaccaagactgcttccatatcttgccaaatgtcccagaggaagcaaaaatcattcccagttgagaatcattctttacttattcccagtgaataaaaaaggcaagaatatatactctgcagctagttctcttagaagaacaggaaatgaagggtagtcagaacagtcaggatatatgatcatcttctcaccgggaggcatccattatagtgcctgctggggcctaagaattttatttctatttctattgttttatcaaagctgttctttcctctacattatagctgcttctgttgccttatgctcaaggtgtacctcaaggttgaactctttctttgtgtttgatgatagtattgttattattattaaatgattccatgcatataacaaaaatgcaaaaatttgaattaaaagtggtacacaatatcccatctctcttcagaggtgtctattgctgtagtttgttgcatattttcctaacacaaattgatttgcatcattctttttgaaggctatacactattatatgattgtaccacagtttaataggatgacagacaacttttgaaagtgcagatactatttcctgtttctaatttttctgtttcctgaggaaaattactttgattcctacttctattccaccagcctcaagctgtatatgtgggagcccagtcaattcttcttgactaagatattactgatgtggtatgctgctgataaatgcttaatcactctcaaacagacaaaaaaacaaaaaacaaaacaaaacaaaaaccaacaaacaacaacccaactctgatttgtagcatttgcaagtttttcgggtgtaaatatcctaccaggattgatttcaagttaacacagtaatgttaggaagtgatatttgagtgtttattagctttgcttttagagtaatttttaaatagtaagtttataaaatttgttttaataatcactgtgtttaacaatgggcttgcaaaatcctgaaagctgaaccatcagctctctcgagtcagcattcagcttctcacaaccactggcactgataatcccttttttagattgtgtgaattgcattattcgtcataatgttgtctccaagggacaacgctgccttggctagtattttagaatctcagtgttggagagagtgtgtttgaaagttatctagacatacattacatttgatacttgaattcccttggtgacattctggctataatagttggtgacataagtcattgaatttatgattatcatttgaaatagagctttcaattttggacaatttgttagaaaacttcacctttttgttaggttgaaattcttctctttatatagcatggatcatttgattctgtataccattcttgctctacatcataaaaaacaagttgagtacctctgtactatgataactcttcaagtatttaaaatgacctattatatttcctatcgatggctttatttttagaataaattcccttaattcattcagaggttcaagctcatctatttctttcttaaatttgtgcaactgattctcaatgaagctccagatgtggcctgacaggtgtatgcaagaatgggagagaaaaaaaacttccctagttctagaaactatactgctaactaagcagactaaaattataataactttcttgctggtctcgtaattctattggctgatactgaatttagcactgatgaaaatcctgaagtttttttttttatacatgctgttaagtcctgtcttcctcactctttattgtataggttttttttttttttcctgggtggggcatggggggacaaattcaagactacctatatatttttattaaatacttacctgtgtttataaaacctaaatccggccttgtcagaatttgttggaataattattctttcaataaatttccagcttcctttgccttcatgtgacttggaaatttgatgaaaactgactaatggtgttttcttctgattctgtaataaaatgcctaagcgtgagaaagttcagcacagagccccatggctttctggtagtttttctcttttagttgccaataatctatttatgagcacctttggaattgcatttttacagtgatccatttacttaattgtcttccgtgcattgcagtgctttcaactgtgttcctcagagcaccattgccttttcttttcttttcttgtttttgacggagtctcactctgtcatccaggccaggctagagtacactggtgcgatcttggctcactgcaacctctaccttctaggttcaagtaattctcctgcctcagcctcctgagtagctgggattacaggcacatgtcaccatgactggctaatttttgtatttttagtagagacagggttttgccatgttggccaggctggtctcaaacacctgacctcaggtgatctgcctgcctcggcctcccaaagtgctgggattataggcgtgagccactgcacctggtcccatttcctttttattgttaacaaatgttgtaaggaagaaggttttcaagatcaaataaatcagagatacattaaattaaacacatatacgcagatttatttactgtaggttttgtgccttgtgaatctccagactggagaatataatacagcatgttttccaaacgtttttggtcatagaacactgttttttcccacttagataaaataatataactaatagtaaactgttctgtgggttgatagatgttttccactggggatatttggaaggaagtagtttggaggtttgcagaactttagctgagatagtctaaggttagtaaagaaagtgtttctcaactttcagaagtagggcttgatgagtttctagaaagcaggaagaaatggaagagaaggggaagaaacgttagtataaatgaagatactctgggttggactaaagtctaaagccagatggcaaactcaaatgtcagacaaataacacacttgtgtgaagtttgttagactaggctatcttgtcagcagattggattgtaagacctacctaaaagcattcaagtaatttttaaaaacacgttgctagctgatggggctcacgcctgtaatcctagcactttgggatgcctaggtgggaggatcacttaagcccaggagtttgagaccagcctgggcaacatggtgagaccctttctcttaaaaaaaaaagaaaaagaaaaagaaaaaaaattagcctggtatggtggcacatgccggtagtcccagctacttggtgggctgaggcaggaggattgcttgagcccagaagttcgaggttatatgagccatggccatgccactgcactccagcctatacaatagagtgagaccctttttctttagtgaggtctaaagcctgaactttcgcattttgttcagtgacccaactaagctatagcagctctctaactcaaatacacagggatattttcagtttggagaaaaaaagaagtaacttatattttatataaatttctccttttcaactcaattatcctctctacttaatgctgcttagtttttgtgtgtgacacatttcagagtatac

SEQ ID NO: 2898 - DNA, 17814 bp, Homo sapiens
ttagaataacagaatttggtcccctcccacttccgtaagttgaattcttaattgctaaatttcaggcttttttgttgttgtttatgtaagaatttcaaggccacaactccatatttgaagtaaagtgctcataaaattaattgcaaggaaatccatcactatgattcagtaagtaaacaaattcaaggtgtcacatcatattgctttttatgcttttgattttagtaatatcctttcacattcataatccagatagagagataagcaagattgtatccaccaagcctcctctttattgatcttccaaactgaaaaacatagctgccattttagtcagcagttaaactttattatagaatatttttataccttttctgctaacattacctgcaactcccatggtgatgctcaaatcccatttgggaattcagtgaactagcagaatgaaattctaagagactggggcttgttgatgtgtccacgctttccatgggaactgatgttaaatatttcacaaataccataacttccaggaattcacatattctttattgaatgtagaattgtgaaatctttaagaaataactgaatcattatttcttcactgtctcctgcctgtgaaagcagaactatgaaatagctcaagggaatcagtgagagatttgtatccattatattcagtagcctgcatgtgtccaaatcacaaatgaaatgatgtgggcaaatataaattaaaattgaatgttgcagaagtggttgaggaacttcaccaggatacattaatgtacaaactgaaaactgatgaaaggtaagagtttggtcctatgtggtgtaaaggataggagcagttttgtggacatttcttcattcttctctttctgcttttccagacttctgaagagagatttgctaggaaaaataaaaagatatataaatttcagtgatgctgaaggtatgtgcaaacaaattgtcctcattaatagtaaaggtataaattgatgtggattttctagaagacaatttaaaggtacacacttggtttctaaaaagtacactttttaaaatctatctttttaatcccaatttatttacaatttattataagaaagtatttaggtaattatgcaaagatgtatgtaaagtaagttcactaattgttctcagtacaaaaaaaaggatgaaattccataaacatctattaagaaagacctggttaaataatgtattgtacctccatatgtttagtcattaaaaatggtcacttaaatctctagtgtattgacatcaaataatgtcaacaataaatttaaaaagcataactctctagtgtattgacatcaaataatgtcaacaataaatttaaaaagcataaatctctagggtattgacatcaaataatgtcaacaataaatttaaaaagcataaatatatagaaaaatatccctatctctatataaagaatgtctacatacccacttatgaatacatggaaacatatctgcaaggatatagtctaaaaccttatcggtagtgtttcttcgcagtagtgtgaaagaaatacagtagaaacatttaactccttccagtaatgggaaggagaggaagagctcacaaaaacagaaagcatatatttttgacattttgatattttaaatgtaatctcttttcttcatttttctggctacatatgttgattcaacacatattagtaagcaggatgtaatattcaataaaaacttctgtaattgtctgcattagttccaatttattcatatagaaactattcattttacatatctctttctattaaactaacatttagcatgtaaggcacagttttatttttgaaattattaataaattaaaatgttagtgacaaacataaactcttgagctttacaataggttaatgataaagaagacagccaatattagatggagaaaagcttcataaaacccacaggttagagaaaaattgttaggcatttaataaatgatagatcctttatattttgctgcacaaaaaccaaagatgaaaccttttttaaatgcatggtctcagcatgcatttcaaatcacatttttgaagtttatgaatttatgattatataggggaagaaaaaattctttgtttctccacccatcttagatctattggctggagctctgcaatttagactgacaaaagacggattaaacaagataaaaacaagtttattaacataggcacaatgcataagaatgggaactgtcactaatgtataactcaaatgagtggttagaccttagagttatataacaatctgaacaaggaataataaatatgttgagaagtgtcaggacaaaggaaaggaactttgggcttctaggggcagcaaattgtgggaaggtaaatttttgggaaaagttaatggaagatgttgggcacggtgtctcacgtctgtaatcccagcacttcgggagaccgaggcgagtggatcacccgtggtcaggagttcaagaccactccagccaacatggtgaaagcctgtgtctactaaaaacacaaaatattagctgggcatggtgggatgcacctgtatacccgctactccggaggatgaggcgggagaattgcttgaacctgggaggcacaggttgcagtgagccaagatcatcaagatcatgccactgcactccagcctgggtgacagagtgagactctgtctcaaaaaaaaaaaaaaaaagaaagaaagagagagagagagagagaaagaaagaaagaaaagaaagaagaaagaaagaaaagaaaagttaatggaggatgaggtctagttagtaggtttgttttatatactatgtagattcctctctggtgccttccttgggctggtagactttatagctgtttctggtgatatagaatcatcctgcccttcctgatagagggggaggataacagagagtttttctcgtgtcttcttgtgttttgttttgttttgttttgttttgttttgttttgtttaattgcctttgactcaaaatagtccttaggccagagtgacatattttggggtgacatcctctgaaccttttcaaatataaggtctgcctccttctttctacttcataacataaagtcttctttctcttccatgaatattacaattcctgcctgagtcttacaaggccctcctcttccctgtaggtcaggacacaattggtcctttgaattgaggtgtggtagtagccaagctttcaggagtgaggtttccacctttcatcttgtttctaaaagtaaatatctagtaaatgataaagctgtgtttttagttgtaagtctatggtgattgtatagcacagaatgattctaatgtattattttagcaatgaagacaagcagatttgatgcagaaatccttgacataaggagccaaaatatttatgttgcccttaggggatagatattaaatatatctacccatactaaactttttttttttaagagatggagttttgctgtgttgcccaggctggccttgaactcctggactcctcaagcaatcctcctgcctcagcctcctgagtagctgggattacaggtacatgtcactatgcccaactttcccaaattaagctttaacaaatcttctcaataatgttttcctaaattattcttgaatacagtcatgtagaacatataacaattatgaagttttaaaagtctttataattcaggaaattttgaattaataaaaacaaaggaaactttttgttttttgagacagagtctcattcggtctcccaggctggagtgcagtggcatgatctcgggttcaagggattctcctgcctcagtctcccgagtaactgggattacaggtgcttgccaggaaataaaggcaataaaaggtcattgctaattatctgctctaggtttaaaaagttcatctaaacttttcaagtatctttttttccctgaagcctacattttgttattactttagttggaaaacgactgcagtcaatgactcctcattccctcaccattctgacatgcactccagcatctctttgccattatttcagcaaagatagatataatatgctatagaagaaaaagagtagcaaccttaacttaagagttgagttcctattgtaaaataaagacattactgagactgggtttcaaacaaatatatttttaagctccactcctgtggatttttttgttttgttttgttttgtttttgtcttggtctctttgttgatcctgtcagccaatggtttctcacttgcctgtcagagctgaagagtccattccttgtcaattcagatgcgaagtggaacaaacgtcctttagtaacaaaacgaatccgaaatgaaaaaggatatgttactgctgactgtggtggttgtcaataaagatgttttcatagcaactattccttcaaaatacaatgaacatctgcaatagtcttttacccaaatgacaaattcctttcctactaaatcatgtctttacaaaattagaaggctctattttaaaccttgaattacttgacattgaaggtaatgctaattacaataaaatctcccacttacataattattaattcaaatttgcacctttttcctgaattttacctgcttagaaatccttatggtgctaatgatgaacataacgattaagaattttgttgctgaaatctctctatgcctcagtttaaccatgttaaaaattgataagataatacttaattgatagaaactgtgataataaaataacaccacaaatgtgattacaacagaacatggcaaaataaatgctagctaaatttttaaatcatggtttaaagatataatttgtgttactttaattaaataattgataaatagatttcttgccttgacattaaccttgagtattcatatttctgcaagtaggagaggaaggatgtgatgtctttccccatccgtcataagggtcatggccaacactcctataacaaaaggtaggctaacgagaaaaaagcatgacaaatatttaatcatgcttttacgtgacagagaagccttctgaaagaaggctcaaagaaccagggaaaactatccatctttatgcttagattcaatggagtggacagttgtgtagaaatgtgatcggacaaaggaagaattatctaatagtaatggactgcgtgtggaaacccataagaactgtctattctgattcttcttggcctctctgtgtggcatttcttcctcctgggtatggggcatgactccttctggaattagggtttgatgacctactatcaaataaggggaggtcagagaatgtctttatggccagctcctagatagaaaggcaggacaaggttagactaatcattctagcttttatttttggctttgaggaaaagcagatatggtttgtatgacccaccttagggaagaggaattccagtttttatggttcaccttgagggagaatgaggggcaaaagacatctgaatccttcacttcagggtatcattttctgaggctcaatatggacaagtatttataactaggtgcttaatatggccttttgagatacacagttcctatgctgcaatctcacaggcaatgaatggtctttataaaagtgtgttaaagttgaaaaaaaagcaacaaaacaaacaaaaacctgaagaaatattcctcattgaaggtccagcttacattaaaaagaaaactataataatttattctcttgagaagggttgtatagcaaaggaaaattcttgaatgttccctctgcttgccccatgcatcaattctattgatattaaagtaggcctagcaaatgtacttccattctcactgactcagtctttgtaattcaacaccaattctgaaaaatacttagaaattatttcagtaaacagctcttataagtgctacatgcataacaatatttcaatatcagagacttctatcccatgagaagatattttcaacctaaaatttattataaatgacctaacaaagaactattttttcagtaattggctattatggttcaatctgttatacccactttacactagaaactatcctatattttcttgttgcctacgtaaaagtgggcacgaaaaggttaaacagtaaacttcctgactcctgccagccaagggaagactactggtgttacctacgaagtgtcatggcattctcatttctgaataatgagggaaatctgctttcaatacaaacccccataagacagtcactcttccagacaaattaagctaaataatccatcatgacagctgagaagacaatgtgcaaaatgtcagtggaggccagggagagaaaggcagagatggactgtaagagctgcagcatgatgcaaatactgagaaaagacattctctgttaatacagctcttaattgtaggcattttttacagaacatattgagagtgaagcaaagcttccttagcagtactctgatgtcttctcagcaggataatgtagggtaattcacagtgaaggcaaggggttaggaaagtcacagccctaaaaatcaatgggctgcttacagggaagaaggtgcaacagatcttggagagcacagaaaagaagagatgagcagcctgtattgaacagaaaccaaaatattagttagatatatccagcaaagccattccacaagttcgttagtgagtaggtgccaaaagccaactgtaaatcctagatacttgtacatatgcatgcttatattacttatattttaagcagtcatatcctcaagctatattatgagttcagtcattctaaaaagatgcttccattgtcttcttggcacttactcagaatcttcagttatcttattcatactgtgtgcttactggttgtcttaacaggtgagggcaggggccctgtcttattcacctccatatctccaggatatagaatagtgcttggcacacagcaggaactcaataaatattcatactattttgagtcccttaatcctcatatcaactacaggatttagattttattgttatctccattttacagatgaggaaaatgaggaacagagaaattaagtaatttgcccaagctatgcatgaataagtggcagagtcaggatttgaagccaggcagtcaatccctagaatttacactccaacaactactgcctctagtggttatgtatgtatttatacacgtatatatttgcagaaataattgaaacttatttctgcctaggtgcatgatatattaaagcatcactaaatccttctgaatataattcaaacttcttcctaccatagacaaagtaatggcctatagtgaacataatgattatcccatcatacaccttgtactgtattagttttctttgcaatctcaattacacttgcatttttattatcatggttttataaaactttatgactggaaagtaccgtattcataaagagttgtgcctcatatatgttagacatatatgcatttttattagtaattataacttttatgcagccagatagccccaggtttatgattccacatcttttgtgttgtgtcatcttttgtagctagttgatattgtaatgtttgctgacttaattcattcagttattaatttctataaactagaatttaggggacatttcaatggactatggagagaaaataactgaaaattggaaattaagagcatctgagaaaattcaagttgtttgtacatcctggacataaatctcaggaaaactgacatattttccttccttgtcaagtcatacaaccaatgctatcactaaaactggtctaacatttaaacattcagacaatcagtttagtcaatgcttcaataagtttactgaactagcagtttcttaccaactagttacagaacagtcacagctgaaaatgatctatacattgtattataaatgggattaattattctgccagacaaccccaggtgtgccaaataacccaaccccttcctccaagacactcattgagaaactagacagcatctgagcattgtaggaacaaacactgaagtaaatggattctaaatccctttgagttctaaaatgctgtagagatctgagaagcccacaaccttataacagcaggcaacatagattacgcttaaaaagcaacatactttcaattgattgataaacccttttgttgttcatttattgcaaataggttttagagctcaattcacacttttgtgaataaacattgaaaatatttgattcaatggttatatttctgcctgacatgaggaaattatagaatctattaaccttaacaatttaattagcatgtcccagacttaatcactcactatctgggtagaattggcccaattagttaaccactctaaaccacagtttcctcatctgtaaaatgggatggaaaataataacaactcatagggttgttaagaggaatacataaattattcatgtgccctgtatggcacacaataagtccttattaaatgaaccggttgtagaactgtattaagaacaagtagtagtagcttccatatttagagagccatcaattctgttttccaacagctccattagtgagaattgtgctgtgtgttttccccccaccccgccccactacaactgcattgctatatgcaaggatataacttctgtctctaaaactattcaaatagtgagcctgggaaaaacaaacttaggtcaaaagagtttgactaaactggctgagaacatttaagttggataaaaatagatgtattttgtttgtataaatagattttggtcatgagaaagaaataaagaggttcctctcaaaagaaagcctggtttagcagtcagtaaacattgggaagagtcagcagttgacttccccactgtgtggaagaaactgccaaaagcccatccagaattaggtgtgtgggagggaagaacaaaggagaggcaaacaagaagctgtcactattcaccactttcaccttgaataacctttaattgaaaaataaagttgccaaaacaaggagtaaaagaaaaactaccattttattccctccttgagattgaattagagggaaacatactgaccacagtaatcccaaggttggactcacatgatggcaaatgtcacttagttctaaagctctaattagaaacagggctgaagttttagccagctcctgctactagaaataaaacatgaggcaacagcaacccaagccctggacaccccctgacagtgaactctgaggtgctttctgagtgagttgagtataaagctgacagagcctagagaattcatacttgagcaaatattgggaaagaataaactgggtcagttaccacctgtttctagattttatttttttctagacttcaactaagattgtctttcacattaataagaagaacgatgaacataatctatttcatccaacttctacattccaggcacagtatcaaccactttattacattttatcttctgtaatattcacagtgttattgggtagattaaacaacttgcccaagttcacacaactggtgactggcagaaatgggatttgaacttatttgatgccagaggaggtgtatcctttaatattttagaataacttatttatttcattatattttatgaaccttgaaatatgtttattgtaaaaaaaaaacgcagaaaatacagacaggctaagtaaaatgtgtctttacattaaagtatttaatttgcaaaagaacagttgttattttaaaatcctaccccacagtttttcatatttctctttctatgtagggttaatctcatcaggaatttctcttatccatccacagtttgtaggacaattctttgcacataatgggcactcaaatgtacgcagatcatattagtccaagaaaaagctgcttgttggggctaccaagccagcatggtaacaccttacaatcaccctttctacctgcagtcacattgttcccagagtggggtggtgatacttgccagctagcccaagtttctggatatagacctttaacaacttcacaagtacccttagaaaattcggttaagaccgaacatggacatgcttgctccatttttttccactctcaaaatatccttgagcagtaactcattcatagataagaaaaactttttctcttcagttttttcttttctttttgaatattctttgattttagcagaaataggcacagtaaaagaataaatataagagacgaagaataaaatttatgaaatttagaaagctcatgttagagaattgtactctttaggtagatccttatttaaagaataattagaggaaagaaaacaaaagatgaaagagtacaaatgagattcctgagcagttttttattttgattgataaacttttaaaatgtgtttgaattacaatatttatatatcaggaatatgaaaggtttaatcataaaaattacataatatttcttccaacattttcatcttgtccatttcttcatatctatagtggagaattatccctctgtaggcaagaagaagtctttattctcttcggaagctgctcctcttgcactccaaaatatagttctgatggaagctgccaatcactttatcccattcccagaacaggcatggtaccagactgaggtcaatcctatactccaccttatttgccatggaaaatagcctagcgatacttgcatgactcagggcagttggagtagtttgatggaattttttaaaccacagctgacaggaagtagctctgttccttattagttgcaaatgctgcaagcatatgaccctagagttatctgttgccagttgttgccttgtggagatcataggcttaagatgatgaaggcagcaatcagcaataagcagaggtgtgcttgtgtgtgtgtgtgtgtgtgtgtgtgtgtgtgtgtcagaatgagagagagagaaaaattactgcttctgaaaccaaatccatttccaaggtgtggttttagaagcaaataaattgccaatttcagagctgattcaagttgaatttttgtcctgtaaccaaaagagtcctgactaacagccaaaactcaggctgtcaagtaaacataatctgtaagaatccgctttccagcctccattccccttgacatcttcctgaaagaagatttgtataggaaatgctgacgtctctttggcaactgcataaaaattattgtattcaacaaatttattatatgtctctttgtggccaggcagcttgcttggcactggaaattggctagggagattggggcaagaaaaatacctctctccatggtggaggcatacataaaagccgattgctacacaactgcgtaagaagtgctttaatcaaagcctgaataaagtgttgtggaaactcaaaggagcaagcaaaatgcttcacatgaaagttggacattcgagtcaaagactcacaggattttcccaagcagaaaagaaaggagaggacatcatggacagaggaaatagcatggtgcaaaggcatggtatgaaaaaaatacacgacaaatttgtggaataacagaacttttgatgtgatcacagcataatgtggagttgggtaacagtgagggattaggctaaccagcttggcagaatactgactaaaaattcttaaatgctgtgctaagttgttagaattttatcttacaggttttgagaagccatctgcagctcacaactagatgagtgacacaatcagatgtgcgtatgcaaattttgagtcatattaagcaatgtttccccattttcagaatatagaagaattcataactgctttttaaaaatacatgtacagttcctttttaaagccttgatttaaatatctgatccattgggaatttatcctggattatggtgtaagaaatggatccaattttatctttctccatatggctatccagttatctcagcaatgtttatttaactgtccatcttctacccagcaatttgagatgctacctataaagcatactaaatggtcacatgtgattgtatcttgtttctgaactttctaccttttcattagtttgtctgcctattcatgtgctaatatcaaactgtttaaataataaagtttttaatagtactttctaaagaaatctgatatagtttttccttccagctgttgtcctgaacattgcttttcttttttagagtttatctggttattcttacttgtttttaaattcctaatgaactttataatcaatttgtttaactctagaaaaaagcctggagacattgaactaagatcaaatttaatgtattaaatatggtagaaagaagagagaatgaaaaataatgttaacaatctaggtgaggaattgctgaggagacaaattaaggtaagagttatttgtaatttctctgttttatgtcagccttcttttcagtagtctataaatccagggagaacagggcctcactgcctttttcactagcatgtctacagatcccattacagttgacaatacattcactcatttaatgaatggatttaaacaatcttaaggaataggaattaactgaagaagataagcctaggtgatacttaccaggtagagtcaacaggatgtagggactaaataaatatgagagattagagagacaaaattacctactattgttgccactaacttgaacagggaatttaggaaagagaactgatttggggataggtaagtaaggtattgattcaaaagatttggatatatcatcttcaggtttttataagacatctgagtggagacatccagtaggcctggctctattttctaagaaagagccctacatggaatcatgtattaggttttcactttttgccagatactgtggtaaatgcattatgaaaattgctttagtctaacctaacaagatagcaggactattaacattctcaaattacaggacagtaaactaagacaatgaagttaagtaatttatcaagatcacctatgattaaatggtggaactagcattcaaacccaggcagtctaatgccagagcccagctatagccatatgaactcctaggatttgaagagagaccagtgtattcactgtagatgaaagaattaaattatccttcaagagtgcatacagcaatagtaaagtgtgagaagcaaaagagctgagagcaaaagaatttaagaaacaggcagaagaggacctcaaggaacagactgagaaggagcaggtagagagatgaaaggaaaaccaaggagagagcctgtcgtggcatgtgtctcaggagtgatggagagttcggggaggaaatttggtttattttctgaccctgattctttaagttccaaaatttcttcatgctaatcaattcccattcttttaatttttacccatcttcccccacaaaaagttatcgggtatgaaatattgcaagatatcaacagctactttaataaaaaaattcacaaaattatcaaacagcaagaatgcccttaattattattaggaaagatcagcatgtttgtaatcccagatagttggtaggctgaggagggaagattgcttgaactcaagagttggagcctgcagtgagttgtgcttttgccactgcattgcagcctgggtgacagagtgagaccctgtctctaaaaaaaaggagaaagatcaatgttttttatgctttagggtatttataagcttaaaaagattcccattttacaagctgatgttgcttacatattgccatataaggaaggaataagtaaccaacattgtgatcaaatgaacaaacaatatgtcaacatttttaaaatgtaatgtaactagtacaacacagaagtaaatacctagttttgctttttgatctgtatgtcatttccttccttgtaagatataagaagcatcagtggggttatccatttggtcttggttgaaaacgttccagtgcaacattgccattcatcttcatagtcatttaaatgcaatttattatccagttttgtgattctactttatattttatggagttggtaagactccagaattactttcagaatcatccatcttatatataggggaaaggtttaatccttccatctctaagcaaggaaaactgtcatagaaatcaggccccaaaatgaattcttcaagagcaggaaggatggagaggatgaatcaatcaaatttttttttctcctcaacttgttattctaaacgagcttataaacagttttctgtaaggaaagggtttcttgaatatggtaacatctgccatctagtggctgacttgagctactatatgattaaactagaaatttttatttttatgtaaataataacatggaggtgggcaaatcattgtacttcatctctctctcttcatgttgcaaacaaagtaggaaaatatagattttctttgatgaactattatttttagtgccagatttgatctaataattcaatccttttagtgtaggcatcttcaaagtaaaggagaaaaataaaaacagaaagaaaagaagaaaaagagaaagaaaaataaaatagtatgtttacctgccacaacagaatacataaacaaagtataattatagttattaaattatttcagttctagggtgattctattttgtcattaaacaaaagttaatttatttgtacatcagatatagttagaataaataaaaccggtatctttaaatgaaaatgtcacaggtaaaagtgaatgtataatacctcctcccttatttttatgagagttaaactattatgcacatatactttaccatctaagctgatagaattagcttaattagatagtctccatgccaaaaacaatgataaattttgagtcttcatctctctcaagtctcaccagcatttgacacagttgacagaccttttcccccatctggaaagcactttcttcactttcaggacaccatactcttcctgtaggtcatagtttgtggggccgggcacaggatgagaatgtggggctccctcgtgcaaaaaatcagcaaaaaaaactgtccttaaggtacatataacttatgtgaattacacaataaatattttgtagttcatacttgcatatgtacttcattcttcccggaagagtggaaacattgcccaaaactaactcagctattttatttcacttcttcatacagtaaatcctgtggaaggaaagaagaaaggaggaaagaggattggatggaagaatctccacttctcagtgtagtccttccttagcctgctttttaatgagtgctgctaaagcccttagcctgcctgtttacccttggagtggagcaatgaactgaagatatttgagtgagttcaagagagactcagaagagaagaattggaggcagcaaacatagacagcacttttaatgcttttctcatatgctgtaagacatgaaagcaatctattgggatgaaagctgaaaggagaagcgggacaagagaagtgaatccgtggaagacccccaaaagaggctgcagattcttagtggacagctctcatatcccctccagggaaaatgatgaaaaatgtcttcagaaaaatagctttatgaaggcaagaggactttttgcacctgcaagacatgtctgaaagctcctcaggtcaaaacacaagtagtcaagagatttgtccatctaattcatcatactactctgatccaagtgagacccacactgggtcagctccatcaaggagaagaacattccacccacgtttggattctggaatatcatccttgcttccatcagattcttgtaagtacctcacttggcacaaggtagacatgacgttcaaggaagtcaactgcgttgcccaagagtaagagaaggaatctctgaagaagagcaacttttcagacaggtagagtgtgccttgctcccaaggaaaagagttcttgaaaaaaacaaatgggaaacatggctacaagaaaactgggaagactgcaagaaaatctcagaatctgcttgagaatccggtccttcttcctccatacacccatggaacactcccaaactctgtatgctgctcactaattctgattaaggtcttcaccctccctaccttggaaattgctacaacataattgtgtttaatttgaacatttcatttcagggtttgggggatccttaccaagttgaaaattttaacagaattcttagaagactaattcgagttgaaaccctctggttagtggataattcactggtggacttaagtgccataagattgccaaggtatctgctctgtagcatgtctagtgaacaggttaaagttaagtcttttctatttggatacatgtgatcattggctgtacatactgcacctggccccctgtggtcaggtcttaaagatgacactttgcactaaagtggcacatacggcaaggccaaaagagaaatttatatatcagaatgtcatactttagagggaaacatctatttttaaaattaatattttattaccaatttttaggaaagttatttgtatgagcagaaaagtttgccattttccttgtgttataaactagaaaatgcaattacctgacatatacattatggtttaagaaattaatttttagttagtcatatttactgaacacctatggggaaagactttacaaggtagttgacagtagtaacctttagggtaacattctgttattggagtggaggctggttatcagattaaagacagaaataaactaaaaataaaatatatatatatagactctttggtctttcaaggattccaaactcatattgttaaaaataatctctttctgctcagggattgctagagaaccccttttacagggagctgctatttgcttcagcaggcagaatgcgtaggtggagtgagctttggtggcaatgagaggggccaacagaggtcctcaggagtgaattagatgaaggaaattgagcatccacaaaaaggaaaggtaatttctagaccaagttaatatataattctgagcattggctgagagaaggtcacagaaagaggccattatagctgtacacaagaggcaaacaggctggcagacaggaagtgccaggacagagaaagttgtgtcaccatccacttgctttgcctcccttctctcccctaacatttcctattgactggggcaatctgtgatgtggtgaatctgagatactgaaaggatgaaaggatacccataaaaaagtgagagcatgactggtaaacaagaaaataacagatttcagaggagaacggggagagaggcagggggcaggaacttcttgggctggtttttcaatgagaaattgtcatactactgaagtgctcctgaagtctgtatgaattctggaaataagcagaagccaaaagttatcaaagataagatgagagctatataaaatgtacatatggagagggactgaaaggaaacaagaaaaataaaaataataaattcaaaaaatttacaatgaaatctggttggttcaaagggattttttttcctaatgattctctgttgcagttctctctttacagcaccctctttcccattagcaatgaccatttaccaagtgtctttgtggggcccaaggcccataaatatgtaccctgtatttatctcatgatattaaatcgtaacttatacataaaggaatttttccttaaggcaagatgtcagtgatagattttgaattattttctctatttgcacagtcatgtacagttatagttttaaggcaaacacactgagaagcattatctatcaggaaaatgtattaaatttaaatgcct

SEQ ID NO: 2899 - DNA, 1838 bp, Homo sapiens
ggatggcagcagcagacacacagggtggttaagaacaacaaacacaggcaaaccacttcaatagaacatggctggcggccatatggacatatttgaatccaacaattaattcagcaaagaaagctgcttgtggcaagttttgaatgtgccattccaggtagtgctttgatgataaatgaggagaagattgcaaagaaaatgacagcaacatttataaaaggattcctcttaggactctagatgcacggagagtggccagattaatacagactggcaaaagaagaacttggcaaagtgatttgatcacacacttctcaccctcacatctcctgacagttcccctaatccctgccccacttccccgccatgggcttccatcaggaaactccttgatatcatcttcgaaaactgaggcatagaacatttgggaatgaatctaagactacacatctagaatagcagagggctgggaccaggatctacccatccccatcaagcgaggattgatactaactacagccactcctgcgggggcccagggcctcattatcctaggggaagaggagatggaggtgagaggaagaggatggatgaatgtggaaggccttctgcagcttagcatgcaatggtcatttcctgtatgcaaggtcttctgctatgttctgtgcaggaaatcaagaatgagaaacaattttggccctagaggccttacaaatatatcttcctaattacaaggttatagtcctttgggaattgcaagttcccttgaaaattcacacaatcctaacatgtgttgtgcctagtttgatgtgttcttaaactattactagctaacacttcttactgcagaatttctgtggaaatgagacataggtatttctacaggataaatgagacgagtgaaaagaggtgttgaaaaggaaaacgaaaggatgaaacagatacaattcctacttcgctgtttttcaaagtgcttatagtgagtgctctccgtttctcacccgaaggggagaaacttccttggcctttttcttcaagtaaatagattaaatctctcttattgctattgctatttgacctttttcatgaagcatagcaaagagtttttcataatcctaatatatacttatggtttgtgactaatgaaaagaattatttccatcctctaaattaataggcttgcctccctgcccagtaagttgttccttcctatacagcattcagtaaaatatttgctgagtaactaaaatgtccaagacacctatttcagcaatatatgaactagaaacaaaacaataactacaaacatgacttatctcttcaaggaaaggagtcaatattcttgtacggaaaaaggatcgtagaaaaatacctaatagcatagtgtgacagaaattgcgtggaaattactacaaggcagcaagtgagatagaccctaagctgagcagacaataagggtatggcaatcctaaatctacatggtgtggtgattaagtcctgcgtccatggagtcagaaagagctgggtcctgactctacttattaactgtgcaaccttgaataagtcacttataccatgagctccaagtatctcatccttaaaatagatacatttcagcaccttattgaatttcttcaggctaggctctagggatacaacggtgatcatgacagttatggtctcaggccttattcaataaacagcaaagaatccaaattgggataagtattctgaaagggagatatgggaatgaaaacgaaaagtaaaccaaaaagtaaaacctttctgagaccagtgattttgacagacactggattatagaggacctgataaacgac

SEQ ID NO: 2900 - DNA, 9086 bp, Homo sapiens
tatttcttttctgcagcatcaagttcatattgatgagatctgtttatataattgtcactggtgaccagaacccaattcatactactttaagcaaagagcttcatagctgaaaaaaaatgggaggagggtgagtggatgggagcttatggaattatacaaagagctaccccaccaagaaggctccaggaactgggactggggactcaacaccattcgtcactcatgctgctgcagatggcgggtgttggactgggttccctggctgttgtgatcattctcacattcctctccttctcagcggtgtgatggcagatggacactgagtggggaggatgcactgctgctgggcaggtgttctggcagcttctcaggtgcccgcacagaggctccgtgtgacttccgtccagggagcatgtgggcctgcaactttctccattcccagctgggccccattcctggatttaagatggtggctatccctgaggagtcaccataaggagaaaactcaggaattctgagtcttccctgctacaggaccagttctgtgcaatgaacttgagactcctgatgtacactgtgatattgaccgaaggctacatacagatctgtgaatcttggctgggacttcctctgagtgatgcctgagggtcagctcctctagacattgactgcaagagaatctctgcaacctcctatataaaagcatttctgttaattcattcagaatccattctttacaatatgcagtgagatgggcttaagtttgggctagagtttgactttatgaaggaggtcattgaaaaagagaacagtgacgtaggcaaatgtttcaagcactttagaaacagtacttttcctataattagttgatatactaatgagaaaatatactagcctggccatgccaataagtttcctgctgtgtctgttaggcagcattgctttgatgcaatttctattgtcctatatattcaaaagtaatgtctacattccagtaaaaatatcccgtaattaagattgttcttcccttggttaatttttctgttactaagcgtcttctaaaaatgctctttgccccctgttagaaactgagatttggtggtagtgtagtagcaatgcttaaaacagtattgagcccatggctagactagagtccatgtgtgtttcaggggaggggttgccatagagggtgacacttcttttatctaaacttcagtaactatgaatgttactccattatgaactatgaaacattagatataagcggtgctggacctactgtgaatatgctaagttgacagctggagtctatttgattttacttttaaatcatgaattggcattctttcctcttttttttttttttttttttgagatggactcccactctgttgcccaggctggagggaagtggcgtgatctcagctcactgcaacctctgcctcccgggttcaagtgattctcctgcctcagcctcccatgtagctgggaccacagggcccccccaccacgcccaggtaatttttgtatgtttagtagagatggagtttcaccatgttggccagggtggtttcaaactcctgatctcagttgattcgcccacctttgcctcccaaagtgctgagattacaggtgtgagccacacgcccggcactaactaacaatttaactccaagactcagtaagaaacgaatggggaaggaaagacagaggcttctggcatctctccttctcccttgcctgctaggcctagagaagaaaaaccatggaggaggggaggtgatactgcacagcctcaagatgcagcatagacgaatgcagtccttagcaaaaggaaagggcttcccaatgcagtgggccggtgtgttcaccggcttgctgggtgtcagtgagggaagactctgagtgccttgggcttatgggcagatgaagagacaagaggaacaagtacaaactgcccatgtagctgctccaccccagggagtccagagtgtatccgctctattgggaagaattagagagaggcgagtaatatcctgacattcaggtgttcaatgccagctgtcagcctctggcccctgccagtgttaggaatgattcccctgtcctctggggtactgccctccgacgacaacttaggatcagcatttaaaaccctttctgctctcgtcttaggtaaattatagaccagaacgggtctataatggggacaggtccccatcctaacccccagagaccgtttctctcaatagatgaatacaaatagctctcaatttttaatttttatgtgcaataatgcaaacatacttttttttttttttgagacggagtctcactctttctcccaggcgggagtgtagtggcgctatctcgactcactgcaagctccgcctcccgggttcacgccattctcctgcctcagcctctggagtagctgggactacaggtatccgccaccgtgcccagctaattttttgtatttttagtagagatggggtttcaccgtgttagccaggatggtctcgatctcatgacctcgtgatccacccgccttggcctcccaaagtgctggtattacaggcatgaaccaccacgcctggccgcaaacatacatttttatagctcctgaactaaattgggtatcaatacaaattactgtggttagtgtagggctcggcctctgatgagtgaggatctttcctcaaagcccacctttgtccaaagaaagaatctgagcctccccttgacttattttattttttgccagttttgtaaatgctgtatgcttccatactacccccttccctaatttccacctctagaattaactgccagagatacagttgtccacatggaatgtagtataattgtgatagaaaggaagaaatcccccttgcttagtattaaaagtttctggttaaaataactgactaaatattaagtaaaacatcaccttctgggtacaatgcagaaaagtaaaagcagttcatataagattactaaactttgggaggtcttcaagaccagccctggcaacatagcgagaccccatgtctgcaaaaaaagttttaaaaattagccgggcatggtggcgtgcacttgtagtcccagctactcaggaggctgaggcaggaggatcgcttgagcccaggagtctgaggttgcagtgagccgtggtgacaccactgcactcccgcctgggtgacagagtgagatccaaaaaaatttactgaaataacaaaaacgtggactttgggatttcctctaactgctgcaaattataacacagaattgctcagtgttaatacttgaattgtggggccaagtcttctggctgccctagttctcttttctggcatttgaaagcccttgagctagctatggagctaatctttggacaggctttttggttcccaggaatgtcatgcctttgaatttccaatctatatatatacagtgtgtgtgtatgtatacctgtcttttcactgtaaggcacctccacccatcccttatagaaggagccacaaacaatcaagcaaatggatggaggttaattaaggggaagaggaaatagtctgttctctgactcgagacctgaaattgcagtggggcacgtaaggtaagaccagagcagaagtgattatcttgaaattccactttagcttggaataaaattaatatttaaattgattttaaaggaaataaaaaagaacattcagtgttcccttttcattgctaatctcacattttctgattttctaaaccttttgttttcccattcttttcttctaagaggaactcaatggtctcatagaagtcaatcaaatagcgttgtaagaaccttttacctaccacatcctttgttggttagactgaaccaacaaagcagtgcctgcttctggggaggaaggatgtggccttttctgtgccccagtttgtgggagggtgagtccatgaagcaagtcaatttaaaaggcagtgtgtgctcttgtttcagagagagtgaatcctttgggtggtggtggtggagtatgtgtgtgtgtgtggtgggtggggggtggggcatgcacatctagatccatactttttgggctcaactcagggttaccaaaatagagtcaaactcaactcaggattacctaaatggagtcaaattttgtgtgtggttttgtaacatgattctttcagtcatcatttccaggccacatttttcatgtcactcatgactgcattataagtttgtaccataattcatttaaccaatactctgttgtgcatttagaatattttcagatgtttattgtccttataaaagtcagtatgaaggtatgcaattatcacttaggccacattcctggaagtaaaattgttggaatggaaactatgtacattttacagtgcagattgctggaagagttttatgcaaaaacttatacaaaaatttacactcttaccagcagaaagcctcagcgccactgagtgctgttgtattgttaatcttgattaatctggtatgtgaagaaggatgtttcaatgttttgtctgtgtctctctgattattttgcttgttgattggccagttgttaattctgtctttgtgagttgtctttttctcagtacttggcctatttgtctttgatttgaaaaagctctttatgttgtagtcattttaattcctgtcatatgttttgtaaacaatttttcgagttcataatttttcaatcttgtttgtattatattttgccacacaaaaattttaaatttgtatagtcaaatttatcagtctttttccttatgttggaccttctaatctcaaggtactaaatataatctagcatttttttaaacattaaaaatttttaatccatctataatttattttaggatagggagtgaggcaggggaaggtatctttttaaataaaaatcgttgctaaatggttggctagttgtcctattaatagtcattgagaccaggagcggtggttcacccctgtaatcccagcactgtgggaggctgaggtgggaggatcacttgaggtcaggagttcgagactagcctgggcaacatggcgacacacaatctttacaaaaaataagaattaacagaggccaggctagtctcgagctcgtgacctcacgtgatcctcccgtctccgcctcccaaagtgctggaattactggcatgagccaccgaggctggcctgagtattctagtttataacttacaaggtcattcatatgtatatgttgttgtgcttgtctagctattttatattttgttattctgaactcttggcctctatctcagctccagcccctgaaagtgcaggagtgcttttgctctgccagtcggccttttttgggaaatcatatcaagatggcttttccagcacaattacttcctagagtgtctgcttgatgcatggaaactcatagatttttggcatgccaaacagagggttttcctgccgtcactgctggctccagccacagacttcagttttcttacctgttagagcctttgtcctctgactggtggaaatggagcttgcttctttttgttttgcctgccactagtctggcagcctccacctcttgacccttgggtttcttatccttggaatcagatacgaggccctgtgtcttctgttgctgtagaggacacaagtcatattctctgagtggagatctctctgaagctcctctttccaggcttgtactgagggacctctggaccctctaccacgtggtgtcaaagctgccaagagctgtcatatgctgggtctgtaaattgactttctcacctctgaccagatgcattcacttgagcggcacagagatttgggggagtgaaagggcactgtttctttgggtccgtgggcttgtgtcccatcccctagccttggggttagcaggattcagaatttatgagtgtggtctgcaaaagtctacctctaccagatgggggagaacctagtgtgtggacctgaagggttagctctgtgctttagtccctgggagtggccatcttgagtcttggtgggcttggcaagtaaggagacattgaccagattcaaagcttccagaggtggtgagaactccagggccgagtaatggagagtacaaaggtccttcttggcccccatgacccttccaagccaagaacttggcagtagctgtgagaagcagagatagggagaggaggtgaggggcacctatagctcttagccatgagttatgactccctccatccaagggagacccaaggacatgaaaggggactcagttccaaggatcagagggaacttgggttgttttgggataatgactgtggcttgggatgtcacggagatgaacaccagaattggtgtgcaacagatgagctccagtacccctgatagtttgcatgggttttgctctgctgatgatggtcagggacagcagtgaggccctctacaatgccgccttctgcctaaacacaggcagtgcccacaaaaggggagctgtcattatggagcctaggaatggatagtcagagagcagcggctgggcagtgcaactcctgcattggacaaggtcctggctagagaatgtcaatgtccacactgcatgtagccctatcgaggagatgatgtagggggctgtcagccttggagactctagcctaagtaccccaccaccactctggctggcttccaagggcacaaatcagctttctgaatctgacttggcttcctgtgatctgcattcatgaacattcttactagagttctcatggaaaatgaatacacaactatttggtctgaatgtgtctgagtttggtgtctccaaaacaattctctggattagatggagaatgaagaaacttcacaaaggcaaaaggacaggtccccatctcgacccccagagaccacttctcagagtctctatctgttcgtctctggtgttagccacgttcctttactttccctcatttctgtggccactcctgtggcttcctctctttcaacctgcaggctgctgctgccctgcctcagacccttgtaggcttctgtagagatgctactcagatgggggtggagctagatgcagagctgaaacccacctaggagatctagcttggagagcttgtgaatcttaggagagctaggcatagaatgactaaagtttgtcaccgcatgagataaaataaatgaaaagccacttctggagggaatgaggcagtctgcctttattggagagatacatattgttgaacagctctgggcagttgattgtgtgcctgggagagctaaccatgtttactctacacttgacctgtgatggtctgtattgattgtatcacacgcttagctttctaaggctaaccaggtcatcgtcctcagtccctgcctgcaactaggttgccaactggcccttgatttcccacccaacttgttcagtttgccctcaatcctggggcctcactaatttcccaaaaagatatggttggtaccacctgtagtttgctgttgcatgttaacctgacttttgggaaactcaaataaacacttttcaaacgcattgaccatttttactctatgacttctgctttgcatgatcgctagcttggtcacccatcatgctgctttctggtgagctgaaaggaaaataaatggtctaaattgagcaacaagaaagtaaacttttaagcaggtactttccaagtgaaatgagaaccggagattgggtccaaaagagaggatgcccagccagactgaactttcaagtgttttccaactggaaagctccaatgtcctctgatctcagtgaatttccaatctaatttcaaggaagtccctcaggagccccattgcaagggtggttatagaaccatttacaactgctttaataaaactaatgcttataaagaaagaaaacttgttttttagtcatccataacacaaaaaagtgaggtttgatgcacagtaaaaggaatcattatttaagttagtctgagttatattgtattttggaaatgctccacattcaatatttatgccacatactctaaaaccaaagtatgtagattaaaaaaaaactatttccagaaataagcttgctgaatcaccacaggcttaatttatttattttaactaccagtttcctgaatgtttttgtctaattggcctatctgcagttgcccttggtccacccttgagcccactctttaagcctgtctgtcacttagagaagtacaagtacttcctgctgagaataaagccttgatcgcaatttcagtgaattatcagggaagtgtgagaataagtaggaataaatgtctaaacatttgggaaaaacttgtttgcaataaatgtggttaacagagagtgaataggcttactacataaaattgttactcatcaattaaaaaaactgtacaatcctcctccgggggaaaatgatcagatattttaagtctgctgatatttttctctggatgtcagacctgtatactttgtcctgcattattggagtataattggcaaataaaagttttatgtatttaaggcatacaatgtgatgatatgatacacctatacactgtgacatgattacctcaatcaagctaattaacacatccatcacctcaccttttttgtgtgtggtgagaacacttagatttactcctatagcccatttcaggtatacattattaactctagtcaccatgctatacattagatctccaaaacttattcatcttgtaactgaaagtttgtactctttgaccaacattcgccattcctccccaacccctaactttggtaaccacccttttgctctctgtttctatgagttcttctgtttcggttccacctgcaagtgagatcatgcagtgtttgcctttgcctttctgtgtctggcttatttcacttagcattatgtcctctaggttcatgcatgttgttgcaaatgacagggatttcctcctctgcctcttcttccttcttcctcctccttctccttctccttccccttcttcttccccttcttccccttctttctgtttttgctttgttttgtgtttgtttttgagataag

SEQ ID NO: 2901 - DNA, 2801 bp, Homo sapiens
gggtaggaaaaagccccacaccattcatgatgttaacaatagcagcattaacagtcattggactcccaccgagtgtgttattctttaaattagaacccatgaatataatgagatggattttcacaggaacaagggcaggctgaaacaaagagataaagaaactgaggctcaatgaacttgtaacgctttagtgtcagagctctagaatgggtgaaggccagattcagacccaggcatcgtgactcccaagtctgcttgtggatccttgaaagcaagggtgagccataagcattgcacctttgagagaactggtaagttagaaccgcagggacttctgagagcttccttcatcattttctgcatgcctcccagtgtgcatagtctctgctccttctcccgttagcatgagccgtgtgtgtgatacagtgtgagcactggtgtggagggttcagatccatgtgggtggcccccacactctagccaagtgagcatgtaaagatgtttttatgtagcttcatcgataattaacttccactctctgcctcattccatgcctccccacttgccttcctccctccctccagcctgggtgcttgggggcctaggctggggacctcactgtgactagcttagcaattctctagctccaggaggctgccaggacccaggcgggagtgcaggaagttttcaaggtctgtgctccagggtgtgtgatgacttgactgctccctgaagagctcgctgcttataatcgcatagtttttggcatgtgctctctgacaaaagaacagatgtttcctacaagaacaaaagaacagggcataactgttggcctaacgctttgccactaataacattgaaagtggaagcaacaagtcctaacgagaaggtccctacaggatcatgaagccagtgccagggaattggagtcaaaatgaaagaactcacggctgcttttacgttttaataggcagtgtgctggatgttttttaacctctttggataaatagcaacaggctattctttctagctgtgttcatgaattttgtagctgtacagtaatgatggcttcacaagttcccttacaagatcccaagcccgtgtccatttcagagacacactgagagggttatgacaggctcggccaaccctgcagcatcagcctacagtccatatatgggggaagccttagctaaatcgcagctctcagccaaactaaaaacaccagagcaagtttttctctttgttgctggctggaacttcaaagcacggagagcccacacacaaaaatgaaaaacaaagaaccctaaaaaagggcccagcctcagagcccacccccaaaagtttagtatgcctcttgtgttaaaaacctttcaccccatatgtcacatgtcacccagggtttcagtcgcgttcctagagtcattcctctgatttttcatctctgaagaatatcttctttgaggttgtccttggctttcgcccaaaggaaagacatttattttttctcattctttcccccaaccacctaccctgactatttcttcaaactaacagacacagtgaaaatattatttaaatgtttttaacttcttttaccatgaactgttgtcaccaaaaaggttcaatgttcgggtttagtaagtcatggttagcaaagaacattcacagcatctgatgtcaacaggatctttacaaatctctcctcctatttcccttggactttattgagagggatggatactatatcccaatgtggcaactggacatcctcatttatatttgtggtcccagcttatacctttttcctgatgttctgtttgctgatttgcatgattcattatatgatcacctcttctttaagaaggggttttgaaaatatttcttatgattctagcaatttatatcaaattttatggtgctatcattataatgcgaatgtgggaaatgcagaaccaaaaccttgaagcgacttgaaattttcataaggcaaatccattcatcacatatacatttgagtccatgttatttttctgaaaatgtggttgagctaatgcaattatgaaaatgttgtttcttggaaatgaaaaggttttgtgttcagcagggtacataaagtaggtgtaagcactctcatatttgggctccaaatatgggttacatgttgagactgagtgccagttgaggagcacattaaaaaaacacccaatcatatgattgtgttattcatagttatacattctgtgtcccagagactaaatatcaacagcagattccttcaaagattggatgggtatgagtgacaaagtgacggatcttaacatcttgaaatggtggcagaattgagttagctgtttttataaaaaaaaataggccaggacggaagttagacacattagtgctgctgaatttgttttgaatcaactctgtggctctaggcaaccagatttctctccatgtgtcggtttcctgatctgcaaaatgggcataaatgtgttttctctaggacctctctcaaaattctcacgaagataaaacaggcctttatttgggatagtgctttgaaagtaacgcatattacacatgtttctcaagctgtacttaaaacagcaggctgtgattttgaggcagccacatcagaaggtgtctggagctctcggcctctgtggggcatgctcagagtgaattgaaatttttggtcagtgaatcctggtggctaaatgactattttccatatttaattcatctatttttagcttattttcatgacttgattcagaacttaatagaaacaaatgtgc

SEQ ID NO: 2902 - DNA, 382 bp, Homo sapiens
attgtcctgaattcacctactaattttaccctcagagaaagagagagtctttggagagttgtgaggagataagtgacataaactggcatgttctgaaagaatcactctggatgctgtgtggagaaaacactgaaaagggggagaataattgactccattcaagtgttcgctcctgtttcaatcaactatggctgaagagtgaggagacatttggaataaatatggcttctgggggcccattcctatggatcagcagctggcttctggaggcccattcctgtgaatcgtcgatctcatagaagataatattgttagaaggcttacctcattgatgctgaacatcctaaaaagcttctgctgctttgagtcactgaaaaagacc

SEQ ID NO: 2903 - DNA, 764 bp, Homo sapiens
gtgaagaggtgtcttctgctatgattgtccaggaatacaaatgctgatgtgatgctattcagatccttaaggtaaggcaaaattctgattggagcagaacacttcagaagtatttttcaacgtatactgagaagttgctctgcgacagatgatatgccaagcagctgggaagcaaagatgaggaagacatgaccctgtcctggaaaagcttcttgacttgaaggtagggaaagagctgacagcatttttatattttctgcatctactgcagacaacaatgtcctgtacatctggccaaaggccaatctctagtaggctaatttctgtatgctggtgagatgagcaaaacacatggaatctcagttgacaaataattcaagcaggttaatcacttcatgctcatgttaccccacttggtctccttgaaagatcttttccttgggtttgggctaaagactgtttgttttactgacctcagtgactcactctgggattggctagtctagattctaagaatgctcagtttccttcttttcaaaacaaaatctcaatatctattaaagaactaaaacgttattttaagtgcagtaatcaataagcctgaagaataatgtttggagtgtttatggttgtgttgaatgacttgtattttcaaaatgtgctcctatggaaaaactacttttaatttgaatgcttaatatttacaagctgcaaaaagattcagaattaatcatatttctacagtaacagtgatgaaaaaaccc

SEQ ID NO: 2904 - DNA, 14391 bp, Homo sapiens
ctgagacagggtaatgagatctggcattgctgggtggctgctttccattggatggtcagggaggcttcttggaggaacaggatttaacttgaggccaaaacggcacaagggtagagccatataaaactaaggagaaaccattttaggatgagggaacaaaccctgaaggtgtgaacaagctcggtgcatctagacatgtaaggaaggttccagcatgtgaaggagcgaggacggagaagggtccggtgaggtcttacagcaacagagggtccagccacatgaggctgagcagccaagtgatctgcctaggccagctccccttcatcttctgccatgagtggaagcagcctgaggccctcaccagaagcagatgttggcactatgcttcttagacagcctgcaaaactgtgagccaaagaattcccttttctttataaatgacccagcctcaggtattcctctatagcaacgcagatggactaagacactcatgcttcctttcattagctatttcaagctcaaaaattgtgagactgtgccaagaattagggcaggatcttgtcattgcgaacttacaacttttctatctaaagcaaaaggtcctaatcccaaaccataattggaaaggtgcctctactccaacctcattgcccttcaactgccccttctctgcctcccattcccctcttactcaccgaaagacaaatgagtttaggctgggcacagttagccatcgttctcagaaaaacaaaatcttgctgcttggtattctcacttagaatcccttcacttagcttatggatcaccctacacagattcctgacagctcactgggccagggaaccagccagatttttgagctacatctgcagtatcttttctactcaggcagctggcataagggatgtgtcctacaatcaccatcagccaggaagtggtcaggatgcagtggttataactggattattttccctggcctggctgaccatctgcaaccccctggtgtttcaatgtacaaactattttaggaccatctgcgtactggctgttgcctgaaaatcttgtgttgatgtggatttgtaagactgggaaagcaccagcattcaaaacttgaagaaaggtgttagcagtttggcagacaatcctacagaaaactctttattcttgggggagaaaaagttgcctcccatcaacttcaatggttcacaggatgatgacgtgtggggaaacacaaacctcgacaacattgagtccaaatgtgtttcggaagactcagaatgaagaagaagatgccaaggaaaaccttaaccaatttattttcctttttaatgagtgatatgtgatttttcaaaagcctaaatacatctaaaagagctatatcagttaagtataagataaaaattctaaaccatagaaagcactgttactgcttaattgacagcaatttttctttctttgcaatgtataaaataatgggtgctttttatgttcactgaaattcatattgttgtctccttttacagctgggaaagcggaaatctggagaactaaaatatcttgctgaagatcacaatgcagtaaagcatagggcaagtttccaactcgaacatcaccccagaacacttccttttaaacataaattatgttgctaacttttttattgttacttagcaggcagatttcaaactgatacaaatgttgaaaatgatacaaaatgttttcccaccttaaaggcattctgaaacctagcacataacatctgtcactgaagtccatagtttccaatgccatgattggataaagaccctattgagactcatgtgtttgtctctcactgcttaaaacactcatgtgttttaagcaacatgacaagcacaaaagagaacaagtactgctcctgctctccaggaagttaccataaaataaaggggataaggtgccttccaaagaaaaaacaaatactaggagaggtcagaggagaagagagattattccagaaggagagactgaggcagatttcaggagggaagaatataagagtcccaaaagaagaaacaggaacccaggttagagagcaatgggcaaggggtaggaggtgagactaaactcacaaggaagttgcttcaaaacaatagtgccccaaatgccaagctgatgggttggacccatttaggaaaaacccacaaagtccacaggagagcagactgcacttccatgagcttcaagctgtaaacagtaacctcaaataaaacttttcccggatcggtaatttccatcctgaacaatggccaagtcaaggaagctgaggatcgagccccctaccgcatgccacaaagaacctcaagggaccccatgctctggggagctcgcaggaggaccagcacagaggtgtgactgcgttggggcagggtggccacatgtacaatgttgtaccttccaatgttcctccttaggctgtgcttatgaagtcccaacatgtcttctgggctgtgttttcaaccaagagagttaataaaaagtgggatgggcaccaactatgcctccagagacatcaggcagaatatgccacagcgtgccatgtcctcctgcaaacagtcagaaagaaaagatctctaaaagcagattggaagagactatatatacagagcgagtgccggtacagaagttttgctgcaaatacaccctctaatcccttgcaacccactgcaagctcgagagaccagtgcccttggtaaaacataggagagatcattaattaaagcctaggccctttctttgatcctgagggataaggcttgggaaaatgcacagtgataaaagtgaacattttaaaagagcagagtgagtgtgaattcccaaagagaccattcatatcaagacccaagccatgagaaaatgctacaatgcccttgatcaatactttataggcattttgacctcagatctaatcccatgaggcttagaccaagaccttgcttgatgcagacctctctgactgctgaaattggtcaggagctcagtgatgaaaatttggaaagtcaatgctgatacctgaagaaagtcccatcagagatctgtgacctgaatcttcataactttcacaggccctttctaaatgccaaggaggatgtgtgtggagaagaatatgccacctatggcatcccaatatgcctgtgcccgcctgctcttcaacaagggaatgaaacctgggtattctcataggttttttaaagcacttgtccacatattttattccgcaaataacacaatttaaaattcagctagaatttgccattttctgtcagggttgtgcatttcttccagtcaccatgacttcctgagatagccaaaacacaaaatttaaattgtgtttaaattaaataaacacaatttatgctgaagctgactttacccactctgttccaacattacttatcctcagcatctctgaattcaaatatcagccaggtgtggtggctcatacctgtaagcccagcactttggcaagccaagatgggaaggttgcttgaggagttggagaccagcctgggcaacatagcaagacccccatctctacaaaaaaattaaaaaattagccaggcatggtggtatgcacctttagtcctagctacttgggaggctgaggtgagaagatcacttgagcccaggagcttgaggtggcagtgagtcatgatcataccactgcactgtagcctgagcaacagagcaagaccccatcccttaaaaaaaatacctgccctctgtacttcatagcacctggggcattttgaacagttcttccttcacctgaggtcattatttgagaatccaattttagagactacaatgctctcattacttggattgtatcatttaatcttcccaacaatccaggaaggggagtctcttaatgattgtccttgatttccagttaaaaaatctagacccagaggtaaccttgtgaaggtcacagagtttcagagttctaagatcccatgcgagattgctgaacttgaacttgtttcttctgatctcatgtcaataagtgacttagtcaacacctgggtagaaatcatcactaaagtgagaaagcacatggtgagggggatgaatcctgtgcccacatggtccctttcacctgcccaatcctcaggcctctcacctggggtacccctcacacacatggcactttcctgaactcatggacatttcagtttgtaacgatcctcctaagattatctactttcacctatccacatttgaactatacttctttagtggaaaaaaagaaataaagccagtgctgagaatgatcaaactccagaaatagtagactgctgtataatttgtcttgcgtgacaccagatctttcaaggaactgcaagctcaagtgcacagttaagcaagatcaagatctacctttgtctttcagagccttcccttggcgaggtcaaggatatctgctgtgagcctgggctggctgaaccaaagggcaatggaggcggccaagaagccccagccaactgctcccctccccaacccccttctccctggaggtcccttcagctagaatttgccattttctgtcagggttgtgcatttcttccagtcaccatgacttcctgagatagccaaaagcatttgctgtgagcagagccccatggctggctttgcacatcaaacatttcagacagccatatatttcatagaatacaaggggaagataacactggacacacagaactttccaacagcttgagaaaatgtggtgcctggtgactgactaaatatacaatcggacaacagccaggccatagcaaaagatggaactctgatccacaaggtgcagcaactttcccagaaaacaatacccttacccacaaaaagcaaccccggaagctggcctgctctaaatcagacctgctggaagccaaattgctctctagtaactatccaggaagctaaataataacttctgtaacaattgactcaaaatgttcaggactggattaataactgatggcttccctaatttttgtccccgattccaacttaggacccaccagagaaagccaaatatggtcccctgaccaagcacacaggatgttcgcttctagtgagccgcctccagcttccccgcattgataacctccaatcagggcacacctgaagccttcgcctttttccactataaagctctcccactcgtctgcccacctttgagtctctgccaaattgcaaatgatggtgtctgactcccttgctgtagcaagctctgcataatagcttgtgcttattctctttgggtaggtcttcatttcttttcacaccagataggcatcatctttgaaaacatctttactgggtctcttgtctccctcctgcagccactgatctaaatcacagacttttttagaaagagggaaaatagtaaagaaagaaagcgattgagttgatgctcccagccactgtctgtaccctgaattttgtttttctgccatatgtcaggtggcctctcctggaccatcgtcactgtttctcctgcttccctgcagctgcagacacaggagcactgtgtaggtctggccttgagcacccacccacccagtacagagccagcccctgctgttctgaatcagtgcagtgaccacttagaacacagtgcccatgcctctgtgatctgaactgctctttccagttccatacaatgttaagaacccacttaagaatgttttaatcattcagtagtttttcgtggtatataataaaaaagtgatttaaatacaatctattttattttagattatatcattaggggttattttacaaagttacctttaaatactattgtaaataaaattaataacaaataagcaaaattcttacttttccttgtttgacaattgacatggtcaatttaatttcctttaaattaattatgcaagaaaaggatatttcctcaagaaaatttaaaatgatatatatttcttggttgggtgccaaatattcattcagaagaagacggaaatttaaatccttgtttctaatttaaggaaaaaactactttcattattggatgtgtgaaattcacccattttgtgtttatctagaaaatctagtttattgtccaaatgttcttattttccccaaaagcatcagttaggagagaagatttccagctgccattaaaatacaattgtgtgcaatgaatacattttgggtatagatagtttttattctctataaatgaaatgccaaattggatagaaccatcctttttttttttttttcaaaaaaaaaaggcttttggagtatcagagacatcctcttatgttattttaaaataaataattatttgagctgtttgcttcttggaagcagataacaagggggcaggtgagataaaaaaaaaatatatccaaactgaggtgagaccaaagatggccaatctaagaaccaggcagatgtctctgcctgtcctgggaagattccctcaccaggctccctcactggccagaggagcccacttgttgggctgccaactggttcctataaattctaaggcaattagaatcatgtggtgactgtaacgggaatgacacagctgcccaggcattagaaggaaaccacacccaatggctcaagccagtggcgagagataaaaactgagagacatctcccctgactagcagactgggctccctgcttccccattgcttcctttaaacaggccattcacacatttgcctgaaaacttacagtggcccagaccctactccctatacacactgccagttgccatgtgccttgtttctctctctctgcatgatgcttcattcctatctggagtggcccagggacaaaggactgccctcccgactctctgtgccctccctgcccaggatccgtaaattacactttttgaatttgtttcctactgtggtgtatattgcctttgcaccttccatctgaagaccaggggatgccccaggccaggttttacctgggatgcccaagagagcacaaggtttggctcccagcgccagagcaatgggcaggggggcataaactgaacacaggaaaggcaagagccacaaagacatataaacaagtttcccaggcgaggagcccctggtcacaggtcagacaactaggcattgggccatctaccaggtaaaagcagcatcctatgaaaggcacgcagtaaataccatgtccatctccccttcatttccccttagggcggtttgctagctgttctgggactggaacctcagtttagctgggggctctcagaacagacagctagatgaattaaacaatgaagtctctcagccttaggcacatcttccaggacaaggggaaggccaggggagagtaacatcagtgatcctacaagatgtgcttccaggccaaggccaggttgcagttgcagctacttagccatggtacacggtgggcctggagcttctgggtgtgcaaagatgtgactcaagagtccatctgccagcagtgagcagggcaggccagctctcctctcactggtacggtggttccagccctcacaggacattaaaaccacctggaaactgtttatgaaggttcctatattcaggaaaaatccctagagattctgaccgaaggaatttggtgctgcctgggtaccagtatttttaaatttccccagatgatcctaacatgcagtctgagtgaaaaacccaagtttgacggctacaggaatttagagcttctctaaaacatacagggaataataccagggccatacattggaagtccttccattgggaatgcaaagaaaaaagaaaaagatggccaacatctaccattttaaagggattccagcaagcatattattaaatgcagggctgcctctggcatctggaagcagcttgggtgccctggatataattctcttttaaaagtttttttcacagcttttatagaccacttaaaactggccttcatcttgtgccaaaatagcagggctgtgtttgtttagcttcaagattttcaggtccaattgattaaaaaaggtgagtgagaagcctgccaacacacagtgaggctgtcacccaggcagctgctgctgctggcttccagcatccagaagctggaacatcagccagctccaatcacctgacagaggatggatcctatgagaaggaggaccggggcttaaaaccagacgtacccactgaagtcagggcaggagatgaaaatcttaacaagtgaaggaggtatgaaaacaacagattctagggatcagcaaccaatgaatgagggtccattttttgaaaaacaaatacttctactggctgtcttttgagtgccaggcattaaacaaagtggaagaaaaaaattggagggtgactcaacagatggaccagatcaataatgaggggtaatttgagcaggacaaggctggagctggaagtgcatgcaggatgccagcatcagagcagccaggcatcagagagccagccttgactactcgccgggcctcaggggctgagccttcgtcccaggacaagggagtggccagagcttggctggccccgttccagatgaggactgtgataccagtcaggtcaacgagcaccgatagaggtagggcccaatataggaccgtgtctcacaatggtgcagacccgcagtccaacacacaggaaggatgcttgttgctaagtcttagacacgggaactggaggagggttgagggcccccagcagtgggaaggcaggcatggcatgcagacggtggacgcggactcaagacaccaactctcatcactacaggtccgtggtttggaaagtcccagcaccattccagagaaggaaacaggcccaggtttctgatggggatgggtagtagccacagagcacaagtcagccgcacccaccacacacttgctgtagtgccacactctcggccctagagggcactgacgctttcccttcgctctgccccagggccagggccaaagccatcaagtcctgggcagagggcgggagcgttcagtgagagcagcacagaggttaaagagctgctcttttttgagatcttcgctctcacttcctttccaggcagccagttcagcaaggtgggtctggggctgcctcctgggagaagaggcctttcaccctcgaaccctgcaggacctcagtttgtcccagggcaaacctcctacattgggcagttaggtcagacctgcttcaggccttggaagactgtcttctccttggcttctcttactgcactggatccagccaggacactgatcagacctccagggcccaggttaacaatatgtggcccagctctgggagagaagccagcaggtctcccaggcttttgaactcggagctgaaaaccaaacaaaaaaacgaatccaccccattgacaagtggcccagcctagttggccagtcaggagactgcacaggcactgaggccaaagctgccttggattaagaggtatggatgccaccgctgcccttttactacaggtacactggccgggaacctgtagcactgagtgacacctgatcagagagtcacccactggctgggtctcccccaactcagatgcatggctaacaatcactagctaagcatgtattcactctgtggaaagccacgtcacgttcatatatttattatctcatgtattaatatactgatgtaccacattattctaatttactacctcacttaattcttacaacaacctaatgtgatgggcaatattattattagctccattttacagatgaagaaacaagacctgaaaaggttaaacaacttgcccaagatcatccagccaagtcatgataaagctgcacttgaacacacacttctcagattccaaagcccaagtttctctctactaactgtatggcccctgcactcaaaaactgagaaatctctctgccctggtgagtttcttcctctacgtcagtatgcatagagctcagggctgtactttccttcactagtgatatggtttggatctgtgtccccatccaagtctcatgttgcaatgtaatcctcagtgctggaggtggggcccggtggaaggtgattggatcataggggcagtttctcattaatgatttagcaccagtggaaggtgattggatcataggggcagtttctcattaatgatttagcaccagtggaaggtgattggatcataggggcagtttctcattaatgatttagcaccatccctcttggtgatgctgttgccatagtgagttatcacaaggtccggctacttaaaagtgcgtggcacctcccccacccccctcctcctgctctggccgtgtgaagtgctggtttccccttcaccttccgccatgattgtaagtttcctgaggcctctccagaagccaagcagatgctgccatgcttcctgtacaatttgcagaatcataagccaattaaacctcctttctttataaattacccagcctcaggtatttctttacagcagtgtgagaacggactgatatgtctaggaaggacagcaacaacagaatccacttttgctatcggctttaaaccaaactatcctctgctgaacaggaaaattgaaacagaaatagagaatggaaaaaaagaggtgactaaaacacacttaaggtgtgtacagtgaaaagggagagaaacaatgggctctctaaattacttttcttaatgtgtattacaccacactcaactggatatattaatatcatcatggttcttccaaaaatcaataattacctatctgtagtagatttcctatactagcctacttttcttccttttttcatttctaacatcctagttaattccatgactcccaaggtgttgccacatccatccctctgtgtacaacatggccggattacgcttcctaaagtctggttttaatcatgtcactactccgctaaaacatggtaatggctccctaaaatgctcttatccttagcctacaattcagagctctgtgtatcctggtcctaaccaactctgaagagctaccacaatactaatcctatacctgggccaatctagactactcttcctcctgaagaaatagctgagcttttcctccatattcagcccaggcatatctagctccattccactgtggccaatgggagaacacagctatcaaaaaagaagagacattgagccaggagctcatgcctataatcccgtgactccagaggctaaggctaaggatggcttgagcctaggaattcaaggctgcagtcaactatgatcttacctctgcactccagcctgggtaacagagcaacaccttgcctcaaaaaaaaaaaaaaaggaagggggatcttgtcctgttctctactgcatcctcagtacctagaaccagatctgacacttcctagatgctccatgatatttttcttttcagtaaataaatggaacaggccatttcctctgactgaaaagctctctgtccaggtcttcagttctcaaaatccttctgtctcaataaatactgtggcactttttagagcatggcactgaaactctttgacacacctctcattgagacttgttatagtggcccttcccttgaatcagcacaccaggaatgctggaccaataaaacacaatggaagtaacactgcagtggttataaaaatatgcccaccaaattctttaatactcctcctttggggtaaaacctgtttccttccccttgcctgtgggctgaactgaacttagtgacttgcttctagtcactaagcagaagtgatgctgtgtgactttgaaggctaagtcctaacaagacactgtggcttttttttttttttttttttttttttttgagacggagtcttgctctgtcacccaggctggagtgtagtggcgcgatatgggctcaccgcaagctccgcctcccggttcatgccattctcctgcctccgcctcccgagtagatgggactacaggcgcccgccatgacgcctagctaattttttgtatttttagtagagacggggtttcaccatgttagccaggatggtcttgatctcctgacctcgtgatccacccacctcggcctcccaaagtgctgggattataggcgtgagccaccgcgcctggcatctgtggcttctgtcttatttggtctctctccctcagatcactggctctgaggaaatcagctgctatgttgcaagaggtcctagggcacagctcttgtggcaaggaactgaagccgtctgttaacaacacatgcatgagtttggaagcagatctttcagccccagccaagcctttagacgactgcagctccaaagtgtgtcttaacagcgaccttatgagaccctgagtcagagccacccagctaagtcactctggactcctgtctctcagagactgtgagagataaagggtgctgcagaatttctcactcatacacacctagggggagagaaatgaccaggaatcatcatttattcagctaaaaatcagaaggcagtggaacagccaggaatacaacaagaagtcaaccgtctgcagcctgtaagagggcctctcaccagaacttagccatgctggaaccctaatcccagacttccaggcttcaaagtgatgggaattaaatttctgttgtttataagccacctcgtctacagtactttgttatagcaactcaaatggagtaggactgtatgcaaacaaaacaacccatttttgatatttgggaaaatctaagatctttaatagtagttggaaattttcagcaaatcctaatattgggtgcgtatcagtatatgtgtgtatccacaatatacagtgtcatacacacacccatataagcaccatctgcattatataataggcacacctgtatcctcaacgttggtgtacagatgcattcatattacccatacagtatgttctgaagatagtcaataaactcagacccaagacagtcctcccatcttttaattctacatagaaatcaggacgcacctgataaacagcagaaaatgtaagagaggccaggtgcggtggctcttgcctgcaatcccaattttgacacactgaggcaggaggatcgcttgagctcagaagttcaagaccagcctgggcaacctagcaagacctggtctctactgaaaatcaaacaaatttagctgggcaaggtagcatgtgtctgtagtcccagctacttgggaggctgaggcaggaggattacctgagcccgggagatcaaggctgagtgagctatgatcatgccattacactccagcctgggtgaaagaacctttgggtgagcagagcagaagtcaagcatttctgggtccctggctccgatgctgtcttacgggcaccacttgttcctaacaggaagctctctttgtacacaagttataattacccatcaaacctgcggctctgtgacctttagcaaaatcactgggtgttgttttcagaaataaattagatacagaaatggagaaaatgcacagagtaactccagacatttttgccaacatcacatccctgattctggcttagctgcggtgatcccttggcgtgtttcctgatctagggtccaagactttctttctctgggcacagagaccggaagagagtccttccaggccaacaggctctcagctgcgttgctctctgctcagcaagctgtcctttttacatttcgaccatggtacaaccacccctcgttcccagaccaactgcaaataatgaatgattcatacccagttctctgccacaacatttagtcataattcacagagtaattgatcctgtttctcagtctgtcaataacttggccaggtataaatacatatgagaagggcttttgttttgtaaactgtggttatcctaactaatgaggacattgactatttaattgactgtgctctcagggaatagtgaagacgtattctgtctgtacacaaaccaaggtcttgctatggcagtataaacgatggataaagtaggcaaaatgattgtcaagccaactgaaaagctttaaagaacaaaaaaacagtcaccaactgttctatttgtgaggaaaccagacattgccctcctgggaagaaaagtaattaatttctcaaattactaccatcctgaaagcattttttttttctttgagatagagtctcgctctgtctcccaggctggaatgcaatggtgcaatctcggctcactgcaacctcaaccacctgggttaaagcaattctcctacctcagcctcctgagtagctgggattacaggcaccctccaccacacccagctaatttttgtattttcaggagagacggggtttcacaatgttggtcaggctggtctcaaacttctgacctc

SEQ ID NO: 2905 - DNA, 6976 bp, Homo sapiens
atgatgctatcttaaaagtagcttcttacctaagaataaaaatgtgtagtcaattctggcttcattatttggagggattagaagcaactctgtcaaacagggtgacccttgatgccatttgcaaattcttcttagaaagaaactgcaaaaggaatcattcacctactaatccaacatccaataaagtttagttccgtgagctagtatcatcaatggcagcaaaattagaacagtagccatagaagtctaagttgaccttcctttgggtgacaagagtttagtaatgcccatggattcattgtggcaggcagttctctggtctccatcattacacctaacattttaattgtgtctttaattttaattttaaacgtgactttaattttaaatgtgactttctccccagtaagaaccgtgagagagtacttaacacaatataatacactagattcttaatattatgtaagagatcacagtaggatatgagggagaagagaacacatgagtaaatgaggcccagagacatttagcatcatgtctgtggccacacagctagttagtgatagggtagaactaaagtagctcttctattaggttggtgcaattacttttgcaccaacctaatagttctcaagtagtttttttacaacatctgtattttttatctctttggatctcagtcctctagccatagtatagtaatttttataaattatagttaacactcttatagtacttgctattttcctggtatgtttttaaatgctttcaatatattaattcatttgatcctgaggtaggcactattttccctacattacaggaaactacaggtatgaagtaacatgctcacagtcatgtaaagctaaggttggaacccagatagtcgtctatatgtaaaccactaggatacactccctgaaatggaatgacattatctttttgttaaagtcgtatgaggaaaagtaaacaaatatttaatgatgtagaataacataatatagattttattacacaaagaacatacatttttaaaaatttcagttaattttgtgttaaagatgctcattaatttgtttacaaaaaatgtagaatcaataggaaaaaaaaccttaatgtttatacattaatattaattagagacacattaaagattctcattagataacatacactttttcaaaatcagtttcttataagcaataatcagttcagtcagaattgatacttagtttctccaaaggatttaagccttattcttttttattattttctatatacttccaatgttaaaatcattctaatgctacttatttttttaattgattgctctggggtttgtaaacttactagtctctcttcaaatagtattagactacttcatatataatgtaagaaccttacaataaccccactttgtgctattgcatcatatatcgtacttctatatatgttacaaacgccatacttcattgtaaatatttttgcttcaattatcttttaaagaaagtatttcatatttactcacatgtttatcatacattcattattcctttgtatagatccaaatttctctcatatgatttttcttttactagaggaacttctttgaacatttcttatagttcaggtctgccaacagtaagttctgtttgcttttatttttattttgccttcatttaggcagaatattttttctgggttcggaattgtagattgacaccttcccctgagcatggatgttgttccattgtatttttgcttacatatttctgacaaaagctgtttatttcatctcttgtaggtaattatttctctctggctgcttttggtattttctccttggttttcaatgatttgtcttggtgtcattcattttttatcctgcatgggatttaattagattcttggatctgtgggtttattctttttatcaaattgggaaattttctcaccataatttatactcgttcgacaagtttgcatgtgctgcttgctattattccacaagacaaaaagctctgttcatttcagtctttttctgtgtgcttcattttgggtatattctaatttgctatgccctcatgttcactggtcttttcttctgcagagtcatatctgcttctacactcatccagtgaaatctttattttagatgttatactcttcatccctagaagttctatttgattctttaaaaaaagattttcacttctcatcacattatgttttactttaaatactagtacatagctataatagttgttttaatggtattaccttctaatttcattatctccatcatttctaagtttgcttctattgatcgatttttttcctcttttggatcacattttcttgcttcttggtatgtccagtaatttttaactgaaagctgagtattatggctattatgttgttgagttggggatttgttgtcattctttaaatagtattgagctttgtcttggggagtaaattacatgtagatcagtttgacccattcgaggcctattttaatatatttctagggcaggtctagaataactttcactcaagagatagttcagtcctactactaagatgtgactctgctggtgtctctactgaatgacctaggatgacactgagggctctctactagtcaaagtgaaaagtcaggtgtgcaatttcaaaagcaatggtcagagatgacttcactgtgaaaatggtggcttgcacattaatacctttcttatacctttcattactgagtcaggggtatgaattcttttaataatgatatataatgtcaaactgctttccagtttatacttccactaccagtttagaaaagtgcctgcttcataataaccttgttagtattgaatttaataaattatagtatatcctttgggaggaattatgcagccattaagaagcatgatttttgagacttgagaaaaggctctcaaaccaatgttaattaaacaaaagcagagcaaaaaattctatgtacatcaagatcccattttgacataatgtattctttggtaatagcatttatattatgaatgattttcatattcttattttattttattttagtataacttcaaaagtgtctgttgttgaattttggctcctgtccaactttgaacaagatatctggcctttctacacttcagtattctcatcgaggatggcacaagcacatatcttataacattgttgtaagcattcaattatttaattgatgcagaactcacagaatagtgcatgtcacatagccatacactaagtgctcaataaagattagctgttactgttatatcaaattatctcatctgtgtagctatttaacactgtacttaacacaggagatatagtggtaaatgcaaaagacagttcctgtcttcactgaagagagattttcccctgaatctagatgttggtcttatttctggtgaggaagcttttattcttttcttttctatttcttttgagacagagtctcgctctgtcacccaggctggagtacaatggtatgatctcggctcactgcagcctctgcctcctgggttcaagtgattctcctgtctcagcctcctgattagctggtattacaggtgcccaccactacgcctggctaatttttgtgttttcagtagagacaggatttcaccatgttggccaggctgttctagaactcctgacctcaggtaatcagcccgcctcggcctcccaaagtgcttggattacaggcgtgagccactatgcccagccacttttattctactttaaaaaattctgtatagaaatacttttctaagggatactgaacagtcaaagcatgtttgatctctctgactttccctcattgaaagcattgattcttgttatacgtggttggtagatttagggagatgtaaactctgaaagaaacttgaaagtaataaatcctatatctcctttatgattatgtctcctttttttctaccccttaaacaacacacacacacacacctttagctgtgctggacacattatctaattccacgtgcgcaaattctgcatctagataatgttgtcttgtggtatctacctcattaagcagtccttctagaatgctttgatgactaaaaatacagatgacgtgtccttcgtacagccgctttctcacccgcatgtaggaacatgtgctttgggtacattttcaagcaaggacttgtggtgatctacctcatacattaatcctagctgtagtaatactttgggaaaggaatatgatcccaaaataaccaccaggagaagagtgtcatgaaaggtcatggcaatggggcagaggatgttggacaggagtgttctaaaaatagagagtaagagatcaaagaaccagcagtaatgaggaacattttttggctttggttcccagggaaggaggaggaggaggcggcggcggtggcactccccagcctgttcgtccgccactcatatctgtgttgcagaagtagggaggatggttagcacattttcctgtcctgggtgctgactgcctttaaattatttatttatataatgcttaaaaacatgtcaaaataagaagcatggagaattttaccttactgccatattgctactattgcaaggaagacctaaacattttggatcaagaatcctcaatttcagcttttttctggaccagacctttaggttttaccagttcaaattgactttttgtcatcttcctaaactatacctgatgattaattgtgagtgtttgcagagccaagcactgagtttttgtgcattcatgagaagttgggtcgatcagccactctgaggtgtgggcatatctggctgcgagtgaagaaatttatatcttagatatgctgttcaatccctcccctgcaaatatagctttgacaataatgaggcgagtagatgaggacatgttaaaatcacaggcctcttgaaggaatttttggcagatgattgtgtgtatgtgtttgtgttcatgtatgcacacaatatagtaattccatacagtagggaattaaaaaatctgggatgaatcccgtaaccttcctaaggacaatttactcaatagtgaactaaacttattgacacttggctgacagacgataaatgtatggaagtgcttgccaactatacaatgctgtacaaatgttccttaaatcctgtggttgtcagagaaccagtctatatgttcaagtcgaatccactatctcctattcaaggaggtttctttctttttgttcattccaaaactatttactgtgccactccagtgtgcaaggcactatgccaggcaccaagaagcatttaaagatgaatcatacccagatcctgccctcaaagaacttaggatataaggaggcagataaactactgaaaaatgctctgcttggtttctctaatttagcttcaaatgatgtcataactgagcataatatgacatttaaaaagggacttagcactccctcttaaatatttaaataacaatgtacatgttaattagtatgcatttgcctgttaatagacttattaacatgtatgctagtagtcaagagtactgagaaatgcctgtgcaggcaaaggtgttcaggacaggcaatgtgaggtactgtagtgattagcaatgactgacagtgcactaatcacagcccttgttgagcaatcagtcttcattaggctccccaaaccaaaactgacccaaaaacaattgattctttctggctttaaagccaatttctccatttgttttgatttgaggctttttaacgctgaatctgtgtgtgaaaggcccttctgtttaatattttagttgcagtgcagttaataaatccttgactttattctaaaagtagagacaaagttaagacttctccaggagactaaggaatcttaatatttacatgagggaaatatacacagttataatcctgaaaattatgcaatttccagtcatttaaaaatcaccacaaaatcttattcttataaaaatctagcttaaagcacattctcagtcagaattctggctttaaaaatattcattgaataagaatactagaggtctttggaaagtataggacatgatactgatctcttctcccagtaaaagaaagctgctttagagattaaaaaaaaaaaaaaaaaaaaaactcttacaatttcctttttaggaaaactacgagggcctgtacattggtcttgagctggcctctctttcaggcatgaatagatctaaatcactgtgagagatcttaaagatggtccttaggaaaaagaagctattgtgaactcagaaaagaggaatgttccatttagtgctcaaaagaatggttgaaaactagtggaggacatgttggtgctaacatttaacaaatgagttccatggaatgctgctaagtgagatgtaacattgtgtgagcagcaagtataatcttcaagccaagatgtccagggcaggcacagaggcctgggcttccttatgaaccaagacagacaactcccagccagaatccccagaaagtccctccatggagagtctggcagactagctccaactctgcagcctttgagctctctcactacaatgtttcagaaggaaggagagtccagatcacatatccagttatgtagcacctgtgaccccttagtggcccattgcctcacagtaaacactaccaccaatattgctgacagtccccagatgcagtggattcatacaacaaatatcagacctctagactgtactgtctatcagaaatgaagaatctgttcatgcctctgacctccaatttgtgcttctgccaagtgcagtgagcatctgcaggcctgtgtctgtctgcctgctgtctatggttaggtcagcaatagtgccctttgctggtaacaaacctctgggcctccagtttcttctggcctcatcttcatagttaggacccaggtcactccctgtttctcaccaagc

SEQ ID NO: 2906 - DNA, 2144 bp, Homo sapiens
cagttgttggcttgggtgggcggacagcgcccggtcggcggctgctctgcccggaggcccgcctgtgcctaggtgtttgaggggttcgttggtgagtgggaggctcctccaggcttgaagctgagcagcgctcgccgaggccggcgccttcgagccggtagctgcgggcttcggttcccgctgcactccggcttcatccatttctgagcgcagcagtttgtcccttttggctcctttggcgggagaacaaagcagcgggtttttttccgctacagccgttttctaagttgctgggtttgaggtaggaagagaaaatggagagaggcacggacacagagacttggtcataaggcaaacattaacccccagcgaacacgcaacattaaccccccgcgaacacgccgggaatggatggattcccctcttctttcctcccctcccctcttttggattagaagaggagaaagaaaatcttccgcattgtattgcaatccagggaagaattattcctatatgtccaccaaagccgcggcaaatagaaggaggccttcgcagttaatccaagacttcgatgtgtgatcataagcctgacgatttaggcaaaacaaattaaacaaaatccactaggaaaaaataaaagcaagctcaatcctgctacatccttgaaagtagtgtcgggtttgtttttacctcctttccttttaccttgtttattgctgtaacaaatcattagaattctcccttactctgtctaaaccccgaaaaatcgaaaatcatttcgtaggggtggtggaggggaaggtgggggacttttcccctttgtttctttctttccccctttgttggtctttatttccttttctttttctgtctctctcttcctctctctttcttctttctcttaatcagtagggagacgagaaaggacctgaacagatcagatatctctctccaagcccccttcccaactccatttctgtaggaaagtacagcccctggaattgggttctggtttcgctttgggctggaggtgggtggatgggggtcagagagagaatgaggtgggggggacttcaaggttctgtcccaccgaccagagtctgaagactattcgcctttcccaacacggacctccgcccatccaggcccgggactatcccttcgcggtgtagcggcagccggagacctggctgaggaggcaaccgcgtagacacctccctgcttagaaaacaaacactgaaccagaccgatcccagttggagggttcgaaaatgttccagacagcctgtcgggaggggttgttgttgctgttggactaaatagctattcctgattggtcatgtatagggttttttaaggcgggtggggggaggagggggtagaggaaaggctccaaacacctgcaggttgggggcggaaagctgtttgcgattccctggactggttggtcggggacaggaggtaattcccagccattgacccccatttctctctctccctccctcttgccctgcctctttctctccacccctatctttcctggaaactcgctttgggcgcggcagatcgcccaggaccacaccgcagcgtaactgcaggcctctcagcgaaaaagggggaaagcaaagacccgggtgtgcatcctcttcctcggcttccgcccctttccggcggagtggagatcctattcagaggggccggtctctctaaatatgccccaggtgagttttcaggggaatggtgccggtggaaacggtgtctaggaaggccttgtgttccggcctggggtgaggaaggctcaggacagaggagagcccattctcagattgggggtggggggaggggaggaccagccagagcttggaatcgggatctgactgctgtagctgcctctgtggcattcagcggctttttcccttttccacccagggtaaaaccagctagttggacttagtcgtccaggcctttcccattggtcccggttctgtggacgtttcccaaggccggtaactttggggcggctgtatccgggtggtacagactgtgcctggagctcccgcaggaggaaggcggcagccttcctggctagtgcagtcccagctcgagtgggccctgatcccaggcctgaggcctagggtggggag

SEQ ID NO: 2907 - DNA, 988 bp, Homo sapiens
caagaggcctgcagctacacagcgaccggtgccctctgctcaggggcgaaggatgacggagacagaggctaagagagtgtgtatcagagctgaattcccccacagagcgcaaaccagtctcccaacaggtgccccctgcacaaccgaaccctcccccgttttcagacaggggatcgcccagaccaccccggggtgggtagcagctgagttgctggtaccattccattcagcacgaggatgcatcgggccggctctcctgcaacgtccagcaagacagatgcatgggtagagcagcgggaagcagctgataaacctccaagtcacgcatgtgtgtcatgagtgttccggcagtcctccctgcagtcccacccacatccctccagctgcaatggggaagataaaaggaacaaggtgatgaccaaaagtttaacaagaagggctctgacacagattacatggttcagcactgtactttatagatgaagaaactgaggatgggaggagacagcaagattgggcagggagctcgcggcagagactaagtaatagtaggattaagtaacagtgacaacaacaataacaaccatgttattgtgtacccagaagtggtctatgctctttatattatgccgtttaatccaaacaataaccccgtgaggcgggtattgtaatcgtcgccatttcgtggatgggaaaactgaggcacagaccagttaaaagtaacttgcatgaggtcagactggtaaaagctggattcaaacccaggcagtcgggctcaggagtctgccccttactcaatgccagcacaccacacaggacacagccatttagaaaatgacattatttgacatagccatgtgggtggagcccaggccactccagggaatgtttgcagatggcgaaaatctcataaacatggtctataatcttctgtatttgtgatcatagagactggtcttgctcctacaaacagagtaagtcaacacac

SEQ ID NO: 2908 - DNA, 13198 bp, Homo sapiens
cttagaataacagaatttggtcccctcccacttccgtaagttgaattcttaattgctaaatttcaggcttttttgttgttgtttatgtaagaatttcaaggccacaactccatatttgaagtaaagtgctcataaaattaattgcaaggtaatttgccgttaatagttatctgatttctactttgatctagtggttgttaagaagagaggttttggtttttttaatcttgattttgctgttgattcctacttttaattgctgtactggagaaaatgatttctgtgggcttctttgaggtacagcacatgattcacaattgtatatggtctgataacataagaaaataacattttctcagttagtagaatacaaatacttaaaaatatatgtttttaaatatttgaaaaggggtctgctgattccattattaatgtattgcatccttacttgattaaattacttttgtttctggaggatttttttgtatatgtatatttgatgctgtgtccctggtgagttataaactccttgaactacagcttttatcatgcatttgttataaatttttattcattttatatatattgatattgtcaatcctcctttttaaaatttggatttgactttataattctgcacatccttttcttttcaacatttgccttcatttttcaagtgtgtttcttatagacagcacatgtctgtattttttaaaaacccaatttgatattccttgtttcataacaggaaaatttggttcatttgaattcagtgtgaagattaatatttcggtgttgttctcactttatttgctatttaccgtttattccttttttcgatttttacctctctttatattcttgctaataatattaagctttttgctagttctgttgtttctcttttggtttttgaattaatgttattttatgattccccatagccctaactataaacttattctaacaatataaactattctaaaaatcacatataatttatgtgtctttatttatgtgtctttattaacacataaaaattaataagtaagtgtaaccactcgagtatttaatttgccattcctcctgcccctttaaaaaggagacatttccactggcccctgctcttccatcctgagcaaactccccaccttcacagtagccaacacttgggtttacagcaatggtttcagattttcagcgtttcatatcctggctaacatttttgagataataatttcttctgtttagcaataagttcttaagatttaaatatattccagtcatatcattttattaattcatttttttctctataccttaaaatctatggcatctcatggttcgacattaggaaatccatcactatgattcagtaagtaaacaaattcaaggtgtcacatcatattgctttttatgcttttgattttagtaatatcctttcacattcataatccagatagagagataagcaagattgtatccaccaagcctcctctttattgatcttccaaactgaaaaacatagctgccattttagtcagcagttaaactttattatagaatatttttataccttttctgctaacattacctgcaactcccatggtgatgctcaaatcccatttgggaattcagtgaactagcagaatgaaattctaagagactggggcttgttgatgtgtccacgctttccatgggaactgatgttaaatatttcacaaataccataacttccaggaattcacatattctttattgaatgtagaattgtgaaatctttaagaaataactgaatcattatttcttcactgtctcctgcctgtgaaagcagaactatgaaatagctcaagggaatcagtgagagatttgtatccattatattcagtagcctgcatgtgtccaaatcacaaatgaaatgatgtgggcaaatataaattaaaattgaatgttgcagaagtggttgaggaacttcaccaggatacattaatgtacaaactgaaaactgatgaaagacttctgaagagagatttgctaggaaaaataaaaagatatataaatttcagtgatgctgaaggtatgtgcaaacaaattgtcctcattaatagtaaaggtataaattgatgtggattttctagaagacaatttaaaggtacacacttggtttctaaaaagtacactttttaaaatctatctttttaatcccaatttatttacaatttattataagaaagtatttaggtaattatgcaaagatgtatgtaaagtaagttcactaattgttctcagtacaaaaaaaaggatgaaattccataaacatctattaagaaagacctggttaaataatgtattgtacctccatatgtttagtcattaaaaatggtcacttaaatctctagtgtattgacatcaaataatgtcaacaataaatttaaaaagcataactctctagtgtattgacatcaaataatgtcaacaataaatttaaaaagcataaatctctagggtattgacatcaaataatgtcaacaataaatttaaaaagcataaatatatagaaaaatatccctatctctatataaagaatgtctacatacccacttatgaatacatggaaacatatctgcaaggatatagtctaaaaccttatcggtagtgtttcttcgcagtagtgtgaaagaaatacagtagaaacatttaactccttccagtaatgggaaggagaggaagagctcacaaaaacagaaagcatatatttttgacattttgatattttaaatgtaatctcttttcttcatttttctggctacatatgttgattcaacacatattagtaagcaggatgtaatattcaataaaaacttctgtaattgtctgcattagttccaatttattcatatagaaactattcattttacatatctctttctattaaactaacatttagcatgtaaggcacagttttatttttgaaattattaataaattaaaatgttagtgacaaacataaactcttgagctttacaataggttaatgataaagaagacagccaatattagatggagaaaagcttcataaaacccacaggttagagaaaaattgttaggcatttaataaatgatagatcctttatattttgctgcacaaaaaccaaagatgaaaccttttttaaatgcatggtctcagcatgcatttcaaatcacatttttgaagtttatgaatttatgattatataggggaagaaaaaattctttgtttctccacccatcttagatctattggctggagctctgcaatttagactgacaaaagacggattaaacaagataaaaacaagtttattaacataggcacaatgcataagaatgggaactgtcactaatgtataactcaaatgagtggttagaccttagagttatataacaatctgaacaaggaataataaatatgttgagaagtgtcaggacaaaggaaaggaactttgggcttctaggggcagcaaattgtgggaaggtaaatttttgggaaaagttaatggaagatgttgggcacggtgtctcacgtctgtaatcccagcacttcgggagaccgaggcgagtggatcacccgtggtcaggagttcaagaccactccagccaacatggtgaaagcctgtgtctactaaaaacacaaaatattagctgggcatggtgggatgcacctgtatacccgctactccggaggatgaggcgggagaattgcttgaacctgggaggcacaggttgcagtgagccaagatcatcaagatcatgccactgcactccagcctgggtgacagagtgagactctgtctcaaaaaaaaaaaaaaaaagaaagaaagagagagagagagagagaaagaaagaaagaaaagaaagaagaaagaaagaaaagaaaagttaatggaggatgaggtctagttagtaggtttgttttatatactatgtagattcctctctggtgccttccttgggctggtagactttatagctgtttctggtgatatagaatcatcctgcccttcctgatagagggggaggataacagagagtttttctcgtgtcttcttgtgttttgttttgttttgttttgttttgttttgttttgtttaattgcctttgactcaaaatagtccttaggccagagtgacatattttggggtgacatcctctgaaccttttcaaatataaggtctgcctccttctttctacttcataacataaagtcttctttctcttccatgaatattacaattcctgcctgagtcttacaaggccctcctcttccctgtaggtcaggacacaattggtcctttgaattgaggtgtggtagtagccaagctttcaggagtgaggtttccacctttcatcttgtttctaaaagtaaatatctagtaaatgataaagctgtgtttttagttgtaagtctatggtgattgtatagcacagaatgattctaatgtattattttagcaatgaagacaagcagatttgatgcagaaatccttgacataaggagccaaaatatttatgttgcccttaggggatagatattaaatatatctacccatactaaactttttttttttaagagatggagttttgctgtgttgcccaggctggccttgaactcctggactcctcaagcaatcctcctgcctcagcctcctgagtagctgggattacaggtacatgtcactatgcccaactttcccaaattaagctttaacaaatcttctcaataatgttttcctaaattattcttgaatacagtcatgtagaacatataacaattatgaagttttaaaagtctttataattcaggaaattttgaattaataaaaacaaaggaaactttttgttttttgagacagagtctcattcggtctcccaggctggagtgcagtggcatgatctcgggttcaagggattctcctgcctcagtctcccgagtaactgggattacaggtgcttgccaggaaataaaggcaataaaaggtcattgctaattatctgctctaggtttaaaaagttcatctaaacttttcaagtatctttttttccctgaagcctacattttgttattactttagttggaaaacgactgcagtcaatgactcctcattccctcaccattctgacatgcactccagcatctctttgccattatttcagcaaagatagatataatatgctatagaagaaaaagagtagcaaccttaacttaagagttgagttcctattgtaaaataaagacattactgagactgggtttcaaacaaatatatttttaagctccactcctgtggatttttttgttttgttttgttttgtttttgtcttggtctctttgttgatcctgtcagccaatggtttctcacttgcctgtcagagctgaagagtccattccttgtcaattcagatgcgaagtggaacaaacgtcctttagtaacaaaacgaatccgaaatgaaaaaggatatgttactgctgactgtggtggttgtcaataaagatgttttcatagcaactattccttcaaaatacaatgaacatctgcaatagtcttttacccaaatgacaaattcctttcctactaaatcatgtctttacaaaattagaaggctctattttaaaccttgaattacttgacattgaaggtaatgctaattacaataaaatctcccacttacataattattaattcaaatttgcacctttttcctgaattttacctgcttagaaatccttatggtgctaatgatgaacataacgattaagaattttgttgctgaaatctctctatgcctcagtttaaccatgttaaaaattgataagataatacttaattgatagaaactgtgataataaaataacaccacaaatgtgattacaacagaacatggcaaaataaatgctagctaaatttttaaatcatggtttaaagatataatttgtgttactttaattaaataattgataaatagatttcttgccttgacattaaccttgagtattcatatttctgcaagtaggagaggaaggatgtgatgtctttccccatccgtcataagggtcatggccaacactcctataacaaaaggtaggctaacgagaaaaaagcatgacaaatatttaatcatgcttttacgtgacagagaagccttctgaaagaaggctcaaagaaccagggaaaactatccatctttatgcttagattcaatggagtggacagttgtgtagaaatgtgatcggacaaaggaagaattatctaatagtaatggactgcgtgtggaaacccataagaactgtctattctgattcttcttggcctctctgtgtggcatttcttcctcctgggtatggggcatgactccttctggaattagggtttgatgacctactatcaaataaggggaggtcagagaatgtctttatggccagctcctagatagaaaggcaggacaaggttagactaatcattctagcttttatttttggctttgaggaaaagcagatatggtttgtatgacccaccttagggaagaggaattccagtttttatggttcaccttgagggagaatgaggggcaaaagacatctgaatccttcacttcagggtatcattttctgaggctcaatatggacaagtatttataactaggtgcttaatatggccttttgagatacacagttcctatgctgcaatctcacaggcaatgaatggtctttataaaagtgtgttaaagttgaaaaaaaagcaacaaaacaaacaaaaacctgaagaaatattcctcattgaaggtccagcttacattaaaaagaaaactataataatttattctcttgagaagggttgtatagcaaaggaaaattcttgaatgttccctctgcttgccccatgcatcaattctattgatattaaagtaggcctagcaaatgtacttccattctcactgactcagtctttgtaattcaacaccaattctgaaaaatacttagaaattatttcagtaaacagctcttataagtgctacatgcataacaatatttcaatatcagagacttctatcccatgagaagatattttcaacctaaaatttattataaatgacctaacaaagaactattttttcagtaattggctattatggttcaatctgttatacccactttacactagaaactatcctatattttcttgttgcctacgtaaaagtgggcacgaaaaggttaaacagtaaacttcctgactcctgccagccaagggaagactactggtgttacctacgaagtgtcatggcattctcatttctgaataatgagggaaatctgctttcaatacaaacccccataagacagtcactcttccagacaaattaagctaaataatccatcatgacagctgagaagacaatgtgcaaaatgtcagtggaggccagggagagaaaggcagagatggactgtaagagctgcagcatgatgcaaatactgagaaaagacattctctgttaatacagctcttaattgtaggcattttttacagaacatattgagagtgaagcaaagcttccttagcagtactctgatgtcttctcagcaggataatgtagggtaattcacagtgaaggcaaggggttaggaaagtcacagccctaaaaatcaatgggctgcttacagggaagaaggtgcaacagatcttggagagcacagaaaagaagagatgagcagcctgtattgaacagaaaccaaaatattagttagatatatccagcaaagccattccacaagttcgttagtgagtaggtgccaaaagccaactgtaaatcctagatacttgtacatatgcatgcttatattacttatattttaagcagtcatatcctcaagctatattatgagttcagtcattctaaaaagatgcttccattgtcttcttggcacttactcagaatcttcagttatcttattcatactgtgtgcttactggttgtcttaacaggtgagggcaggggccctgtcttattcacctccatatctccaggatatagaatagtgcttggcacacagcaggaactcaataaatattcatactattttgagtcccttaatcctcatatcaactacaggatttagattttattgttatctccattttacagatgaggaaaatgaggaacagagaaattaagtaatttgcccaagctatgcatgaataagtggcagagtcaggatttgaagccaggcagtcaatccctagaatttacactccaacaactactgcctctagtggttatgtatgtatttatacacgtatatatttgcagaaataattgaaacttatttctgcctaggtgcatgatatattaaagcatcactaaatccttctgaatataattcaaacttcttcctaccatagacaaagtaatggcctatagtgaacataatgattatcccatcatacaccttgtactgtattagttttctttgcaatctcaattacacttgcatttttattatcatggttttataaaactttatgactggaaagtaccgtattcataaagagttgtgcctcatatatgttagacatatatgcatttttattagtaattataacttttatgcagccagatagccccaggtttatgattccacatcttttgtgttgtgtcatcttttgtagctagttgatattgtaatgtttgctgacttaattcattcagttattaatttctataaactagaatttaggggacatttcaatggactatggagagaaaataactgaaaattggaaattaagagcatctgagaaaattcaagttgtttgtacatcctggacataaatctcaggaaaactgacatattttccttccttgtcaagtcatacaaccaatgctatcactaaaactggtctaacatttaaacattcagacaatcagtttagtcaatgcttcaataagtttactgaactagcagtttcttaccaactagttacagaacagtcacagctgaaaatgatctatacattgtattataaatgggattaattattctgccagacaaccccaggtgtgccaaataacccaaccccttcctccaagacactcattgagaaactagacagcatctgagcattgtaggaacaaacactgaagtaaatggattctaaatccctttgagttctaaaatgctgtagagatctgagaagcccacaaccttataacagcaggcaacatagattacgcttaaaaagcaacatactttcaattgattgataaacccttttgttgttcatttattgcaaataggttttagagctcaattcacacttttgtgaataaacattgaaaatatttgattcaatggttatatttctgcctgacatgaggaaattatagaatctattaaccttaacaatttaattagcatgtcccagacttaatcactcactatctgggtagaattggcccaattagttaaccactctaaaccacagtttcctcatctgtaaaatgggatggaaaataataacaactcatagggttgttaagaggaatacataaattattcatgtgccctgtatggcacacaataagtccttattaaatgaaccggttgtagaactgtattaagaacaagtagtagtagcttccatatttagagagccatcaattctgttttccaacagctccattagtgagaattgtgctgtgtgttttccccccaccccgccccactacaactgcattgctatatgcaaggatataacttctgtctctaaaactattcaaatagtgagcctgggaaaaacaaacttaggtcaaaagagtttgactaaactggctgagaacatttaagttggataaaaatagatgtattttgtttgtataaatagattttggtcatgagaaagaaataaagaggttcctctcaaaagaaagcctggtttagcagtcagtaaacattgggaagagtcagcagttgacttccccactgtgtggaagaaactgccaaaagcccatccagaattaggtgtgtgggagggaagaacaaaggagaggcaaacaagaagctgtcactattcaccactttcaccttgaataacctttaattgaaaaataaagttgccaaaacaaggagtaaaagaaaaactaccattttattccctccttgagattgaattagagggaaacatactgaccacagtaatcccaaggttggactcacatgatggcaaatgtcacttagttctaaagctctaattagaaacagggctgaagttttagccagctcctgctactagaaataaaacatgaggcaacagcaacccaagccctggacaccccctgacagtgaactctgaggtgctttctgagtgagttgagtataaagctgacagagcctagagaattcatacttgagcaaatattgggaaagaataaactgggtcagttaccacctgtttctagattttatttttttctagacttcaactaagattgtctttcacattaataagaagaacgatgaacataatctatttcatccaacttctacattccaggcacagtatcaaccactttattacattttatcttctgtaatattcacagtgttattgggtagattaaacaacttgcccaagttcacacaactggtgactggcagaaatgggatttgaacttatttgatgccagaggaggtgtatcctttaatattttagaataacttatttatttcattatattttatgaaccttgaaatatgtttattgtaaaaaaaaaacgcagaaaatacagacaggctaagtaaaatgtgtctttacattaaagtatttaatttgcaaaagaacagttgttattttaaaatcctaccccacagtttttcatatttctctttctatgtagggttaatctcatcaggaatttctcttatccatccacagtttgtaggacaattctttgcacataatgggcactcaaatgtacgcagatcatattagtccaagaaaaagctgcttgttggggctaccaagccagcatggtaacaccttacaatcaccctttctacctgcagtcacattgttcccagagtggggtggtgatacttgccagctagcccaagtttctggatatagacctttaacaacttcacaagtacccttagaaaattcggttaagaccgaacatggacatgcttgctccatttttttccactctcaaaatatccttgagcagtaactcattcatagataagaaaaactttttctcttcagttttttcttttctttttgaatattctttgattttagcagaaataggcacagtaaaagaataaatataagagacgaagaataaaatttatgaaatttagaaagctcatgttagagaattgtactctttaggtagatccttatttaaagaataattagaggaaagaaaacaaaagatgaaagagtacaaatgagattcctgagcagttttttattttgattgataaacttttaaaatgtgtttgaattacaatatttatatatcaggaatatgaaaggtttaatcataaaaattacataatatttcttccaacattttcatcttgtccatttcttcatatctatagtggagaattatccctctgtaggcaagaagaagtctttattctcttcggaagctgctcctcttgcactccaaaatatagttctgatggaagctgccaatcactttatcccattcccagaacaggcatggtaccagactgaggtcaatcctatactccaccttatttgccatggaaaatagcctagcgatacttgcatgactcagggcagttggagtagtttgatggaattttttaaaccacagctgacaggaagtagctctgttccttattagttgcaaatgctgcaagcatatgaccctagagttatctgttgccagttgttgccttgtggagatcataggcttaagatgatgaaggcagcaatcagcaataagcagaggtgtgcttgtgtgtgtgtgtgtgtgtgtgtgtgtgtgtgtgtcagaatgagagagagagaaaaattactgcttctgaaaccaaatccatttccaaggtgtggttttagaagcaaataaattgccaatttcagagctgattcaagttgaatttttgtcctgtaaccaaaagagtcctgactaacagccaaaactcaggctgtcaagtaaacataatctgtaagaatccgctttccagcctccattccccttgacatcttcctgaaagaagatttgtataggaaatgctgacgtctctttggcaactgcataaaaattattgtattcaacaaatttattatatgtctctttgtggccaggcagcttgcttggcactggaaattggctagggagattggggcaagaaaaatacctctctccatggtggaggcatacataaaagccgattgctacacaactgcgtaagaagtgctttaatcaaagcctgaataaagtgttgtggaaactcaaaggagcaagcaaaatgcttcacatgaaagttggacattcgagtcaaagactcacaggattttcccaagcagaaaagaaaggagaggacatcatggacagaggaaatagcatggtgcaaaggcatggtatgaaaaaaatacacgacaaatttgtggaataacagaacttttgatgtgatcacagcataatgtggagttgggtaacagtgagggattaggctaaccagcttggcagaatactgactaaaaattcttaaatgctgtgctaagttgttagaattttatcttacaggttttgagaagccatctgcagctcacaactagatgagtgacacaatcagatgtgcgtatgcaaaaaaaagcctggagacattgaactaagatcaaatttaatgtattaaatatggtagaaagaagagagaatgaaaaataatgttaacaatctaggtgaggaattgctgaggagacaaattaagtaaatcctgtggaaggaaagaagaaaggaggaaagaggattggatggaagaatctccacttctcagtaatttgtttatttactttattagtttacatccatgtgattggcatctaaattattattttaaagttagatgacttttgctaatatccttgtatttaaatttttaaaaatacatctttttattcttcta

SEQ ID NO: 2909 - DNA, 3823 bp, Homo sapiens
ctccccacacccatgacagcctgtcctgatatagatggagaggggactggtttaaaatgacagtctcaagttcatttagaaagagaaggctaattcaaagaaacagcaaggcaagcttcctttctctgtaggaatcattattatccccctttgtcatggcccaccggggagcccattttgcctttagatcccgctggcagaagaccgacgatgaactctgtagacatagcatgtcttttatccttcacaaagccattcgcaatgacttctttcagagctatctctacctgctggaaaaaattcccctggtgaaattgtacgctttaacaagccaagtcatcaatggtgagatgcagttctatgccagagctaaacttttctaccaagaagtaccagccacagaagagggtatgatgggaaatttcattgaactgtccagcccagacatccaggcctctcagaaatttcttaggaaatttgttgggcagtgtggagctggtggatatgatggaatcctttctccttgaagcccagaactacctgcaggtcaaaggtgacaaagtagaaagctaccactgctacagcctgcaggaattcacaccccccttcaggagatatgatgtcatctggattcagtgggtctctgggcacctgactgataaggaccttcttgcatttctttcccggtgccgagatggcctgaaagaaaatggcatcatcatattgaaggacaatgtggcccgggagggctgtatccttgatctctctgacagcagtgtgactcgggacatggacatcctccggagcctaataaggaagagtgggctggtggtgctgggccaggagaagcaggatggcttcccagagcagtgcatccccgtgtggatgttcgcactgcacagcgacagacactcctgaaaaagcagtgggaatgaacgactggactgggcagtggtgctttgggatggggttgctatccttccaggtgccccttgtaatgcagatagggatggcaagaaaagggatacaacatatgtctgcaaattatttgtgatataatatgtacatgttttcagtgattatataatgcacacactctgatgagacatgcacaaattctgtggattttctgaaaaaaaaatggagtgaaatatcaggaaacgtgctttaacttctcttgaacaaacatctccctctaattaagaagacactagtcaaaataatcttgtgaaaacaagtccattatttaattttctctttagcctttctcttggcagaaaaggtatttggtttcactttctattttgggtcagttttactacccaatgatgtaatatggatgtaatttgataacagaagtctgcattacagtgatgggaagtatctcctttcaggagaaaatgttgtgccctgaaatttcaacctttaacatataagtaaatgtcattgataatctaattttagtctttgcttttcaacatggcttggttcattgcagctgctcctggggtcttgattgatatgaatgtatattggaaagagaagcagcaaaagaaatggacaaggaaatgataaccctgaaaattgactagctggacattggtttaattaaaaataatctaaaatcattcaaaaaatgtaattcaatttttattagcagaatgctaaatataactgctgttgtctttaaaacacttcaacatccttcacagggaagcacattgatatgtattgaccatgaaattcaatttaagtaaagaagacagactacatggatatgctatcatcataaaatagtattttcaggtcacagctctagaggaaaacaattttgataaaacatttaatacaaagtgcagcaaaactatgttttaggcctttgtaattcttagagcaaattagcagaatcttctttttaggctcatcctgggaatttttctttcaccagtatccttaattctcttaacccttgactttctgcttttcatgattgacacagttgtcaatattctctgctatgggcttctgagcttatggagggaatgacataattttcctgtagatactgatatatgattttcaactcagctgggtcattgaggttgatcatcattcccctttctcatcctaaatcacatattattctccttagaaatttttcagatttttattgctctatacaatttcccaattccatatctatgcttaacttaactgagaaagtagacattgggagtaaatagtatcatcaccccctctttatattgttaataacgggtacaaggcaaagggtggcttgagagaagttggagccagatcctgcacactataggtcatgttaaggtttggacatgttactcaaagaacaagtggaagttcttgaagggtgcaagtaaaggactgatttttctgcctttgggagtagagtcgtagaaactgtggatttagagtgagacctactccagtcctctttaatctaattgagtaagccaaacacactgctcatgtttatcaacacatctgaaagctagtgatgcaaatgacaacctatattatttcccaaatactggtccatagtccagctgcctcagaatcacttggaggtgacttataaatagagattctcaaacttgatccccgtgatatatggttctgggtcactgaatctgatcactagttttgtttgaggacactgatgggaaagaggtgtggagctgggctcctcagaaccacagaaagtaaggcaagggaagcaaaagtacgggccaggttcaagggactggtccattctccacattgatgccagtccttctaaaatatgaatctgactgtctcatgtataaactttcaatgactctccaccaccaagaggatgaatttctatctccttagaatggcatataaagccatttgtgatttggccctggcttccctctccactccagcagctgtacttattgtaggtcccttagggagccataatttgtggcatttttacatgttacttccttggcatatatattttattttatttttgtcaggcccacaccacttagatgttgctgacttctgcttaccatatcacagcattcataatcgtctgtttacttgccttaaattctgagctccctgatgggagtattcatggttagagtctcagtctctattacgggccctagtacacttcaggaactcaaaagctttgctgatataatgcaaggtgataaaaaagtagaaagacttgggataatcttgatttctgaaggcatcaaacgggaattagagaaagcagcaggaaaaacgaaggcctttttaagttccatgagaactacggtttgcaagactggtcaaaacagtacaatgcaagcggcaagaatcagaaacaagaagctcggtgcacactgggatcaggcaagggagaagactgtagcaagactggatcctgaggtaaaatcctgtctagttatgaaatctcattctctctctctctctctagaggagacaatccgaggatatgagcaatccacagtttcattaggtgagtgtgtagacttgataagagagatatgttgaaattgtgagtaggttgtaacaaaatcctcactcatttcctgctatgcaagaggtcagaagaaactaactaggttatagatgacgttaatccttctgtgaatgttgcacagatgagctaattgcaaacatgcctgcaatcctagatgaactttggaggacctcttgatttatatagtgattcatgaatgggtgcactcttcatctacctctcttttcgagaacctgagccaccactcctaagcactggcat

SEQ ID NO: 2910 - DNA, 7192 bp, Homo sapiens
catgctggaagaggagcaggcttgctgagaaagatgctcacttaggtcagttctggaagggcaatgttggggcggtccaagagagagtctctccaatgcagatgggagcagtcagttgaagtaaaacctccctggagaggttatttttttattttttatttttatttatttattttttgacggagtttctctcttgttgcccaggctggcgtgcaatggcgccatctcagctcaccgcaacctccacttcctgggttcaagtgattctcctgccttcgcctcctgagtagctgggattacaggtgtgcaccaccatgcccggctaatttttgtatttttagtagagacgggtttttgtcatgttggccaggctggtctcgaactcctgacctcaggtgattcacctgcctcagcctcccagagtgctgggattacaggcgtgggcctctgcgcccagcccctggagaggttttaaagctggtggctcatggatggtgactggggccatgatgggagtgcatggaattatcagggagctccttagagtgagaaagaagaggaccgaaaatagagacgtaggaaggctgaagatctaagacctgaaggaggggccagaaaggaggccagaagacaccccggagcctgtgaaaacctggaggctgcccaccagatagcatgatgatcaagactacaggttctggtgtccaacccacctggctttgaatcctgacttccccactaaaactgacatgactttcgatgagtgtaaggccattatcatggactttttccccagctgcagggttatctacaactccgggtggaagtcaaagattggaagaggatgacctctgatcctggaactgcattgcttggtggtcaggaggggttcttagtaagcaaactcagtttaatcccagagtcggaagtgggtgtcaacaagccaaagcaacatcctttcagctctgctgcttttttgtcttggtggaggaatagccaatggaagaagatggagagtccggaccaaaaaaaaaaaaaaaagatgaggtaaagtagctacacttgtgtacataaggaaccatgtaaaagtatgctatgtatgtatgtatttatttattgttttgagacagggtcctgctctgtcacccgggctggagtgcagcggcaggatctcggctcactgcaaccttcacctcccgggttcagatgatcctctcacttcagcttcctgagtagctgggactgcaggaaggccccaccatgcctggctaatttttgtatttttagtggagacaggttgccatgttgcccaggatggtttcgaacttctgagttcaagtgatccttccgccttggctggccaaagtgctgggattaaaagtgggagccaccgggcccggccatttttttctatccacgtctttttcactgctgtgtctgagaaattttacacgctctcatatatgtagctgaaatgatgcaggagttccccggcaccagccgcttggtactctcatttattaatatcaataaatcaatgaagccaggttgcaaggcattcttaggtattcattcaccatgctaggaccgcattgcctggagctcttcagcagtttttcactgcaaggccttcacacaagctagtccctctttctggaacattcctctccacgttttgcacggcctattccctcgcctggttcagatctcttcccaattgtcctttctcctccagctttccttgatcccttcatcattctttcctctatttgtatttatttatttttgttcattgttttcttccctcctctagaatgcccatttcaagaacgaagggaatttattttgttttccctgctgtgcctcaatgcctaggacagtgtgaagaacatagaaggtgcacaactaataatttattcactgaattaacagggccagggtgtttttgttacttgttacagatgtgtgtgtaacattttcaaagccttggaagttattaaatcactttcccgcattttatatgcaagactcctattattcttaataagagtcagctgtacatctagactgcattaaaaaataagcaaaactacattttccttggccttgtaaacaatcccacatggtatatgggccaaaaaaggaaaattaacaaaaaagggagaatgtaccaaaccatattcagttagtaaaaggggatgtttttccatattcttaaatgaagatcttttacccaatatatccagtctctcataaaccatgaaatgaagtgactgggtatcagaactaattttcagaagaaaaactgtcatctttaaagcagtaaaatcttcataaaactgtgtaaactaattactgggttaagtaaaatcactgaaatatatcaggaccttcaaatgtctccagggcagacataatatagtaattctctaatagtcactctggggagatactgtaatgggcgggatgaagtcattgtaatattctcatttagtttgggtcctgagacttataaagagaataccggtggcagactgcacatacggaagagatgcctatttatttcacatgatactagctggcctttccaggctgtggatcatgagctcaggggagcccaatggagatgggcatactcatttgttctgcagagaagatatgccgaatgtttcttctcatccctcctcatcaaagagagtggaaaatattttgtgtacagtattttttgctttaggttatttagaagccttatgtatattaggtttttacatgtgagcaaataactaaaaacaagagcaggacctaccagaagcttcaacagaacagacagaccatggaagacctcatgttcttttgaattagtgaaaagctatatagtttaagtaggtatcttggtaatctaggataaatcacaaggattgggtaaactcaatggaatattgaaggtttattttattaggtaattttatatacatttaggccacgtgcagtggctcatgcctgtaatcccagcactttgggaggccaaggcgagtggatcacttgaggtcaggagtttaagaccagcctggtccaacatggtgaaacgccatctctattaaaactacaaaatttagctgggcatgatggcacttgcctgtagtccagctatgctggaagctgaggcaggagaactgcttgaacccaggaggcagaggttgcagtgagccaagatcacactactgccctccagcctgggctactgagtgagacaccgtctaaaaaaaaaaatatatatatatatatatatatgtatatatatctgtaatgtgacattgttttctcaaacctcagactaatcttatgctcaatatggaagataatcataactcatcactctggattataactgcttacatatgtctttcttatgagataatgcaccttgaaggtaaggacttcactttatttgcttcattctccagtgtccaatttgtggaatgaatgaatgacccttaacagaaacctgactgtgattcccttcactattaacttttcctagagttatgaattccagttagaaatttgttcagaaaatcacttgtccttaggaatataatttcacaagacacacaagttgatttccttatagtctatcatggtgatttctaccctggctcaaggctgtgattcatgaagaagagtggtaggaaccagacttcttaaaagtggtgagcatcaggccacaatctcagaggatagtgtatgaggagtaaaattgggaagacacattcacatttacccaaatggcttgcacattaaaagctgtacaccctccccaactccaattaactcagagggaaatctttgggcgggtttggttctctccaatgtgtgtgagcctgcagttgcctggctggctcctgtgtccctttggaattgataatgaggttcaagagagaggaatagtcctcactaagcatgtcacccctatttagcaccttttccaggatggcagccactattgttttattatgtctctgatcagctgtcactattcataaagtaatcactgccattaacacatcacgcctcaagccatctgctgcagcatggcacacacagagctgttggttgcaagcaaagcaggtgtcacctaaaaatgacagtaccacagtaaaggtgggaggtcatcatggtgaaagaggatatgtcacgtcaagtaactctattttttgatgtattatagtgcaatgagcaatagtatttcttgctcaatttgcagaggctaaaattaaaacttcttatttgagatactttttttcaatattggtaagtcatggagacaaaaaatgtcattgaagttcttaaaacaatagcatctagattgtgaatgaactcttgcattaaatttgcagtcaagtttaaagcattcttgaagagatctgatccatcaaacctttatttgacaagtgtttattgagcacatattaagtgacactgacatgtggctggcccacccgaaatatacagttgctacgtaaaacaaaaatcacaagtaatgtgtacagtggagattcctgatcccagctgcatttttgacccttggtcagtccctaacacttatcttgattttggataattttttggatagttttcagttttaacaggatccatattgattggattttctgtggatgtgttggaaaataagcttgcattggaaaaatacaatgatttcataaagtctgttaagaaggacaatatctttataggacaattagttctcttgaccaccttcattgtaaaggggctttatatttatacaactgagagaggagataggaatttaattgaagatcttaaatgctgatagaaagtgggacaagggatcataattgggttcaactatctttctagccccttcccctcctgcatatacactggaattgcatccttagcttaacttcagaaaattcatgtatttatccttggcaaatatacacacttatacatctatatgtatatgtaaaaaattaactagggtagttaataattctaccctccattttattgcatgagtttctgctcttttcctgggagtgagaagtattggatgagggtttggatcttctagcccatcagttactcttagcaacatcacccatcctttcctactggtgatgagagcatcttgctgcatgggtggtggttctcaggtgtatacaacaagtactcttctccatgatgcacatgtccacacatcctgtatgctactgctggtttaagggattttcaagggtcaattcaatagtacatttagaaattaacttctgtgaaacatgctactcaattacaaaccaattgaggaatgctacataaccccaaagtctatagaaagcaaagatatccatcttctattgatatagaagatatctataagatatctatatagggatctctcaactacttttgaatccaactttcttttgagaatcaaaaatctcaggctctctccctatccctgaagatttatagaatcatctgttgtaaccaaaaaaataaaatcgagcttgaatttttgtgcattcagaaaaatgtcttttattatttttttcaaattctataatgatctatatgcttttcaaaatgggtcccctttctccctggggattatgatatgcccaagcataagaggcattttaactttaaggatgatatttgtgaatctgggatgcatgcttttcaagataccagtgaagcagcagaggatgagcaagcagaagtgtctcctgatgactgatggccctttcttttttttttcttttttttttttgagatggagtcccagctcggtcacccaggctggagtgcagttgtgcaagctcagctaactgcaacctctgcctcccaggctcaagtgattctcctgcctcagcctcctgagtagctgggattacaggtgcccaccatcacgcccagcttatttttgtatttttagtagagacgaggtttcaccatgttggccagactggtctcgaactcctgacctcaagtgatctgcctgcctcggcctccccaagtgctgggattacaggcatgagccaccgcacctggcctgacagatggccctttctaaggagactgaggtggtacatttgtgattaccagatacgatagagttgatattgaccgttgcactagtgacttaatagtttttataaaaagccccaaaattgtttgatatttcatttgcatcaaaatgttgtagctcaaatggctttatcagattggctccttaaaatatcatgtgcccttgttctaggcgcagaaggaacacaaagacaaagacaaatggttcttgggtcctgccctcaaggcacttacagtccagtttcagttttagaagttcaaccaagaacatggctaatggctggtagagattgtactgactattataccacttctcctaaaatattattttggttgaaataataaaatgtagattctaaacaaaataaaataatattttactgcatttttctgtgaaagaaatgggggaatcttgggatttcaagataatccaacaagctgagtagggctggccataggtttggaactcatggagatcacagtggaaacccaggaaacattctcctgagggctgcgtctccattaatgttttctgcctaaggaatgtgctggctctggctctatgggtaaacaggagggtgaagaggaggctgactgagttaaagacatcagcaggttgggaactattaacactgaggatcatctttctgtttttattttccagacagggtctcactctgactcctaggctggagtgcatcatggggctctgcagcctcaacctcccaggaccaagcggttctcccaccacagcccctcgagtagctggaaccacaaatattcatcaccccacctggctaactttttcgtttttattttttatagagacaagttctccctaagttgcctaggtgagtcttgaactcttaggctgtagtcatcctctggccttgggctcccaaagtgctgagattacaggtgtgagccactgcacctggcagttgaagattatatgcggatcacctaggtcaggagttggagaccagcctgaccaacatggtgaaaccccaggggctttactaaaaatacaaaaaaaaaaaatagctgggcgtggtggtgg

SEQ ID NO: 2911 - DNA, 1816 bp, Homo sapiens
agaggatttggagaaaagtggtatatcaaggaaaaatgacatagacttaaaaggaattgtattcgtcatccagagtcaaagtaattcttttcatgcaaagagagcagagcagttaaaaaaaagcatcttaaagcaggctgcagatcttacacaggagctccccagtgtcctcctccttcatcagctggctaaacaagaaggtgcatggaccatacttccgttgttaccgcatttttctgtaacatatagcagaaattcatcttggattttcttctgtgaagaagagacaagaatacagattccaaaactcttggaaaccctcagaagatatgacccctctaaggaatggtttttgggaaaagcattacatgatgaagaagctacaataattcaccattatgccttttccgagaatcctacagtttttaagtatccagactttgctgcaggctgggccttaagtattccacttgtaaacaagcttaccaagagactaaagagtgaatccttgaaatccgactttacaatagatttaaaacatgagattgccctctacatctgggacaaaggcggaggacctcccctgaccccagtgcctgagttttgtaccaatgacgtggacttctactgtgctaccacattccattcttttctaccgctttgtagaaagccagtgaagaagaaggatatttttgttgcagtaaaaacatgcaagaaatttcatggtgacagaatacctattgttaagcagacttgggagagccaggcaagtctcattgaatactatagtgactatactgaaaattccattcctactgtggatttgggaattcctaatacagatagaggtcattgtggaaagacatttgccattttggaaagatttctgaatcgtagccaggacaaaacagcatggttagtcattgtggatgatgatacattaataagtatctccaggctccagcacttgcttagctgttatgactccggcgagcctgtgtttctgggagagcgctacggctacggcctgggcactggtggctacagctacatcacgggaggaggaggaatggtcttcagcagagaagccgtcaggagacttctcgccagtaaatgtcgatgctacagcaatgatgctcccgatgatatggtcctgggaatgtgctttagtggcttgggaatccctgtgacacacagccctctcttccatcaggctcggccggtggattaccctaaggactacctttctcatcaagttcccatatcgttccacaaacactggaacatcgatccagtgaaggtgtatttcacatggttggcacccagtgacgaagacaaagccaggcaggagacacagaaaggttttcgagaggagttataaatcagggtgacctgtgcgcctagcctgcgcagggaatgaactggagactgtggcctcatcccactgtgctgtgctcacaacacttgtgtctgccacatggcattgggtgcttcctgactttagggggagattttatgtatggtattttttgacagaggaagaaaaggggtcacaggagaaacatttttttttctgggaaaaatcacttgcttttgacttatgcagttgttttaacacttagtgatgactgtgtattctccaagctgtgatacagcagtttttttttattgtcacagggaaataaatggtaccagaagtccctttcctgttctgtctcttcattgtaatggaagtttcagttgggcatgagcctggagagatgtgactgtctacagttctatttgtatatataaaaagaagactgaaagtcttttg

SEQ ID NO: 2912 - DNA, 2279 bp, Homo sapiens
ctgtactcctgctctgggaagacagcgcctcccgccaggggattccgccaaccaccgctccctgcaatcggggttaccagtgatgattcttcccccagcatcaccctacggtgtcttggcagcctgcctccttcacagactgcctcgagagtccctcagagctatttccttaaagaccaaatgcgagcatatcttcactgacggggtttcagagcctcactttgcaagttttgaggcagaggctcaaactaattttgctgagaaggacaggagagctgagagaaaatcaaacagaacggcggctctcctcccattcatggcatgtaatgctctgggcccagctacatctgccatggcctccagggacctgctggaggggtctcccagccccacctggtataagccaagcctgctccagactcaggatctgcccagagggctgggatctcacagcctgaggtggttgataaggaaaagggaagatgaagcctccatgttgaacatgcctggccccaggtagccttttccgattggcacggctgccgccattcacccgttcaagcttccagcttgcctgtcaatgtctgcagctcgattttacaggctgctctttgttagaaaagaaatgatgtgggggctgctttttgttaaaagggatgccttaccgaggactctcttaccctcaccaactgcctaagtaatttctttttagctcccgtattactgcatcaaactatagccagatccacggtgactacagcgcagccacggcaggggtggcctctggctgagcgggacttgtttgcagcagcagcatctggtggcaatcgcagaaataagaaggcagtcgaggccgggcacagtggctcattgctcattgcttgaacccagcaggcagaggttgaagtgagccaagatcgcgccaccgcactccagcctgggcaacagagtgagactccgtctcaaaaaaaaaaaaaaaaaaaaaagaatttcggcatttgagaaaaggcttaagaatctggcattgaacaggctatccagcccaaaagggacctcacctgctttgttgattgttgaatggcccaactacatctggttgcagtggcaaacggctgacctccacgagcagctgaaagtgcctcctgcaagtgaccgactcatccaggccttggaccgagaaaacagctcctcaactgcatcagctggaccatggtacagaccagagacagggcaagaaaagaagcagaggctattggcccgtgcagagaagaaagctgccggcaaagggggcatctccatgaagaccccaactgtcccacgagcagggttaaccccgacagcaccttggtggagaacaagaagcctcagctggtggtgactgcacgtgactctcgtcgagcttgctgtctctctgtctgcgctgtgtcctacagtggggttcccttactgcgttatccaggggaaggcaggacggagatgcctggtctgcaggaagaccccagaaaagactgtcaccttcacacaggctcactgggaagacaaagcagctctggctaaggtggcggaagctatcaggaccgattacaatggcaggtgtgacgagatccacagtcactggggaggcaatggaacctcctttgcaaaaattataactgaggaaattatgacagtgaaagaaatcagacctaaccgactccatcttgcgtctaacctttaagctgtccttgtccattcctcggcgtgggctgaacaaacttcggggaggaattcagctcgtggtttgactctgaaacaaaattgataatagcccttaaccgaaaagactcttcttgcctggggaccagtctgcctttgcaagactaacagattagctacgagatcagaaattgtagtttaggggtcatgcagactctgactctaagagtcggaacttccccacattgctcctgggaataacatcactattgtaaaacctaagatcagtacttgagatacttttcagaccctgcactcgatagatcagctgacaccacccagactcataatctgacctaaccagttctgccactgcacccaggaacagaagacagcaagaaaatctcactttgatctcctatgattccgtctccaacctgaccagtcagcgctcctcacttcccaagcccctatccgccaaattatctttaaaaactctgatctctgaatgctgggagactgatttgagaaatagtaaaactctgggccgtgtcacgtgcgtccgagtgaagagcccaccgaac

SEQ ID NO: 2913 - DNA, 7770 bp, Homo sapiens
ggcaggagttggtcctgtgagggaaacaggttgtacctaagcttctgccattttctgtctcatgtctgtccctccatatgccccctccctcagtcctgcccccaccctacctcacatccctcagcaagctctccactcagaccctagctccagttctggggaggggaggctggtgcagagtataggggatagcgcaagtgctcttcaggagccacagacagagatctgcttaccctgagcacatggcagctggggcgttcttcttgctcgcctatttgtgaaggtctacccagaggaaatgggctatggcaccacaaaatggtccaactggaagtcaaacatgagacactagaaagtatcctacaggctgcagtgcttgggacttgagacccctgccaggaatccccaaggagaaaagaggagttcatggacttgtggccttgagcctcttgtgctgtcacttatacccatttccatagaattacagagtgtcggtgctggacactagacagtgtaacatcgtcttgtccaactaccactcatcatgtagaagggatgtgaaaaggaaggatgcttcccagggaatgtgggaacagaaggaagccacgtctccctgtgccatcctagactaccgctgtgtgtgtgtgtgtgtgtgtgtgtgtgtgtgctcacacacacacgtgagcagctcctgccttgacctgagcctagagtgttcctccttggaaggggaccctatttcacaatccatctggtcctggagaccagtggggctaagttttgtttagggatggggggagaaagcaagtgaaggagagacagagaaagagatgaaaagacagggacaaagacctcttgacagagagaaattataaaatagggcaagaaagagagagaagagcagacacagggttggagaaaatgaagaaggaggagccagaaagagaggaatgaagggtgaccagcagaccaggcagagctcacagcccaccctggcatggtttctctttgcagagggttgctctccccatcaccaccctcctagtcattctctggagcccctggtcataagtgggtattagcttagcccagtgcttgtgttcaactgtcatccaagctgagcctcccttactgcacccacaactacctggttaagtaaagccttaaggaggggtggcagggaggaggtccatgtgagccagtgccctgggtaactcccaccgtcttccttgctttcttcctatgcctgagaccagagcctaagcaagccagtgtgtgctttggccccagaatccctgttgggggcagcaaaggagatacaaagtgatggaggaagcacggtggtagccctgtggcttcagtgaccctgtgtgagacagaaatcagggttggactggaagaatggggaacaggtatttcctgcggtcctgctgaacagtggctcaaccagtccacccaaaatgtcagaagcagagaaactgtaaacatgaacagcggtgccatagcaagagctggcctgtggaggctggcactgtgagcccaggcacagcaccccaatgtacaaagagcccccacttatgagccatgtgagggcaggcaaggtactttaacttccctggcctcagtttcctcattgtgaaatggagctaataataataacctaacagggttgtagttatttaataaaatatcccagcactgtttctgttccctagtcaatgtacaattcacagtcttttcccccattccctatgagaaggcacgggagcttctagactctgggcagagccccagacacagcagtcaggatgctcagatggagaagaaaagcccttaaagctctctgtagcagctagcgctacctgtgtttggaaggcagccagagccccacagacatgcatgggaacacccaggattgtaatggaagaggtacaatgccaatcatttaaatttaggtgttcttggtgtcctaatttgatggaagggtaaactgaggcagacagtggggaaacgatagataatgcagagtgaacaagtcttactttggaaaaaacagtttccctggtgggagaggaagggagattgtgctgtgactatcacccaactcaaatgtggaacccaagatgggcaagaagctcaggtggggctaatgctgtacaaaacacctggttagctccgataagcagctgtcccaagccaggactctgccccggctgcactcatccagcccggaggggccatcagtcactcctttcttcttgctcactctgtcttcatccccagctgtcaattcatgtgtctcaaaatgacacgagttaaacatcttaaagaactagggatttatcatatggcgatgtcaactcagaaagcagaaccagggatttgtatctcagtagtggatgattacagttttcttggtgctatgaaagccctatatcctcatgtgtcatgatctgattaataggcagtgttggggttgaattacatccccccaaaagagatgttgaggttctaacctgtgaatgtgatctttttggaaacagggtctttgaagatataattaaggtaagatgtggtcattagagtgggcttccaccccatatagctattatctttataagaagagaagacagagagagagaaggaagatggtcatgtgaagatggaggtagaagttagaattatgcagccacgagccaaggaattcctggggctaccaggagctggaggagacaaggaaatattctcccctgaaggtggcagaggaagcatggtcctgccaacaccttaattggcaaccccaggaaatgaatacagtaggaaaaaaaatatttaagtgggaggaaggaggctgggaggaaggagggaattctgtttaagggaaccctggaatctcttttcttctacccccatgtctttttctattttctatcctctacctcctttcaactcttcagccaatggatctttaattcttaatcaataagcatcggtgtcctgcctccatgtgcctggctttgtgaaggaggcagaagcggcacagcgacgtgagttgaactccttgcctgttgacctctagcctcccgaaggcagttcttgggagtgggaaagggtgccagctccagggtcagagcacctgggcccaaatctcgctgtctgggtgacctcaggcatgtgattacatagcatgagcttgcttcctcctctgcaaaatggggaaaataacacacctattttgtgaggttctcttgagaattaaatgagataatacatgttaaatgattagtacaagcaatcaatcagcattaattattgttatgactgttattattagcgtagggaaaagaacatgaacagcattcagctgactacaggataaagtgtgataaatgctggcacaaaggtgcagatgaagcatttagagaagaaagagagatgaattatttctacccagaaatcagggaaggctttgtagaatcacagcatttgaatagagcctgaaaggacgggtagatgttacccagtggagaaagggggatagtatgtgtgtaggtggagagggggcttgggggagggataagggagtttctcctggaggaaactgcattcactgaggcaaggagggctgagaggttcagcagagagagtagatctatgtgtgtgaagcatcctgtgtgcggtgcatggtgagaagtgagacctaggacaggctgggtctagatggttgttgctttggtgtcaggaggagtctggtttttattatgaagacagtgacccctaagggagttagagcaatacgatggaggaagctagggtgggggcggggaggccagcaagttctcagtggtccactccagtgacaaaggaagtctgaaccaggctggagtggtgaaaaggaaggggcagattaaaaagtcatggaagtaatactgaggggatttgataactggttgggagtgagaggagagggagagaaacatctaagatggtttcttggtttcttgccagaactatctggaaggaaagtaatgggagattctagactccacaaaggctgaggcctcatcctttccccttaccccatcccagcaccccacagggcctgcatggggtgggtgctcaatacataaatatttgttgaatgaatttgatgccagcagtggggagggggaccaagggaaggataacaggcttggaggggtgttcacagtatggtcaacgttaagatacccacaggaccatcatgtcaggctggcctgtgggctgccagacatgcagccttggagagaggtgctggagggagatataaactttggagccaatagcaaccaagtgaaaacaaaagccacacgtgggtttaaagtccagagatggctcagatctctcagcgggctccatgagatttgtcataataattagagacaatctcagatgctgggtgtaaagggagcacggtgacagatgaatgtaaactaattatcctcacagcaaccttgagaaacaggaatgtgcatgcatgtttccttgctaagatacggagaggaaaaaggaccaggagagttgcatgatgtcccagaaggctgccagagccctggcacagctgcaggaacacccaggaactccttcctccactatccacccttggaaatgtcagcatgggtactttcctcatcaaggaatgattttaagaatttgttttcaaaataaaaaggggttttagagttgggaagccctgctggttgtaatcagatgtgttttatgggaccattcaccagcacttgaagaacagggatgacctataaatgtattcatggattcagacccagggcaggtttcatgggctgattacaaatgccttggggatggcatcagcattcaggagacacagtcacccctgaacaccagccacagtgccatacacaccttcaccacctgcactcccacctcctcctcatccctgctgctgtgatgccaactcctcagtctcagcagctcctggaagctctaggacacctttcaagaaaaccacaagtccttatccagatcagggcagcccaggacattatctttgtcccctcaacccacataagcccagcctattcagcctaatccgcatgacttcctcaatcagcctggcatcccactctaccaggtccccctcccacctcctccaccataataagttttatgcagagggtatagcacttgaagctaggctgacctggcctccagtcctgaccacttagaccctgatcttgcatgagtcagtctcagagactcaactttcccatccatgaaagatctctctccttgtctgtaccctcctgggcctagcaccatgcttggtgcacatttggtggtggtccacagatgccacgtggatgcataaatgcacggcttcctgagaggatgacacagatgcacgtggatttttatcacttgctgaatggaagtgagacttaacagggacctcttaggagcctatgggctcccccaagcataaaaacaaaaaaacaaaaaaacttcttcctttccttcaagggaaatttcaggcacctagctttccctgagaagtaaatgtgataaggaagaaggtaatactagcttaagaccatagccaaggaagttagaatcatgggatgcttggttccctggtagaaactagagataacatcttaacacaggtcactgagttgtttttcagaaacctggatccccaccaaatggatctgctggcacctagacttcagccatctaggagttggggttttaagtgtgaccgcccaattcgccttacttgctgccctgcaaataaatgccttcctttcatctgctgcaaaccttggtgtggacgttttggccttactctgccaggtaagcagacaccagttaggtttgagaacagatgcgcttagtaaaataaattgcttccagatgctggtgataccatctcggcctcctcttggtatcctggttggctctctatttgaaagcctcgcccaggcatggtggctcaggcctgtgatcccagcactttgggaggccaaggcaggcagatcacctgaggtcaggagttcgagaccaggctggccaacatggcaaaaccccatctctactaaaaatacaaaaattagctgggtgtggtggtgggcacctgtaatcccagctactcaggaggctgaggctgggagaatcacttgaacccaggaggtggaggttgcagtaagctgagatcataccattgcactccagcctgggcaacagagtgagactccatctcaaaaacaaacaaacaaaaaaacccaaaaacaaaacaacaaaaagcctctgtccatcttctgttgcacaaatccctcctcactctctgagtcctggtggagctccatgttcctcatgcagccctcctggctgcccccagctggcacaactccatcgtctggctgctatccgccttttggtcagtacacttagtttgcactagactggcatcacccaactgagttctaaggccgacaaggtgctgtttcatattttctctgtttttgttcattacatagaccccaaatacaggcaggctgagcagtcagttgcaaaatcagtcaccagaaaggattctgagattaatcaccctgtaacataatcttaaaatactgattttggacttgggacaccgcctaggcactggtatgttcatgggttcgtacatacatgtacacatgtgtgcacacccactttggggatgggatagtatttgcttttctttgaagtttcactgagctgcctcccagtacagaggggcccaggtctgggcctggagatggtacacatggtgtaagaaaggtttctctatcccctggggctggttgactgtgatgtggctgctgctttccctactgatatgaggtgcatgaggaggagtggaaagggacaaagctgtgcagcttgagcccaggaagggacactgctgtcaggcctctgagcccaagctaagccatcgtatcccctgtgacctgcacgtatacgtccagacggcccaaagcaagtaaagagtcacaaaagaagtgaaaatggccggttcctgccttaactgatgacattccaccattgtgatttgttcctgccccacattaactgagtaattaaccttgtgaaattccttctcctggctcagaagctcccccactgagcaccttgtgacccccacccctgcccgcaagggaacaaccccctttgactgtaattttccgctgcccacccaaatcccataaaacggccccatccatctctccctttgctgattctctttttgcactcagcctgcctgcacccaggtgattaaaaagctttattgctcacacaaagtctgtttggtggtctcttcacatggacacgcatgaaatttgatgccatgactcgggtgaacgggaaatagttttttctctggcccaatctcacgctgacaaccactggctccacgagccagaccttcaggaaggcattagagcagttccccgagaggatccccagtggaactatcaggcagattccccaggtacagctaggtgagattacatgatttcctgcctagttgaagggcttaaaaggcagcttacaaagctgttaattatgacaagcttaaagaaactactcaaggtaaagaagaaaacccagcccagttcatggcttatttggcaacaaccctgagacgctttacagacacagaccctgaagggtcaaaaggctgtctcattctaaacatgcgttttatca

SEQ ID NO: 2914 - DNA, 77068 bp, Homo sapiens
gtgccagcgcccatgcaaatctgctgtgcatccagagagcaaagtgggatgatctgtcactacacctgcagcaccacgctcggaggacagctcctgcctgcagcttccagacccaggaagcctgaggggaaggaaggaagtacgggcgaaatcatcagattggcttcccagatttgggaatctgaagcgggcccacatcttccggccaacttccattgaacttcccagcactcgaaagggaccgaaatggagagcaaagcaccacaggcctctttgtggttgcccctttctaatgctcctcaagacaacctgctaatataagcaaagagtaaatgagtgaggagagcaccttctcatgtcaggaagcctatggagttagatcacctggatttgctcatttcctggacaaaaactgcccttttaatcctcaatttcctattaaggactggttcaacattatcatttcccagggagagtcttcaacttgaagtgatcactcaatcactaaaagcctccaacttgaagtgattgcaaaaccactacagctgcacctttcttatgcatttcttttattgccttttggattggactttatgccttatttttttctccatttccaagtgtgtcttgcctagaatgtagcacacagtaggagctcataaaatatccactgaaattgagttgaacaggagagataaggcaaggaaactcagtggatcaaggccagctcttgccaagagttccaaacttcatctttgtacctgagctgcatatttctatggccttgatgaattccttggcagcagaatgttcaacaactgaaacatttatgaaaatttaagcaaatgggtcaataaagggaacaaaacgaagcccacacagtctactcttgtgctcttttgcttttaaagaagcttgtttgtgttatcacttcaacggtttgataaacaactgtgccttctcacggatctgtcccctgtgtttgaagtggtaaaatgtgatgattagtcatgggtaaaagctgtatgcatctttccaagctgcacggcaatacgtgtgcaggaatttgagtttattacacaatgtcatcatctgtcatggagcctctggaaaacacattatcataagaaaatgataatgaaaaagataaaccatggtcctgattttgctggattttcaggattaatgcactaaaaatcttactgaacgccagatgaggtttctggataatttgtttttcttctttgcgcttttctgtgttttctagttcttctctactggattcatttggttgacacaaaatgaaatattaaggtatattacaacgaggaccacattgcttaacttcataattccaaccacttcctcttccacgtatcttgagaaaggtaggagcatttttactcttcacatccatacactcacaatcagctttatcacttactagtggtaggattggagaagcttatgtgtactatgtccttcaggggcttcttatctaacatggggatactattacctgcctgtctgtctaatgggattatataatgcatgtgaaaatgctagactaattgcaaacacagaacaaacggatgttgtcaccattattgtcagatctctatgtatgtgcaaaagtgaaatccttggagacaagctgggagattttttttttttctttagcatctcttctgccaaaaatatatattgattgcagctggaaggaaaccgttctgagagagaaaataatgttgaatagaaatcagagcctgtttgatatttgacagcttggacatgtttcttcatgtttaatgataataataatttgacttttaagtgacttctctgacatgagagccccctaaatcaggaaagctataaactgatgcaaagctacccccagagagatgacatggaagggtaaatgggattgaccagtgtgtttggctgagggtactcatctgcctaagattttatgggcttcacaggaggcctgttctgtggcatgtgaatgacctgagaacaagtcacccaccagccttggaccccatttattgagattctactatgtgctaccctctggagtaggtgctttgacaaagttattacatttgaccttcagaacaattctgcgaagagagtactattgtaccattaatgtctgtaggaaaattgatactcaaatattccctagactacaattatcatcagatcttctaattctaaatctggtactcttttcattttatagacaactgcctgacaaccacataaaactgtattagtaactacgcatttacaaagcacttctacacaaattaccttacttgattgttactttttctgtctgcaagttttccaagtcatgctagtgtgttatttctgtctcagttctggtggcctacctaaaaagaacattgcatgatcatgaaccagaattctggtattgtctccttcaccagttagctttgttacttaaagccctaaaagagaagggaattgcctctactgtagctatttggtagaagaatccagaggagaacccaggcttcttgagaaccaggtctcccaacgatctttggagataaacagtactaaacatacaagtatttgtgcatttgttgcgatcattatttaattatttaaaaagtataattatgatctattccttctggtaatcaataagactctgactcaaaatgaaataagggaaaatgttggtagaaaaagacttagcataaaggctgggtccttattgatagtgaaaatgatacttagaggagaagaagctgtttaaagcttgcattagttgtagaaaccccagcttgaggcactgaatctgtaaaaactggagacagagtttgggctgtatttaaaagagtctatcaagggctcctctttgtagaggatccaagtcagacctcctagcctatggaaatcagcttgtcagagcaaatgaatgtattggagactgaccctgacctaggtagctttcaagtcatccctgagaaagagcattttagaggttgaattgatgagatggctaatatggttattgaagttattggaggctatttatttggattttgcaatgattcagatttatgaaaatgaatctgtaatgaaaatgaatggtggaaataagctaatacaggaagtgttcagctaccaaagcaaacctgccttttcaataagacaaggatattacctctggaggatgaataacatatcatttgagatattttattaaaagttaactgtgactctcttttgaaggcagtcgctattactccagggagaatgaccttgaggctacttccttctttctcttacctttccttttcttttctttcaccatttcttttggacatacgctggtgaatgaagactgtggaatatggagtgaggaataaggaagcccactcaggctgagtcagatgcagtaggagatcagtgaaagggatttttcattagggagtgggatgtgttgatgtgataaagcttcttgaagtagaattttatggcaagcgtgatattgtaacttgcccatatttatgcagcttttaagtagtaaagctacgatttgaactgggtctgtttgtcttgaatgcagaggccccagggaatttaccaggtctggctctcattggttttggatagcagaaggttgaaccttaacatgtcagtcattttatttgctagattgattacattttgtctggaacatggtaatctcagactctagtcagtcttcagcttaggaaatattttcttgattattatttctattccactacttaagatttgttcttaaggataaaaattacttgtaaagataaatctccagtatttactatttttattatcttccctttcatatctttcaccttttctgattcttgggagaatttcctctttacatcaatgatttaatttttactgagaccgagtctcactctgtcacccaggctggagtgcagtggtgagatctcagctcactgcaacctctgccacccagttcaagcaattctcctgcctcagtctcccaagtagctgggattatttttaatcccatgccaccatgcccagctaagttttgtatttttagtagagatggggtttcaccctgttggtcaggctggtctcaaactcctgacctcaagtgatccgcccgccttggcctcccaaagtgctggaattgcaggcgtgagccacagcgcccagcctatttaatttttttatagtgccagttttgttcttttccaattccagggtaggattaatttggctattttgttaccttgcttttctcagccaggtcccttaataattttagactatattgccataaattgtctttttatctcatcacttatcatcatccctaaccttaacaagcgtaccatttcatgtatttacttgagaacccagaacagacgttcccagtttttttcttaatattaaattattattttttttttaaagaactagggttttcttctgcactttcagaacaacttttccttatttcaattttatagcatgtgtccagcctgtgctttttttttgccccacccccacccccaaatgtttacttttccttgagcatgaatccaaccctggaatttccaaaagtgaggcttctctgttttcccttattccccaataatttccatgagagtgtaatagatttgtacaaagctcttcactaatttttaggaggtctattagtatggttctgcctaaataaggaagtatctcctgcttccaatgtagaagatacttctttggctctgaagaagataatttttcatcccttgtaagttgaaaattttctagttcttacttttccaaaaacagagtatacaatggtcagagctcttcctatcttcactagtgcccactcaacaactttacattacgtcctacttggaatttctttctttttttttttttttatactttaagttctagggtacatgtgcacaacgtgcaggtttgttacatatgtatacatgtgccgtgttggtgtgctgcacccattaactcatcatttaacatgaggtatatctcctaatgctatccctcccccctccccccaccccacaacaggccctggtgtgtgatgttccccttcttgtgtccgtgtgttctcattgttcaattcccacctatgagtgagaacatgaggtgtttggttttttgtccttgcgatagtttgctgagaatgatggtttccagcttcatccatgtccctacaaaggacatgaactcatccttttttatggctgcatagtattccatggtgtatatgtgccacattttcttaatccagtctatcattgttggacatttgggttggttccaagtctttgctattgtgaatagtgccacaataaacatacgtgtgtgtgtgtctttatagcagcatgatttataatcctttgggtatatacccagtaatggatatatacccaaaggattataaatcatgaaggatatgaacagatatttctcaagaggagacatttatgcagccaaaagacacatgaaaaaatgctcgtcatcactggccatcagagaaatgcaaatcaaaaccacaatgagataccatctcacaccagttagaatggcatcattaaaaagtcaggaaacaacaggtactggagaggatgtggagaaataggaacacttttacactgttggtgggactgtaaactagttcaaccattgtggaagtcagtgtggcgattcctcaacgatctagaactagaaataccatttgaccctacttggaatttctgtaccactgggaattacagtcttcaactttttctataagggtaatccactaatgctgctttagggaaaaagcaaatgtcatgggagagagaaaatcatcctagatggcttagttaaccatttccttattgtattttcttattgtaatatatgtgggaagggggatgtaagatttctgatttctgcaggttggagagggagctacacagtgggagcgactgatggtttctgctacttttctagccctgtatatacacatcagctggggatgaggccacatgctcatcttatacagatgagtactgatttctcctgggtgctgaaaaactgttgttagatattatcagtttagttttcattgctatagttctgtcaggtcatattttttgtttttgtgtattttaatgggatgtagggagaagaaatgccataagatgtatcaacactttatttttatgatgtcacactaatgtattgctacaaacttaccctcagtagttataattttctgggatcattttagaatagatgatgtccattgttgagctcatgttttcctatccgtggaaatctagcatcagcagctgaaaccatcagttttgggatgactttcaagcctgatttgtcctgtcccatgatccactcaaggcacatagggaagcagcttggcgtcctggccggaccactaaccctggaaggcaggggccatgtatgacttacctttgaatcctgtgtactttgcaaagggcctggcacctgggtttctagaatatatcaaattatggttttttgtttgtttgtttgttttttagaacaaatggaaagcctataaaatttccagagaaaaactcagtcaccttttcaggcactctgtcttcagcttctaatgggataactattttgatatgtagcaaatgaggttttttaaaaatcttaagtgcagtggtaatttcatactaattattgcactggacaaataaattattttcattgaaaacctaagttatgcaaaactatgatttaaaagaaaagcagaatttttatttattctcaagctaacctattatttcaaaataagccaagtgccctgctttctagggtaaagctaatgcaccctaaaactttgtttactggttagcacgctccaaactctgcgttgctctgctctccatgaggatcttcgtgcagaggctgcagcttgctcagcttcagaaagtcatggcagaagtaataaaactgctggtagcagcatttaggtacccaagggaacgttctcacaagccagcagctgatcttgagttgaaagaggcaagtgatgagctacagaagcaatgcagcagtctgatatgccaagttctgggtacctgaccactggcaggttcagtatcagctttcagcctgctaaggcatgggtccggtttaccacctattttgtttgtataaaactatatagaaaatctatttcaatgtaattttttaaacagtggactgattgattatgtagcacatttaccatggtttttctgtgatttttcaagaatcactgatgtgtcctattgtatttttgtcctagttaaacttcacagcgtctctgtcagtgtactgttttttatctgcaattgcaaagtgctgataaaggtcctttctgttttccaaaagagcaatgatagagtgaaaaaaaaaacccaaatagtctcgtggtactcattgcagaaatatagtttagcccagagtaaaaaagcctttaaaacttcatattatcttgccacacttattacttctgaaaattttattagtgttttgatcttttggcaatttaaaaatgggagctgcatgtttgaaaactaaaattattgtttggaaatgtctaggaaatatggttttattgataaatttgggtttaagtgttagtggacatgcatagcttggtagatacataagatcccattatactatagccaaatgtaggattttaaaaattatgattaaaatgtctactacctgtattttaagaccacatgagtccgaatctcatagatttaacaaattcaggtagttggaactcagttgtaaaccaagaaataaagccaaaaggaatttggtgcagataaaattgatacccagaagcttgtatagtctcagctcttcttccttctcacctccctcccctctccccctacactatgggaggttcttttaggagcttgttttacagttctaatagttctctgttttttttttttaatagttctctctagttaaaaagaggcagttccaactctgccagaaaggcagacaaagaaaaatgataaaaatcagacagaaaaactctaaaagcattgggactatctagtgaagtgacaggaagccctgaatatttcatttgctctaatacagaacaatgtggatattcatcataaccgccctgacatgttaagggaagattaaattatgttcaatacgttatatcaaataaagttcagaaatgtacagtacatttcaggaagcattctgtgcaagaaagttattgtctttatgaatgtaaaggaaaaaaaaaacctcaactcagcagagaacatagatatccagaatagcaaccattgtatgattacatattaaccttcccattgttgatatgtactggggacctctgttgtttataagtgctgtgaccttggccgtgagactttatactaatacctatccctcagtaatgttctgtagattcaccaagatttatctttgtaaagtttttcacattgtacttgccaattagtatatatttaataattgtggctattatgcatttcaagcttcctgtgaacaaaaaatacattggaagccaggtcgcgtcaaggattacagaccacacattacattttcatgagcctacactgctaggtgttttcttgttgggtactctgaaaaatattacatgaactaaaagactgtcaacattggagagagtatgccataatcttgaagtagctggcattgttactggatatgtatggcttaagtctttggtttggaggtgggaggctgtcctgtgcattgcaggatggttggttaacagcatccctggcctctacccactggatgccagtagcacccctcctcccaccccagttataacaatcagagatataggcattgctcaatgtccctgggggccagatcaccccggctgagaaccactgcactagagaaacaaatgtgtaaatatggagcatgaagttttaaatagtggtcacaagtgaatgctgagtgtgtttaaattctcattccttttgtgctatgaggctttgactacatgtatctgctttactataattctctctctgtgtgtgtgtgtgtgtgtgtgtgtgtgtgtgtgtgtgtgtcttttcaccttataatttaggtgttgtttagtgacagttaaaggatactaagaaaggattgggatgaaacagtgtgttttatccagtattttgagagtaaggcttcccaggtgagcttccgtcactgattttttggatggctgtacattaattaacatacatttattgagtgcatacccttctaaaaagtcctgtgctaggtactgcaaggaaaagaattttttttttttttttttttttgcctgaacctcctggatgagggaatttcttttctggcatgtaacgtttcttttctcggcccatgtgtctggagtgctagttattcttcccctccagtcccaaacagcttcttttcctatggcttcactgacctttcgctctaaaatcctcatgcttgtgttcacctcttcccattcccccatctctattgcatcattatgcgggtttgcaaacatcatcatcttctttctggcatgactcagactcctgataacgttcatttctggttgccttatttagggaaaatcatcttcttcttctaggccatattagcatgggacactcgtccatctattactcagtagctctttaatttcaaaatatagtcctaatcaaaattttctagctctttattttacttatattttgggggactcatcagttatgattaaatgggtcaactagtaacagaaatctaagtaatacttgtaaactaaatagaattaattttcccttgatgtagaagtcaagaggctggtatggtgatgttgtgatttcatcagcctctcagtttttctcaatccttctattctgcgttcctattctgtagcttccatcctcaaggtcaagtcatggtctaaagatgtctgtctgtctattgcagctccaaccatcacatctgagttttagaaatagagatgtagaaaaaaagaaaggcctgtcaatggaatgctttctgcttctctgaagtccctcttaaaattgtttaaattttaacacctatctacaagggtggctaggatatgtagctgggcacattgttgctatcaacaatacagagattgtgttaataaggaggaagtgagaatagatattggccaggcagcagatgtctctgcacacagagaattttgagtggaatttatgtcatcgatgttttatacaccatatacaaaataggactttaagaagatgtttcataatctatacagcaaaatttactatattaatattgagttattactcctaaaatttgttccttgtgctcaaatacagaattggaaggattctttatcattgctccaaggaatgagggggaaaactgtcacattcctctgaaaagtaaaaaatgtggtccatcaatctagttgactattttttttttcacactgatctgtcagaagtggctgattagctgtgggtttctatacatagctagcatttatcagagaaatatcatgaggacactctttctgttgaatatacgaaaaccataaccagtttctacatgtaagggaaggagtggtacacaggtctgtcaaactgtgatgcagggtggtgtggggaaaggaacggactacgttcaagaagcctctcttctgcttcacgttgaacatttctgactctgtcacttttcctcaatcactgtaagcctctgcttttcatctataaaatgggactaatccttaactcggctatcatttgttgtgtcccttcttaaagatacattgaatgcccatctgtggcaagataccagagtaggacagagctattgttatgcttaaataaaatatcttgtagaaaatcatatgtaaattcaaagtgctattgggttgctgatatggagattatttattttttttatcatttagatccagatcagattttagccattcttggcaacagataaactctatttctcaaaaatttctagtagcaatcaattatctcaaaaaaattctgctgtcctgtgtgacactgcaactatgtattacccattaatgctaattaggaaggacctgggaagcacagccagataacctatagtttattcccagccctcctacttggcctccaaacttccacaaaacactagcttcctttgtgcctacttccaagcctaaaattcttaagtaactttattatttatttgtttatacagtggcaaaatcctgaaatccttcacatacttgttaggcaacattaaatatttgtgaagtctgagtggcacactcaccttaagaagcttcaaatgaggccaggtgctgtggctcatgcctgtaatcccagcattttgggaggccaaggcaggtagatcaactgaggtcaggagttctagaccagccagaccaacatggtgaaaccccgtctctactgaaaaataaacccatacacaaaaattagccatgcatggtggcttgcacctgtaatcccagctactcaggaggctgaggcaggagaatcacttgaactggggaggcggaggttgcagtgagctgagatagcgccactgcactccagcctgggcgatagagcatgattccgtctcaaaaaaaaaaaagcctcaaatgaggaatatatattgaaagagttttatttatttattttggtttaatgaaaatttgatctgttgtatttttaattagaaattatttgcttcaaggtttttatacaggacatacaggaactaatttggatatttttaatattatagatctgtactgcgttctcagaaggctacaaaactctgtaagagaaaaataattatttggcctgcattgtttaaaaggagatcatatctagttgaggaaaactggtggcgttggagcatggctttgacagattttgatgggcacagaaagcgaggctggctgagcattccaggaagaaaccaaaatgtagggaccagagaaactcctggggatgatttgggaaaagtgagattttttgattattctaaagaaatggactgaatgcctcaaaaacaagagctatgacttatttctcgtcaccactcctagcctagttacagtgatgacataaagagagcttggtgatcatttatcaaactgaattacaaccagttttaagccaaacccaaagactgcagagaaatggatatgcccaccgtctcttctgtaactgtcatgcttaaatatgacataggtgttccctaaagagcatttcacaatttctattagtgcaccattcgaaatatgatgttacagaaggctaacagtaagttctgtgtcacaacagaagtttattccaaggagagtagggccacagatggcatctactcaaattaacaatgggtgcttaagtctccctttcagtagccctaaaaagtgatgactcaccacctcagcataaattcctagtttattcccaaacagtccatcttgcaagcttctcttacatgagcatacaaagttagcctgtagatttcaggagtgtgttggtaattctgggttagaactgacgttttttggtataaggatattcaaatgggcggaagtccttcaaagcagtgattctcaaatttgagtgaacatcacagtctcctggagtacttgctaaaacacagacttctgggccctaccctcagagtttatgatttggtaaatttgtgacactagcctgagaatttgtatttctcacaagttaccagataataccaaggctgttgatttgggcaccacactttgagaaccgttcttaaggatattccgaagccaagagcaagtaaacatcctctgtggcaaagcttggagaatgaaaaacatagagaggatattttactttgctgcctcagggctggtctggctttctctgaacaaaacgatgcccactcagtctttctcctgccatacaggccaaaagaactaccttcctgggtgagctttgcactctcatccatccgggctgtcattcctgctcttctttccatgttggcacgccttcccttgctatgctccctattgaaatactcctccctcttcaaggcctagctaaatgccagaggctgtctctgattctcatgaacatgatgaattgttcaatgggttcccatagttccttgcttatatctttatgtcccacttgtaacatgtgcccatggcatacaattcgttttatccactttaatctctcctggaagtgtaagatctagaagtccagaagggcagggatcgtgtgaggtttgatattccctggcatctagcagagtgtctggcatagagtaggtgcctggcaaatagtttttgaataaataaatgagccttccaatctcttctcttctcacttagccacatcctctgcatgaataatatgactggagggaggggttgcattgataacagaatgaagctgaattgaatctagagactgacaattgaagcttagctctacatttattagttgctggacctcacgcagtacactgaacctctctgtcccatcctctgtctaaatcaaagggtcctaactctcagcggtgtttcaaagattaaacaaggcattacacatgagtgttttggaaaactgtaaatcctatataaatatgaatatgttagttgcttaatatttccatgtataacaaaagtatgtacatcttctacaatgacccaaagtgacagtggtttcaatatattttctataatgaactagaataaatgctttatttgtccacccattttaaatgtgttgcatataagaaaagcatcttatttttgtttttaatttgttttattttttattttttgtcttcaaaggcgaggggaaaaatgagattgttgaattgagaagcaggcctcttatttgccatataccagtaaatatcacttaacctccctcgtcatttattataatttgaaacaatccatagcttgacagggtgtgagacctggaagactctagggtatatcatctaggcccctaattttacagaagaggagctgcagttcagaaagaagtcccctgtccaggttcatatgactggtttgtacccaattcaccccacctgaatatcccactctgaaggcttcaacaaatgtcggttagtctgagaaggtcaatgttctgtttgctcatcagtcctgggactaaggtttctatcaacccattgacccaagtaattagaatgttttgtgtgttttggaaattcacctgaatttacacatttaacttcctagtaggtgtctgtgcctacgaatacaaaggacatagatgtacagatttcatctggaaactattttttggtgtccagataatcaatatcttcttagcaacttgagacattaggacagaaatatatttaacttaaaatcttgatcactgtttagaattaaatgttggtcaatgaaacccattatttactttttatattcatgttattcatatttttcaagtaaaaaattcaagctatcttgtcggatgataggacagaatatgtaaagtcataattttcctattggacatacattaatatgtggcattattttattatatattttaaaaaatattactcttgaagagatgctgtttcattccttaggtcaagaatacttcagatttattcagaaacttttatggaacatctttgtgtgccaggaactgtgctaattgctaataatatgaatttgaaaggtacacaggtcttgtttggaagaaacttatagacagactaaaaatgtatttaaggacaaagtatgacagtgaggtataataaattcaacaatgagataaataataggtatagggttggcacaagtacaagggagtgggttgttgtttgggtggctcagggaagctcatacagatgggaactgtctttcagaatgagtaggagtttatcaaaagtggaaactaggaaaaggatggcagttccagtagtggaaatagcaggtgcaaaggcatggagatgtgaaacagtatggcatattcaagtggttgtaagtcggtagacacctctgaaatgcagaatttgtgtaggttggtagtagaaactgaggttgaaaaaggaggtaaggacaagttcctggaaggcctttgaaggcccattaaaatgtttaaagtattctgcaggcaaaaaggagtttggagtatgtgtaattttagagacatgtgacatgatcagatgtactcttaaagagggtctttggggcttcgcccatgactctctttggttcttcttccttacagtctgcaacagtgaaagactgtttcctacatgaagtctgtgagagagagaacaggtttgcatgttgccaagttatcaaagaaaatacatttccttcaaaaccaacttatcccctgaagctgctagtaagaaaaatatgagcaaaatataccacagaataaacttaagctgcattttaaaaagactattatcttgtatgaaaataattcataagttaaaatgttaaaaggccagggaccacacctgtaataccagcactttgggaggaaggggtgggcagatcacttgaggtcaggggtttgagaccagtctggctaacatggcaaaaccccatctccacaaaaaataaaaaaaaaattagccaggcatgtgacggtgcacgcctataattccgcactcctacttaggaaggtgaggtgggaggatcgctggaaccgggaggcagaggttgcaatgagccaagatggcactgtattccatcctggaagacagggtgagactctattaaaaaataataaataaataaaaataaatagttaaaatgatatttcagtgtaattttagtaacacagaaaactcgatatatttattacaactcaaagttataataataagaataaaactacattgtcaaggcaccctatgaattaagaattaaaacggtcattagttaagcagcagaacgcttaaggagaagtcaatgaataatgagatttactgcactttgggagggcctagctctttccgcccattgaatagacattaccattggggtcactctacttactataagtgcttactatcgtatgcagtggctgaggttttggctgtggcgatcaatcctctactgttggataagggataggtgaaatcacttcacaggtcacagtaatgaatttttcactgtctgggacactatcagttaaatcatatcatggctacttataggcgtattgatttgagagctaagacaactgcaattggatagggtgactcaaaagccttcaacttttgacaccctgcttgtgctgatttttaacatgatagagtgaccccttaagattgcaacttcccttcctccatactcaataacatttactctaccctccaaagagaaggatgacttgaaatcattccaagaatgagttccttgatttatttgagaatccatattggagattaatcagctccaagtttggtgaactccctaactggcttctggccccatacttcaatttcagtttatatttagttgttactcaatggaaagccttacctcacagaaaatttattctgctttctgcaagcattgtttaaaaagtcttttttccttctatttttctgttgctcccttctaatgccatttctcatccttcatattttgcgtaaattttggagcacaaagcataatcatgaataaaataatctctattgaagcaatgattatttgcttaagagatgtttatctagttggagaagaatgaaaaccaacaaaagccagaaaattcatgggtttttaaaacaatttgcttttgttaaaaggggaaatatctactgatgtgagaatttgaaattctaagagactaaaaaaaaaaaaaatctaaatagtctttgttcctgtaagtccatggatagttgagaattgaccatatcgtgggggagacaatcattttgtgtatatagatgtatctcagtgccttacttttctttgtgaaatgaacaaaaaacaatgacaaaaatcaacaaaaccaacaaaatcaattattttttctaggatacattattatctggaccactagtcagttgttatagaccatttctgttatatcttatgccattatttactttctatctgacatttgtgtatatttttatcctacaataataaaaataacaataataatagtaaaaataatgatagaatattgtgtcatgtcagaatgtattggacttgatgtcagaagatttgaattgatataaaactgaatatgccacctcctagaagtgtgagtctacataaagtggccttacttttccaagcctcattttgaccctttgtgaaatggggctattctttctgcactgctcatttcatagagcagatatgaggatcacatttgataatagatgtaagtggggacctatcaaatactaaagtgtttttattcataaatatttttaatctgctattcttgagcagctttcctatttagtttgcttggttatttattcatttattcacatcttattttctaaggagttcgttaatttgatggaatctccatcatatattcgtgtgtgtatatatatagtgtgtgtatatatatatgtgtatatatacatgtatgtatatatgtgtatatatatatgtatatatacacatatatacatatatatgtatatatgtatcttcatttctctaaacatccataataaatgtgttaagctatgttccccaggttgatatgaattccaggtaattattcattctttgattattgactatcaagggaaagttgaaaaattgataagtccactttttttaatacttcctgaatacttgccattataaggattcagcatcctgataagtcactaggtttcttaaactagaaatataataaaattttaaatcttaccttggcagtcttcagaatgttggatgaatttaacccctctctatcttcttaatgaaatgaacttgtaggttagtgctggcagaataaatggagtgcaaaacaccccttctagttcattgatgaatattttatgtgagatagaacccaaaacctcattaaaaccccaatgtgttataactctgcctcatttttgatcaatcttatcattcagcacgaaggaggagacttcctaactgtacttttataaggtagcaagtggcaacgtttcataagacacatggatcttgtcatcttcatgtatttgtgatggattactgaaagcgttttcagtttctttccaagtaaaaaattaatcttatgaaactgaatttccaaagtcattgttaaatacagacataactcatttagccacaactcgttgaagacaatatcggttttcaaaattaattctggtaaaatcctacctaagcaagctctctagatctatctctatgttagtgtgtcatatattgacactaacaggatgcaaggaggtctcccatgacatttaaaaaaaactttattgatgtataatttacataccgtaaagtttacccatttaaaacatacaacgtactggttttcagtatattcgtagagttgtgcatctaccaccattatcaaattccagaacactttcagcactgcaaaagagaacctgtacccattcagcagtcattccccattttcccctctccctagcacctggcagccattaatctactttgtctctaacgatttgcctactatgaacatttcatattattggaatcatacaatatgtggccttttgaatctagctgctttaactgaacgtggtgctttcaagggtcattcttgcagtacatatcagtatttcattcttttgcatacctaaacagtattctcttatatggctatttcacattttgtttattcattccatgagttctttagtttcatcaaagtgttttgtggattcctcttcctactccccagaagagaacatttctggtggacaaattagccatatataatgactcatatatttatattaattgggagaaaggggctcattagtagataccatactgtgctggaaatggtcaaaatctaggtttcttttgtaggctttacttcccctgcctcttttattaaacgttgacttcctgcattccacactctgatgattgattgattgattgattgatattgtgtctcaagttatacattttctctgcataagtagatctctttgaactaacccctttctacctctcatcctgggtacatgtgagatgtcccaaccacactgaccttttcagtatcttgaatacaaaactgtttctcgttttggggtcttcacatatgctgttcccacttggggtgatttttcttagctaaccctttatcaggctttcgtttcagtttaaatgcccatatttcagagaggctctgaccatctcctactccccaactcagtctagattacatggcccctgctattcctttttaatagcactctacgcctttcctttctggaacttaacgtaaatttgttatcgtggatttgcttgtatgctctaaagtgtaaccttcactagaatgttggttccaagaaagctagacttttttttttttttttttttttttttttacctgttttgtcaactgctgtatcctcagcatctaaaacagtttctggcacagaataggcattcagtaaatatttgtagaacaaacatttgactttaattaccacctgtactctgatgactgcctacttggaatctctcccctagacatatctgatgctccattctggtatgggctgtcatcttgacatctctatgtgaatgttccacatgtacaccgaagtcagcagttctgaaactggactcattatctttcttcaccaactttgcttctacctgccctctttagtggaataaaaattcttcttactacctaagccagaaatctgagcatcatcttaaattcttttctttcttcagctattaatatggaactggtcataaggtccagttgattaagtgtcctaaacatttatttaatatgtttttatttccaccatcactatcttaattacttcttttctctctgttgtgctgttatgatatcctcctaacttgcctcaccccacccaagtcttatttaattcatacctcacaccgctgtgagctttctaaatctaatagttgaccatgtcaactgctttgttacgaagcctttggggattatttcttacaggtgagatcccaacttcattacttggcctgcaagccccaagcttctttggcttcagcaggagccatgttccagtcatgccaaactgcttttattccccgaaatatgctactttttaaaaactgtgtgccttttcccataaggtttccttcacccacaaagccctctttctcccatctacttaacaaacttatagtcatttttttaagattctgcccaaatgtcatatatttctcaaagatttggctaactaccctagaagagttaggtttccttccaccatgctcaacgacacctgtacttatctgaataatagcttgaaccctgtgaatttaatcatcatgatagcgatctgtaacactagacatgagcccttgaagggcaaaggctcttctctgctgacgtaggcttcagatgatggcagacttgtgtttaaatcctgattcttacttgcagtcccacagcttgggtgagacctttaactctaactgagaagatgtgtgtaaagagcctattatagtacctgacgtacaataagtatttacttaatgataattcttattcatattatttttaataatagaagtaacaacagtgtcctaggtgtgagacagcaactgacatttggtaacatttgttgaatcaatgattcaacaaaaattaactttgttgttggtgaatcatgatgaaaccatcatgcaataaaataggagtgaacataaacttatgaggtgatccagaaaacaggtgcacaaatatacgacaacaggggttttagcctagagtggctggagagagggctgggtgacttggactttgcttcccctcaacttgctgaaggccagatctgaaaatctgaaagaattcatacaagaatccaggactccaaaggtatgttcagactaagttattgaatgaagttatggtttgttctaaaaatgtatggacatgataacaatagcaaagcagcaaaacatgtatttacattttagcagtggacatcaccaactaaaaaaaattgttagggaagcaatatgatcaaacggggatgtatgggcacaaagagccagaagacccgagtcttaatgctgcgtaagtcgctttatcttttttagaccttcatattttatgtgtaaggctggaagttcagcctagaaggtcctttaggttttttagctttgtaagttctgaagtcacttggtttactcttcaagtggggtgtcagtgatttcagaacaagaaaacttccgataaatcaagacccatttattttgtgagaactcactgaggtgatttaccacagtatatgagttcaactgttttttcatttgtattgtttcaccaaaattcagatgccaagaagtttcccttatttgatagtcttttctgtggtttaaaaaatgtatatactatttataatttatatactgatataaaacagtaaaaaccagaatgatgaatgtataaaaataagtgccactggaaatggacactaataaagttcattaagaattcaaggaagcagagccttgaagagtggacaggatcagaatatgaaaattaaaaggaaaggacattcatattatttaaaagaacaaggaaaaatagtgtaatacaacatggctggtttgggagtagaatgagggacagaaagtataatttgcatgaaggagagagctcatggtggtaagattaaaatggtagattggggccagattgcagatacattcactgtgtatgtaatctttactttcaagattcacattggacaaaatcccctttggtggtagtttcctcactgattaagacagttggactagatgatctgtaatagttcatccaatcataattttttaaaaattttgtaattctccatgtcaggatcaattagtgatattctaactagctagctagagatagataaatggatatatattctaaatttatctatctatccatccatccattctaaatgatccaccactgttttcagaagcttagaatagtaaagaatttctctgatattttaactccaagtctgaattatttttaaaaaatcatgtctgccagctatgtgcagaaaactctcttgtgcaatatcattccatgaagaaacacttaatgattgtgaatatacagccaggtaatttgctgctggtaagaaaacgtaattgataggtgatcttactgtaagtcagagcatttagtagtaaaaaggaatcaaaggaaagaaataaagagtaggactccagatggattgggcaggactccccatgaagctcctcatcaggttcctgccagagctggcacggcgtcaaagagcagtgatgtgcttcatcattttctttgggctacaagtaaatggcccatcaaaacggatttcatggcaagggctatgctgacctccgattaacatttaattggaaattctcttttccttgagaaccattggagctatgtgaaatctttcctgagagagaggcaattcttactggtgggagttgctttcacttgatcatcttagtttggcaacttttgaaaaccttatttgttgaataagtaatatatgtgcatggtataaattttaaacaaaagaatagtaagtctttcctaacttcttctttggccagagacaaaagttattcctgattatgtttccagagataaccatgcacaggaaaggactgtcattgtttttataatattatcctttattatgttttggcttctctaatctcagctgtgattatcttgtatctttcaagtggagtgctgttctcttaggagcacttgggttctggggtcagggcaggaatctcttgctgactgaacagtgctcttaggaaagtgtttcgaattctcggagcctggtttccctctctgtaatgcagcaatagtaattatttccatgggctcctcatgtgagagattaatggaataatggatgtgaaagtgtttgagacagacagtaaagactgacgtaaatatggtttgaaaaggaggtgtcgactattgagaaattaggaaaaattctcagacatttggtatccttgatgaaacagtttgataagcccatggatgtataaccaaaacacagaaggatataaatcaagttctgggtatgtctaatttataaacaaaagatacgctgtttgcagacacacatcaacatattaaacatctcttcacagacgtcatttagagaaggggtgagcaaatgttttctgtgaagaatcagatagaaatatttcaggcttttgaatgctgtggtctctgttgccactactcactgtcattgtagcatgaaggctgctgtagacagtcagcaaacaaatggtcatagctgtgtttcaataacactttttatttaggagcatggaaatttgaattttatataattttcattaatcaaaaacgttttcttttcaaccatataaaaatgtgaaaggccggccaggcactgtggctcacgcctgtaatcccagcattttgggaggccaaggagggtggatcacctgaggtcgggagttcaagaccagcctgaccaacgtggagaaaccccgtctctactaaaaatacaaaaaattagttgggcatggtggtgcatgcctgtaatcccagctactcaggaggctgaggcaggagaatcgctggaacccgggagacagaggttgtgatgagccgagattgcaccattgcactccagcctgtgcaacaagagtgaaactctgtctcaaaaaaaaaaaaaaaaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattaggcgggcgtagtggcaggtgcctgtagtcccagctacttgggaggctgaggcaggagaatggcgtgaacccgggaggcggagcttgcagtgagccgagatcccgccactgcactccagcctgggcgacagagtgagactccgtctcaaaaaaaaaaaaaaaaaaaaaagtgaaaggccaggcactatggctcacaactgtagtcccagtattttgggaggctgaggcaggtggatcattgagaccatcctgggcaacacagcctctgtctctacaaaaaaataaaacaaactagctgggcatggtggcatgtacctgtggtcccagctatttgggaggctgaggtatgaggatctctgaaggccaggagattgagggggcagtgagccatgatcgggacactgcactccaacctgggcaacagagtaagaccctgtctcacacaaacaaacaaacaaacaaacaaacaaacaaaaaaaaggggttttaactctcagcctatacaaaaatgggctacagtccaaaattggcccatgggtcacaatttgccaaacactaatttagagcaaattgtatatagaaaaatgaacttttaccaaccaaaatttttatttatttactcaagtttttaacacattttatgtaagattgggctgactgtgtggacactggcaggccatgttatcctctgaacctcacttttcctcctataaaataacggaggtaccattctatgacctcttagcagctttcttttgctaatattttgtgatttaatggctctgaataacctacctctgttggagttcatctttacttatatgtgatatataaaattagcctgtgaaaaacattctcccggcaagcttttggcttctattttattttatttcactcttttatttttatttctttaaatttaaaatataatttattgtccatatttgatatatacaacatgatgttatggatacatatagatagtaacatggttcctagagcaaatcagatttacatatccatcattgcacatcgttgcccatggttttttgtttgttaatgtcaagagcagctaaaatctgcccattcagcaaatacagcacacatttattagctgtagtcctcatgttgtaccacatcctccagatctgctacctcacaacctatgacctacatcccccatttccttcccccattcccatcccgtgcccctggtaacctctgttttattctcatctctgtatatttcactttttttttttaattctacatataagtgagattaggcaatatttttctttctgtgtttggcctatttcacttactggcctccaggtttatccattttgtggcaaatggcaggatctttttcttttctaaggctgaataacacttcattgtatatacagtcctaccttagtgtctataggggtttggtttcaggacctcccaagaataccaaatccacagatgttcaattctctgacataagatctacattacttgtaatatctaatacaatgtaaattttataaaagttgtttttctgcattatatagggaataatgatgagaaaaaagcctgtacatgttcagtacagatgcagtttttgtctcaaatgtttcccatctgtggttagttgaatccacagatgtggaactcatggagggcagactgtgtataccaccgtttccttatctatttgttgatgatggacacttacattgtttccatatcttggctattgtgaataacgttacaatgaatgtggagttcagatatgtttacaaggtggtgagttcatttttgggggcgtatgcccagaggagggattgctgggtcttgtggtaattctattttgaatttatttggaaatctccatactgctttcgataatggttacgttaatccacatttccaccaatagtgtaaaaggcttctcttttcttcacatccttgtcaacgtttgctatctcttaactctttggtaatagccatcctcataggtgtgaggtgatatctcattgtggttttgagttacatttcccggattattaatgacgctgagcacctttttatatacctattggtcatttttctgtcttctttggagaaatgtctattcaagtcctctgcccgttttaaaatcaggttatttgtttttctactattgaatggtatgagttctttataaatcttggatactgatcccttatcagatgtatggtttgcaaatatttttttcccaattcataggtttccattttattttgctgattgtttcctttgtagtgcaaaagcattaaatgcagggaaagccagaagtgaatttctacatcttttagggttcagtttgccttggttcggaagtttctattaaattaggtgttttggatgtgcattaattcttcaatgcctcctgggaatcatttgggacactgccatgttattactgcacagcctagtgaatctgatccgtgggatttttcccatccaatactcccacaaatgtgggctgtaactcatgctaaatgagcacatctataaaacagagaactaatacctaccttgtgggcatgtggtgaaacttaattagttaatgcttctaaagaactttcaaatccgtggataaaatgtattattcaattgctaagagctatcattgtttattatttcctctagtatttgccagtgagtgctttactgttaggatataatggcagtaattttgaaacaagctggcatttgactttgtttgcagagtgcatgaagctacaggtaacattttaatgaaatctttccctcttccccgcagagtcattaggtacacagatactgcctccttctcttaaagctttacacaattgagtagtatttaagtaacatcatcattgctataaaaagaatcaaaagaaagaatctttttccaactaagaccaagtgatttagtaacttaatccttgtttataatttttttgtcactaaggctatgtctaatggaaggaagaacaataagttgtattcaataattcactaatagttgtaattgaccttttatgttggtcagcattatagtttagataagagtcacttgagacaggccctaagttactctgctattatttatatatgtacatatatacacacacatatatagacacacacaaacacacacacacatagctttggcaaggcttaccatttttagatgtcatgccatttaaggctcacttgcaataatgtgaaagccagccagcatgttataatatgaatagaaagaacactggcctggaggcaagccacctctttagagactcagcttttccccttcttagcaagtttcttttctttctgcatttcaggtttcttgctaaattggacgattatacttgattttcaaattgtgctttttggaatttaaggcttagaacagatgcttcaaaatttctaccaacagttaagtactttccaacaaatattaaagacttatatgcccaagaaccctcatttattattttttcttatatatattgtttccttttacacttttatctgaagatttttattacttaggaaaagaattctattctgtgactcaaaagatcccttccagttctggcgtcctataatctttactctcaaaagaagctaaacaccacaaactttgacaagacttcctaaaaatacagctcttagcacagagcctatggtccatttaacagagaaggaaaatgaagctgaatgcagagaggtctaccttctgaaaggcacatttggtaagtggcagaggtgaaatttgaacccaggcaaatgtactttagtgcctgaatgcaatgtcaatgccatattgcctatagatgtttggggcaccatgctaataactgtcaggggccacaaatatgatacaaattttgtcctcctagagcttatggtcataatttaagctgaaaggaaatatgagtgaaagcactgaaagaaatgccaggcggcctgcacgtcggtggccagaggagaggtgcagaacatggctattctgggcgtcctgagaagagggccatagaagcttggcatcactgaagtgtcattataaaaccagccaaaagcattgtcagcattccgcaagatttccattgccttatccaaagaaataggagcgagggagagacgctataaaaggaagaataaaggaaacatctatttatcagctgtgttctcagtcatccctcacttggctgagctgacagcctatgataatcaggctaaggtggattgtcaggtaattctgtgcaggcccatagctctttggcttcctatcacctcccttctcccacctccctaatcagtagttaacactctcttcattgccattgcccttctcctctcatggcctttcttagtaccctggccacactgactgtatccttgtttccatttctgcttttaatttagtatgatacacatatagcattttggaattgtcctctctgataacatcgctgttgctctcctgagtgcctgagtcatcagggagaagtcccctgaagtcacctctgctgaccagtatggctaggttacctcatggcacagaaggattcagcaggcagagtagccaatagctatgactcttcctcaaactctgcaccaattctgatacatacacatgtacccacacccattttcaggggactagacactgtcatatccttgactcatgaaggagaaaagaagtaaagatgtagcatgacaccttggaagagatttatgaaactatttgttaagaattgacttgtgcagatttcaacatgatgaaatggtggtagtttatagtggttgttgaaatttgttcagagaactttctgcagcgatggaaatgtcctctgtctgggctgtctaatatagtggccacatgtggcatttgaaccctcaaaatgtggaacttgaaataaaaccaaggaaataaatttcaacttttatttaatttcaaacatttgactagtggctaccacatagaacagggtagctatggatcaaagtatccaaatattcagaactgacaatctagggtgatctagtgtcttcctagttatataacatataaggtgagtttctatacattacatgattgtatttgagcagaaaggtctcagtacatcaaggatttctattctataaatatttattggaagaacacatatgccatttatcctccagctccctgtctcagtctcagaatcttcctcagtgcagtgtttcgggtagctagtgtcaattggttgtatttgtgaagagagagacacctgatttctatctttgaggtgcttgagacaacatatattgtgtactttgatacagacatcatcaattaagacttgatgaccaaacgatctttaaggtctgatcatgagattatatgattccatcaattaaaagagaatcagttctacatcttatccagacttctccatagaacttcagaagagaaaccacctctatagcactaacatatactaaaaggatggacctctacttccaataaactccctccccacacgtaaaaaaagaacagaaagaaaaaaatgtacagcaagattttaaaccatctattggttgaagtgatatcaaataactgattgttttctctggtttctggattaatgtatacacggtgtcaggccaagtcataagcattataaaaacttactacggtcaagcacttttaggtgctggtatagtacagggtttaatgacaagttattaagtattgtaaagtgacgtagcaaaatcaacaaagctttaccaggttgtacttaagttaaacagtaattctctgtgatatatgcaataccatatatatgtatcaattctagcatcaaaatgtacatgtgtatatgtagggatttcagtgatttttaaaacacaatcaggttggcctaaagcaagaagagttatgagtaaagaggtacttgaaaaaaattaaaacattctaaacactaacacgggggacaagtgattctaaatcatgttatagctctatcttttaaaactgtaagaatgtcttacaattattatgtgattatagtaatagatcatagtattttaaaaattattctccgtcaggcgtggtggctcatgcctgtaaccccagcactttgggaggccgaggtgggtggatcacttgaggtcaggagttcgagaccagcttggccaacatggcaaaaacccgtctccagtaaaaatacaaaaatcagccgtgtgtggtggcacgcgcctgtaatcccagctactcaggaggctgaggcgggagaatcgcttgaacctgggaggcagaggttgcagtgagtggagatcatgccactgcactccagcctgggaaacagagtgagactctgttgcaaaaaagaaaaaaaattattctcatccctattgtgaacttatacctaaaatcagttattctttttaaacactcacagttattttcttcttaaatatataaattaattaatttagctaattaattttaagtaatttaagtttctataaagtcatttaaatatataaagtaatttattcatttattagtgatttattgtacaccttcttggaacaaagtatactgcagtatacactcttgagagatagtaaggtatggggcttcctctctcagatgtcggtttcttcttttggaattaggtggatgtgaatgtgtgtgcatatatgtatatatagtcatccctcagtatccatgaggacatcctgtggataccaaaatccatggatgcgcaagtcctttatgtaaaatggtgtagtatttgcatataacctatgcacatcctccctgtataatttaaatcatgtctaagttacttttaatttctaatacaatgtaaatgctatgtagataattgttatactgtattatttttaaatttaattttattcttattgtattacattttaattttattttttggatattttcgatctgcatttggttgaatccatggatgtagaacccatgaatatgagggctgactggacgtacgtgtatgtgcgcatgtgtatatgaatctacgtgtgtaggcatcatgtgtatacaggaagaaaaagatgaaagagagaaaaaaggaaaaaagaaagaaaaaggaaggaagaataaagtatgatgaaaattacattttgtttcgtatcctttgaagcaaagaggtagtgctatggtaattgaggagacagatttatatctgcactgggcctttaggaatgaatttagacctaaatggattttgagcatgcagatatgacctgagcagacagggatttcaggagaagcaacaacgatatacagttataaaaaggtggaggagatgcaggcacctgtctaattcaccttggtttaacataaaggcgcatgaagggttgttgagatgtgagagaggttactgaaaatgatggccaggtgtccagttcgggtatcatgagcaacaaaaaccctaaactttcagctgttggctgaagggagttgagcctccatataggactgtcacagatagttaatcctgtgctgattattgtaaattaaaagaagttgaatgaagcgggggcttttgcagggtgatacggaatgactccagtgctacagcagcacatcctaacttctctgacttgggcagcataatgttatagaaaaatggagtgaattggataagggttgaatatacttttgttgtggtcttggctccacatcctattacttgtgtgatttgggggaatcttttaactcttccgtagtgatgaatcgtgttttcccaaattaatgtccgccaagaacctaaggatgcgatcttatttggaaataggatcctgaattaagatgaagccatattagcttaaagggggtcccaaatccaatgattgataagacgaggagaggccgggcgcgagggctcacacctgtaatcccaacactttgggaggcagaggcaggcggatcacttgaggtcaggaattcaaaaccagcctgaccaacatgatgaaaccttgtctctactaaaaatacaaaaactagctgggcatggtcatgtgcacctgtaatcccagctactcgggaggctgaggcaagagaactgcttgaacctgggaggtggaagttgcagtgagccgagatcatgcctctgcactccagcctgggcaacagggcgagactctgcctcaacaaacaaacacaacacaacaaaacaaaacaaagcaaaaaggagagggcacacagagaaaaatgccaaagtggggatgaaagcagaggctgaattgatgcatcgatgagccaagaacaccaagtattgcctgcaaccaccggaagctaggagagaggcatggaatagattcccccccagagcttctagaaggaaccacccctgcagcacgttgatttcagagttctggcttctataaccatgagaaaatgcatttctgttgttttaaggtgcccctttgtgctactttgttatgatgaccctaggaaacaaatacaccttcaaacctttatttacttcattgtaaaatggggatgatgatttttacctctgagagtttcgataagaattaatgaaccagaatcaaattaagaatacatttatcacatttaaagtgctctacaaatatctgcgaatttaaaactccattttctagtgttgggaaatatatctaaccattactgagcattaactgtgcatcaaccaaagcattaagcacattatgcctgctctctcacagtagaattagcaatatttagttgtcattttacctgcttggcatttgaagcttgatgtcaacaaaattttgtaagtctttacttactgggggaaaaagtgagtgcagtggttaaaatgagatgattaatgcatttttactttctggcagtggttttttttagtcaaaatcatttctttttctctacagataagcaaaattgctatgctatggtttaataagtaaaatatgtatatcaagttaaaataaaaatttcagtgggtgttgaattccatgctctggttttcaattactactcaccctctcttaggaaagtcacacttctcatttgccttggattagatggggggaaggagctccatgtaccacatcgtaagtgtaatatggaattccaggagaaaatgcatgtgtaaagctatttagctcagttcatttttagatgatttggcaactgttggctaatttgtttgcgttgctctcctgagagaactatgagttgggttcttttgtaacatggaagctgaaatggagcagttcagtgatttactaatatgtaaaaggagtagatattgctgctggagctggactcccaggagtttagggctctactcattgatgagcttcccccactagcatgtgaagaccccaggcagcacccacaaactattcctgaccatgctttaaatggccaaataatttttctaggtttatagtatatcacatattgcaaaacccatttgctctgtctttagccttccagtttccattccactgccttatatgcagaaatacaatgataactataatggggtatgccacctgccttcaatgtgtcatgtctagtaatggagagaggaagttaaatcacagtgtgtgaagtggcatgccattttttagagctccactttaaatagacaaggccacttactttcagcaagaatgtggaggaattatgtagaccaaaacatccaggtgctaaacttgcccactggtgtggtacaaggagttaggaaaattatccaggtgtggctgcaaatgagggctcaatgtggtgaacaaatgatgttagcaagattttcagttatagttaaacagttgctgtgggaagccaggagtgctatactggatgaagtgacattacgttccagtagttgggctagatgtcgtgatggatgctagaggagtgtgaggacacagttagtctcaaatatccagacactggcatcagagtcgtaggacctagtgtctagcctgaagtttaggaataggactcttctctatgaaaggggaagtgaaaagcaaattcgggccagcaaatagatggaggacactgaactctgaagcaggttagcaaaaaaagatccttctcataagaacaaaggcaaaaaaagtggcaatggctcaggaactggagaaagagataaggaataagctgctggcaaggacttgatacgtttgaactccagaatatggaaccggagacagtttagtaaattgtgttatgaggcaaaatttggggggaaagccagaattggaagtgcctgcagatgtgaaacatagctttagcctcagctgttggggggaagaagagtgaagaagtttggaaccagactaggccataatatagtttttctaagaaaaaaaaaagtgggccgggcgcggtggctcatgcctgtaatcccagcactttgggaggtcgaggcgggcagatctcgaggtcaggagattgaggccatcctggctaacatggtgaaaccccgtctctactaaaaatacaaaaaaaaaaaattagccgggcgtggtggcgggcgcctgtagtcccagctactcgggaggctgaggcaggagaatggggtgaacctgggagacagagcttgcagtgagccgagatcgcgccactgcactccagcctgggcgacagagcaagactccatctaaaaaaaaaaaaaaaaattgaatttttttatagcaacaatgtgtcacacagcgttaagagcacaggaagcgtggaagagttctagttcagcctttgttaggtatcaggggcatgaccctgggtaattttttttttttagccctgatttccgtatctataaaatgaaagcatttctctatattaataattcccaaatagcaggccatgggctgtgtgttaggctgttctcgcattgctataaagaaatacctgagacttggtaatttataaagaaaagagatttaattggctcatggttttgcaggctgtacaggaagcacgatgttggcatctgcttggcttctggggaggccccaggaaacttacaatgatggcagaagccaaagagggaccaggcgcatcacatggccagagcaggagcaagagaggcgggcagggaggtaccccacacttttaaataagcagatttcttgagcactcactcactatcacgaggacagcaccaaggggatggtgtgaaaccattcataagaaatccaccccatgatccaatcacctcccactgggccccacttctgataccggggattccagttcaacatgcgatttgggccggagctcatccagactatctcaggctggcactaagttgctaataaggattacctagggagcgtgttaaaaatacgtgttcttgtgttatatcctcgcagattgtgcttgaaatagtcgcggacagatcccagaaatctgtgctttgaacaggcactccacgtggttctgaggtaggaatggagatgagactaccttagagaccgtgaagtctctgcaacattctgtttgtagtattttctcttatcatcatttgcctttgtacttttttgtattcatgaattgggatgatgctcaaagatccaataaagaagtttattggcacactctttccagcagtcacttgaagtctgggagccaaataatgcagggaagttagtttttattgcttactcagccccagcagcacaaacaatcaaaagtccaatctagaatctgttttcatctgacttctgagcccatttttgcagatgcagaagtttgcattcttgagatcgctggtttcctttttctattttatgaggcttttctgaagcctaactagtaatatctccccaacattttaaactctttagagaaaaagttttcataaataaatataggatcagtcatggtggtgattaggtgatttctgcagtaatgcaggacaagggaaaaactttctggagtttgtctcagatgaagtaaatcaacttgctgtgttcagtgggttacttttggagaacatgatatgctctagggcccacatgttaccttgttctccaaaaatagcatttcctactcattaagcaaattaattctttgtctttcagaagataaataatttacagattcttcctagattctaaacctcatagtcagtcatgatagtctgttttatcttatattcatataaagttaaaattaaacattattagaaactttgtagtttacagaaaccatgttccagagagaggaaatggtttgctcaagatcacacagtaaattggtggcaaaaacagtctcagcctctggttcttagctctgcattcagtggccaataaaaataataagaatattctccatacctatattagtcagggttctccagagaaacggaaccgataggattgtgtatgtgtgtgtgtgtatatatattaatatctatgtagaaagtaatggtaaaaaccacaattacttttgcgtcaacttttatagtaaaaagtatatatttatgtatatatgtgtatatatgtatttatgtatatatttatgtgtatatatacataaatgtatatatacttttttaatgtatatatttgctatatatacattaaatctataatgaaatcacaggctcacagtgtcctccatctatttgctgccccgaatttactttgtatatttatgtatatatatgaaactttggttggaatgaaaaatagtatatatatatatacacacacacactaatatatatatacatatatgtctgtgtgtgtgtgtgtgtgtgtgtgtgtgtgtgtgtgtgtgtgtgtattcctttggttggaatgaaaaattgtatagcctctctggaaaaaacaatttggcagtttttatttatgttatgctcttgagttttattccagaaaaacaaaagtgtattcccacaagaacctgtatatgattgttcatagcagctttatctaaaatagctctgaagtagaaacagcctaaatatcctaaaacaggagaatggtttaacaaactgtgttacattcataccatgaaatactactcaacaataaaaagaaacaaactattgatatctaacaacatggatgaatctccagggaattatactgagtgaaaaaagccagtcaccaaaggttatttactgtataatcacgttcatgtaatgttttttaaatgacaaaattttagaagtggaaaacagattagtggtttccagaggttagagatcagttggtagggtgggaaaaggaaaggagagtatgtttataaaagggcaacataaaagatacctgtgacaaaactcattttgattgtggtggcctccacatgaacctctacatatgataaaattgtatataactaaacacacacacacacacacacacacacatgcacacacacagagtacaagtcaaactgaggtctgtgaattatataaatgttaatatcttggtagtaagactgtaatagttttgcaaaatattaccattgggggaaactacgtaaagtatacacgggttctctctacattatttcttacagttgcatgtgaatctgcaattatcttgtaaaaatttcaaataaatgatatccctactaataagcaagttagaaaactgttagtatttttcttgtgcctcaaaaggatatttgtatgcttctgttgttgtcaaggacagaggaaaatagatacttctatactgtactgatgggagtagaaattgctgtacttttaacaataatttgatatatttaatcctttggcatgataatttcacacctgtgaaattgtcctaggaaaataatcagaaaaatgaataaaatttacatataagtgtttaattatagtattcggtatagtgtattatgatagcaataaaactaaaaataacctacataataaaatatagtattttatatgttttattaaaattatattttccaactatatttgttaattggagaaatgcccctgagacaatgttaagtacaaaatataagataaaattttatttattatattacaaactatatatcaaaatagatatctgactcctatgctactagctatgtgatattgggtgaattgctaaacctctctatggacttgttatctgtgcaaaggaatacaataggaatcgttcattttcttttttaattaaatgattatagctcttccaagcatatcctagcatgtagatttttaagctgataataaatagcagttgtatttggttagtagtaatacgtctcatatttacactcttctgtattttaaaaatctttaacagtgagcatgagcatgtgatactttttgtttaaaaataattagtataggccaggcatagtgctcatgcctgtaaccccagcacttagggaggctgaggtgagaggattgcttgaggccaggagttcgacatcagcctgggcaatgcagtgagacaccacctctaccaaaatttgtttaaaaattaactggacatggtggagcacacctagctactgaggaggctgaggtgggaggaccgtttgagcccaggagttggaggctgcagggagctatgatagcaccactgcacttcagcctgggtgacagagcaaggcccattctctaaataaacaaacaacaaacaaacaaattggcatgtatatgtagcgtttaacttattccttcttactctaatgatgactaattcctgtcgatatttaatttatatccaaaatgcctacagttagtccatttctgagagaaaaagacatgcaaatgtctacccagctgaaattttccttatagattctcttggatagtgacagagtctttgaatggagtatttaatttttaattttaactatgcccaaatatagggtgtatacttaaggaatatgatttgatcctgaagagcagaaaaaaaagcgttgaaaaatatttactgttaattttggtagtagataattaattgactgcctggaaaattaatcactgatgagaccatgaaataaataacatatgctaattatttcaaaagattgagatgatacattggtgattggcattgaaacctccaaccacttactgggtcaggttatgaagcatttaatcatttacttattcttggtgagcatttaatttgtgttaaaaatggcagtcattatagcagccgtgagaaaattttgtagactttatgcattgcagcactgtcagagcaaagagcaatctgaggaaataagaagctacagaatgtgggtcaacagggactgtctcatctttctaatatcatctatttatctaattttacccaacaagctagctatcaatttacttttaaccctttaatcctaaccttgggatcttgggaaaaattgcagttcatggtattaggtttttaaagtttagaaacatgacatctaataactgttttgcccattatttgtttccatttgtatttgttcatgcccttttccttttgaatgtattttgtgtttttcttttcaatattttattacctaaataccctttgggataatctagacacctagtaacaaagtacttgaaaaaatatgactttttaaaaaaagtttattttctgaaaatagagatttttcctttatgtatttgctcagtttttaagaaaaaacctagaatctgtattgctttctgaaaagcattagtgtttgacactaatgtttcttgtttaatttttaaaaggcagtaacagcctgaacttattaggttctcatttttaaatttttaatatagaaaaataatttcaaaacagaaaacattcaagtggctattaaacatatggaaatatgctcaatctcagtcttaataagaaaaaagcaaactaaaaattaaacatcaatataccatttttaaatccacaaattttcaaagatgagaaaattttataacacactctattgactcagttgcaaggggaacaggtactcataatacaagtatgagaattggtataatatttatcaaggacaatttggcaacatctgtcaaaattacagatatacatattttgatccagcaattctacttccagaaatttacctcagatatcctgggacatgtgaaagatgattatgtaaagtaatacatcatagaatcatctataaaagcaaaagattagacacaacctaagtactaactaaatgatggcacatctataaaatgaaatcctatatatttgaaacataacaaagcttttaatgtgctatatggactatttcccaagcttgttaagtagacagagcaaaggtacaggactatgacagtagtctgtaccctatttgcttcttattaatgttttcataaagtatctctggaagaatgcagtaaaacatgacaaaatggctgctctatggaagggtactgatggatcacaaataggggatagagacttttaaaatgtatggtctcttacactttcggtttttaaactatgtgattatgctacctaatcacaaaaataaattaattttacaatcattgtatacacacataatatatagtaaatggaaatgtttaaaagcaactttctccttgctacgaagctaattttttcctaatatagtcctttaacaaggaagatgctatataattattttataatactgatgaaaaatgattttttaaagtttaaagagaagaataaagctttgcagcattgaagtcagtttattacctctacttgtattattcacatgagaaaaaatataaatgaacacctaaataagtgaatcactttcccccttctccttcctcctcttctctctgctcctcctcttcatcttcttcttgtctagtttatctgtagcattcgctggtattggaaggattttcaaaatacattcacaaaatataggtatgtgcatgacaattgtaaattaatatttagatattcatctaaattatgtttttcctatgttgatataaatagaaacaggcctaactgcctttctgcacataccagccttattttaatagggattttattagtttttcattcagtttcatgtgggatttttttttttatctaagagattgttccgcatttgctactgggttgtatgccctatgtatatttctatggaaagtattagcaaatttcactaatttttgctattaccaactctaaagaaaatatggaaaaaaggaacttaaaccacggagcctcataatgtcatgtcatctcaatctagttcaagatatggtgtgttttcacatttaattaaccttctgtcacatcctgtgataacctagtcttaaaattgattatacagtcgagcatgtttttggaggctccataaactaattactttttgaaacatgcagttttggcaactagtcatgattacttctgaggctcctgtaaggggctgtcaaagaagggctcagctctgatgcaccatgaaaaaatccaacagggaataatagccgagagagaggtgaagttggtgaagttattggacttccttggtctctggctgattttcttacagcctctcctccttctgctgaatctgcactgcagtgactcgtttatgttctttacacctaaggaggacagcattctactgtaggcaaacgtatgaaagaaactaatggaagtctggtttccttcattcatagagccttgctctttctgcaaaacaaaaccaatacatctggataaaaaacagaatacaaacaaagtaaacaccagggactatgtacaaaacaaaagagcaatcgcaatttttagggcattatatttacaggattatgaagaaattcagttgaccttgaggcatcaccccccaaatctgtattagtagcagtttacactggcattcagataccaagcatcaaaacgtgtaattttagcaaacattgtaatcccctgatcagaaatcccatccagagctgttcacaaaaagcatatttggcttgcttaaatttttactttctgttgtctcatcagaaaaaagatgatacccccctctgtgctcttgtagtccatttggtactgacttcacttttgccttgttattagttgctttcatgtcaacatgaacatgaacatgaacaaacagaggacaaagaccatgttatttctatctttatctaccataacctctagcaggggacctggcttatagctgttacatggttgatgtttatttgatttaattgaataatgagtgacactttgattatcccaacgtaaacagaggggaaaggaagggagatatgccaggtttgatatagaaattggttttatttctaatatattaagtgcttgctgcaaatgtcataatccagaaagattgttctgtggtccctggatctaggagagaagacgccactgacttgctctccttggttgtccaggaaggccaccctaagaaaacaacaaaaccttgatttctttagccacgtgtgtgtgtctgtgtctgtgtgtaagtgtgtgtgcatttgggtcctcacctgatgaagaaaagtgagaaatctgtttatttgtgggtacaaggtgtttcacagtttatgaaatgcatctgtgcttttccatgatcatatttaatgttcaaaacggtatgagaatactttgtctagtttacaattatgtaaactaagcttcagaacagttaagtgatttgcctaagttctcctagttagtaaagattggaaccaagactggggtaaacttgaattatgtggggacctgccttgaactccacagtgactcccactgactggtggtccctgacccctccttttcctagtcactgtttccatgagagaatgttgtatgtcttgggtgtcttagggtactgtgaggattggaaatatctgatccaaggattggactcctagtttagtggtttctgctcagggcattctaccaatgacttacctactgtctcatcggttcgatgataactctagaatggctccatgtgaggttgaaaggagcactcctggatgactctgttcccgcatgtctctttctttccctttggactgctccatagccttcctgtctctcagttgctacattttgcttgatacccttgggctgagggagggcatgctgtggaaatgattacatctacataccagttggcacagagaagccatgctgtgcgtatttatttgtgcccatgccatttgacaacagcaaaatttagtacttggcttgcatttgtaaagaaattggaaaagaggccttttcctcagtgggctactcaccaacaactggaaagatctgagttctcaatcctggatggctgcaactttcttcatatacatctggcattatttgacttctcgtcacagggtaaatatttgggatagaagatatgtaccaatttcccttattgcccccaaagaacttgcgttgtatcatttccactagtggcattggagcacagtaccaagcgtcttgccaagctttccagatttcttgaggccccttctggttctgagagcaacagttcttagggctggaggcaggaggatgtgtgcaagtgtatgttccttttttttttttttttttttgtatttgtatcttgcctaagatattgctgaaaacttaatttaaccctgctacttccctaaacaaaagacacaattttctcatcaataagaatatctactttttgacaggcactatgctccacgagtcgtctatattatctctactctaaaatagccctgcagagtgggtgctattattcccaatatgctatgaggaaagtgagggactccatattttctctaagatcacagtggcagaacttcaattccaaatggctcttgtcgggcttcaaagcccatgctttttctggtatgcattactgcatagctgaactacacagaaacttagttttacaaaaggtgacaattaatttcacacagtaacttttacccaacctgctacctatgggaaaaaattctggacagaaaataaattatacaagaaaaaagaatttcattgaggaagtacatttctctataaaatttttgaggaaggaaatttatttatgaaaattaaccagctaaatgcaggcaggaaaggtgagggaaaagcgcacatatcattttgggggtgggtgaaaacaaaaacaatggtttttaatggatttaaagtcaacaatggattgcttgaagagaatgtaaggttgaggggaggagatgtttgaaattttcaagtcatatagaattatattcccttaatttacctgactaaaaatatataagtagtatgttagagtcagatgatgctgggagttaattctccaactttacagatggaggcttatgacctggagctcatactggtatatacgtagacctagaacctaagcttactgagctcgagcccaggtctcctttgtgagctgccatgataggctttggtagggaagtagatatcccagctctttcaacttgcctcaaaaatgaatccagagctcactgcattgatgttggggggctcacagctgggtacatgacagttcagacattttgatcttaagaatatatctggacaattctgaaaccaaatagacctcataaagaaaataagagtgagtctagtgaatgatatactcagggaggacacagcacattaggtttcagaacgtaaaagctaaataatatggactcttgatcagcagcttgccaggcaagaagcttgggcagcaggttggtggcatgctggctagcttagacagggtggcatttttcctaccgtatagtttttatgcagagcacactccaagcaaataattctcagcagggaaggatgcagattttctctagtatgttacagccactggggtagatgaaatatgggccctggaagcctttttggcaaactctccgattactgtaaggagtgcttataaaaggaagaagaatgtgggctcttttttagtctattgaaaccttgaaatatttttcaggtttgagtgtgtgtgtgtgtgtgcgtgcgcgcgcgcgcgcgtgtgtgtgtaattgatcttgttaaactgaatcacgaattttttttgtgaattcagggccagaatgtattttcacgtccccctcgatgaggaggatgagagtgaggtcggcaaaaatggagtgttgacaggaagtggatgccaatgggagtgaacctgtgttgtgggggatttgaataagagttccagtaagctcttctcgcccactgagcacaaatgaccacagggtatcccggtctgaaacaatcaataggtttctcaataagtatttttgtcctctcaacccatctcagctacctgtccccaagggttaaggagaagctgtcaacttgttggtttgggaactgattaaactccattgctaaaatccattcttctgctccagctgaaaattcgcccagcaggagatggtttcctgattgaagatatgacaaaagaaaacataggtctaacaagtattcctaattattttttcaagatgttaagaatttatggccaaatacgtttggaatagagcaatgtatctccaatttcgcacattataggaaaatcaaacaagcaaaatcaaagaacttcccatagagagtgtcagaattgggtttactacttggattctaaaatctcatacctgagcaagatgcagaggtaacagtcctcaaattagtgccagcccaaacttgccaataaaagttctgaggtcagtaaaggccatggctatgataccaaatgtttcaaagatgtcagcaggaggtgctcgggggaagcttggctagagcgactgatgggaacgccagtcaaggcccagatgtacttcttcagccttgtcctgcaccttcctgctatacgcactagtctaatcacctttcccagttcctgcccacacttttcacttccctttgcttttcatatatgcttttgttttctgtgcctggaaatgcttgctccttctttgaggcccagctcaaacatcacctgttctgtaacatctctttcagattcccacccatcaggggaggaaggaggaataaatttctctttcatctcatctcatttgcctgatagaggttacaggcagccaattaaaaaatctaataacatgctaaccacttaaaacaggactactaaaaaatatgtatatgtaaattagcaaatgtttaccaattaaattagcctttaattagctaatttaattagcaaacatttaccaatcccttgtatatattacatatatattatatattgacatatatatattttttataggcttattttaagtggttaacatgttatatgattttttaattggctggctggaacctctatccgactgtaagccaggtcttgtctgtgcattcccagtccctagcaagtgtttctcacttagtagggattggtgaacgtttgctaatttaaggcggattcttggaactgttctcacccaaagagcaaatcctcttactgttttttttttagtattataagatagtcgaactttgatctatgaaggcagaagccacatttgtaattgaacagcgttattacctttctttttcatctgtgaatctgttctggaagacttagcagcttcaaatgagactgaaattaaaattttgaagcagtccatttctgagccagagttttagagagaatatttttagctttaattctgaggagaaatcggtcaaatttattattgatatgctgccattttaatacattaactaactcttctcatcttgtctatcatactgtaagtctcctcccttccttccttccttcttttcacctagaagtgataatttttaaaaatcaatctatttattatcttgccttacatcaaatggcactaatctgccagaacttgatggacttgagtctgaggtcatgggatacacattgagcttagagacctgtaccagtttggaatgcaattctatcagcagtagcattctctggttaacttagcggacttcagaattttttttttttttttttagttccccatgatatctctttataaaagaatgtactctttttcaccttagtgattccattataaaatcagaaaaacgtacaataagaaaggaccttggctgtcacttcaacaagccctctaccattcctgtaagggttgcttatgttcatcttgaatacttccattccaagcgatttattatcttccaagttaacgcattcctttgttagtcaacctcaattcttctttgccatcctgggtatacagatggagtcatatttatatcaataacccaaatttattttcctttcctatatatatgttcttaaaatacctaggatagctggagtactcccagcgtttctgggtatgtctggattgtgtgtggagggtatttccagagtattcataaactaccatgtgggtttcggaccctgttcagcatctacccagtttttcctctcctacttagcattttccttgtcaatttcttctcatctcaataatctctactaaaactcttctacctggtggttgttggactagcactatcaaaattacgtgatagctcatttgaaaggtggaatcttgggtcccacctcagacccactgaattggatcagcattttaataagagcctcaggttggttgtattcttatgtaagtttgagagggattggtctgtctaaatagtgccttatgatgcctgtggctttgcccattcttataacaccaatttcaagactgaaagaggtgcttctggctgatttccaaaccagaatggtcaagttggagaaggttctgcacagaaagtgggagaatgacttctccaattttatgaccccctttatcactttgtagtgtcctaggcagccatgtcctgaaccccactctctccgtggagcttttcataaaacttgatcctccaacctcccacctcccccactttccttctgagggatcctggaaatgctatctacaccattatgttttttccaatgactttttcaaacttctctttaggttcttaatatatccctagcctattctccttaagtctgaaatttaaaagcttacctagaaatcagttggtgccaagacccttgtggacccacatacatcacacacatgcaaataagcctgaattccttctggatttaactggaccagcccgtattcatttctattgtactgacataccttccaaaaacttcttcattttctaatttttgtcttccgaagccatgaaaaaatatacttttaacctctcttccatgtatctgttctttaggtatttgaaggtcatttttatgcctgtgtcccccaaactttctcatttctgcactgcacattctgacatctctcacatttttctcatgtttgatttttcagttatttgtccagaatatagcttaactctctaaagagtggatgatacaagttgatcacaaaataaattgatgatcacaagcaggagatagcagaaggcagagaataacaacacaggacattctcatatacatgagggtgtacataatgccgtagaagatttccacatgcaaccaagctggaaaagaactctcttactttactacctctcatgcatcaaacagatgagctactcatcttctcttctcaaaatatcactgcccatattactttttttcaccagtttatttatattctagattttagtttctcagcacttatgctgagaactcttcaaacaacaaaattctgagagtctatgcctcaaaggctctgtgtgtccagggctactcaaattattggatgttaaaaacaataggcttaggaatcataataaatctgatgtaagaaatgttgtgatggctgaggcttttataagttgatgaggtatatacctaaataaacaataaactaacttagattcataggcttcactgatggtattccatttctcagattgtagatcgtaagactttagagacatactacgtttatttgttttagttaaacaaataaaaataagttaaataaaccataagtgattttgaaacttctctgaggctgtgacaatgtggcacactttcttttctttgccaatgattccaataaatacaacttaagataattttttcagtaaaatttgctctattggaatttattacatgtaagtatctataaaatatattagttgttggtatattacatttgaggttatatgtgttagattttaagaaaaaaattttgtaagcataaaactaataattattgtagaatttttaatgctataattgattatatttacaaagaaattaaaatcatccataatcccattacttgtagataaatgtgatattttgatgtacttttttcatttttaatcaatgaaatatataaacatatacatgagtatggttattgactctatgcaatgtcatattctgcttttatcacctggcataaatttccatcttgttaaatattctttgtctttaattcttgcataacaaagcagcacaagaatatgccatgctttgtttattttaccattatcttcttgccaaacatttagatttcttttaacattttattgctttcactggaatgcatattcttgtatatatattttgagcacttctgtgattatttccttataatggattctgtgaattggaatcagtgagttaaaaattatggacatgtcatacatatgttttaaatgtgtaggtggtttagtttgtccattaattaaaatgccacttgggtggagtggatagtgtgtatggggtctggcggggctggtaaggggtgaggaaatggagaattggagttacatattctcaaggaaagaaaaggaaaatcatttgttagtagatgattcaagatcttagctattaagtaattctaaacactctaaaatgtgattttataatgagaaatcttaattctataattatagagaagggagaatttcgaatcttttcatcttctaatagaataaaaaaacacacacatttaaagtgtgtaattagttgtttatcttggcataacactgagattgtataatctctttaaaatttttttaaaaggtttatattattttcttcctgtcataaaaggaaagacacacaaaatcaatactgtaaactccgtgaaggcaaaagatggcggctgtcccaggggctctgcatctcagtcccccatagatctcttgacacatgaagagtacacagtagatatctggacagtgtagagaatctcttccttgtgacttctggagtattaaatagatctggtcaagatgattttattttcatcaaaattcttagagagtgatataatggagaaaaaaacccctgtaaacaaataaaacaaaaacagtatgtaaaggccattctgaaggttgaagtacttagaaggctggaagtgctcctctgtctagagattgcggtagatgggatttttttcttaaccaggaaagtccaggaactcacagaaaacctttctctctctcacttttcaaaggccagttacctgaaactctgtctctctgttcttcctttgccttattacagcataaagaatactaaataacaccttcagaaatgtttccttttaaaatgtagtctcctacgactgagaaaaaaacggattagagttttaaaaaatctaaattctaccatttgtagcaatacaaagaaaacacactattctctgttcatgtatctaaggtaataagcaaatttaaagaataatacagaaaaagctagataaattaacttgaatgaaatagtttctttttttcttgaaatggctcaagtccttttcaaactaccactgaagttttttagaagttaaaaaatccatggcaggatataggtttcttccttcttgtcccaattaaaagcattctgaatactaaaactctaattttattctcttcactttcgtctagatgtagaaatacaagggcagatgagcaaaggatctttgtagcagattgtttgaaaaaaggaggatttaaaagaaaaaaattagctttaactatagaaaatgttgacccttaggaaaaaatttgtaaatgcaattaaaggaaaaaaaaaggaaataaaaatttagaaataaaatgatctgtggtagggatatacagagtgctacattgaacacacgttttcacccctcatactcctggagcaagtatatgttcaggagagatgaataacaatgtcttcagtgggaagcaatggggaaggacaagaaatgctaggatgccaggggagagcatgctcttatgactttgattcaataagaaacccatccatcattccaaggttgatcattcttaccactgataaatgaattaatttacattcctttgtgtaatggccttattgcaattgtaaatttataagtgatgttttaggatcttatgcataattactgaaaaaaaaagtttgcatttttgagcctgtacacagggttggaattttactaatcaaagatttcattttggatgtttccaataatatgagtgtaagtaggaatgtgtcttggtagtttgcttggtgtacctaggatcattcacctttgacttctcttaactgggaaaattgatcatacctatttttttctttgaacatgccaagactcttggtaaatatttgtaaatttttataaaatatctggaaaattgtgttgaaggtctacaggtcaaatagcatttgttccacagaagagtcctttattggacgatttatttattacatgttctccgaacctagatataataatctattcagataaaggtaaatgaagtaagtcctatattgttttgctttcagtctttagtgtcatatttttatagcaaacactttctcatcgtactgttccagaaaataaaacagagcaagatatctgtggtatacctgtgagggggttgtctgttacaatttcctctatcataaaagcaattcctataaaaatgctcataaataaaatgagaaagggtttggaggcaatcaataagggagaaattatacaataaagttactaatctcttttcagagataattttcatcaaatgaattgtacaaaaagtcttcaaggaataattgacttcaacaagctttccactggtcagcaagactttttgctttgaagtaaaacaaaataaaacaaaacaaaaaacagatcagaaaaaaaatggtaaataagaagtagtgcctacagatcttcccaccaagaaaaatgagcagggaaaggtcaccagcgtgtgttttcaggattatttgtctatcccacagtttgtggttccaaagtatttttatcagcattaatttgtttttgccttaaaattgtggaaacattcaactcagaagagttatgccaatttaaatctcaaagaaaaatttgggcaaggagcatgtttcttggaacagggggtataaaggaaaactgatttctatttatttggtttccattaaaacaccacaagttattggcttaaatgtccctattttttatgttttgaaattaatacatgttcagcttagaagagttggtatgaaataagcagaatatgaaaatatatagccctaataatgttatttcatagctataatttgtaggtcatttttatatcagaagtagctttgtatcctccaccctcacatttttttcttactttatggtgaccattttcccgtgacatttcccattctgcaaagtatttcaccatctaggtttatcataatgtatttaatcagcctcccttttagtagccatttgtctatttattcttaattaagatgaatatcatcaattgaatatgaagtcaaccatgtaagccaaacacagttatgaaattcagatgtgtgttatagatcccagttcggcataataaagcaaaacttcgtttctctgtcttccaagtgattcatttactttcaaaaggctaacaaaggaaatgatatacaaacctagtcaattaagaagtgcaaaaatgtggagaaaatataaaaaaaatccaggtagataggagcacccaaagtccagggtcatagaaggaaagcagaggatacttcatccagtcactataaacctttaaaaatagagccatttctctactactgtgactggtttgttttcgtggccaagaactggccttggttgcaattctacatggctaagataaatgggtatatagagagtcatgtggtggcatgaagcccaagtagtattataatcccagagcctctgcaggcctgtttaacagggttgaactcatcaatgactctccgtagaatgtctgcctcatctccctcaactcacttgagtgcagagagattccctaaaacactgaatctccatgaaatggagaatgaataatttcccaaatttatttgaacgtggggctatttactcacctaaaatagctattaacctttcacagatgactactgtcctttggaacatagtttgaggaacatagctctgactagacagcattactctttctcgtactcctctagcacttatatctgttgctccttcagtatacatccttttaatatgacagcaggagtaaaacctggagtgaatatgacagttacgtgggaagtacttaagaattcctctgttcttctttctgaaaccaggtcccaggcagtggtttggttttgagtttcttgggcaattctattatgaagctgtgttcagaaccattgcctgacggtgcactttttctttatgtattttacagaatacattcaatacagcttcagatatccttaaggctaatgcaaggaccttgtagataatagattctcaatagatatttgttgaatgaatgaacacacccgtaaaacatgctaatgcaaacagtatcaaagtaagatctaaaatcaaaattaaaaagacaatccctgataacagcctccttttctgaccactgtgtatgtaggctttaaaagctagaaataattccaataagtagccatacatgcttttcaaggatactctgatcttcccagaggcttaaagagttttaaattctacaagcaaagcagaaagcagagcttctaggtatgtagcttccacgtatggcattgcaatggagctggccctccatcttttcttcttttctttcttctatagctgattattaagtgattaatatgtaatgaacactattgtaggctttgagattatgctagtggacaaaacagacagaagttcttgcccttacagaagttaaaatgtaattggggaaaataaagatcatgataagggctaaagaggaaagtaaaacagaaacggttatagggagtataaatgaggctgcaatttttatataaggaggctagcttaggccctgctgagaaggtgtcatttgagcaaacaatggaatgaggtgaaggaatatttgggtgacaacgttctccaggctgagggcacagcaagagcagaggttttgagacatgaccacacacctggtatattcgagaaatagccagggtattaggagtaagagatagtcaaagaagaaatggggaagccagatcttgcagggccttgcaggttctaatatggacattggctttaattcttacagagatggaaagtcattgaggcttttgaataaaggagtgacctgatctgacattttaacaggatcactctggtttccatgttgaataaactgaacaaggtaatggatgtagcaaagagaccaggcagaaagcaattgcaataatccggatgagataattgtggtttggaataaggtgttaacaacgggagataaacagtggccagattttatgtgaatcttccctttgatctgtggaccaatataacaagactggagagaacacacaatttcctccctggatatacatcatcactgttcatattttcttggagctcagtgtacacttctaatggcttcctttttataattgcagacaatgtacaataaaagggaaatttgattcacattcagtaagctctcagcttcttttgcttggattctgactgaccaatgagtgaaagaatctgaagaggagatttctgtacccagcagcgggtggaaatagatgaatgtgagcattctttctaattctgagattctgtgattctgtgatccttagtaactctggaaattgaatgttcaaagactgaaaagttatatatgatagtggcaccaattgtcacaataaattggaagcaaatactaatgatcatggatgtatttaaaatatttcacacctgtcctagcacagaccagtcagaacagatgccaactgtaaacagcaggcacagccatgcatcaggctgaatattagttgtgcttatgctcaggtacaaatcaaattatattttagctgacatggtctgacaaagttctacgtctgtttgaaccaagtcaagtgagcaagtgcagtgaacacagatgttttgcctaggtttgtgcctgatattttgagaaaaatattaaaaggggtataaaatacagttatgaccttctgagtgtttttaatctgtttcagaagacaacactttgcactcaaaacaaattaagaatgttgcaacatatgaggccataacaactattttacgggttcttggctcccagcagcttgcccctaacacggtaactgtgtctttcctgagatttcagagtagtgtaataatgaaagaagaacaagcttacttgcaagatattaggaattgttgacttcatgatgcttgctggcatcttaagaacagacatgcaatgtctcaagccagcgttcaacacactaacttaggcaacagccgtataaggcaatatatcttttccatattcatgatccctccctcctaccctggtttgggtgcttcccagcactataagaaccaacaatcataagccaaagtatatctggagagtgggagaagcagtcctgcaaatgcagccttttcacacgcttcaccccccgtttatgattggcttcaggaaaatctgtgttgtatggcatctgatcaagtatggtcaaggtctgcctatgcatcatctattcagcatgtaacacagttagctgggtagagggtgtgactaccgtccagaatcaacacaccaggcttatataacaaatatggagagtttgcagaattttagtttatttgacctgttgaacccccgtcattaagaagaatctagaggaagaagagaatgatcacagctttatccagaaggaacacagaatttccaaagttagctaactacagattctgtcccttaagctggatgcccattatagctcagccaaatgccttttttagtatcctcctctttaagcctgcctcactaagctggttaagtgccagaatatgtggaactgaccatgcacttcttctgcattaaatatttcggagctggtaaatttagaacaacctaaagagtcatgttatgtctctctctactgcttatcaaattggcataagggttagagacttaaaactgggggctggattttcccagagggctgaattatttaaccgtcagcaattttgaggttcacagtaaagtagcaataatgaaatcatctgcttctagatgtaaaagcatcttctcggaaggccagaaggagtttgcagctttttctatctgttgggtgttctgggctctgcctaatacacactgtttatctgacctgaaatatgagacgattctgccataggagaataaattccatataaatttaaaagggagggtctgcatgtgctgatggctccttataaggggatagtttgtcaaatttggtacatattcctctccttttttaatttttaatttttgtaggtatattgtaggtgtatatatacagagcacatgagatattttgatacaggcatgcaatgcataataatcatatcaaggtaaatggaatatccatcacctcaaacatttatcacttctttgtgtcacaaacattccaattatactcttttagttatttttacatgttcaataaattattgttgactgtagtcactctgctgtgctgtcaaaagctagatcctattcattctatctaattatattttttgtacccattaactgtcatcacttcccactgcccccaccacccttcccaactctggtaaccatcattctaccttctatctctatgaggttcgattgttttaatttttagctcccacaaataagcgagagcatgcgaagtttgtctttctgtgcctggcttatttcacttaacaatggcctcaatgatccagttttctcatctgtaaaatgggcacaataatggcaaggacatgttcctaactgggtttttgtgatgcggaattcagtcagaagagggactggctcaaagtaagtgctcagggaatgttaactattcttcttcttctttttttttttttttttttttaattttcagtgttctctgggtatgttaactatttttatttgctcatggtgaaacgaagagagctgacaagaaaatttccaccaacgaactttttatgtcctttttaaaaattgtcaaagttctattgaaatacatggggagcttaaataaaattaatgaatcatacatcagagtaacaagagtaataatcattgtatttttaaaacagtcaattagaaatgaagaaaaccttttactccaacaaaggaactgacatatttttgaaagcgtgctatatgtcaggcatttgtaatggcattgacatcatatttagtcttcccttcaccctggcactactatcagcatgtaataaagaaactaaagctctagttaacagaagctctagtggaaagcaggatgaaaactcaagtctgacacccctgaaactcctcctcttccactaactccaaataccaccacattcttcgttcttccttatgccaggcctcaattttctttctgtggtgttgaagcaccttctctctgtgctcctctcttctttgctcagcagaacggctttctgatactgctcctgaacacatggggtttcctggataaggtggatttcatgggaactgctgcaggatgtggcagcttcatgtgggtttttgtccaactttagtcaaatagcaagcctcttatgtccagtagtcaatggctaatgactctggttgtagctgttaaataaacaacagtgaaaacatttcaaaagttacagagaatcagtcagagcataaatggtaaaattgtgactgaatggatagtgtacctgcgtgtgtgtgtacctgcgtgtgtgttgggggagggggttgtccttgaagctgtctctgcattcttatgaagttccagtaataaacatttgtattcacctggcttattcaacatgctgctgcaattactttaagatatttcacgctgtttggaagagggggatttatacctgggagtcagggggaagactgaagtttactggaggtgtggagcagggaattcccagttggaagctgtttgatagcccagacttgagaatagaacagatccaggttcaaatccttgcactgcttttaaataactgtatgaccttggacagcttacttaaccccttaagccttgtttcttcctgtgtaacaggaaaataaccatatcaatgttacaagattctctgtgatgatcaatgaagtaatgagaatcaagtacatggcacataaattagatagtgcctagtgaacagtgattattaatgtgcactaatttattattattattttaaatttcaacttttattttagatgcagggggtgcatgtgcaggtttgttacctgggtatattgtgtgatactgaggtttggtgtacagttgatcccatcacccaagtactgaacataatacacaatggttagtttttcaacccctgcaccctctttctccctcctctttctggtagtcctcagtgtcagttacggccgtctatatgtccatgagcacccaatgtttagctcccatttgtaagcgagaacatgcagtatttggttttctgttcatgcattaatttgcttaggataatgatctccagctgcatccatgttgctgcaaaggacatgattttgttctttttttggctgcatagtattccatggcatatatgtggcacattttctttatccagtccaccattgatggacatctaggttgatttcatgtgtttgctattgtgaatagtgctgtgatgaacatatatgagtgcatgggtctttttggtagaataatttatttccttttgaatatatacccagtaatggggattgctgggttgaatggtagttctcttttaagttctttgagaaatctccaaacttctttccattgtggctatactaatttacattcccaccaacagtttataagcattcccttttctctacagctcaccaacatctattgtgttttgactttttaataatagccattctgactgctgtgagatggtatgtcattgtggtcttgattttcatttctctgataattagtgatgttgaacatttttttcatgtttgttagctgcttgtatgtcttttaagaagtgtgtgtgttcatgtcttttgcatctgtatttttctgtttttgttgggcctttttaaaatgagattatttgtttttggcttgttcaattgtttagctttctcatagattccagatattagacctttggtggatgcataagttgtgaatattttctccctttctgtaggttgtctgtttactctgttgttagttgttttgctgtgcagaagctcttaagtttcattaggttccgcttgtcaattccacttgcttttgaggacttagtaatagattctttcccaaggccaagccaatgtacaaaacagtgtttcctgggttttcttctaggatttttttttttttttttgagacggagtctccctctttccccaggctggagtgcagtggtgcgaccttggctcactgcaacctccacctcccaggttcaagagattctcctgcctgcctcagcctcccgagtagctgggactagaagtgtgtgccactatgccaagctaatttttgtatttttagtagagacagggtttcaccatgttggccaggatggtctcgatctcctgacctgatgatccgcctatctcgacctcccaaagtgctggaattaaaggtgtgagccactgcccctgaccctcttctaggattcttatagtgtgaggtattacactgaaatctttaattcagcttgagtttttgtatatcatgaaagacaggggcccagttttactgtggctagccagctatcctagcaccatgtattaaatagggaatcctttccctattacttgtttttgttgactctgctgaagatcagatgattgtaggtgtgcagctttatttctgggttctttactctgttccattggtctatatctgctttgtacccatactatgctgttttagttactatagccttatagcatagtttgaagttgggtaatgtgattcctctggctttgttctttttgcttaggattgtttttgctattcaggctcttttgtggttgcatatgaattttagaatagttttttctagttctgtaaaaaatgacatttgtagcttgataggaatagcattgaatctgtagattgctctgggcagaatgaccattttaacaatattgattcttccagtccgtgagcatggaatgctttttcatttgtttgtgtcctctatgatttatttcagcagtagttcgtagttctccttgtagaaatctttcagttccttgattggatgcattcctgttgtgggaagtcagggaccctgaacggagggaccggctggagctgaagaagaggaacataaattatgaagatttcatggacatttatcagttcccaaataatacttttataatttcttatgcctatctttactttaatctcttaatcctgttatcttcataagctgaggatgtacgtcacctcaggaccactgtgataattgtgttaactgtacaaattgattgtaaaacatgtgtgttcaaacagtatgaaatcagtgcaccttgaaaaagaacagaataacagcgatttttagggaacaagggaagacaatcataaggtctgacagcctgcacgtgcatgcaaaaagagccatatttttcttcttgcagagagactataaatgaacgtgcaagtagggaagtatcactaaattcttttcctcacaaagactattgatattaatactctgggaaaggaattcattcctggggggaggtctataaacggccgctctgggaatgtctgtcctgtgtggttgagataaggactgagatacgccctggtcttctgcagtaccctcaggcttactaggattggggaactccatcctggtaaatttttggtcagaccagttctctgctctcgaaccctgttttctgttaagatgtttatcaagacaatacgtgcaccactgagcatagacccttatcaggagttctgccttttgccctttgtcctgtttcctcagaagcatgtgatctttgttctgctttttgccctttgaggcatgtgatctttgtgacctactccctgttcagacaccccctccccttttgaaatctttaataaaaacctgctggttttgaggctcaggtgggcatcacagtcctactgatatgtgatgtcacccccagcacccccagctgtaaaattcctctctttgtactctttctctttatttctcagccggccaacacttatggaaaatagaatctatgttgaaatattgggggcaggttcccccaatacatccctagatattttactttatttttttgttgatattgtaaatggaattgtgtacttgatttggctctcagcttgaacattattggtgtacagaaatgctactgatttttgtgcattgattttgtatcctaaaactttactgaagtgattaatcagttccaggaaccttttggcagagtctttaatgttttctaggcatagaatgatactgtcagcaaagagatataatttaacttcttattttcctatttggatgcctttgatttctttctcttgtccgactgctctggctaggacttccagcactatattgaataggagtggtgagagtggacatcatgtcttgttccagttttcaaggggaatgcttccaacttttacctattcagtatgatgttgcctatagatttgtcatagaaggtcttattattttgagatatgttcctttgatgcctagtttcctgtgggtttttatcatgaggggatgttaaattttattgaaagcttttcctgtgtttattgagatggtcatatggtttttgttaattctatttatagagagaatcacatttattgattttcatatgttgaaccaacgttgcctcctaggaaagaagcttacttgatcatagtaaattgactttttgtgtgctgctggatttggtttgctagtattttgatgaggatttttgcatttatcttaatcagggatattgacctgtatttttctgtgttttttttttttttgggcctttgtgcactaatttaattagaagtgccagatactcataaacagcaacgttttcctgggtcccacagtggtatcatagatcttttccttaacaagtatctattgaaactttgctgtttagaaacagttgcatacacactgtggcagcaacttgtacatgcctgagagtggacacttcttatcagcgttaattcaactacacttcacagctctgagaggatgtgtaatcatcaacatagaatttgatggataaggtggtagaaggatttgcttagttggatccttctcattttttaggttttgcacaaataccacctcctgggaaggagcttccctgaccatgatgtctcaaatacccctcaccttacccatgacccagccagctgtaatctgtcctctttagtattatttatttgcctactaattttttacttcttaaataatagactttatgttttgagccattttaagttctcaggaaaattgagcagaaagttcctatatatcctctccctctcaccacatacacaatctccccactatcaacatcttaagccagaataagacatttgttagaattgaattggtgaacctacattgacacatcattatcatccaaagtccatagtttacattagggttctctctaggtgttgtacattctatcagtttaaacaaatgtttaatgacatgtatccacctttatagtaactaacatgcagcatacagtcagccctccatattcatgggtgctacatctgtggattcaaccaactgtgaaacaaaaatacttaaaaaaaatggacagttgtgtctatactgaatatgtacagacttcttttgttttccttattccctgaaaaatattgtataacaactatttacatagtatttgcattgtagtaggtattataaagaatctagagatgatctaaagtacatgggagaatgtttactggtgatatgcaaatactacaccattgtatgtggattttggtatccacaggggttctggaaccagtcccccaggaatactgctggatgactgtagtttcactgtgtttaaagtcctctgtgctttgccgattgatctccccatcttcactaacccctagcaaccagtgactttttttttcttttctaagctgacctataataattgtacatatctgtgggggtacattgtgattttgcaatacatgtaatgtatatgatcagagaagggtaattaagatatccattatctcaaacatttatcattttcttgtgttgggaacattcaatatcctccttgtagctatttgaaactacatattattattaactataatcacactacagtggtatggaacactagaacttactcttcctatctagctgtaatttttatgttttaacagatctctccctatttcccctgtaccctactcttcccagcctatagtattctctgttctacttttaacttctatgagatcaactttttcagcttctacatatgattgagaactttaactttctattcctggcttatttcatttaatgtaatgccctccacttccatccatgttgctgtgaatgacagattttattcttttttatggctgaatggtatttcgttgtgtatttatatcatatgttctttatccattcatcagttgttggacacctagattgactccatattttggctattgtgaatagtactgccataaacatggggtgcagatgtctctttgatattgctaatttcccttccttgggatagatgctcagtagtaggattactgggtcgtacagtagttctatttgtagttttttgaggaacctccatactgttttccatagcggtgttatgagtttacattttcatcaacagcatataagagtaaccttttttctgcatccctgccagcatttgttattttctgtatttttgattacagccattataattggggtgaggtgatacttcattgtggttttgatttgcatttccctgttgattagtgatgttgagcatttttttcatgtatttcttggccatttgcatatcttcttttgaaaaatgtcttttcagttcatttgcccatttttaaattgaattgtttgttttttgctgttgagatgtttgagtttcttgtatattctggacattaatcttctgttgtatgaatagtttgcaaatattttatttcattttataggttgccttttcactttgttggttatttaatactacccaaagcaatctacagattcagtgaaatctctatcaaaataccgatgatattcttcacaggattttttttaatcataaaatttgtatggaaccacaaaagaccccaaatagccaaaacgattctgagcaaaacaaacaaagctgaaggcatcacactaccagacttcaaaatatattacaaagctgtagtaactaaaatagcatgatgttgttataaaaacagacacatagaccaatggaacagatgacagggtccagaaattaatccacatatctacagccaacatttaatttttgacaaaggcgccaggaacagtcattgtgggaaggacaatttcttcaataattagtgctgggaaaacaggataactatatgcagaagaatggaactaggtccctgcttctcttcctacacaaaaatcaactcaaaatgaatcaaagactgaaatataagacctgaaactgtaaaactactagaagaaaacatagagaaaacaattcaggacactggcacaggaaaggattttatgaataagacctcaaaatccaggtaacaaaagtaaatataaacaaatgggattgtatcagactagccactaactttactatctccacactttttttctctataatgtcatatagttggatactttatttttaaaacatatatatcactatttgtattatttacatgttttattatttatttttttctccctctagaatgacagctgcatgaaagcacagtcattctcttactttttaaatgtcgtatcctcagtgctagactatgattgtctcagaaaagtcctcaataaatatttattagttaataaatgagtaaatcttccctccattataattactctcatccttctgctaacattagaaactggtcgttggaaatacttacatagtggcaataacaatattggttgtcatttttattatcttatagatgccaggcactgtggtatacattctaagtgcattattttattcaattctcagaactaccttctgaggtaggtaacatttaacaggtaatataggtagtatataagtagtcgagatattttttaggtacaaaaatgagattcagagaagttaacttactgaagatcacatatttagtaaattgcaaagttaaggcctaaattcaggactgtaggattccaaaggtaacagtctttattattattattattattattattattatacttcaagttctggggtacgtgtgcagaatgtacaagtttgttacataggtatacacgtgccatggtggtttgctgcacccatcaacctgtgatctacattaggtatttcttctaatgctatccatctcctagtcccccaccccctacaggctccggtgtgtgatattcccctccctgtgtccatgtgttctcattgttcaactcccacttagagtgagaatatgtggtgtttggttttctgttcttgtgttagcttgctgagaatgatggttttcaacttcatccatgtccctgcaaaggatataaactcatccttttttatggctgcatagtattccatggtgtatatgtgccacgttttctttgtccagtctatcattgatgggcatttgggttggttccaagtcttcttaaactgtatgttggaatttagagtgagaggaaagtgtatagctaatccactccactctttggatttgaaatacggttgcttaatctaagtgccttgatatttaactctagtccatttaataattacacatctactatttgctgtgccatgtgctctagggttatcacctgacttttcttagaaatgcagacttttagctgtactccaggcctactgatgcagaacctgcatttaaacaaaatctccagcagctttgtatacatgagatatgtgtgtttgagaaacactgccctctaaggaatatcaagacccaaaactcccatgtccttgactagtgagcaaacaaggatcttagcttttagaataccttgcactttaggaggggtcatagttactcatgcttatcacacttgctagcactaatacacacccagaattattataaattatacaagcaatgaactatcagccagctagtaaggcagatagtgttgctgagggtgaacaagccagcctctagcccctcgacagtataaaatattcttttccaataatgcatagacaatgcaatttctttttctcttgctgtgattcactggtggcgtgggcatttggtgtcatgttagcttttctaactgtagttgtgtagagttctgttataccagttagactgtagtacatctgcaattatgcagtaatgtgcattgccaggaagggctgatattttactacaaatcacagaagagctactgcatgtccaccagggaagttgtgggtggtcaatcttagcacatcttgaggctgctgtgttcttacaatagggaacaaagtgttgactgttttctaacatctctggtccaaacaaacccaaccttcgttacccactttacagtttatgagcatttatttacacaagggaaaatgaattttgatactccaggtatgccatctatcccagcctgtctgcatcaaaatgccagattgtcatctccagtttaggccccctctttttctgctgtaagttgtatttcagtctgaggatgaattcagcactttaatcagtgcatttgttttctgctttgtcatccacgtaactggcaagtctggccagggcactgtttgcagatgaaatctgcctgtgtctggaatgcagagtggccagtttctccgacttttcttctctttctcagtcaacacagccactctttccatttgttcccagttctatgcagactataattatgtatatttcctttcatgccacttacacttgtacatttctgcactagggtgaatgcaattattccattttctccttttttcccctttgtggctcaaactgttgccttgttctttctcattgattcctgcactgcaaaacagtcaaatggaaatacaatatgttgcacctgacattcatttaaatcacctgccatgatggtaatacatgctggtgatttcttagtgtactagtcaatggaaaactgtattagtattgcaataatatgcctatatttgctttttctggaatatactgtggtttggtgcgtgaacgattcaatagaattttgaggatgtagtgggaatgagtaataacacttcactcaatatgttctttaatgttcaaatcctaacagtcctagcacatccttttgcccttccaataagttagggtaggaattaactcttattgtgcactctcactactcaaggccctggactaggtactctgtatgtacattcttagtttcacatatatttttgcgtaatccttattagagattaaaattttaacatatacatatactttattttacaggcaagggacttaacattcatagaattaaggtgaattttttcaaggtatcatagctggtcaatgacagaatgaagatttgtttgactccagcatttatccactttctacacactatcttcctctttgcaaagttttaaattccagaaagtttagcagcctccttgctatctgatgctgattaattgggtggaatagagtctattttttaaatctcactcaaagtattcactgcaaagctgccgtgtgtaaataattgtgtgtgtgtaaaatagatgctttctgtaatttgtgagtaatgtattatgggtccaattgcattttaagaatcttttagcttatcctaaatcctcatggcatttttaatctagttttcattgtgtgtcagtaaataatcctggtgagcaagactaaagatcaagtgctagccctggctttgccatatatttgctttgtatcctagggaaagacatgtcaagcctctaaaacttagcttatttatctgtaaagtagagtaatacacataccctattcacctcacaggattgttgtatatgttgaatgagataatgaatatgaaaagcttaggaaaccacagtcatacatagaaatgtatcattgtaagtcaataggtgtttgccaggtccatagcattagcctacgttagacactgcactgaggaggctactaggatttctttgccttcaaagaagttaaaatgtagacaaacaaaaaaagtagtcattgaacagtcttgacgtttcaataaatttacaaaaattactcattgttttcaatatcatcagcagttaattctcaagtagagtaggcatcatgagaaatgctattatctaatatgttgtaattcacattttaagagtatattatattatattatattatattatattatattatattatattatatttttgagtcagggtctggctgtgtcaccaggctggagtacagtggtacaatatcggctaactgcaacccccgcctccctggctcaagccatcctcccacctcagcctcccaagtagctgggactacaggcgtgcaccaccatacctagctaatttttatatttttggtagaaacagggtttcaccatgttggtcaggctggtcttgaactttagctcaagtaatccacccacctcagcctcccaaagtactgggattataggtgtgagccactgtgcttggctttcaaagttttttaaaaataagtcttactttactatgtcttgcattcaacttgtcaaattgttacagtgaaaaatgccttctaatctaccaagaccaagttcaaagcctaccacttactacaacaatgattttccaagtgtggtccctgcactagcaacatcagcatcatctgagaaattgttagaaatgcgaattcttgagtctcaccccaggcctactgagtcagatactctggggtgtagcccagcaatctgtgttttaataagccctcctggagattttcatacatgttcaagagtaagaaccactgctctactaaaacctcaaggtataagtcagacgttaagaactcaaaggctcaccgaggccaagaaggacacatgaatgagggaaaggactggaaataagattatcaggagtgggaggaggaaactgtgttgaattggagagctgcccttgcttaatgggagcagctagtgattattctagacattggttcccatttaggaatgtgaagcaggtccaaatataattttccaaaagctgaaagaaagcatgactgtcttacaaatatacagtgaacgtgtcaaagattaatttaactcataataagaatttagtaagatgacagctggttcaaaggagaaaatgagaggctggaatatttatacagtcaacagaaataagaatactgagagaaaataaagttagttaaaaaattggttaataccctacaaggaaacaaaactgttacctatggagttatttattctattgtacaaaaataatttacaatcactcaatcttctacaagttggcatctaactttatagacttttaactctaatcagtagtacacagtaaatgtaacaatattgcatcactagagtctagggcctagacaattgtatgagtcttaggcaggtatcttagtccattttctattgctgtaacagaatatcacagattcggcaatttataaacaaatttatttcttacagttctggagactgggaagtctaagactgaggggttgcgtctggtgagaaccttcttacggcatcataacatggcagaaaatatcacatggtgaaaggacgagagcatgtcagctcaggactctcttgctcttcttataaaaccaccaatcccatcatgggggcccaactctgtttaggatcagaccttatctgatcctaattatctcacaaaggcctcatctccaaaagccatcaacgtatgaatttggggattacgtttccaacacatgaaacttgggggacatatccaaaccatagcagcagattttttagacaatattctattatgactgaatgagcatgctgtagtccctttgtctcatttttgtcttatttccaaggcctgggtgattttttcttaacaagcaagtgtggcagaccttctacttttaaaggaaaatggagatcaagatttatatgtgaaattttttctttaacaaatataggctaaataaagtgtgcttgaggactggcaactgtggattgccaccttgcaaaccaggtaaaaccattattgagtgaatgtgtggactctaaaactagcccattcatcatgtgatgacactcattctattcattttatccattgtgtccagttatgcaccccgtgtttcactatcaaagcctgttatccaacttttgaaaataggcagtctcctgttcaaatgtccttaccagacatttcaagccccagctccactacgttctttggaaaattttagcagatttgctctttttgcataactttactctaaccgacaagctgcttaccctcttaatatttaagcaattcaaggcaagactaagaatgaaagtgtctagacaaagtaagaccaaaaccatttaaatccttattacaatattctcaggcagagtaatgcaatttgaggatttttataaaaagaggaattttttttcctggtttttcctttgttccagagccttctaccgtttgagccagtatctttcaagcctcagagggagggcagaagcaacccagaacaaagaaatcaatgcctagctttgaattgaaaaatgaacttttaaaagtgcaccgcagaaaaaataattttgaaacccaatgcaggcttcttgtgagattgtttttcggttcgtttgtttgtttagttccaaagattgactttgctaataaagattcaaagtttggtgaactcccaatttagagtttgttcattcattcattcactcatcctacaaacatttattgagtatctgtaaagtgccaggcactgggtattcagtagcaaacaaaataatgtgttctcatggagtttatgttccaatgggtggaaatgagcatatatcagcaaataaacaaatagtatgtcaggtgataataagtgctgtggggaagaagaggcagagagaaggagaagagggtcacagagggcatagggttgctattctacgtatgatcatgagggaagagggtcacgcaggtgcatggcagttgaccagacctgaaggcagtcaggaaaaagatatctggagtctaagcaatggggacagcttgtgcagaggcctgaggcaaaagagcagagtgttagagaggaggcaggaagggcagataatatagggcttcctgggtcaatatcagagctttggattttattaagaatgaaggggaaaccaatgaaggattttgcggaacagaagaatgatgctatgttacttgcattttaaagggatcacatggctgctgttctgaatataggttctagagaatcaaaagaggaagcagatggaccagtgaggaggcaatcacagtagtacaggtggaggatgatggtggctcagaccattattgtaatggcaggcaggtgaggaattatcagcttctgtatgtatttatcatagtcagtcagaaacgtgtgacatcaaagcagacaattttgtgcctaatgggcaggaaatagcactagaggagctatgagtcgagctgaggtgtactgagtctccatgaaatgctcaacccctcttccctttgcttgataccaagctctggagataaagagaagatggagacccttggagaaatttgagggaattctggaaagtggttttgtttttgttttgtttttttctgcaaggacaactatgccctgtgaagtatcctgcatcctgcatgatattatgatggtagaggagcaacaactgggcgaggagcttgggaagatggacaagagtgttgcttctcaaattcctatgcatcccgcatggtgaacaactaaaagtttcccataaccctaagaaagaaacaacgataggaggggaaaaaaccagcagaaaagaaggatctgtgactaggatcaggaggacacagtttgcaaataccactttaccaggacccgtgaaagggccagagatgctggtggcagtagacaaataagattggattccaatacctagaaccaggtagtctgaaatgtgctacagtgtacaccagcaaagacaggggcaaataacgaagacataatctcttctcccaaaaaggagggtttatcccaacagagctttgtaaaatgtgtgcaatcttcatcaacaagacaatactgataaaacaacttcagacaaaatgtctgtttactctatcaggcccgagttgaatggggagcaattataattctagaattttgaactaggtaaaagtatccaggtatacagggctacttgtcctaatagagatttttttttccccctgcctaacctatttgtattgcctacacagcctgtagcaaaacagagtagcaagagtagtcacttataagtagtttttcttataatttttttttctggttaaaccactgagattatgtactgtggcaaaaaaagaaaaaaaatgcttagcttccaattttatttgtggtaggaataatctagtcccagctttccctctacccatacccttccacccatccttccccaaagtcttcagattctccatctataacgtgaagggcttgtgcagaaaataattacagttcctttaattctaaacatggtggactttctattgccacgtaagcatttccaactataccatcccctttcctgtcactcacctcagtgtctggcacaatgccttgcttatgttgggtactaaatatctttttgccttatgagtaaatgatgcatgagaaagaagacttcagcctgagcccactgtagggccttgttgaggtaaagggcttgatgggccttggcctgaactccattggaaccagattataaataagccacaaccagcttatttcctgtctctttttcctcagtgccaccacttagctactttctggtttagtcctttaggaaaaacaataagcacctttctcatttcttctcttttccttcactggcagctgttttaaggcattaaaactgggagccgagcatgtccagaagtgaaagattctctcatgatgacaaattgagtctctatttttaaaaaatgtatgtaagagtgctccaactggtcatcaaaagggctaattagaaacttccaatccccaggagcactcaagtagaagacggatagaagacacttcttagagcaacactgctgctttggtccgactgtgcctatgaaggaactgggttttgcctggtctccatagataccgccttcttcactgactttatcttagactcacactacttgtttccaatacgagatagcaaagcatatgaatagaaaatgaagagaggtgacctgattggactgaggaaggcaaggccccttgaggagacagacagtttggtgttttgttagaaagtgatatgcatgggaggaagagggagagagagaactattcagagaactgtgtgagcaagggggagcagaacaaggtttatgtcaagaacagcaagctatcaggtcatcactgtggctggagctgtttttttgtttgttttattgggacagaaacttaagttgatggtgccacttttgagaggtttaaaatctaaggccaagaagtctgtatttcacaaaatccataattcaagaaaatgtggcaaggtccatgtgattatctgctagatgtgtggtacagagaggagtggaacatgagtaattgtgatccaaacctccatctttggccttgaagcaaaaggaagtcattcgttttaaagatggatgtagaaataatttctgttgataatttttgggcagcacttgacttctatggggtttttgattcagaataaatacttacctacataatttcatttatttgttctgctgaaaaatattgttttcctgctaaaaagaaaaaccttcaagtgttcataaacctttctgattatctgcagttctactgatatgttcacaaaaaaatagggataaatgaattcgaaatgtaggaatttaatttcctgagaactatgtatgttttctgaatgaattaactatctataaagtatgacaatgtgcaatgcagtttaggctttacaaatttttttcatggtttgaaatttttctctttatctgtgttctgattttatatatttccctggttccatacatatactggttctagaatgaatcactatggtgtctagttttacactcattaatgcatgaatttgatatctgaagcctgagttttaggttaaatatggtggtagggtggaaagagcaaaggactttgagagagaagaaccaaggttgggatccccattctaccacttcagagtccagtggcccttgagcaattaaaaaaaatctcccaagatcatttttttctcatctgtgtagtagtaaaaacaataccaacctccatcttggtagagaaggaagataagagtttctctcacaggtgctgaacaatcactattcttccctcttctttttccataaaatatattacttgcttgcatagtctttctcctaaaaattgtcattttctctgaaaagtcctcctaccgtgtgaccttaagaaagtgatttgtgtcctccgagcatcagtcactctttatgtaaagtgagggactaaaggagattgccaggggaccttacttcgattagtgtcattcagtgagtttgggggatttcatctacttcttgactccactcttccttgactgtccatttcctccctccatcccatgaatcctatagggtttcagtgtgacttacataatgggtgttctatatcagacatcctggacttgctgatgagatttaagcctagaaataagttgatagaatttgatgagacctactcatggagcaggcagtgtttttcctcttgttagctaactttcttttccattccaaaacattgtgatttgcaagtctttaagaattttatatcttctgacaatttagcacaacctgctcgtataaaatggtgttatacaatccagtagcagttgttttctttttttaaaaaattttaggacttttttttttttttgagatggagtctcactctgtcaccaggctggagggcagtggtgcaatctcggcttcctgcaaacttcgcctcctgggttcaagtgattctcctgcctcagcctcccgagtagctgggactgcaggtgcgcaccaccacacccagctattttttgtgtttttagtagagatggggtttcactatgttggccaggatggtctccatctcttgaccttgtgatccacctgcctcggactgccaaagtgctgggattacaggcgtgagccaccacgccttaaaaataagcttaaaataagctaataaagtgtgaaattcttgaccatgctgatacagtttctagcgacctctgtcacacacatccctattagtctcagcacttgagtattctgttatggagctcaagaagtggtcacaaatacatacaacaggtaataaggtaagatgataatatgtttcattcttttactctctagaacaaacattataattactaatttacctctcacctaaagaaaaatcccaggaattccagcgtgctttaatgtagtggaaagtgaactcaaataagaagacctgggtataaatactgtctcccagtttctagctgtatagccttggtgagttaatttgagttaattttctgagctttaacatcttcatgtataaagtaggaataataaccctggtatcccaggatgttgcatggattaaaagagttgatatatgtaaaataacactgtaaagtctaaaacacaaaaattagcattattataaaataacttctttcttgttcctaacatcgttactattattgttttaattttatttaatttttttatccagatgctgaattctttaatatgccactgttttataaaagaatttctttcttgttcctaacatcattactgttttaattttatttaattttttatccag

SEQ ID NO: 2915 - DNA, 710 bp, Homo sapiens
aatcactaatgacctcatcttcaaatggtcagtgataataaacaagaaggagggatttccaagggagcagagcattaataaggttttatctactacaaaggatatcacttgggaaggaatttcttgaaactgctcccaagagagccattggaccatgtggtaaacaactcctagctgatggattattgggtaaagataaacctggatgatcccatgctcagaaagtttcctgattataatgaataagatgtagcagtggcatgcccaatattccatagtatgctatgcacaaatatacatcacctttgtttttgtggatggcaagctattaaacagaataggaaagaccagtgggttcctgatgggattagagcagtaggtaccacgtagtgattctgacttcctctgggaatagccccaccctgagttgaagaaggctatagcaggcctggtatacagaaactaaattatgtctacctgtatcttgtatggtggactcagcattttgggtacaaaatgtgtattttagttgcactcaggctgttagtacccaatggcaacaacatgaatggtagaacacagcactggcctgtgagacagaaacatgctttaggggagacatcttctagttgaggcttcattggatgagctgaatttgcttttagtgaggagtggcatttggagaaaaagacttattaactagaatgagc

SEQ ID NO: 2916 - DNA, 5560 bp, Homo sapiens
caggacggaaaggggcaggtgggcagggatagaaaagtgagtgctgagtagacgcttctctccttaccagaaccagtaaccaccctgctggctgctcctctaatttgccctggcacaaggacagaatgtgttctgctgatacacgtttctaaagcaccaagcagcctctgctgacagctggcttggttgctgtgtcaatgcagaaaaagtgagagagcaaaagaatttgctcacctgaattgcctcccagagaactgaaacaaggcacagatgttcactatagaaccaacatctggaatctttgaaaactaaagatgggaggaatgccaaaactccaaactaagcaaacattttcctggttatctaagaacagaaaggacagattctgtgaaccagagttcagtaagtttgatatacatgttttcagtattggttcttgaaaaaatttgtgatgccagcatatatcccaaaagaaaagtcatgataaaataaccccattaactttctttaacaaagatattagacagtggatagaaaactgacatagatacatcataatttaaattaaagaaggtaatgatacaaactcttttgacatgtttggaaaagtgtcaatggtgacataaattttttgcagtaaccaaactaatgggtacgtatcgatagattaataatctagagggaagccaagaccatgtgctgttgaccagtgagttgaaggaagacatggagacagcctcatcaagtgtgtagatgacactttgctggagggatatagcaaatacattacatctggatttaaaaagatctccaattaatggaatgaatgctatgatgaaatcaagagatgcaatttatcatacataaatataaaatcatgcttttaattttttaattgcaggatacaatagtccttttgtggaaatatttgatctgaaaaaagaccagacagttcagttgaccacagtatatgataaagctgtcaacaatgctaaaatgtactatccggttacatgagctgatacagtatctgaatccaggtattggtggaagggattatcatactaaaatttccaagtcagataacctgtggaaaagagtatcaatatacccactggaagagggacattgacaagctgaactttattcttaaaaggtcaaatgaatttttagacacccaaaatgtgttggctcatgagcatttagcctaaaggagaaaataataatttcactaattatctataaatatgtgatggcttattttatgaaaagctcattctgagtttgcaagacactaaccaaagaccacagtgagaaagtacagaaagtaccttaggtgaacacacaaagagcccgccctagtaaaaccatctcatcatgggacatcagtgtcccagaaactatccagacagaagggaggaggtcaagtggagatcctacaagaggattccttcatttagtgagaagttgcacaagcttttgttctaagatctccaccactttatacttccataattttatataatcaacagtatctagagacatccagctgtgtagttaacaagtactatttgttaacttgtattactcagacctcagttgtcttcttatactgtccaagcaaattaagaaaagctgaggtatagttgaattatttgggtaatagtagctataaaaactcaagtagaaaagggggtagtcacaacttcaaatttgcaataaaaaaacaagtttattgtgaacccacaaatggatctggctagtattgtattttagtaagaatcaagagtgaataataaaacagctctgaaagtgacgaaacaactgtaccatgtaatatagacagtcagaaataaactttgttcaaacaaaattctatttgagttccacatacgtggcttttcctattctgggtctcaaaatcctaccataatagacacatagaagcagcctagttcaaatatcaatttcattagattctgtacttctgggcattatgaaggaaggattagtagagtggttgagagcctggaattcattaacttcagcataagtacatactgcaatctccaagggagttctaacacattttccagtcatcctcatataagggaccagtagaagtctttagcgagaataattaagggaatatttcagaagcatttctgttgtatacaaggctggtgatcctcttccgtgtgtctgtgcaattcttgtcctctgttggtctctattgcggtaatatttccttctttcaagagccttattattataagaggaacttttaccctgttacatgcataaagttaaatttacatacaaattactacatatcaactagtcacaaagcacaaagtgttgaaaaaaacttttgtaagcagtctttgcttacctctcaaatgctttgcaaaatgtctatgcctttttttttttttttttttttttttgagatggagtctcgctctgtcgcccaggctggagtgcagtggagctatcttggctcactgcaagctccgcctcccgggttcacgccattctcctgcctcagcctcccgagtagctgggaccacgggcacctgccaccacacccagctaatctttgtatttttagtggagacagggtttcaccatgttagccaggatggtctcgatctcctgacctcgtcgtgatccacccaccttggcctcccaaagtgctggggttacaggtgtgagccaccacacccggccgtctatgctttcttatattattaatttttaccttgaagttgcttttctatagtttgttcactgatacagccctgctgcctaacataggggccctttgttccccttgatcaatattctgttctccttggattttgcatgaattcatcctgctgttcatccctgttctaagcatggatatattctattcccttcaatgtgaagagaaatctcctgattgggggctgcattagagaggaaaggagacctccaatagaccaactcggagactacatgataccctatattacccattacccatcaattgccctcctggatggtggtggctcaatgtattgcttggtttggttttcctttatttcatgccccctgttctatgtactaagcaagcatgaaaataaaaggtataaacagaaaaatacttagagaaaaaatttaaattttttccatactatatcataggtaatatggtcctacacatctaagatattatatcaagtggctagttagcattttcacagggaaactccatttcactaagtttgacagttgctttgacctgaaaatcacttccccttgaaaactactgaacttttctcctggccatgatcagagacctctagtcatgcatcttctgtactttccctattatcactgtagccccaacaggctcagtgtccttgatgagttggtgaaaggggtacagaaataagaggtcccatttctcctgccaggctactttatgagcagacattatgcctcaatcttttgtgccttaggatctgttttctcataaagtaagtgtagtttatttaccatactcaagctctatgcagctacagtttgagttaaatagggtttagaagactgtcatgacaacgtacatagcatttataatgttatttctacaggggaatgtacccttcacttcaaagaattgatttacaaataattttttaatacataattatttgcaaattgatgagttgtacttacagtcttcaaaattatacgtacaccacagacatgctatggtatgtatttttcctatcagagagaactagaaagtatctttcccatttgagtgtaactaatatctaatttttttttttttgacagagtttcattcttgtttccctggctggagtgcaatggcacaatcttggctcactgcaacctctgcctcccaggttcaagtgattctcctgcctcagcctcccgagtagctgggattacagccatgggccaccacgcctggctaatttttgtatttttagtagagacggggtttcaccatgtatgtcaggttggtctcaaactcctatacctcaggtgatctgcccgcctcagcctctcaaagtgctgggattacaggagcgagccatcgcacccagccctaaatatttttaataacactaacttaagtccacatgatctgtaacagtaaagtatcaggtattgtatacatgttggtttattttcttcaacttgtcttgactcacacaccattttcacaccttgctgaaagtgttgggtgtcaataaagcaagatacaaatagatttgattcatgaatgtttgagctcaaggaacagacacctcctggcacctgtccataggtgggacaggtgatctattgcttctctgcaatagtctgtctgactgcaaaaaatatatgattgttgaaaaggtagctacttgtccaccttgaatgggaaaccttgctgacttcgatttcaggtcacaaaaattgttcggggttctactttttctgagatttgcagagcgctgcctaaagagcatgacttggcacaaagctcctttatttcagatttcatagatttgctgtattcagtatcaaaatatgctgtgtaggtagccaggaatattgcacgttatgtttatattctagttttgaccaatttttctaaacgacatcatctaaacttgccagttggcctaatgagagttaagagaggagaatctaaggaatgtggctttcctcaaaacaaactgaaaggtgaagtcacaaagcacacagtgttgaaaaaccttttgtaaactaataacaacagctgcttaataaatggcttttgctgggatggaggagggagtgcctgcctgcatagctctgcacacaggcaagtccatctcatgttaagtcagaggaaattcaacaatgttatctaaaacatacaaagggcataaactgatataactttaaatcaactgtgtaaatattcttaagtagatattaaaaaaatgttttcttttgtctaaactatgaaatatggaattgggtagctttcccatttccttttagattgtttaggactcacactacttctatttcctgttttttttccttctaatatgaactgtagaaatacaagcataaatttaaaaaaagaagaaaaataggctctggtctaactcaacgtgtattatgacttagccaaaatcacgtatacgtgatgaaaattaacaagaggtttccatctcaggaggaacatggtgtttcttttgactttgcattatgtaacatgataaaaggactccattttcctaaccttttctggccatttcaaaccacatttactagctaatattagttactgcttgtttcagttttttcttacatgtgaaagtataaaagcctccaggaagttaatattaaagttagatgctcaaatatacattgatagaacagaattttggaaacaacttgattaaagtacaatcatatacattaaaatttaatgagaattcaaacagaaaaaaatgtaagttgtactgatgaaaattataattgtagtgttaggtagaaattcatt

SEQ ID NO: 2917 - DNA, 2205 bp, Homo sapiens
gttttgggaccagggagggagttttgaccccttcagctctatatggccaagagtggttatgcctgagacggtgggtgggcctgcccctgtggggcacatagctggggaagagaggaggtgtgggtgaggatggagccttcgagagctctcttttagacgccagcagaggaaacagttataagaagaggaaactcagaccatagttatgaatttagaatctgcatttggttttaataatttacacacagtgagtttcccaaagagatggagaagtcaactgtttggaaccaaaaagccaaagctggaaagaaccacagtgccctgagtcagttctgcatttgatggacagatggacgggtctcttgagtccactgaatttccatttcatcacagtcaccctcccggcggcgcctcccccagaagccgttcccaggggtggtgatgactcaggctacgccacacattcaccttaaccttcatgagaccacaatgctgcagatggctgtgggaaatagaaggtactgaacactcaacaaggaggcgtgcaatttagagtagttttcactcatctttagcatgagtgcttaaatggttgtaattagaagggatgacctaggacctgtgcggaaagtgtgacttaatattttaagtatttttgggagctattaaaacaagaaaagtgttctttactttgtcaaattttgcttttttcttttccttgatagaactcgatcaatgtcttagctattatataatctgtcattaaaactgtgaccttgggcaagttacctaactctccctgatttcattcatgaaatggagataatagtatttgtttcataaggttcttatgagaacaaagtgacgtgacatgtagaaagcccctttgtacatattggcagtaaagtgtagttgttatgagtaggaggaagaaaggggaacatgatggtgtttggtgtctttaaggaagagtgaaggaagggtaagaaggcacgggagcatacactggccacccatgggtggtgctcacacctggcagttggatgtttgggaccggagatgtacctaacttagataacttgttgtgtgctctacgctctagttgttttgttcgggtttcctgcaatcagacatagctggattgtaggatgtcatgaaaatggtgatagtaggaaggaaagtagttataatcctgtgttggattaaaaagatcatcaactttgggttatgaaaaatgtagtgccacgaaagtatgaaaatgttaaaacttagaaacataaaataacagtttatgaatgcaaagcttgggaaatgaattatgaaagtctactatgtttttaggagcataagacaaaatgaggaagacaaaacttaaggaaaacccatgaggggatccagctgaacaccggatcggtacacactaagaaaataactgaaactcatgtgagttcaaacgcaagtgttaatgctttttatcaagcaaaagatatcaggatgggtaacactttgcttcccaaactctgaacatcacaaagggagttggggaatggcctcaggatgtgtgttaggattatcaatccctgtgcccttttccctcccatctttctgaaatctaatccaagggttgtcacacttttggacttcacgttcaaagaacacttcaataaaatttgtgtggatcaccataggtcgccagcttttagttctggcaagcaagtgctttttaaaaaaatctgtcatctcttatcaccattactgcattaaaaaagaagacatttaacatgcacacatgcatatacctacacacacacacacacacacacacacacacacacacaaagaagagcataattaaagacaattttttgatcaagtaaagttatctttatgagaaattttctttgttgtcttatcttttcttcttttcattgtggactgttaaaataattgtccacacaagcacaaacacagacctacagaatctggccagaatttactaagtactggtccagctgttgtctacctgctcccaggtgaccagcccaggacagcttgggagacagaaatcctgccaccttcgctgctacaaacgcagggctgaaaagaccaaccctttttccggaccactttgtggcccaagccaagttatcaaaaggatctttgttgccaggggatgtttttttcttttctgagagtaggttgggt

SEQ ID NO: 2918 - DNA, 4874 bp, Homo sapiens
cctctcagttgctcctgcctgagcatgctcctcttttccatctgtgttgttttttaccccagcatactgttggaagggttgctcgaaggcatttgactgaagggtacttggaaagaccaaacccaaaccacagtagtgaccagatacttagtggcagccccagctgcagttatggcaagaagtggccaaggaggggaatcaccatgaccacagaggatgcagtgggcattagggacctggcatttgctgtcagaacaatccagtcagggtaacaggtggtgttgcaggagatgggtggagcacacagcagggatttggggaacaggagatccatggatatctacacatgctgacagctctcagcatcgggttatctggcagctcagagcagttgctttgcctggagtggttgggtactcagcctggctgaggcttgtctgggagaactttctctgtcattgttcatcttgatctgtgagaagctgtaggtgcccctaaggctcagtgggaagataaaaccccaacaagttggtctggaaaatcgaagaccagcaagtgggaggcagctgtatggaggccaatatgcagacaagggaagtaactcaggcattttgggggagaggtacagaaagaagagaaaagactgaactgactgctgttctgaacaagaactgtgactatatgtggtactcccagaatggtgaggtctgggacacttgaataatatggctatactgtgaatgatgttacctagacagaatgtttatcccagttaagtgataggtagggaactaaggtatcgagggtctcaggtataacgtcctgaggggtcccatgaaagcaaagataacaggtgtatcttttatgcctcttagagctgtacgaatgctgtaactcagggatctataaagccctaagtcaagcagaggcacaggtggaaaaaggggcaaatttgataacccagagaagaaagcctggtgatcaaagcaaggagacaaacctgaggctgccatcaggtgctgaatatgaagtgaggctgtcaagggacacaaggtattcagtagcggatggggtgtgcacagagaggaaggctggacaaatatctgaatcagggccatggcccagggctgatattttctgaaatgcctaaggcatgatatgtgagcaggccactatagttagagtgacacagacagagtgacagaatagaacaaacagcagaatcagtttagtgttgagtgtgttcatctggttagactaatttcctagtcacaaagataaaactgagaacatgtttttttcctctagccaagtggtcctttacaggcagattaaagacaccagctatagataaacatgaaagcagctttactgctacttcccttcgttttcagttctggtgggcaagtaaggagtctcccgctccaagagagagtaaaggtttagagctactcccagcagggttcagggcatgcttatggcagagaggagacttgccttcccagcctcctgcaggccctaggatgccctgggtctagccagagaaggacaacagtgagtcagcaagttagaatgggtttaacagtaacagccgggtggagttcacgttctgtttcctcaggcttccacaaagaaaaccagagatctcttatgtaggactaaccaagtataatcttgtcttactgagtatagccaagtattcacagtttgggtcactgtgaatggaattgttaacagtggagaattcgtacgggtcggcagcaacctcaatcggggcataaggcagagggagagacccaggcaagttttagagcaggagtgaaagtttattaaaaagctttagagcaggattggaaggaaaggacacttagaagaggtccaagtgggcgacttgaaggacaagtgtggtttgacttagggttttatatgttggcatacttctggggtcttctcccctgattctttcgttgagggtggtttgtccatatgtgtagtgacctgctagcacttgggaggtgagcatgcgcagtgtgtttactggagttgtacttatgctcacttgaaacattcttccctttactggtgacatgcccccagaagatcaaataccagttaaactccgccattttgcctcttggtgctcatgtgtgagtccgcacgcccaactcctgggatcttatcaggaagctgatgatcaccagtttcaggtttcttctatctatagggagactgcctttccctggagctggctgcaaccaattattattttagagagacagttaacaatggcctgaccatcacccgatggtcgcctgactttcccggtggggtgtggggaccctcttctgtcctgtttgtgtctgactagctacctactgtaacaggatgaccatataatttatcattcaaactactagacacttttgagagtgaaggggggcactattagttatgttggcaaaacaggtgtgaatgtggatgtctctggataatcaatatctacagccatccaactcatatatggtaacccaatcctttccattttttctaaaaagctagccatgctcttaaattaaaacacagcatttgagtctaaagtcggattgccagttaaaatacaagatgctctgttaaatttgaatttcagataaatgaatacttgtaagtataactatgtcctaaatatttcataagacatactaaaaattatcacggtttatttgaaattaaaatttcactgggcattctgtattcttatttgctgctgacaaccctagtctaactagggttagactagtttaactagtctaaagttaaactactgtgttgtattcaattctatcatcctgcttatgatgtaagtcttttaggctccaaatgatttaggacatagtctggttagcaaaaggagaaaattgaggcatctgttccaattggaccagtcacctgagccactaaaatcagctttcttaaatgtctctgaactaggaatacgctgggactaggtcccagtgcttggggtgagccaggccagcaggtgagtgtcctcagttgtgggacaaggagcttagtagataagcatcttctccctgctcgatgttcacctttgcttgatctcctaggccagtggttctcacccctggctgcatattagaattgcctggggagcttgtaaacccactgatgtttgagccccactccagaccaattaaatcgggatctccaggggcaggctgtggcatccatgggttcccaaaagttcccaggtgattttaaggttctaatgagaaccattgtcctatgccctcgctctgttcccagtggcatcagttcttgtttaattcttctcctttaaataccctctttgtagtattggacattttatagcccagaaaatatgactggagcacctgttctgtgttaaaatggcggcatggatgggatttgcccggaagggttccttgtccttccatgaccttgtcttgtgctgactcctggctctctccaagcctcccttctcctctctcctgcttaagcctctcttcagctttggctttccttgtctcctccttctctgtttataacatgtcaatttccattttgcagctggtttcctttcagacccatcaagtggccatcctattggcttggactgaagacccccactggagaactgtctctgcagcctatactgatgacactggccactgtccagggctccaccccaaggagtccaagccccagacatttagccttagagagaatccagattttgcatttccagtgcagggattgatggagccttgtgtatcaaagtgccaatttctttctaacaagctagggaggataccgttgacagcagcagaaaggggtagcagtggtttgctttccaaatggtaataagaagggcctggcagtggcaacctgtccacgtatcattaaaaatggactctcctgcttcgtttggaattcaacccaatgaacttgaataaactctggacaatgaccagcacagagccctaagcaggatacagcaagattatttgctttactcatccactgagtacctaccatgtgccaaatactatgctatatgccgagtatacactggcaaataaaacagatatggtccctggagcctatgaatcttaccccatctagccacaaataataaaaataagaagaatctgaaggacaagtgggacagaaatactcaagcagaatgagggtgagattgaagtccctgaacatacagtgccctttacacttgatcttagccaaaaggccgagaagagattacagtgctttttaaaggtagcatttcacccagccaataatcaatccctttggccttcttgaggtgcaaggccacacactcaaattctttaatcaaacaataggctagtgcaaatggagctatttcttaaacccagctgtttacacagcagctacaaatctgttcagaaggaatcccccaccatccacaactgtctatcgagcagatgtgcaagagtatttgtctctcaccaccagggttgcagtcaggacaagagagcaggtttgaacgtcttcggctcctagaactgcacaagctgtgtcttcagtgcccagaggcggctgcaacgtctccccagttctcctctcagaacaatggaaattttttttagaggcgtaataggaaggtttgcattgaattattaaacaatgggtattgaaaaatatgttttctttgacctctgtacttctagcttttaccagtcagtgttttcttgtaccaaggctaagatatgtataacactgaaatggatgtcttcttatataatattttacaagcttttgaaaacctgtgccctttaataaattttaaaacgttt

SEQ ID NO: 2919 - DNA, 9663 bp, Homo sapiens
gtttgattgcctcttcatttctataacaactgtgaaatttgaaatatgaaatgagctactgtaaacataatcactacataagaagacagaatctggctttgagtaatagtatgaattgccaatatattgttttattgtactttatttcttaatgttaacttgataagcatatacttaaagattttataaaactctagtgctggaaagaataatctataaattctatcttaaaaaacccagctgattaaataaaatattctgttgaaatgtaaaagaattaacacaatcactttatgaattaataaatttagttttttcttttacaaacacatttggttaattttaattttgctttgaattccttgtggatatatcactttctcttttaatactatacagtattagtacatggaaaagtgaaaggcctgttttatatatgagaaaggtggtatatgaagctgtgaagatgtctcaaatttaaaaagaaagcatttacacagaatgggagaaaatatttgcaaactacccatctgacaagtgattaataaccagaatatataaagtgctcaaacaactcaataggaaaaaaatcaaataatctaatgaaaacatgaagaaaatatctgaatagacatttttcaaaagaagacaaatggccaacaggagatcctaagaaaaagcttatatgttcagtgtgcaataaaaagtgttcttcagcatcaagcctacaggaacatagaaagattcatgagatatttgattgtcaagaatgtatgaagaaatttatttcagctaatcagctaaaacgtcatatgatcacccactcagacccactctgaggagagaccgttccaatgtgaagaatgtaaagctttgttccggaccccattttctttacagagacacctgctaatacataacagtgagaggactttcaagtgccatcactgcgatgctacctttaagaggaaggatacattaaatgttcatgtccaggtggttcatgaaagacacaagaagtataggtgtgagctatgtaataaggcctttgttacaccttcagtgcttagaagtcataagaaaacacatacaggagaaaaggagaaaatctgtccatattgtggccagaaatttgccagcagtggtacactcagagttcatatccggagccacacagatgttgccaagcctttgtcctactgacttggaaaagccacaccttcccagagtcacgatgatcctaaggtcaataattctaggtcagcttacctagtgcaaaggttgattttgtctcagagaagttggtgagcgtccctatcaatgtccttactgtgaaaaaggattcagtaaaaatgatggactgaagatgcacattcgtactcacaccagggagaagccgtacaagtgctcagagtgcagcaaggccttcagccagaagcgaggcctggatgagcacaagaggacgcacactggagaaaagccttttcagtgtgatgtttgtgatttggcttttagcctgaagaaaatgctgattcgacacaagatgactcataatcccaatcgtcccctggcagaatgccagttttgccataagaagtttacaaggaatgactacctcaaagtgcacatggacaatatccatggtgtagctgacagctaataggggctgtaaaggaattaaactattcagaagggctcctaatatgaatcccagatttttatcacctgatcagcataacagaagtagccaaaagtgacttactggtctcatagttcttatttgcctacatttagagtctgtagatgcatatgcaaccaaaaaaaagtcttacttttaacaagaaatggtataaatggaaaaaaaatacaactccatagccttgcaaaatgcaacttgtgctctgtcttataaaaatggagaaaggagtcatggctctctttcttggccatccctctgtaatgaagtttataatatacttccctaataggcctttttattttattgttattctttgtgtgtctgtgtgtctgtgtgtctgtatgtgtctgtgtgtgtgcactcacttgcaaatgccagttgttgcagctggttttaccaatttaaatagaaataaatcaagatatccaactatttctttgcagatgaggataagaataagttatcaaagtctcaagtttgataggaaaataaatagttgctattttataagacaaaccaagagctgagcttatctaatagctctgtgcaacaaatgagtttaaaatagatatttgataactaaaacatctattaaaatattgctcattttagaggattcttaggaaacattatttattctcatcattcagatgcagacattcatggtctggaatacttttataagttctacacaaaaatgaccatcacatttaaatattcagcaggctacccctcttgaatttagaccatttagctttagaaattaacagtataccaatatatataattaaaaatagaaaccaaatagattctctgtatttggcaacagagtggcagaacaatagtggcatctccacatttgttaggatgaacatagccctttcccctctccttccataaaagtgcacagaacatgttagtgcagatacagtcctcagaacattaacattccattttgcaaaagacattttccagaatcttggcagtaggtaattctgaaacacttttgaattaccttcaatcatcccatataattaggaatccagaatacaaagtacaaacttggcaattgttatgattgaaactgtcactgatgcttaagggaaattgaagcaagaagcataatttcttcctttaggttatatttcagcaaaatacttgacagcaacatacaatgaacagcttgtttggagagatgatatgatacaatgtaatagtgatgtcaaaataacctggaggaatatccaaaaaccagaaaaacgttaaaatgaagcccaactcatgaacctctctaactgaagcccagtcaaaagaaaggaagtatagttttaaggaagttatttggttctaatgagttaaggagaaaggttatctgagacacagttctttgacttcaggaatctcattttagaattatattcatgcccagttccagttttaaaaagaaacataaagattcaatgtagacatttgaatgttgtaaaatactaaatttgaaactcagaagagataacttttaaaaacataaatcctaaaattatagtttagaagatatttaagtatagttatatgtagtattttgaatctgaaattatagactgtattttataaaaataaattttggtcttgtttctcactatatcatttgtttcaacaatatatttttagatctaaagtgttttcattttaatatgatagtgtgtttaatatcatttgaatataaaaagacagctgtaaaatttgatagtgtgtattatttaagcacatcctgtatatttctttgaatgctgctttctctatatgggatgctttatatcccgattatgtgatgaatgtaaaacttgaaaggagtccaaattccaattttgtgtaatctcagtgagtcacagttcacatggctgctggggaaattaccctgaaaactgtggtgtcgctatgctgtggagtaaacagacaggcaagaggtgctgggctttatcctgctgaaggtttatagacatggaaatctttagaaaatggtgtagaaggacctacaccagagagtggtacaccactctctcctttcagaggactgaaaccaaaacaagtccttagtagactatttgtatgctgtaaatttttatccaaaagacaagtattcatgggtagtttcagatatattagcatttgcttgctaaaacttttaaattacttagtaataaccaaaaaaagacactattttaggcatgattgatcaattgaaagcatagataatcataaggaaaagtcttacagacaagctgaagtacaggtacctactttgaaatgtcttctgtttcctgctgtgaaagattttggctggggtattttcttgagaaaagaccagacccttaggtgcctataaagtctaagtaattgagacttagaaattggctaagtaaatttaagagacgttcaataatgtaggtgggttcagatacccttttataataactgtcttcttagtatattaacactcaagatgtttgtgtatctttaatttgcctttgtttcacaataactggcttttgttttccttttcatggtgtgttgttggctatatagaggcatttattggtaaattataatcagcagttgcaccatggaagtattcttggtgataaattcttggggttacatagtatagttaacatgttattttcaagaaacatgagtgtgtgtgtctgtgtgtgtgtgtctgaagagtatcacttatatgcagtgcatatacatgtaagtgcattactttgctcaaatatcttctgacctattacagtcaactcatgcatgagtgtgaacatgtattacagaaggtcttacagccttagtttctgttttagattttatgtgctgcttcctttctcaaacaaaagcatgaaaggaaagaggataagtactagaaatattcatttttttccttcacaaatctaaatgttgcttatgaaaactcatcttagagtaatgaatatgtggaagtgggtaggtaggaggaaatgtgcctctttaaaatcctaaaattttaccattgatattgacatttgtttgcgtgtatataaatggagcatgtgtaaatatagaattccaatagcattttttattttattataaatctataataaatatatataaatcactaccagacttggtgttagcattttattttactatagaactatggtaccattctatggtaaaatccaaatgaattgctttaaagttgtttttgatgaatgaaagaaatgtaattgccattacctccagacctcatgcttttatactttatacatccaagtgtttctcaatctgcaaagtacctctgaagttgagccaagttggtctcagggctataagagatattttccttgcctctcttctcattcctggttatacaaagaacaatgtgaaaaggatcatcactaagaatgaatgaaacctggtaactaagaatgaatgaaacctgattagtagcatcttaagtaaaaataacttgatgctcacaaatataatttaagggtaataaaagttatggcaaatgtttcaggtattccttttattttaaatttatgtttatcattttgatgttgccccaatcttgtgagattttcttgatacaaaaaataatcatctgagtagtggatttagaaattatgcattcatttaactttgatttttcagaatcagctgaggcactagttctttggagctgactcatagccttagctagcttgggcttaaaactgtattatcactctacacattgttaatttgttgtatgacagaataaaaaattaactctggagccttcattgtgggcatgttaaaatattctagatattctaggcccaggaaatagtctggaatgtaacaactacttatatactaaaatagtgctgcagatgcaatgtccaaattcctcttcttccttttttaaaaaaattcttaacacaatactgaaacaaatgttcatatttagttagaaaatatatagtatttaatttcctgaaattaaaacatatatttagttacctaaatatttgattagcatgtttagcttcctaataatgcaaacttttagccaattagaataaggtcttagtccttgaacccatgccaccttagcatactacatggtaggaggaaactaatctaagatgttaaattatatcaataatgcatatgtttaaaattaagaaagcatataggaccactgaagcttgatcatctaaatcaatgcaaaacagttcaaacaaaatatcactgctcctgacaagggaaactgtagacctactaggaattagctacacttaaaaaattcaaaaaatatcaatttatctctttaaaatagtataaaaatgaagagagtcccagctcacaatggatacgtgaatcactccattactattttttgattttgtcttcttacagactatctaataatgctttctttccttaattttatctgatatctttttctttaatgtttgactggcatatcttttttcatttttctactgaaaacttttctgtgattatatgaaaattttacattttttaaatgaactgatgttaagatttcttattttttatcctgtctgacagcactgaattgagtgcttttcagtccgcgatgatggctttgtcctgcctttctcactgtctcatcttgcctcatttggatggtggcctgagcttgtattggaggcccttctcaaagagaaatctggtgcttcatacgtagcatatgaaatttatctggacacatgtatagtaatacatttaaagctgaatgagttcattattggaattagtgttaaaacaatatattatctattcattccttagtatctgataaatacataaaaacatgaagtacattgaccccaactctatactttttattttctaaagtaattattagcatctgaagaaccaaaattgcctttaatggatgaaaactggttggaaactaaatgttaatgacatgtgagcaaactatatagttctcattctgtgtaggcatataaagagtatggagatggggagcaatgtgacatttaattgattataacacttttatttaaattggcaaactgatgggtccttttgtggattactacatgtagtaattaagaattttgaggctggacacggtggctcatgcctgtattcccagcactttgggaggccaagttaggcagatcacttgagcccaggagttcgacaacagcctgtgcaacatggcgaaaccccatctctaccaaaaatacaaaaattagctgggtgtggtggcacgcacctgtaatcttgcctgtaatctcagctactcagctgaagcaggaggattgcttgaaccctggaggcggaagtagcagtgagccaagattgcaccactgcactccagcctgggcaacagagcgaaaccctgtctcaagaaaaaagaaaaaaaaaaaaaagaattttgaaaatctaactagtggaaatcaatcattacttttgacttgtctagttttattactgaaatgtaggaaatcttctctagaccttacttctaatcaaaaggctcaccacataagtaaaataattgtttgctgctcatcttccacctgacaaacacagtgcatagctttatccagaaaaaaaaaagaatataaagcagggtcaagtacaactgtatcactttcattctttccttctctcctcgcataaaatccatctcttatgttgtttcagctgcagtataactggtgtagtctccagttctacccttttaagagtgacaagctggttttgttcctggactcaaattatgatatttaggatattaaattgtttcctttctgctctgactaaaatatgaaattggggtctacaaatttagctggttaagatactattagactaagtatgtgagttgagccagttggctttatcctgataaaaactattccacagttttctaagctacagatctgacccgagttgcatcagtgcagtaaagggcagatgacttgttgtttaccacagatctagataaagggggtatatggatggcacagagtcactagaatgaaacgaggaatacaaaatatatgttctataagccaaaacaatcctgagaaagaacaaagctggaagcttcacacatcctgatttcaaaacgtattacaaaattactgtcatcaaaacagtatttatgccagtttttactggcataaaaacagatatgtacaggccaatggaacagaatagacagcatagaagtaaaccttcatgtatacagctaaatgatctttaacaagagagctaagactacacagtgggaaaagatagtctcttcaataaatggtattaggaaaactagatatccacatgtaaaaaaagaagttggagccttacaccatatacaaaaattaactcaaaatggattgaagatctaaatgtaaaacccaaaactttaaaactagaaagaaatatgggggaaaatgctttatggcatcatatctggcaatgatttcttggataggacaccaaaagcaaagacaacaaaagcaaaaatagacaaatggaactacatcaaacttaaaaacttctgcacaacaaatgaaataatcagagtgagaagcaacctatgcaatgggagaaaacatttgcaaaccatgtatctgttaacaagttaatatccaaaatatgttaaaaattcctacaactcaacaacaataaaaaacaacccaattgaaaaatggacaaaggacttgagtagacatttatccaaagaagataaatggccaaaaaaaaaagcatacaaaaacatgttcaacattactaatcaccagtgaaatgcaaatcaaaaccactatgaagtgtcacctcacaccaattagaatggccacttcaagaaaaagaaaatataacaaccattgatgaggatgtaaagaaatggaaagcactgtgcactataggtgggaatgtaaaatggtacagccactatgggaaacaatatggacatttctgaaaaaaataaaaagaccgtatgatccagcaaacccacttcttgttactaatctgtattagtccattttgtgctgctatatcataatacctaagacttgataatttataatggatgaaaatgtattgctcacagttctggatgtcgggaagtccaagatcaaagtgcaagcactggcaaggatgttattgttgtgtcattccatagcggaaggtgaaagggcacaagagaaaaggggattgaactcatccttttataaggaaactattctcacaatagtggcattaattcactcataagggcagagcgctcatgacctaatcaccttctaaaagtcccacctcttaatactgttacaatggcaactaaatttcaacatgaatttgagaggggacaaagattcaaaccgtagtattatcccaaagaattgagaactggatttcaaagagatatttgaacacattgtagcattattcacagtatcaagaggtagatgtagcctaaatgttcatcagtggatgaatggataaagaaaatttcatgtacacctacaatggaataatatttagcattacaaaagaaagaaataatttcatatgctacaacatggaaacttgaggacattatgctaaatgaaataagccagttagaaaaagacaaatactgcatcatttcacttaaatgaggtatctaaagtagccaaactaatagaaaatagaatgtaacaaccagggaaggcaaagaagggaaaataagagttgttaaatgggtatagggtttcagttttgtgagatgaaaaagttctagaggtctgttacacagcaatatgcaatagttaacactaccgtgctgtatactatacacttaaaaattgttaagatgaaaaaagaaaatgtatgtcctatagatagggttacaataatactcttctaaaaat

SEQ ID NO: 2920 - DNA, 2116 bp, Homo sapiens
gaaaacattaaggattatttacttttcacaaacttagtgatatagtttctcttttttaaacagctttattgaagtataagtcccatacatattattcacccatttaaactgtacagtttaatgattctttggtatatccacagatatgtataatcatcatttcagtcaattttaggatatttttatcacttgagaaaaagaatctgtactttttagctaaccacactcccatctccccactccatctctgtccaaaatgcttgagactagaattctttcagattttgggtttttttggattttaggatgcttgcatatacatagtgagacatcttgagcatagaacccaagtctaaacatatatctttcatatacacctcatacacatcggctgaaggcaattttattccatagttttattaattgtgtgcatgaaataaagtttgtgttaaatacttatgtgtggaattttccacttggtggtgtcatgtcagcatttaaaaagttttgaattttggagcattttggatttggggttttcagataagggatacccaacttgtactactctactttctgtctctgtagatttcccagttttagacatttcctatgactggagacctttgatgtgtggtcttttgtgactggcttctttaactttcctggtagaataaagtccatcaaagtgttttataatgataaaaaagtcaatttataaggaagatataataattataaacatgtatgcacctgataacagaacaccaaaatatgtaaagcaaaaactgacagaaatggagggacaaatagacaattcaacaacaataattggaaacttcagcaccccgctttcaataatggatagagcagccaggcagaagattgacaaggaagtagaaaagttgcccaacactataaaccaactactaagagatatctattggacacgttaccccacaaacagcagagtattctgaggtgaacatgaaacattctccagcacacaccagatgcaagaacataaaacaaatttcaatacgtttaaaaggataaaagtaatacagaacatatttgctgatcacaatgtaacaaaattagaaatccattacagacaaaaaatgagaagctcaaaagtatgtggaaattaaacagcacactcctaaatgaacaatgattcaaaggagaaagcagaaaatattttgagatgaatgaaaatgaagactcaacataccaaaacatgggatggtgccaaagcagggcttagaagaaactttagagctgtaaatacttctatgaagaaagaagaaaggtctcaaagcaataacctaaccttctactttaaggcaacggaaagaaaagagcaagttaaaactaaagcaagcagaagaaaagaaatcgagatttgagcagaaatcaacaaatgagaaatagaaaactaatagagactttaaatcttctaaaatgtctaacactttacttactataataaatcaaattgtaatatttacagaagacattaagcaaggactatttatttttcacagtataagtgatatactttcttaatgtattaaaaaaatttaattttcaacatagcttccatacacctgttgtaaaaagcaaaaatcttcgtgaaaatatccaccaggcactgtctttttctcaattcatatttactttggaagctgttcaccaaatcatgagctcatttcaaaccgtagctgttgagaaagctcacctaatcgaaagagcacaatttcgggaattgagcaaatctacgactgattccttgtacctccacttcctgcaatgtgactttgaataagttgctaatttctttgagacttattttcctcatcgggaaaatacaggtaattttctcactttgaaaggagtaagtaagataacatacataaaagagccgaattcaatgcctggtacatagtaggtgcttgtttaatatctagtctacattcatttgatgatttaacaattgatttggtcctggtatgcggtatacatatatgagtgttcttgaaagaaaaactagaagaagaatctaatgttacatcttatgtaccaggtttttggctagcgatattatctataactg

SEQ ID NO: 2921 - DNA, 615 bp, Homo sapiens
caaatatgatgcctagaacggcatggacgctcaaaatctgttgacaattgattttcctagcacatatgatttgggtaattctgtcaagacttagtgatgtggcagcaaaattagtgatgtttatttaggagtagttttctggtaagaggttgaatggggaaatgttaaactcctacttcctagatacagctacagggagaggaggaagagtcatgttattttgatatgattgtaaattaacataacccccctggaactccttttcctacacacgcacttccttccttcaggatcacaccaacctaaaggtaaagccagagcaatagtaatgtttatagaccatctttcttataaatgccactgctcactattgtacatatgtctttttcaagtatttttggaagacctccctcctctgctaccatatttccctaatgtctgtgaaactaaccaccacgcccggccttatttgctacattgtttagagatggaatcttgctctgctgccaaggctggagtgcagtggtgatcaaagctcactgcagcacaacttcctgggttcaataaatcctcccagttcagcctcccaagtaactgaaactacaggcacatgcc

SEQ ID NO: 2922 - DNA, 6005 bp, Homo sapiens
cagtatgtcatttagaagcttgctaaaaatgtagcaagaggccaggattatttttagttggaaaagcttcatttacttctcacaagctctgtggcctgttgtgcttcaatttcgtcatcttcaaaaccaggaagagctatattcatcttatctcacaaagctgattaacataaatgaaggagccttggaaaatggaaagcattatacaaatgtaagttgtatagagttccacggtaattgctaaaaatactgaggcaaagataatcctttgtagacagaggttttggttaacttgtgagaatagagttagtagaatgctagacatagaaaacagatttcagtgatttcaggagaaaatcagagggaaggaagaaacatgaggtgggtccagaagtggaagtcttcaattcctttagaaaaggcacatgtagctggaagcagtggctcacgcctgtaatcccagcactttgggaggccgaggcgggtggatcacaaagtcaagagatcgagatcatcctggccaacatggtgaaaccccgtctctactaaaaatacaagaattagccaggcgtagtggtgggcgcctgtagtcccagctactcgggaggctgaggcaggagaatcacttgaacccaggaggcggatgttgcagtgagccgagtttgcactactgcactccagcctgtcaacagagcaagactccgtctcaaagaaaaaaaaaaaaaaaacagtccccggtgtgaacatggcacgtgtatacatatgtaacaagcctgcacattgtgcacatgtaccctaaaacttaaagtataataataataaaataaaaaaaagaaaaagagaaaaaaaaaagctccttttgggttccgatctgtttcctcggggagaaattattctcctcaacctctctttctaagagagtggacagaaatgtcttatctctccagtgggtaattataacttctctgtaagctataaataggcaaaaaaattccctaaggatgtatgcctggggtgttgtaggttttagtcatacctgaaagggttgctccttcttcctttttcagagtactctgtatcgttatctattcctttcattttttttctgaatattttcctaacttattttgtccacatgttctacaggtaaaccttaaagattaaattctgttgaccctgtgctttcttcagtctaactccttggcacactgaaaccacatttgatattgaatgttttaacataatctatttcaggaagtaaaaaaaatcctagagctctctcttattttcctttatgttaaataatcaccctctctgacattgtagctttttaaggaacacatcatgtagaattgataggttcttttggtagaattcccaactgtgatatttatttcatgactacacatcattctcagcaggtcaaaaatcattgtattatgaacatctaaattggttctttaatatatttttgttagcagcagcacatctcctgaaaagcaacactgaagtcgattctgcggacataaggatgatttggcattgacatctgtcagcctgttaattactaaggaagatttggctgaattaatttgtttcctggttagctccttttctctgctccattatgccctttactatgttgcaaacttgaacaaattaaagatacattccaagatatgagaagaattttcatcaaatgtatgaaaatcaagtacatgagaaattcagtttccaaaatatagggcatcattgtgcagacgaacagctttttgaacctttctgttgaggaacacttccagttctataacatttcttcagacatttaatgacagtttcctctgtgccaggcactctctgtaaggtgaaagctcaggctgggaagaggggtgggagtagggtgaatgggaagcgggtggggacaaggaaattaacataagtggacatgcacaacaaaaaggccctttcgggcgttaattttgtatcacctgcctgtatttctattcaaacatgaaaaatttttgaaacaaatttgaagggggagtggtccttcaccaataaggcaccaataaggcaggttattttctcctttgtactggcaaccatcttttctgtagtttatgctctgctcacaccctatgtgcttgtttcccatctgagataaccctgccccttttctgttttcatgaccattattcaatggaaaattggaataaagtaaaacaggacaagcctgaattactttgggctctttgttatatctcatcattttttttggtctcttttctccactacatttaaaacaaaaaataacctttgcctgtgcttttccctcacttctaaatatgttttttttaaccttttctttcttctcttttgtgcttgctttcttagttaacattacaaattttctgttttttctaaagctaattttaaaaggaggcctataatatttgtgtaaagtttttcattcctccagtcatcccattttctatatgactttaatgtgttatctgccagaacaactagaatagatatctccattatttctgcacagatggcagagtgaacaagactttgtccttagaatttccatcaacaaaacaaaaccaaaccacttactatatatgtattgccattcatgtttaagtgctgaaaatggacttggagacttatctcagcactatcacttatgtactctaactcttctttatttgagtagggaatccttcttgtgacttccttcagggtgtggacacattgaaagattaattattcacatatcagctggaaaaaagtgaggtgacaagtgttgacatttgcgtttctgaaagaggcacattgttacatcaaaaaaaggataatgccaattaggatttcatatgtgttgttttattttcacaattacaatgttagaggaaagctcaaaagtaaaggcttttgtgaaaatgatcagatgataaatcttgatacctgtgtaagaagtgaaagcaccagagtttttttagaagatgaaaaatgaaaaaaaaaaaaaaaagaaaaagaaacaatttggcattgttagaaattctttattgggagtggaaaaacatgaaataaagggaaaatagctttaatcaactccaaattccttctttggaagtgctgtgtgtaatctccaataatggtggtgtacatttcccccaactctattaaaaccatcattatcattgtcatcttcatcaacatggtcatcatcattgaacacacactccatacaaagtaagatgttatgtgtttgtattataagcagagattagacaataactctaatcacaaggatgctgtaactagtagtgtagatggtagatgtgcacaacaatgaagggatgtttgatggtatctaagttgtgtaatcattaggcttacttgaagagtttcccctaatttttctatttttctttttccttttttttttttttttcaaacagggtcttagtctgtacccaagctggagtgcagtggcacattcctcatggctcactggaggtgcctcagcctcctgggctcaagcaatcccccaacctcagcctccctagtagctaggactataggcatgccccacaccagctcattatttatttttttatttttttgcagaaacatagtctcactctttttcccaggctggtctcaaactccagggctcaagcagtcctctgtcctcaacctcccaaagtgctgggactacaggtatgagccactgtgcctgaccagaatttttcttgaatgtgatattctccttcattctattacacataatttctctaatcttcataatttaattatcattgaatttcagtctatctgattcatgtaaagacaacctgtcattccaaacatgatttgtcctctttacaaaactaatctgatatgaactgtatttgattcactagagaacagagtatagtgatgcctcaagttattgatacctgcattgatcagggtaactaaggcttactactggaacaagcagtgctgtaaatctcatgggcttaacatgaagtctgatatggatttgggtgggggctttactagggggcttacctctaagcagtgacaaaactatgtaggctttattcaattgtgtggctctgtcatctttaagtccatcacttcctgcctcagctacagaagagagaaagaatgaactaccaaatgagactttttaggactatatcacatgtggcttcaacttaagagcaacggtagctgggaaatatcatcttcctgtgtacctcccaaaaaataaaatgggtttgtgaatacatagcattttctttattacactatagaatatccaaatagagatcggatattttatagtgtaataaagaaattgggaaattaggagttagggctgaatgataaatatagcctttgaagacagtgacaatgatatacagttgattagttggatattggataataaaacccatcacctaaagaaagagcatagcaaatgattaaaaacaggatttaaagaatggtttttacaatgagggacaatggtagaagcttattgtggtgtggacttgtaattacctcttaatttccatttttttcttcctttgtaacaaaactctagttttttgcctaactaaaagactgttgtgtacccttctttatagtagggtataaccacatgactaatgtcacatataaaaatggagaacgggtgcacattaaagagtaggtaagtggttaatatactttttctctctcaatcctcccaacctgccctctttacctttatctctccaaaataacatgtttgttgtttaatagagatgacatcgtcctaatctaaggcttaagattcctgtaactcttaagtcacactttgccaaatttttattcaatcactgaaggctcacattgcctctgaaagaaaaaaaaaaagcaagtgaaatatttctgactgtgagtgttcttatattggcatcttagtgtgaacttaggggatatgttagcgttgactgttttctgtatcacctcaggtgtattttgtctttcccctcttgacttcacttacccactcactctgactaatgtcctagcagtggcaagcatgtagatgtctaaaaatgtagaaattgtaagaaagaggctgtttcagggcagcatttggaagtggctattgtgtagggctaaccatatctctctcctgccagaggtcatggccttgttgatggtctctagtcaagagcaatcccattagtgaaaaaaaaaaaaaaaaagaaaaccagcactgacagtgactgcttccaaatattctcctgtctgctactatagaatttcctagtgtttcccatcttgtcaattcctttccctcaccttttttacactgagtgaacaacttttatttgaagtgttaggtactaacccagttctctcaccctttactctgcttccttcctttcttaaatgcttcctgctttgtaaccctctgcagctagtgatacattagtttatgtttgtgttttctcaagaagtgaaactgttgtaggttgacctattatatagaagtacatactcctcagtagaaggcaacttatgattgtagaaactgggtgtttcgtgagaagttgctacttaactgaccaattaggaaaaggggtacagaaatgattgagacctccaaggagatacagattcatttaagttgagtgtactgctgcagacatcattttgaatatctgtattacgagtaaatggtggaaatttgaagacaagtccatactttatgaaagtaagagaacaagaaatttgtttccctaaatctgtgagcataccctataattcatcagaaacagcaaattcacaaacacaaaattgacagaaatatgtaaaacttttccagcagtttacttctgaatacattagaaaatgtgacagaacatagtaaatttcttgtcattttacttcccaagggaagtgctaggtttgtaaatcctagaatatca

SEQ ID NO: 2923 - DNA, 2732 bp, Homo sapiens
cgaggatattgctttcatctttgttaaccagaaaatagattaagcaaaggttagctggtgagacatgtacaaatcctcaagtcaagctgagtattctgagagcctaaggtgaattttttcttttcccctaaaagtacaacttttacctgctgagtgtaacgatctattttgacttgtgcctcaggacagagttcgatatctttggctccatagacagcctgggcaatggtccttatcttgtccacaattggaagctgcagaaacacaaattataacaaaattgtgtaagtttaatctggttaaagattttttaaaaagtttagtgacacttactgtaattgcttaaaattcccttatcagggtaccccctcagcaactgcaggattcctcgcaaaccctcttttttccttttagcaccctaaagcactgaaattttcagtgtcagaatagatcagatgtcaactagcaaataagccttaggtgttcaggcaatttagaggctgcttagagcccacgtagaatctgcagagggaggccgggcacagtggctcacacctataatcccagtactttgggaggctgaggcgggtggattacctgaggtcaggagttcgaaaccagcctgatcaatatggtgacaccccgtctttactaaaaatccaaaaaaactagctgggcttggtggtgcatgcctgtaatcccagctacttgggaggctgaggcaggagaatcacttgaactgggaggcagagactgtggtgagacaagattgtgccactgcactccagcctgggtggagtaggactccgtctcaaaaaaaaaaaaaatctgcagagggaagagggaagttagtgccttacagagggcttctgactaggaagccccagaactgcggccgaccccttcctctccctgcctcacccctgcagaaagacctgcagaaaaagctggaaggggtgggatggtgtgtgtgggggtggggactggggctatgcagtttccagacctggtctttggcaccctctacaggacagttccattcccacacctgagctttggacaactgaatcctatgccccttcccacccagggaacctggtgccagaaattcccaggacttacccaccatccaccacgccacatagcaagtgtcctcagtgtctgcagaccagaaacaactcccttgtgtctcagcactgggccacctgctgaaaccccaaactgcctgccccattgtttgagacccagtcaggccttggctccaaaagtcctcttggactgccactggcccccagggtctctcctgactgcacctcggtcccggagctcccacaccgctgggccccgagccccatgccccgatccagctgtggctcctttacgggggccttgctggcctttcctaagggaggtgttttcccgagggcaggtggactgctcctcagactaggggccctcggagggccaggcctgggcttctacctcctctcgcaggctggtgtttctctgcaaatatggctcgtgtgtcctccttcctctcagactgggggcccctgaggactgggcctgagtttccctctcccccttcagaatgggggttccctgaggactgacccagggcctccccccgtcccctccatctggctgttaatctccaacactttcacctccagtcctattctgcacagcgctccccagcgctgggagctcagaggcctcttcagccttccccagggctggggctcagggagggcttcctcaggcgctggccccagagtcaggctgcacattggcttggaggacaggcctttcctctgggactgtgaggcccagagtgcccacccagaactccacctctgacctcacaaaggcctgcttcagaactcggtctccactgcactgctggccagacgagggatgttattttgggcagtgcatctggacttggttcaagtggcaccagccaaatccctgccttactgacctctcccctggaggagcaggagcagtgctcaaggccgccctgggagggctgagaggcaggctctggactggggacacagggatagctgagccccagctgggggtggaagctgagccagggacagtcacagaggaacaagatcaagatgcgctttaactgagaagcccccaaggcagaggctgagaatcagaagacatttcagcagacatctacaaatctgaaggacaaaacatggttcaagcatctgggcacaggcgaacatacatatgatagttgagaaagacacatattctgatcatgaagaaataaacacaagttaaatatgactaagcagaaagatggaaggaccaggaatggtgatgctaacttggaaccacgatgcaggctctaaactcctctacaatcatcctcccttgtgagaaaaatacataagatctaaggcacatgagatgatatgctttctgtttgagtttctcctttatgttacgcatactgataaaattgttgatgccagttgatctgaaggtcccagcaaggagccgactcacagaagaatgcagttttcacatcatgatgatttaatcttccttgacctgagcaattgacaaccccaattctccagaacctcacccgccacaatccccttaaaaaccctggcccagaacccctcaagcagacagatgtgaagcttgaggattccttcatctctttgcccaatggcattgtgattattaaactctttttctgc

SEQ ID NO: 2924 - DNA, 50749 bp, Homo sapiens
atttttttcaaatataagaatttgaatctcatatatttctaagacttagttaaactggatcatacaaatatagagtgatttgttttcgtgaacatacattttcagaaattatctaatgtgccttgttgtttcttctttaccttgggtgatttacaaatgtgctgtttcgtttcaaaatattgaagattttcttcatcttagtgaattttaattcaatgccattgtggtcagagaacatacactgtaaaatttcaatatttttaaatttattgctacttattttatggtatatcatgaatgaatcttgaacatttttagcatttgaaagggatgtgtgttctgcaattgttgcagtagtgtcctataaatatcaattaggttaaaatggttgagatagtgctgaaatcttctacttacctactgatttttttaattcattaacgaactttagtttttagaggagttttaggttcccagtaaaattgagtggaaagtacagagagtgtctctatatgtccctgtccccagacagacacaacctccattactatcaacatctcccacctcagtggcacttttgttgcaatctattgacacatcttttttttcttctttttttagttttattattattatactttaagttttagagtacatgtgcacaatgtgcaggtttgttacatatgtatacatatgacacatcattattaatcagtgttctacattatggttcttgcttagtgttgtacattctatgaggtttgaaaaatgtataataacatatatacaccatcatagcatcgcacagaattgtttcattaccctaaaaatcctctgtgttctacctgtttacccctccctatccctacctcttgataaccactcatctttttactattcccatagtaacattgagcatgttttcatacacctattgaccatttatatgtcttctttggagaaatgtctactcaagtcctttgccaattcttaaaacattttaaaaagtgggttatctgttggttttgctattgagttgaagggggtctttatatattttggaattaactcttcctcagatatatgatttgccaatattttttctcattctttaggttggcttttacctgcagattgttttctttgctgggcagaagctttttagtttgatgtagtcccatttgtctatttttgcttttgttgtctgtattttcagcgtcaaattaatgaaatccttgtgaaaagcgatatgaagatgttccctaatgatttattataagagttctatagtttcagatcttgcatttaagtctttaatcgactttgagtttatttttgtttatggtgtaatataatggttcaatttcattattttgatgtggatattccattttcccaacactatttgttaaagagactattgtttctccattttgtagtcttggcacttatgtcaaaaatcatttaaccaatatatacatatgggtttgtttctgaactctttattctattccattgatctatatatctgtcttgatggcagtaccagattgcattgattatgttgctttgtaatatgttgaagtcaggaagtatgaagcttccagctttattcttctctctcaaatcattttggctatacagtgttttgttgttgttgttgttgtttattttttggtttcatatgaattttaggattttttttccatttccacaaaaaatgccagtgggattttgatagcaattacattaaatctttcggtcactttgggtggtctcgacattttagcaatattaatttttccaatctgtgaacatgggatgtccttccattaatttgtgtcttctttaatttctttcaacaaagttttgtagtttttagtgtacaaattttttacctcttcagttaaatttattcctaagtattttattatttttgatgctattgtaaatggaattattttcttaatttctttttcaaattatttggtattagtgtatagaaacacaaattatttttgtttgttgattttgtatcttgcagctttgctgaatttattatctctgtttttctgtttgtttattctgatatgcactttagaattttctctatatgcaatcatgttatttgagaacagagataattttacttgatcctttctgattttgttggattttatttattttttcttacctaattactctagctaagacttcaagtactatttcagttaaatagaagtggtgagactgtgcatttttgccttcttacagatctcagaggaaacatgttcaattttttaccattgaatattatgttatctgttggttttttatatatagtcttcattatgttgaggtaatttccttctattcctagttttttgagtgtttgttaaatgaaaaagtgttgaattttgtcaaatacattttctgcatctattgagttgatgatgtggttattacccttcattttgttattatggtatatcaccttgattgatttttgtaagttgaactatcatcacatctcaggaatatatgttaccacctggtaataaatacatgattctttcagtgtgctgttgaatttggtttgctagcattttgttgagaatttttacgtatgtattcattgggaatataggcctataattttctttcttttggtgtctttgtttgtctttgctatcaaggtaatggtgtcctcataaaattagttttgaagtgttcccctctcttcaattttctacaagagtttgagaaaaaatgatattaattcttctttaagtgttttgtaaatagaattcataaatgaagccatctagtcatgggctcatcctttttggaagactttttggtgctgattcaatctccttacctgtaattggtattattttatgtctgtggcatgagttgtaatgtcacctctttcatgtctttttttttagacttatctgtttttttcatactctggctaaaggtttgttgattatcttttcaaaaaaaaattcttaattttgttgatttctttctattgtttttctacttgtattttatttatttctactttaatcttgattatttcctttcttttggtgactttgggcttaatttgttcttctttttctagttatttcaggtataccattaaggtttttatttgaggttttttttcttattgcaggcatttactgacataaaactccctcttacggctgcttttgatgcatcccatacattttggtatgttgtgttttcatttttatttgtctagcaatatttttaagtttcccttttggctttttctttgactcattcgttgtttatcattcaagggtgtgttgtttagtttccacatatttgtgaatttttaagttttctttctgcttttaatttctagtttcaatccattgtgattggaaaagatacttcgtataattttaatcttccaggagctcaaacaaccctataggaaataatatccttaaatttgttaaaactccttttgcgacccaacacgtgatctatcctggagaatgttttgtgtgcacttgagaagaatgtttatcttctgctgtagaatgtttcttacatgtctgttaggtccatttgataaatagaattgctcagctcctatttccttattggtttcttctctgtatgtttggtccattattgaaagtggagtattgaaatctcctattatcattgtactactgtccatttctcccttcagttctatcagtgtttgcttcctatatttggttgcccatattttgggtgcatatatatttataattgttgtctcttcctggtaaattgacattttaatcattatataatgtccttctttgtctcttataacagttttttacttgaagtctattttgccttaaataaatatggttaccatgattctctttgcttatcatttgcatggaaaatcttttccatctcttcactttcagtctgtgtgtgtccttaaatctaaagcaagatttgtttatatcttatagttggatctttaaaacaaaaacaaacattcagccactcaatgtcttttgattgaagagtttaatctatctatatttgaagtaatttctgatagggaaggacttatgattgccattttattagttgttttctgtctatcctgttgccttttggtcctcctttcttctcttgttgtcttcccttgtgttttgttgattttttttttaatagcaacatgctttgatttattgctcactttctttggtgcatcttttatagataccttttattgtgtttaccaaagggcttacattagacattttatagttgtaacaatctctttttagctaataatttcaattgtacacaaaaactgccctttacgtctcctccccatggtatcagtgccatcagttgtaatgtctccccgtgcacacactatgctatagatgtcacaaattacatcttttttttttttccccgagatggagttttcctcttgtcatccaggctggagtgcaatggcatgatctcggctcgctgcaatctccacctcccgggttcaagcaattcccccacctcagcctcccgattagctgggattacaggcacctgccactacacctggccttttttttttttttttttttggtactttttagtaaagacagggtctcgctatgttggccaggctggtctccaactcctgacctcaggtgatccacccacctcagcctcccaaattgttggggttacaggtgtgagccactgtgcctggacaattacatctttttatattgtgtattatcatgtttttattgtcattttttgtacttttatctttcaatttctacaccagaattaaaagtgatttatgcactacttttatagtaccatactattctctgattttctatttacctttgccatctagctttaaactgatagtcttattgagcctcccttgtatgtgaaagtcactttctcttttgctgctttcaaaactctctcattgtctgacttttgacaatttgattacaatgtggcttgttatagatttcttatatactagttttatacgagttgaagtcttttggtattcttgaatatggatattcatttctttccacagatttgggaagtttgggcccattacttcttcaaataatctttccttccctttctctttctcctcatcttctgagaccctcatattgcatataatgaacaccttgatcatgtgccataagtttcttagtctttctttactctttttcattcttttattcttttctcctactggataatttcaatgacctgtctttgagtttaccaattctttgttcagctagatcaaatatgcagttgaacccctctagtaaatttttcaatttagttattgtattctttcattccaaactttctgggtgtttaaaaatattttatttttgttgatattctcattttattcatgaattcttttttttttccttagctcattgagcatctttatagtagcaatttaaaatctatttcatgtaatctccatacctttgtttctttgggttcagtttctggagatttattttgttccttttattgaaccatgtttctctgtttattatgtgccttataactttgtgttgggatctcttcatttgaaaaaatagccatatatatcagtttttatgaactggctttgtataggaaaagatctttaccaatcagcccagctagatattctagagagcttctcaaacttttcctatggatgcctcttctctggacttgtgcatataaattcattagagagatttgccagtttctttttttaagaattcatcatctctttctccctctaatgtgtctgtttgtgttctttggagctgccacaaggtgcctagctctcttttgctctcagtggcttctagtaaatgttgggacacatcagtgcactaagtccgaagacacagaaacaattccccccagagagctccctgaaaagccagaccactagaggcatactctactcttctcttctggcatgaccccacaaaggagagaccaccaaatggcataggcctctgtctgttgtatgttatcagtagcagcagcaatctgcccagctctattttgtcctctgtgccttgcaagtacatagagtattcgaggtccctcccatccatcctccaagacaggcaagacagaatctagtccttcgggcagtcccttgaaagttcagaattttggacacacactttaactctttccctccacagggataagccaggagttgaggcttctttttctccctactcattctgcactgagccagaggggaagggtatagaattttggtgagcgagtgtttgttagtctaaaccattacttttgttttcagtggtccccaacctggcccttttgtttttctgtgcttagagtcaggcaggagataaaccagttccttgggcagcaccgcaaaagtctgagttttggatgtgttttagtcttttcgtttcctccccagagagaagccaggaaatgggagttttctccggattgtacaactctgagccgggggttggggggactatggtgtatgagtgacacgaattttcttactggtttcaatgcatttggcttcatatttgcctgaggttcaggaacctcataactggtttatgggtttctaacaagggacatttgtcactgaattgctgttaaatggtgtcctatgaggggaaagaggttctgggcttcttattttgccatcttgctcttctattggctttttaagctgtgctgctttatttatttttagcagttgtatggggattaaaatatgtattcttaatttattattacttacttagagttaccattgtagtatttcatataaaatgtaagaactgtattataattatatttatacccttttccatctttgtggtattgctgttatatatttttcttctacatatgttataaaccctacaatataatttcttttttttactttgactagtaagctgcattttaatgacatttgtaaaagaaaaaatagtttctttatatagattcatatattcagcacttctaattttcttctttccttcttgcatatctgtgcttcaatctggtatcctacttcagtttgaagaaccattaataacaaattattatagcgtatttttactggtgacaaattttctcagtacgcatttattaaaaatgtttattttatcctcatttttgaagtatttccactgaccgtggaatactggcttgactttaaaaaactttcagtactttacagctgttgtttcaagatcttctggcatgtatttttttctttttttttggtttatgttttgttttgtttttgtttttgagacagagtctcaccctgtcacccaggctggggtgcagtggcatgatctcggctcactgcaacttttgctacccaggttcaagcgattttcatgcctcagcctccggagtagctggtgttacaggtgcacactactatatctgcttaatttttgtatttttagtagcgatgggatttcaccatgttggccaggctggtctggaacccccagcctcaggtgacctgccagcctcggcctcccaaaatgctgggattataggcatgagccaccatgcctggctggcctgtatttacttttctgatgaagagtccatcatctttcatcttttttcccttcatatgagggttttttttgatacattttaagattttctttttaccattatctttcagcactttgattataatatactcagtcaaggttttctatttacatggtttagggtttactaaatgtcttgaatctggagggtaatttttaaaacaaattttgaattttgaattttgttttttgcttctttttctctccctaccttttcttctctcctactttttctcctcctccgtctccttttcttcttcctctggattttcacaaatagttgaattttctgaggtaccagggctctgcttgttcttctcaatcattttcttttcattgtcttcagattggttaatttatattcacatgttttcaaattcattgaccctttattgtagtgtctaatctgctgttcagcccatctagtgaatttattcagggaaagtattttttattatagaattctcattagtcctatgttatagttttcttttctctcctgagatttcccaactcagcattgtgaatatattatttctacatttttctttaagtttatatctatatctctacatatatatctctatataaataataacatatccacctatatatctatatttatccacttttaaggtctttatctccttattccaacatctctatcatgttgggatttgtttatatcaactttttacttttgactatgggtcacatttttcctacatctttgcatgtctagtaatatttgactgtatgcttgacattatgaatggtatgttgtgggatggtatgtattgagtattttttttttctttgaggagtgtttagttttattctggcaagtggttaactactggtggcttgttttgattttgttagaatggatttatactttatttcaattttatccttagttctatggcatggccattattttaggtcacggtctttcctcctaggcatggtcattccagcatctcgaccgaatgcttttgttgctcagtgaagctttctcactctggctgcgttaggactttaacatctatgagcactgtttaatgtctccattcagatgagcactgaaggatttgtcactgctatagttgttctcttaagagtgtcacagaatactctcctgaacaaaagtagcccatcttttggccaagggcctgagggcaacctctgtgaagatttcttgcttcccctagtctgcgaagctttctctcctcagtacttggccacacaaattctagctaccttaccagcccgaaactctgatctgtgccttctcctctcagtaaaattgtcattctctatttggcctctgtctcccatgctgcccctggaaagtgaccccgggtagaaagctggagttaatacggggttaacttacattttccctttctctaaaatatgacagtcctgcaccatttgttatcaagtgcttgaaaataatgtgttaatagtttttgacccagttttataattgtttatggcagaaggataagtccaatactagttggactttgtcatggctagaagcagaagtgttgtttttatttaatattgcatacacaatctattcctagggttcctgacctaagtgactctctaaacctgacagttacatgcgttccagggagaggaagctaaaataaatggggataattttgctttttgtaaagagagagaaaaaggtattcgtatctttaaatatttgagtattttaaagtatttttaaaatttcattttaagtcttctacaaaaccttcattgaattatattctttttcttaaattagctctgaactctttggttatgtatcagaaattttcccctgtgtacctccaatctacctttttctgcttacctcctactttatctcacctgatgctctagttgtgttatactatttgttcttttaaaactataccctacctatgtaattttctctttgtctgaaacggccctcttcctttttttaaggcttagcaaacttgacatactacattctttgttacttatttctgcattactcatggttcttcagagaaccatggttcatggaactcatggttcttcaataggtgttgtatatcataatattatatctgtgtaatatataatgtaacatatgcaatatataatatgttatatatgtaatatatgtaattacattatatattatgtatacacacatataatctattatatatgtatgcacatatataggaaggaaaggaatatattatatatgtttgcacatacatatatacgtgtgtgtacaaatattatctatgcacatacatatatatacatacatatatatctgtacatatacacatatgtgtatggtctctgatacacctcacatcctgtggctcactcaagtggacacataaaattaaccatcccaatttccttttttctatatgtgtaattatatatacatatatatatacacactcacacatatacacatatataagtgtgagtgtatagatatatgtgtgtatatataatatacatatatagagagagacagagagagacagagggaggagatttattataagagattggctcacatgtttttggaggctgataagttccaaggtctgcagtctgcaaactagagacctaagaaagctgttgtgtagcttctgtccaagtctgaaggcctgaataccaggaatgctaatggtgtaagttccagtcagaaagctggcaggctcaagacccaagaaacgctgatatttcagtttgagtctgaaggctgaaaaagaccaatgtcccagctcatagcagttagacagaaggagttccctcttgctcagcctttttgtctattcaggtcttcaattgatggataaggcccacccacactatgaaaagcaatctgttttactctatctactgattcaaatgtgagtctcatctagaaacaccctatagtcatacccagaataatgtttggccaaatttctgggcattctgtggctcactcaagtagacacataaaattaacattccaaatttccttttttctattttcaaatgtgattttatcctccttttcatttgttcctatatctgacactttatacactttaccatgaataatcattattctgtcatgaataataaatgtctatttttcattttgagccccttttctacttagcacaattccaggagcttggacattattgcttcttcttctttacttccacacacaatcaattactaagttacattaattattagaatctgttcttttatttttatcatgactgcatttgccatcgtttagggttttacaatttgttgtcaggtcatattggttttctctgtctccatactagtaccagagtaatcctcctgaatcacatatatagcctactaggagttaaaatctttcaacagctttgatagcatttttaaaaatccagatttcttagcctgagcaacagttagtgtaattagcttgcctggtatggtttaggaagcataaactattacatccactttaatgcctattaagaaatgtggcagtggtttataatagagaagtgatgtagagatctatgaaagactttttttgatggaagaaacacaagtgaagtattttttcaggttataagagacagggttatattgcaatgaattattcccacaggaacaactgtagattagttatggaatcagctttcctttccattttttaggttaatattgccaggttttttttaatgctgtgtgttgttattggtgagatgaataaaaatatcagtaaatgtgttagaagggatataacactacaactgggtaaatacatgattgtctttgagtctatctgctctgaaacacaatggtggcattattagagaatagctatcactggaattaataataatgttcagaatctggctaatacataccttgattaattagttaaccccatcttagacacggtagatgagccattgtagtgtcactgaaaatacaggtgatagccacacagttgataagaatcaatctagcaaaatcctctggaaaagggatttagaagtgaaaaggcttgaagtctgctccaagttgagtaattatgttgtgagtttttctgagtgattcatttccctatgcctcagttttttccatttgtacaatgaaggcattgaactgtgtaatgtctgaaatttatatcaattctaatattgaatttgaaatttaagaaatatttctgattcgtgttttatatttttaaacatgtgtatcaatgcttcgggaattaaggactttaagttgcttaatgttatctattgtcaccaattcaactggtaacagctctaaagtctctctatgtactagacagcaaacacccttcttctctccctcagcataccctgacacttaaaaaacaggaaatgtgtatttttggatgttattcaaatttacttagaagtatttactcacttagaagcaatttactcattttgaagtatgctaagaaaggcattttcaaatcctgtagtagttggaaagttttttaaatcttggtttcattttttgacttcatttctggttctagtcatctacattctgaatgtacagaggcctccagtaaattttctagctaatacttgggaagcatttgtaagggaacagagtattatctcccagcacatgttgaagaaaatgataacagaagctatagaaaaaacagtgacagaagctatagagaagaaaatgataatttttatcgcagtgactgaaaggcaaccctggccagtgctgtgatgaggaataatactagtttcattggttaagttctagcattatatacctagagcaggtatttttaagaacaggttggagaacgcttcctgttggttttggattcagttgtgaattcagcaaactgtttagaatccagtatcatttctatgtggccaattttactgcaacataagctataatttgtatacatattgagatttgtccacaacaatataccattgtaaagataataacctgttataaattataataatcatttattagagacaaccttcctgaaataacttggtatcattgaggtgatgaaagagagacattgggggagtttattgcagaagcagagactctataaagaaaatggtgaacttgagggagttgagaactatgtatagtttgattgtggattattctattgtgatcaaactgaaaaagactaattcatagagactacttataaaaaacatttaattaatgagtcagatgctgatggatacatttacactgggagagagacgtcacctgctctactaccaatggaaattgccactctgttttctataaaggattccatacatggcttataaaaagccaaagagtcatcacaaggtttcttttgatatgtgaaattagtacagatagagttgggtaggtctaaggaacatttgtggaggctcagctagaatctggtttgtcttgccccactattgtttttttgagaccgggtctcactctgttgcccaggctggagtgcagtggtgcaatctcagctcactgcagcctcaacctcctgggctcaagcgatcctcccactgcagcctccgaagtagctaggactacaggtgtgtgccaccatgccaggctaatttttgtattttttagtagagatggggttttgctgtgttgcacaggctggtctcaaactattgggctcaagggctctgcccacctcagcctcccaaagtgtggagaattataggcataagccaccccacccagcccaccctactattttgtaaatagtcattggttattagggtactgagttagggttcactcatttgtcaataaaagtctattgagtagagactatgtgtcagaaatagttctggtctctagaaatacattggtgaatcagataaagttcctgccctcataaagcttacattctatcaggaaggaataagcattgaaccagggaactacaattaaacccttattctccagttgtggttttggtgtattctttatctgtcgaaatatccttttttttttttttttgaaaagtagcaatttctcatgacaaacatgttacagattctaaaatttgctgcgcattttaaatttctccttaatttatgaattatatatatataattgatttttccatagatgatcttaaaaagctgggatcactgtggtttgcacctaaagtattagtgatgataggtttaatttgtttagtgcctattgtaagccctgtagtgcggtagtcactatatgtataatatctcatagacttcttacaatactctataatgaggcattcttatctatatttagaggaaacaactgagactcagagaggtcatgtaaattgtctaagatgacacagctaataaatgacagaaccaggatttgaatcaaagttgtccagactcaaaagttatgttcttttccaccacaccactctgtccctcatttactaggtctttcctaaggcaataattacagctagctaattacatttcattctgaaatgaagttatgacttcttccttagtttatttgggtggaatccattcagagcatagagatccttatgcctttaatcagtcagattggactacttttcttttcaaaatctctgagatctaatttgtcttagagagtgtagccaagtggttcaacgtcctttgcccacagctcaaatgtcctctgaaagtaaaaagaagctcactatgagtagagacaggtaattccaactgtggatggatttgagaaagagaatattttttaatattgagttgagaattgtctccttaaagtaccagcatctaccacgctgaagaattacaatattttatccataaaagaaccctctggatattatgtggacaattttgttttcttctggaagctactttttctagcacctacagtttcattctcttcaccatgtgtcactcgcctcgggataggggccagctgagacaagctatagctatgggacgtaattcacagctttgctagaaggtaaacatttcacaaaagctatgcacatacttgtgaagggttttctgtgggagagaaagatcagtggttgtggaggaaagctttttcagaggtcgttgaaacatgactattcacagctgaagactgttatttgtgatgctcactgtcctttgtgataacatttatcatgtggatgcacatggtaaatgcctcctggaattcagtgccagggaaaatatgttggtaatgataaattggtacaattgtcttgataattaaggcttatacacaagtagttttgggggccagagtgcaagtgttcggttggtacctacataaaggaatatcctgtagtatttgattccccaggcagttgtagttggcacagaaatcccctataatgctatgctagagagtgctgcttctcataggtgtttctgatcattgtggggctcgcttcccttggacatggctcagttgatcttgcgtgagtctttgtaccagcttactgattattcaagttctccttaagctatctcacctgacttctcctccatctcctcttccaggaagaggaaaagtcaaagtccagacaaagtagttgcggcgattgccctgaaataggtgtctgctcttagacagacctgttgacttacagactgaatggaaatacaaaggtctgctatactcacgactgtaccctgattctgtgcccaagcttatacaacttgtgtgggctagacctggaatgagagtctaaaaagtctagctctagaatcagctctcttaaaacctacagtatagtgcttcactaataatactttaaaataataaaatgaatgtgaaatccagaccctacttctataaaaaaaaattgtaaaatttaaagtgttgtagagagaaatctatatgttttgttatgtgttaaatagctcttttggataactttaatactgagataaaataaatttacagtaaaattctcagaaggatgagataatttacatgagttcactgtccagatatcgaaacttactccttctaaaaattaaaatatcagagaggaaggcagcgcaagatggccaaatagaagccttcactgattgtcctcccagcaagaataacaaattgaacaactatccacacaaaaaagcaccttcataagaaccaaaaatcagatgagcaatcacagtacccagttttaacttcatattgcttaaagaggcactgaagagggtggaaaagagagccttgaattgccaacagtacccatccccctccccccagcagcagttctgtggcgtggagaaaaaaaaatctgtgtgcttggaagagggagagcacagtgattgtgggactttgcattggaactcagtgctgtcctgtcacagcagacagcaacaccaggcagaactcagccaaagctaatggagggagcaatgagaccagccctagcaaaggggaattgctcagaaccagtgaacttggggggcatgtgacctagtgagacatcagcttgaacagcaaagagagtgcttgcactatccgttccccagccccaggcagtgtagcttgcagctctgggagatacttcttccctccaccttaggagaggatagggaagagtaaagaggactttacttgccacttggataccagtttagccacagaaagacagggcactaggcagagtcctgagggccccatcccagaccttaattccaggatgacatttctagacacaccctgggccaaaagggaatccactgccttgaaggggagaacccagtcctggcaggattcatcatctgctgacaaaagagcccttgggccttgaactttcagcagtggtagctgggcagtactcgctgtgggccttgggtgagactcaaagacatgctggcttcaggtgagacccagtacattcccagctgtgatggctatagggagagactccgtctgcttgagaaaaggggagggaagagtaaagggagcttcgttccttagcttaggtaccagctcggccacaatggggtagagcaccaagcagactcttggagtcctcattttgggccttggttcttgaatggcatttctggacctagccctgaaccagaggggatcccattgtcctgaagagagtgtcccaggcttggcagcattcaccaacatgctgactgaagtgcccttgggctttgagtgaacatcagtggtagccaggcagtactcgccatgggtctggggcaagggtggccacaggcagaaactctgtgcttacagaaaagggagggaagagtgtgaaggacttagtcttgtggcttgggtgccagctcagccacagtagaatagagcaacaggtagattcctaaggtttctgacttaagggactggcttctgaaaaacatcgctagacgtgactggtgctggaggaaactcaccattctgaatggaaggacaaaagccagagtggctttgtcacctgatgattgtagagccctagggatttgggtgagcataggtgatagtcaggcagtggtaaccacagcccttgggtgagaccccagtaccatactagtttcaggtctgacccagcacagtcctaatagtggtgacaacaggagtatttgtgtcacctctcttctagcctagttagctcagcacagagctgagctgtttgggagaacgtaaggaaagagaacatgagtcttttcctggtaatccagacaattcttccagatctgatccaagaccaccaagaagtatctctataagtctgcaagaaccatattgttactgggcttggggtgctccctaatacagatggggctgcagtgaccagaaacttagagcacaacacccaagtgcctttgaatgcttggaaagccttccaaagaaggacaggtggaaaaaaaaaagactgtgaagactacaataaatacccaactcttcaatgcccagacactgacaaacatccacaagcatcaagattatccaggaaaatatgacctcaccaaatgaactaaataagggagcagcaattaatcctagagagacagagatatgtgatctttcattcagagaattcaaaatagctgttttgaggactcgcaatgaaattcaagataacacagagaaggatttcagaatgccatcagataaatttaacaaaggaattcaaataattaaaaaagaattatgcagaaattctggagctgaaaactgcaattgaaatactgaagaatgcatcagagtctcttatcagcagaataaatcaggtggaagagataattagtgggcttgaaggcaggctatttggaaatagccaggggagacagaaaaaaagaagaagaaaaaagaatgggccaggcatggtggctcacacctgtaatcccagcactttgggaggccaaggtaggcggatcattcaagatcaggagttcaagaccagcctggccaacatggtgaaaccccgtctccactaaaaatacaaaaaaaaaaaaaaaatgccaggcatggtgatgtgcacctatagtcccagctgcttgggaggctgaggcccccaacgtcaaagataaagaaaggatcctaaaagtggcaagagaaaagaaatgaataacgtacaatggagcttcaatatatctggtagcagtcttctcagtggaaacctaacagatcaggagaaagtggcatgacatatttaacgtgctgaaggagaaaaacttgtatcctaaaatagtagatccagtgaaattctccttcaagcatgaaggagaaataaagatttttcccagacaaataaaactaaggggttttattaacatcagacatgtcctccaagaaatgtaagggagttcttcagtctgaaagaaaagtttgtaagtgagcaaaaaaaatcatctgaaggtgcaaaactcactggtaatagtaagtatacagaaaaacacactatattttgacaccataattttgatgtgtaaactactcacatcttaagtagaaagactaaagatgaaccaatcaaaaataaactacaacaacttttcaagatacagatagtgtaataagatataaatagaaatagcaaaaagttaaaaagtgggggacacaattaaaatataaacttttaattagttttctctttgtttatgcaataggtgttaatttgtcattaatttaaaataatgggttataagatattatttgcatgttttatggtaacttcaatcagaaaatatacaacaaacacaataaaaatcaagaacttgaaacgttaaaacatatcgtcagagaaaatcacccttgctaaaaggaagacagacaaaaggaaagaaggaagagaagaccacaaacaaccagaaaacaagtaacaaaatggcaggggtaagtccttgcttatcaataacaacttgaatgtaaatggactaaactcttcaatcaaagcacatagagtagctaaatggatttaaaaaaaacaagacccaatgataagttgcacttttccataaagacacacataaactgaaaataaagggatggaaaaatatattgcatgcatgtagaaaccaaaaagagcagcaatagctatacttacatcagacaaagtagatttcaagacaaaaactatacaaagaatcaaagaaggtcattacataatgataaagaaatcaattcagcaaaatgatgtaacaactataaatatatatgtacccaatactggagcacccagatatataaaggaaatattattagagctaaagagaaagatagactccaacataatcacaggtggagacttcaacaccccactttcatcatcgacacatcatcctcacggaaaattagcaaggaaacatctggcttaatctgcacaatacaccaaatgaacctaatgtatatttacagaacattttatccaataactgcagaatacatattctcctcagtacatggatcattctcaaggatataccttatgtcaggtcacaaaacaagtcttaaaacattaaaaaaattggaagttatatcacgtatcttctgtgaccacagtggaataaaactagaaatcattaacaagaggaactttgaaaactatacaaccatgaggaaattagacagtatgttccttaatgaccaatgggccaaagaagaaatgaaaaaggaaattgaaaaaaatcttgaaacaaatgataatggagacacgacacactgaaaccaataggatatggctaaagcggtactaagagaaaagcttatagctataattacctacgtcaaaaattagagaaacttcaaataaactacctaattatgcttcttaaagaaatagaaaagcaagaataaaacaaacccgaaattagtagagaaaaaataataaagtttagagtagaaataagtgaatgtgaaattaagaaacaatacaaaaatcagtgaaagaaaatattggtttttagaaaagataaataaaattgagaaaactttggccagactaagaaagaaaagagagaaggaccccaaaaaaatcagaggtgaaaatgaagacttcacaactgatactgcagaaatccaaaggatcattagaggctactgtaaacaactctatgccaacaaattggaaattctagaagaaatgcatacattcctagatgcatataacccaccaagattgaaacatgaaaaaaaatccaaaactggaacagacaaatgacaaataagcagatcaaagcagtagtaagtcacccagcaacgaaaagcctggaacctgatggcttcaatggtgaattttaccaaacatttaaagaagaactaatatcaaccctactaaaactattcagaaaaatagggcaaaagggaatacttccaaacttatcatatgaggccagtattaccctgataccaaaaccagacaaagacacctcaaaaagaaaagaaaactataggccaatatccctgttgaacattgatgcaaaaaccatcaacaaaatactagcaaactgaattggattcaataactcattaaaaagatcattcatcatgaccaagttggatttattccagaaatacaaggatggttcagcatacacaaatcaatcaatgtgatgcattatatcaacagaacaaaatacaaaaaacacatgatcatttcaattgatgctgaaaaattatttgataaaattcaacatcatttcatgacaaaaaccctaaaaaaaatctgggtatagaagaaacatacatcaacacaataaaacccatatatgacagacccacagctagtatcatagtgaatggggaaaaatggagagcattgtttctaaaatctggaacatgacatggatgctcactttcaccattgttattcaacataatagtggaagtcctagctagggcaatcagacaagagaaagaaataaaaagcatccacgctggaaaggatgaagtcaaattatcctcgtttgcagatgatatttttgttatttggaaaaacctaaaggctgcacccaaaattattcaaattgatcaacaaattcaataaagttgcaggatacaaaattaacatacataaatcagtaacatttctatatgccaacagcaaataacctgaaaaagaaatcaagaaagcaatcccgtttgcaataactacaaataaaataaaatatctaggaattaatttaacaaaataagtgaaagatttctacaatgaaaactataaaacattgatgcaagaaattaaagagcacaacaaagaaatgaaaagatattccatgttcatggattggaagaatcaatattgttaaaatattcatactgaccaaagcaatgtacagactccatgcaagtccttcaaaataccaatgacattctattcttcacagaaatagaaaaaaaattttgaaaatttatatagaactgcaaaagacccaggaaaaagctagaattatccagctaaagctatcatgtgcaaaaagaacaaaactagaggaatctcattacttgacttcaaattgtactacagagctatagtaccaaaatagcatggtactggcataaaaccagacaaatagaccaatggaacagaatgaagaactcagaagtaaatccatatgtctacagttaacttattgcataaacaaagatgccaaggacatacattggggaaaagacaatatcttcaataagtggagctaagaaaactggatatctgtacgcagcggaatggaactagaccccctatctctagctaaccatatacaaaaacaaaaacaaaacaaaagaaaaaaaacggattaaaggcctggtgcggtggctcatgcctgtaatcccagcgctttgggaggccgaggcgggcggatcacctgaggtcaggagtttgagaccagtctggccaaaatggtgaaaccccatctttactaaaaatacaaaaaattagccgggcacagtggcacacatctgtaatctcaggtgctcaggaggctgaggcaggagaatcacttgaacctgggagtaggaggttgcagtgagccgagatcgcaccattgcactccagcctggggagcaagagtgaaactccatctcaaaaaaaaaaaaaggttaaaggcttaaatctaagaccttacactatgaaactaataaaagaaaactttgggaaaacactccacaacactattcttggcaaaaatttcttgagtaataccccacaaacacaggcaaccagaccaaaagtggacaaatgggatcacatcaagttaaaaaccttctgcaaagtgaaggatacaatcaacaaagtgaagagacaacccacagaatgggggaaaatatttgcaaactatccatctgacaaggaatcaataaccagaatatatgagaagctcaaacaactcaatagggaaaaaatccattaatctgaataaaaaatacatgaatatctgaatagacatttctcaaaagaagacatgcgaagtggtatataacaatatgctcagcatcactgattatcagagaaatgctaacaaaaactaacaatatgtcacctcaccccagttaaaatgatttttatccaaaagacaggaaatcacaaacactggccagcatgtggagaaaagggaatccttgtacactcttggtgggaatgtaaattagtacaaccactatggaaaatcgtttggaggttcttcaaaaaactaaaaatagggctaccatatgatcccacaatcccattactaggtatatacccaaaagaaaagaaatcagtgtatcaaagagatttctacaccctcatgttatagtaacactattcccaatagccaagattttgaggcaactgaaatgtccaccaacagacaaatggatgaagagaatgtagtacatatacacaatggtgtactattcacccataaaaaaagaatgagatcctgtcatttataacagcatgaataggactggaggtcattctgttaagtaaaataagccaggcacagaaagataaacttcacatgttctcactgatttgtgagagctaaaaattaaaacaattgaactcagggggatagacagtagaatgatggttaccagaggctaggaagtgtagtggcggggaatgaggatagttaatgagtacaaaaatgtagttggaaagaatgaataagatctagtattcgatagcagaatggggagactaaagttaacaataatttactatatatttaaaattaactaaaactataattggattacttgtaacaaaaagaaaggataaatgcctgaggtgatgaataccccatttaccctgatgtgattattatgcattatatgcctgtatcaaaatatcttatgtaccccataaatacacccagtatgtacccacaaaaactaaaagttaaaaaaatcaaaatatcaaaagcaaaaatcttattttatatatatatttttaaatgtcttagaaaattctcaacatattttacaatttttgttaatgtctcaggatcattattattaattttaatagttgtattgccctgtaaaatacactttcggagacttgttgacaacttgataggctttctggtgttatttgtcttcacacatgatggcaccatgtattgtgactttggagggcatgatatttgttggtttgttgtttgcttacttttttgctataaaatagttatttctcaccatatgttttaaaatctgtctatttcaacttttgcttcttgataagaggttagcagtccttttctgctaagagccagatagtaaatattttaggctttatggaccatatagcctttgtcacaatcactcgactcaggttgtagcctgaaacagtcatagacaacacagaaacaaatggctttggctgtgttccaatggaactttattttcaaaaacaggcagtttgctggatttggtgtgtgggttgtagttctagaccgttgagcgtggtgaaatagccgtgtagagtaatatgtaaaaaagtaaatagaatttttaaaaatgtaagtacatattgtattaggacataatgttaccctacaagctatgtaaaatttagtgctacaattttatgacagcatttgtgggtggttagatgtctttcttttgtcccttctttgcatcttctttcaggtttgtatctatgtggcagatatttggggttattgaatgaatgagctctagaacacttgcttcatatgaaaacgtgcatatgtatgtttatgtatctcagatacagctaaattcattgtaccaattaagacctagctaagattggtttgagctccattctatgaattttagagttcagtagtgcccaccccaaccaccagcaagttgtatgcaaattttcagtgtgagtttatattttcaaggtctcctctggctctgaattctgcttctgtcaaattatttcattttagagattgtacagctatccttgttctctgaaaaagtctcttggccatttctatacctcagactgcagcctcctaccatggtttttggttttccttagtcccttccagatggctcacaggagctccaaattcttctcacattgttctgcagattaattccatttcctccagtcttactcccaaatttctctctgactcctctgtgcatgttttgatctaccaagatgctttgctgaagaaagaagacctattctcccttaattgaactgtcttcctaagaagggagttttaattttaagtagaattttttccctatggatatatggatgaaagactaggtggatggatggctaaaaagatgttatacagtactgtatattaggatagctacttcatatggaggctagtaccaaatatgaaaaacctatttttagcttattatagttgattttgtgatctagatattattcagcattgttcttcaaatcccctgccatagccaaaacacaccttatatactatttcaggaagaatttttttcatttcttatttgtttcattttataacatatcctaataatgattttattacaaaaggagtcaggaataccacttcatatgatagtctactaaatcttaaaaatagaatataagatcataaattgtgtaaggtaaaagttagacttaaaatcaaagtatccactgaaacttacaatagtaaggtggtatttctatttggaggaatgtctccaaatctccaatattagaaaaatagttatcttattattattaaatagttctaaaatcggtaattttaaaatgattttattcaaaattagtattattcagtcatatatgaattatcagccactcttaattgtctacaaagagcactgcaaagaacatcaaataaacagatacatttttaatagactaaagagcatggtggttcatgcctgtaatcccagcactttgggaggccaaggcagggagatctcttgaggtcaggagttcggtaccagtccggccaacatcacaaaaccccatcttttctaaaaatacaaaaattaggtgtggtggcatgcacctatagtcccatctacttgggaggctgagacacgagaatctcttgaacccaggaggcggaggttgcagtgaggcaagatcataccactgtactccatcctgggcaacagagtgagactccatctaaaaaataaaaataaaaataaagagcttacatctggttttgtttctggaagtgatagaaatatgattaaatgattagaaaaaatcagaagtttaaaatataagttaattttttaaaaactcacatttcctgagcactacagtaacctaaaaccagcttctttgaagtttactcagtgtgttgaactgtaatggaaagctagcagctatactgcttatacttttttcttagaatcactagaaaatatttgaccataaaaaatagattctgagtaaaattactttttttaaacaaccaaacctgatccttttgtagttcgtaagcatgatgattgggtgttcacgtgtatgtgtgagatgtgccacccttgaaccttgtcaagacatcggcacattacccatctgatatgaaaaaaaaaaaaaccctgtcatcttataaaaattcacatttataaagaggaatagagataggacactgaatgctttgggtttgttttgtcgacatttatgttttcaagcaggcttgcttcatccaatttttatattcttttgaggaaaaatacactgccaggaatcacagtatgcaatgcaaattagacacagaactattccctatggactttctagcctatggagagagatatgcatgcagacaacagagaaaaatggggtcgcttctgatgtttggactggcccacgataaactttaataaactagaagagacatagaggacagttttggctaaggaaagaaaatgaacagaggctcaaaagttcaaaagtctatgtccaagtaaagcaagtgcaggcttacattttactgtctttaatttctaaattcaagaagctctgaagaccactgtgtgtgttgttgtttttccttaagctacagactgacctgaattgacaggaggctatttatagtctttatttgtcctacttatgagaatatttatagattttactgcagaaatatcaatgtatttcattataggtgcaggccccaacatacatggattttgctaatattttatacattaactgtattactttaaaaaaataccaccttgttccccaaaaacctgaattacaaaactcactcggccccagctgtttctggtaaaggattgtagacttgaagtaattatgggggaagtgatattatagaaactatgtccagaaagctaggtgaagattgtgccagttcttgaacataccaagttacagattttggtaatttgactatagattgtaaggaaccattatacacttttgaagaagaagtgaagtattcaaccagtttttatcaaaattggttgaatccctgagcacacgctattttaaattttttctccatgcaattacaaaaactctgagtaagatggtgtcagatgaaatgccttttgaaaatagatatttacatccatcatttgttttcttgtgatggtgtgtaggagaaataaggttagagaaaacaattctagatcatgtctgcagcttgctaagtgtcatgccacataaatatggtcagagtttgatgtccccaaatgactatgcattaaaaatacaagaattgtctcatagaagaaaaaaataaacaagcaaaaaaccataagaaatagtgatttatttcatatttgttcatgtttcttgctaaaaatacctgaaggcaaattccagaaaatttgtttctgatttggttaagaaaattgagaaattaaaaatgttattgtcattgttgtgtgtacagtgtatgtgtgtcactcatagtgagtctttaaactctgcctttaagaacaagcatcaaaagtttggtacaaaatcaatgttcacaaatcagtagcactgctatacaccaacaacgacaaagttgagaatcaaatcaagaactcaattgcttttaaaacagctacaaaaaataaaaaaaatacttagtaatatacttaagtaggtgaaagatctctacaaggagaactacaaaacaatgctgaaagaaatcatagatgacacaaagaaatggaaagacaacccatgctcataaatgggaagaatcaatatagtgaaaatgactatactgctcaaagcaatctacagattcagttcaatccccatcgaaaggtcatcagcattcttcacagagctagaaaaaaaaatcctaaaattcatatggaaccaaaaaagagcccacacagccaaagcaatactaagcaaaaacaacaaatctggaggcatcaccttgcccaacttcaaattatactacaagactatagttaccaaaacagcatggtactagtataaaaaataggcatgtagaccaatggaacagaatagaaaacccagaaataaagccaaacacttatagctaattgatcttcaacaaagcatacaaatacataaattggggaaaggacaccctattaaataaatgttgctgggaaaactagcaagctacatgtagaagaatgaaactggattttagtatatgctaatccagaatgtaggtctaatgctgagtgtctaggaagaccatggactaaaaacaactaacaaacaagaaagcactatccaaataagctgccatcagattaacacctcctaagcaaaagctacttatattcctcaactcaaggtgtcagtgacagcatcaagcgtgtggtagaaaattaaaggagggggttgatttcccaaattttatcttcacataacttcctttcaaaatataacaacccaaaatgttgttaataactttaagttttaaatttcacctttaagaaaagtattttcatttgctttaaaataattatacgttttaaaaatagggacgaccagtgggtgtttcataataggttctgaccggagaaaaagaaaaaaaaatacccaaacctcttttttcggaatgtactagtccttttgaagaagatcttctgtaaatggggagtccactaagtgctaatctctatgttaagcatttccttttctttctttcttttttctttttgccacaacaaacctcaaggcagactattagctttgttttgcaaatggggaaaatgaaattaaagttaagaaatgtgtccattaacacacagctgggacttgaactcagcaatgtgtagctctcaagtgtttcttgtgatgtcatctaagactttgacaaccaaactgatcataatctctacaatgtggagtggacaactgaaatgaaaacaggaaagaaaaaaaatcaccactctaataacgtgtgtagctgtaaactatcttgctgtccaatatttttcttatagttttaaaacattaaactgcagggctgggtgtggtgtctcatgcctgtaatcccagcactttgagaggccgaggtgggtgcatcacctgaggtcagttcgagaccagcctggccaacatggtgaaaagctatctctactaaaaatacaaaaattagctgggcatggtggcatatgcctgtaatcccagctacgtgggaggctgaggcaggagaattgctcaaacccggtaggtgaaggttgcagtgagctgagattgctccattgcatgccagcctgggtgacagaacaagactctatctaaaaaaaaaaattaaaatgcaattcagataccataaaatttacccttttaatgtgtacagttcagtggttcttagtatatgtataagtctatgcacccatcaccactctaattcctgaacactttcatcacctcagaaaaaaactccatgcccattagtattcacttcttatagaattttgatgaagcaaaatccttcaaaagctttctactaaaagtccaattttcttagatttctccttcaaacaaagacaattcttaaatattttatagatacagaagagaaattattaaaataatctcaaataacaaatgagcaatattgctgttgttgaataaatcttcaaggatgaaaggatgaaaaggattattactggtagagtttcccaaaagtcataaatgtcaataagcttctccaccatatcattaccacaatttttaaggacctacgatctggcaggcaccatattaagatattctatctcaatttattctgacaacaattctaaggaagtatgaatactcactctattgtacacatgaaaaccactgaaagaaggagcagtcgtctcatccagtaaatgtaagggttgagaggtaatcctaggtccagtttgatttcaaagctcaacctctaaacactaagctccaccaagtgagagaaagtggatcaaaagagaatgtagatgtcaaattaaaaaaaaaaacaggatggagagagaaggatgaacagaagtgggttaagggtacaaacatacaatccaataagaggaataaatgtaatggttggtagcagaataggatgaccatgcttgacaaaactgtattatcctcaggtgatggacattttagataccttcccttaattgctacccattagatatgtgtaacaacatttctcatgcacctcactgatatggtttggctgtgaccccacccaaatctcatcttgaattcccatatgttgtgggagggaccccatgggaagtagttgaatcatgagggtgggtctttcctgtgctgttcttgagatagtgaataaatctcacaagatctgatgatataagggggagtttccctgcacaagctctcttcccttgtctgccaccatgtgagatgtgcctttcaccttctgccttgattgtgatgccccccgagccaggtggaaccataagtccattaaacctctttcttttgtaaattgcccagtctccagtatgtctttatcagcagcataaaaatggactaatacagtaaattgataccagtagagtggggtgctgctgaaaagataccctaaaatgtggaagcaactttggaactgggtaacaggcagagattggaacagtttggagggctcagaagaagacaggaaaatgtgggacagtttggaactccctagagacttgtcaaatggctttgaccaaaatgctgataatgatatggacaatgaaatccaggctgaggtggtctcagatggagatgaggaaattgtgagaaactggagcaaaggtctcttgttatgtgttagcaaagagactggtggcattttgcctctgccctagagatttgtggaactttgaactttagagagatgatttagggtatctagcagaagaaatttctaagcagcaaagcattcaagatgtgacttgggtgccatcaaaggcattcagttttataagtgaaagagagcgtaaaagttgggaaaatttgcagcctgacaatgcgatagaaaagaaaatcccattttctgaggagaaattccagctgactgcatacatttgcataagtaatgagtagctgaatactgttccccaagacaatgaaaaaatgtctccagggaatgtcagaggtcttcatggcaccccttcccatctcaggcctagaggactaggaggaaaacgtggttttgtgagtggggcccagggtccccatgctatgtgcagcctaggaacttggtgccctgtgtcccagctgctccagctgtgtctgaaaggggccaatgtacagctctggccatgacttcagagggtgcaagactcaagccttggtagttccaatgtggagttcagcctgccagtgcacagaagtcaagatttggggtttgggaacctccacctagatttcagaggatgtaaggaaacgcctagatgttcaggcagacttttgctgcaggggcagggctctcatagagaacctctgctagggcagtgtggaagggaaatgtggggttggagcccccacacagggtccctactggggcactgtctagtagagctgagagggccaccatcctccagaccctagaatggtagatccactgacaggttgtaccgtgtacctagaaaagctgcagacacacaacaccagcccatgaaagcaactgagagagaggctctaccctgcaaagccacagttgccgagctgcccaagagcatggggacccacctcttgcatcagtgtgacctggacctgagacatggagtcaaaggagatcattttggagctttgagatttgactaccccactggatttcggacttacatggggcctgcacccctttgttttggccaatttcttccaatgcttgaaccctcattgtatcttggaagtaacaaacttggttttattttacaggctcataggcaaaagggacttgtctcagatgagactttggactgtggacttttgagttaatgctgaaatgagttatgactttggaggactattgggaaggcttgattggctttgatatgtgaggatatgagatttgggaggggccaggtgtggaatgatatggtttggctgtgtccccacccaaatctcatcttgaattcccacatgttgtgggagggacccagtgggaggtagttgaataatgggggtgggtctttctcctgcgctattctcctgatagtgaataagtctcaccagatctgatgattatataagggggagtttccctgcataagctgtcttctcttgtctgccgccatgtgagacatgcctttcaccttccaccatgattgtaaggcctccccagccacgtggaactataagtcattaaacctctttcttttttaaattgctcagtctctggtatatctttatcagcagcatgaaaatggactaatacacccataaatatgtacaaataaaaaaataaaaatgaaaataacagttcagtctaaatggattatttacataagcccaggatgctgaagatggttatctagtgctggctcctagaagcattattgcagtgattttcatatctacatattgaatgcttacaatgtgcacttgcataagaccatagaaaacagatctttctgatccttccatttttcattatttgttaattaacctataaaactagaaatggaaacaatggcaaaatctggaagtatacaacctttcagactaatactatgaacctcttctcccaggtctttgtctgttggtcttccaggatctttatcctaaactagtcatcatcttagtttattttctgttgttataacagaatatcacagactgtaatttataaagaaaaatacatttaatttttgcagtcctggaggcagggaaggctgctagcatctggtgagggcctttttgctgtgtcatatcatagcagaaggcaagtgtgtgctagctcaggtctctcttcctcttcttataaagccaccagtcccattgtgagggccccactctgatgatgttatctaatcctaattacctcccaaaggccccacctccaaattttatcaatatatgtttggggattgagtttctaacacatgaaattttgaggacacattcaagtcagcatcaatttaagggttccaaaggctccttttctcctggcttgcatttcttttggattttttcaagacttcctttatttttatcatacttgaaaccatgtggtaggtgtgtcattgatttttaggaaagacagaaggcatgacgcatactgcttttgttgtaactgaaatgtaaggttataataaatttgattaaggctttatcttcagtcgaaccatatggttaactctaaagaaacagaatcatataactattctgcaactcgggtaaagttttcaattcaattcagcagatatttattgaccatttcctatgttttgagtagcatctgtatattgcgaaaggcagaaatagtaatatttcatgatgaatgacttttaagacttaccatgaaagggaacaaaagtgactgtgtttgtgtctgtgtgcatgtgtgtgtgtgtgtatgcgtgtgtgtgtttataagcttgaggtgaggaactgtatataaagcatgtgcccaactaattgtgacacaaactatgatgtgataagtgcctcagcatttcctgattcctctggctaaatcaacacttctaccacctctttagacaccataaaatcatgtacttctccacttttgcagccgttacagttgtaataatatattagtttgcatgactatttggctaaattttcaagaagtactttggctttttggaaatcagagactattgtgtgaaagttctgtgctaagaaatatgcgcaggtaagctccaaagaagggcacctaatccagccagggaaggtttattgacagaggtgataatgaatccaatttttgaagggttggtgtgaactcactggaagaagaaagaaagcaggatagtctaagcaagtgaactatcatgtgcaaaaacatgtagacatgaacatggaagtgtgactcaggccaggcgcggtggctcatggctgtaatcccagcactttgggaggccaaagcaggcatatcacgaagtcaggaaatcaagaccatcctggccaacatggtgaaacccatctctactaaaaacgcaaaaattcgctgggcgtggtggcgcacacctgtagtcccagctactcaggaggctgaggcaggagcatcacttgaacctggaaggcggaggttgcagtgagccaagacggtgccactgcactccagcctggcgacagagtgagactccgactcaaaaaaaatagaaaagaaaaaaacggtgagactcaaggacatggatggagttaagttcatgtacggagataaaagaagacaagcaaatcatcgtaggttttatgtaccaaacttacactgtcgacttaatcttcaatacaatgaaaagtttctgaagagccacattctttagggacttaagttttggggtgattattttggcagtatggaggctaaattgaaggcagttggaatatttttgtaaatatgttgtagtaattaggcaagatgtgatcagggcctgaaggaaggcaagaataaagtgatggatgttagagatgttaaacaaatagtatctgtaatactctctgattggagataagttagcaagaacagtctaggatggctcacaaggctttgaatttggaaactggatagttagatgtagttgctcattaaaatatggagctcaagaagtttacagagaaagatacgtgtccagttgtagttattattattatttttttgaaatacctgtggatcctttagcagaggtttccagggaaacttggaaatggatgattaaatctatgtaggtatcttgtcagcagacacagatccaggagttatcaatagcgtaggaattttaatgtgtaagaagatgcctagtaacagtaaaaatggagaagagattgaagcttggtaaatagtaacacttagaggatggcagaaagagaactatgatgttaatagagaagtagaaggaaaaccgagagaaaaatgatgtttctgaagatgaggaagagtttcttgaaatagagtgatcaataatttcaacacatataattactgcatctttgtagcattaggacaaaatgtgtccattttatctggaatagccttgattatggtgattttataaaaagaactttggtgagattgtgcaagcaggaggcagcactcgggtttaagaaagaaaagaaatgctgaagtgaaggtagtacatatagcctcttctttaagatgtttgtatgtttgtggaagggaaaaaagagaggatagaaaaataatgcacaaaggagatttcaaaattccacatgtgccttttgcctggtatgtgagagtggcaactttggccttaacctgtgttctgcacaggcagaaagatatatacatacgtacacttgtgaatatatttgtgagcataacaatcaccttaaaggggctgaaatattcattctccaaattacttcatgtccaacaagcctttgatatggatcctaatgaacatctccagttaaccctttttctcctcctttcccacaaccatttgtattaggacagttaaaagcttgccatcaggaaagttagccaaagtcataagcttagactctttcctatgcccttttctgaaagttaacactaatagaaagctcagagtttactgtaaaggcaatgcttatttttattggtcagatctttaaatgaatggctgccttctgcttctaaaaagcagacaatttacagagaaaattcaatttccagggaaaggaaaaatgccctgaaataatttctatgcctattatcaagtaagtttgattctgatgctatcaaaaccaggggcagcatcatagtgtcttttggagaatgttgcactaggaagggggcaggggttctgagccacttagttgcagccctgctgctgggggccaggtgactttagaagtcactgtcccttttttgtattttttttttctgttaaaggatggagttagaaaataaatgtctaccatgagttgacttatgttaaaattttattccctaaaaccccaaatgaagtcattccacatatacatatcctttttctatctgcattttggaagaacctcttctttacaaatatcatgatactgctatgtggttttacatggtttgcatccctcctcggcaatcagaatcactcttctcatctgtgctatcattaccacaggcttcacatttctctatccatctcaacattgtttgtatagctatctattatttccatccctatgagatagtgagtccactgagggcagggttatatttaaacaaaatatgcactcgctaaatgtgcagtgaatagaaatgaatattgtttaattcatttaacaggtggacttaatagtatcttataaaatttgatgaaagttttatttggagagcttggataatacgaaagctaaaagaggttgggtgaatctttattatcagacttgggtagggctctttattactgttttggtgtctttaatactcaagattgttgaaattccagaagggcatgtgggaatcaaacatggtttataacaatcacatggaagtaactatttttcccaatgtcacctaaatgtaagacttcccatttaaaaatgaatatatagtttaaaagtaaaataagagtagcacctcagatttatggcactttggaaatttcttatcatttcctcatgcatcccttcatcctagaggataatgatcatcaatacttgaactccttttggtaccaacattctactgttaggctctgagaagttatgatgttcacttaggtcttctgattctcaaggcatcaagactatatcctgttgcaacttagaaataacatttctagtccctgtgtgtctccttcacattctggatttttgtattttaattaagcttagtaataaatatgttttaaaaatcaaagccaaatttatataactgatttttgttgtaatatgttatttattttgaagaatatgcatatggtacatttttaaagtataaaatggaatgcagtcaaaagtaggtctccctctctgttgtgttctgctacctaatctttctccctcagacgacaactgatgccaatttcttgtgtaccttttcagaaagagtccatgagtttataaacgtgaacgtatgcacattcttattttctagattacacaaattgtggcaaactatatttattcttttatatggttgttaaattcagtaataaatttcacagatctattcatattaaaaaaattgtagcacattactttgtgggaatataccaaaatgtaagttagttccttattgatagattagtatcactactatcaaatagtgttatcaacaatgttgtaccgactactttgtgcagttgtcactgttgtatgcttatgcaactatatctaaaataactaaataagaatttgccaaagggggaattggctttttaaagtttgaaggttagagacaaatagctatccataaaggcattaatgcttacttttaccaagaatgtatgagggttcccatttcctttatattctctctagtacaccaagttatcaaacatttttatccttgaaatcttatacggtattaatatttgattttggattatatatattatttcatgtgtgaatctgatgacttttcaaatgtttaaaagtaagttatatcttctatctaattcatatcctcactctaaattctttctgagctattgtttttaaatgtaatacagaattacaaatatttttcccaattggaaaatcacaaaaaagtcccccccgtttttttttgttttttttttttttgagacggagtctcgctctgtcgcccaggctggagtgcagtggcgcgatctcggctcattgcaagctccgcctcccgggttcacgccattctcctgcctcagcctcccgagtagctgggactacaggcgcccgccaccgcgctcggctaatatttactatttttagtagagatggggtttcactgtgttagccaggatggtctcaatctcctgacctcgtgatccgcccgcctcggcctcccaaagtaaaagtccccattgttttcatttcatcaatatttaaataaattatttcttacatattctaggtaccaagatatacaaacataaaagatatgaacatgaacaccaaaatttggaggcgaaaaggctcatagtctcttggggggaaaatatacatgtgcaagctgaataaaataaatcctataatagaggaattgcagtgtgctgtgggaactacgaggaagctgtgactgctttgggggaggcggggagataggagggaaagtttaccagagagatcgctgtggcttctatggtaggtctcaagaaatgtgtataatttatagggtcagagacgtgttcaggtgataggagaaaagggtggaaacacccattttgtattgtgcccctcctttggtaatgagttttgactaatgagcaattgctttttttccttgacattcataagtatttattatcctgaactgattgacctcatattttgcaaaataaacagctcatattttactatgatgatttaaaaacattttccttccatttgaattagataactcatctttaaagttttcttatggctaacgagctcgtgtttattcaagacaacttgttacagtgctattagaagagatggaaaacgtccaactgcagccccaaatcctggaggtatctatttgaagataagaaaaaagttctcaaacaaatgacaaaatgttcaaactcaatcataattagagatatgcaaattaaaacattacaatcacactgacataaatgaaaaagtaggacaatacattatgttggtaaggctgtgggcaaataggcaatcatatattgctggcaggaatctaaattcatacaagccttctggagtaaaattcagcaatacttagcataaatatctatacacatacttttcgacccagcatttctttttctaggaggctaccctggaggcacacagagtgtatttctcacaggagtattggttagcagtgttttctacaatatgaaaatgctacacacaaggttacttattgcagcattgtttataatagtacaatactggaaacaatcaaaagaccactacatagaagagtgtgtgtgcatttgtacaaaagaaacacaggcaagataaactaaagaaaccagttacctataggcagtgcatgggaaataagtggaaaaaaagagggaacaggaactggccaggagggataatgagggaataacgattatcaagctatactttttggtaaagctttgactctaagtaccatagtaacgtttcacgcacccaaataaaaaaaataatttaagtaaactaaatctagttaaataattaaaatcaatgtgtatggaatataagtttacaaatgaataaccaaaccacactgaagaggatgggcaagtaaagaagcaacctaagtcactttcaaaagaaaatagtattttgattggatactgtaaagttcaagacaaaaataagtgtacataaatactgtactcttgtaataagtgtttctcacaggagtatcagttagcaattctctaactaccttaagtgtatagtaggatttaataaataagtgaatatattataaataacggaagtcaggcctttcactgtcagaaagaagttacaaataaggaaaaggcaaaaaataaaatgaacctggtggtattgacttaggattgaagtattaacgatatctatctctatctctagctctacatgatatatcagaatctatctaaaaagatataccgatagaaatgtagaaataaatatgatgtacgtgtatgtgtatatagatttcctagctctctctgctgagaggacctgagagcaataacaccccagtaagaatgaggacacttagcgctcagatgttggttgctattgttctccaaagaaagaacccagactcatttggcaatcatttgaatccagggctagggtagaggggacaaaataaacttggaacattatgtgatgccaaacaattaaggaactgctaaaaaacaattggggtatgtcaaaaggacacaatagcaaatcagaaggatctcccaatggctaaagccagaacaattttagccacaaaataaataatgatagtattggattataatccttagaataaatatccttgaggccatactgatataaataaataactgaatacataaataaatgtaggagaaggaacagctcttacagaattcctattactttagacagaataaaggaaatacaaaagtcactgccgggcaaactgcacattaataattgttgcaagcaagatctgtcaatggatgctaaaatcagtggataaaagtttgaggaaaaataggacattagcacagcatcaaagttttttcctcaatatatttatcaattataaatgaaaaaaatgtaactttacaatatggaaatctagtagacataactttaaccaggcaatcaaggttaataccactaactgacatcatgtaccctcccccctgccataatgatatactaagaaggatacaacatcacttctatggcattcttgccaaatgaataaccttagactaatcattagaagacattggacaaatccaaattgaaagacattccgcaaaatatttgaccaatacctattagaaatgccaaggtactgaaagacagggagactgagggaccatcacagattgaaggagattcaagtgacatgacaatcaaatgcaatatgggtcgtagttggatctggtacagaaaaaggacatgagggtggggaagagctggtgagagctgcatagctggtgagagctgaataaagtttgtagtttagttaatcacaaggtactagtgtaaatgctctgggtttgatatttgtacactggtcatgaaagtcattaacattagggaaattgggtaaatggtatgtatgaactctcagtcttattttataacatttgcataagtggaaacttatgataaaaaagtttggaaaataatagaaggagataacgaagatgaagaagatgaagagaaggagaaggaggaagaagaggaacaggagtcagggaggggaaggaaaaagaaataaaaaagaacaaaaggaagaagagaaattttaaaataacatgtttgcttttttaaaaacagtatcaagattgtatttgaaggtattgctaagatgagagctacaggcatggttttgtgccctttcagagtcaatgggctatatgcataacatggaacaaaaatgccatgttagatatcgtactgattttcatcttttagtttatatgttggtttctttgtgaaaataaatttaatatcaattcaacagacattttgccattgatatattcaataaaagttttgcaacctggcatgattctttatatgttattaccaattcaacattctcttccaaacagataaatatactgattaattgcacagctgatgccaagagtgaacagatgcctatgtttagtcttaatagaaaaatatcttagataagtcacaatttaaatatctcaaaactcccttacacaattattaatttctacaaactcttagtaattatttttaaaaagaaaaaatttaggtactaggaattcaaacacattcatccatcattatataccagaattcctaatccttctcaaaaagtgctaacttattttattttgaagccacactggtgagtcacttgctataatttgtccaagatgtctaagtcaattagaaaacagaaagaatggctaactttaaaaaatcccaactacagacagataacataatttaaaatttgggtattaaaacaataatatatctgaatataaaattaaaaatattattgccagtaaaattttgagtttggcttatgggataatacacagaaaggagaaaagatgaatgttcttgttcaaactaaaatacatcactttcttacccttcatgtgctcctggctattttttttgttttgttttgtcttttttgggatgttatgatacatgtaaaaatgaattctgatatattgctcaagatacttcagaaagactgtactctgtgtgcctaattgtggaagtgggtgacaatcacatgaggagttgctttaaaaagcatgaacattgaaatcctgataagtgtaagagccttttttaaaaaataaaaaactgtctaagtaatacaattctactgatcaagtccctttcatacttacttacaaagtagaaacttatgttgatatatacttacaaagtacgagcttactattatcaaatgtccatactatacagtaagaaaatattttgcattaaaatgttacgtgccctctgaactcacctgaaagctcaataccaacaaaacaatctataaatgtaatacttcagtttgtttttataagtactgtgatgatccatttcctctctggtcataagaatcactgtgatagccatttaaacaatacagtacactatttgaatattaattgtactgagttgtctttcctgctttgcatcctaaaagtttacaatcctgttgtggagtaagaagactcacacataaatgcttcctataatcaaataacagagccactgtattagacgtcaatagtctaacacccagaacccagggaagttggtaataacaccttatgttgcaaagataattaaaatcttcaaagcactttcacatgttttacctaattgaactcttgccacaaccttgccaggaggcagagagggttgtgataaatataaaaactgatgctcaggaggtcatatgtgttttaaaatcacacacggacctgttcactctgctcaagtgccgtcgagggaaccacagcattgtcctgttcatttgctatttttccaggagtagcacttccctcaaagtaaggaaatagctctaggtattgggttccagaataggagagccctaccggaaaaccgtgttccgctgcagcacaaaggactatttttagatgttttccttttgctaattgtctctccctctgtggggaatttctatgggtagaatcccagatgagccaattttctcactaattctcaaagagacaggaaagatgaagaccatggctcaggttgccctggggctgcataacttcttcggtgatgtcactgcagtggttttaggaagatcttcaaggaccttggagcttaaagagcttgtgataccactgaacaacaggactaagaggcgactagaaagaaaggcctgggcatatcttcttgaatcttggaatcaccccaaatgacctttcctggagcttcagctttgaaaggagctaagagggtgtgaacccaggtggtggctgtaaactcaagcggccctccagatgttctggtttttcttccatcacctctgagagaaaaaaggaagagacttcttccaggcaacttcaaacatcatttcaagtgttagggagccagtggaaccgcgaatgtttagcctatataagagaaagagaacaggtgtgatgcaaaccatttttactcccttgcagggaagagctaaccagttagtgctaggcagccttgagacaatggatggaacaaaggtgaggtcagttgttggctcaacctcagggaaaacctaacagttttcgtgcaatgaattacctagggagctgctgagttcactgtcacctggattattcaagcagaaattcactggtatgaacactggcattcatcggaaagtgaaaatgattcacaaccctacaggtggggtctaaataataataattgcaaacactattttagcacttactttaaaacaagtgttttcttaactctcagggggtgtgtgagacagatgctatctttaactttcttttaaagatgagaaaattgagggacagagcggttaagtaatttgttcaaggtcacacacctagtaggaatttgaacttaacgctgcttgtctctagtgtctgtgctcttaatcacttgtattgctaagtgtcccctaaagtcccctcttgccctgagattccacatagggttacgtcctgtcacttcgacagcattcttcccatgcttactcattgcacttccaaaagggcattgttggcatcaggaaaagaaaaaaaaaaagagtcaagggggctgctgggaaaaaaaaatcgagatctttaaactcatggagaagctgtttggtcatcggggcgggctggcagaggcaaagcctgccagaatactggcgccaaagcgaagcgctcttttgtcttcagatttctcgcctcacctgcctcctctccctctgtcccttctagctccacttcccactgcacctatgctaagcttttctaggagcctgaaaggcacggggacaaacaagcacgccgctgccaatcctctatctcacaccctcttccccacccagattgacggggagacgcccagggtggtaagtgacttacccaaggacacagagccccgaccagaaaatccaggtgtccagactcccacatcggcactctgtccacgcctacgcacacctgacttctcatagccggcacccaggagctttctttattccacgtccccgcctccctaccccaccccctagttccctagagtcgcttctgacgctctgcagcctccggggtccagccctccctgcgggtgcttcccttccgccggattcccacaccggagtcgcccttggccgcgcgcagcccgcgggaccgctgccttccgggctggaagccgcgcagccctctcagcgcctcaagcccgggacggctgggacaccgaggtagtcgggctcccagggcacagggtccggcaccgagggcaggagcaggggaggtgccaaggaccccggtccagaaggcacctgtaaggaagcaccgacccgcagtgacgtcctccgcgtcgtcctcagaccagccaccgcctccggaaggtctcaaggggccgtgctcgagcccaccgaggggtggcagcgcctcgggctctcggagggctgcccccggcggaccggcacttccgcgtcccggcccgccccctgccggcgcccgggctccctccggctccatgtgcaaactcccctccacctgggcgcgcgcgatggactcgggacccggcttccgaagacaggccgcctgttggttggactactagcgcaggtgggcggggagttgaccaaccccacacacgcgcttctccatgaagattcttgagctttctctgaagaaaggagtgcatatgctgcagtgtctctgtggaaggagcctgaggtccagcgacagcccaagtgaaccccagctcaaagggattgtgacaaggttattcagccagcagggatacttcctgcagatgcacccagatggtaccattgatgggaccaaggacgaaaacagcgactacactctcttcaatctaattcccgtgggcctgcgtgtagtggccatccaaggagtgaaggctagcctctatgtggccatgaatggtgaaggctatctctacagttcagatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtgaagaaaaccaagccctcatcacattttgtaccgaaacctattgaagtgtgtatgtacagagaaccatcgctacatgaaattggagaaaaacaagggcgttcaaggaaaagttctggaacaccaaccatgaatggaggcaaagttgtgaatcaagattcaacatagctgagaactctccccttcttccctctctcatcccttccccttcccttccttcccatttacccatttccttccagtaaatccacccaaggagaggaaaataaaatgacaacgcaagacctagtggctaagattctgcactcaaaatcttcctttgtgtaggacaagaaaattgaaccaaagcttgcttgttgcaatgtggtagaaaattcacgtgcacaaagattagcacacttaaaagcaaaggaaaaaataaatcagaactccataaatattaaattaaactgtattgttattagtagaaggctaattgtaatgaagacattaataaagatgaaataaacttattactttaaaggaaaggatttggagaattgaactcacaaactgatgttatatactcaatagcttaaactcatgataatgctgcgatgtgtggttttgcttgattttgtattttatttgggcatctggaattgacacaccattacattctgtttgcaggattttttttgtaaccatgaaattgaacatttccaaattataaactatgttaatacctataaaatatatagccaggaaccatttatcatcaagaaaagtgtaagaaattatttttgagatgtaatttaagattgttttatgtaaaaggaaaatcttgtatggcatcgaatagccttaatgagtttaattctttcacaaaaatgatttcaaattatcctagagtataacatttttatcaaagatattatttccggagttcttctttctttcttttttttttttttttagtaatttagcaaaaacattactgttctaatgctgaagtgacttttgccagtgccatgtccaggtggtgaggtataagttacttgctcttagcatttggtctgatttttttgctttgtggacacctttgagagtatccacaaagcaatgtctcaggtgtggacacctgagagcatgttttagaaagctttgtaccctgtcttgtggcaggaaagaaagaacaggggttttacataaggaaataagtcctaggaaattagtcaacgcaaattgcatttgcgtttgtaccttaccacagtcttatattgttttttaaactctgccatgaaatttggagacatgactgtgaaattcctaacttactatcttacaaagccagtagctaatttgttgctctatgtatgatcctgttacaagtccagtttgcaattcatttgtttcctagaacacagaagggtaccagtaatacactaaattttcaaggtgtgtagagaaataatatggaattagcagctatgactccaacagacaggattgtgtgagcagctgaaaggagcaaaaaagaactcagtgtaagagaaggcacatacatagttaagaatactaaagtatttttaaaaatcaaggaagaaataaatgttacacaatttgcattggaataaatagatctatttagtcctacaaatcaggagtggtgtagagacatccaaatttaaagaaaaaaaaacacaaaacagaatgttaaaaaatgtatgcagatttatggatattatcaatgagaagacatagcatgtaacttctcctatatctctactgtccagcatgtattgttccaaatatgactccctaaaatatatacactttgcagaagctctaggccctcacctcaaaccttgccattggttgccgtatttcaaggtcaatatagtttccctcactttacacaatcattattcttcaatagtggaccatatccttcaccaggtatcctatttctgttatctagaggttagcagaaaatgaaatgaaggaatttccctaagcagttgggaagaacaaattgtatgcatgtaggcaaagattttgaagatacatttgcaagagatatttgtttaaccaaaatatttggaaagtaacaaataaagacatttaaattttctaaaaatggacttgctcttctaggaaaagaatacccctggggcaaaaatataactctagctgtatttcttcttgtcactcttgattcaacttgattataaatacacctgtcactaccagaaccaaaaaaaaaaagaaaaaaatcccaagcacaaagcttattttatttgaaaaaaataaaaaagaaacttcaacactatgggacactggctcttttagcatgaaatgacttgagcttttgtagtgatgatacacatacacactcatcagtaaaacgatggtttcataaataacacaattgatgcaaatcataaaaatcaattacaattatgatttcatgacaaaatatatttaattaagtttgttatgaaaaaaatagagatatgaatcactaacaaaattcctccattttcagtggctattcatcatttatcatctagactcacatttgtctccttcctgatagcagttaagaaaaaattctaaccacacaatttgtatattgtttttctccgtattatgttaagcaaatgttcactgcagtaaaatgttttggaaattagctttgtcttatttccagtttagttcagagaattaattggaaacctgatttcttttacacataaacctgacaaaaaatgtagcttagagcaaagggtgaatgtttgcttaactcctgcttacttctcaagtacatgaaaactttaatagaatatgccagtattcactgagtttttaaaaatattaccatgtgtaaacatataatatccaacttcatccaaaaatatggttgagtttaagtactttgtttttcaggcttatttcaagtataataattctttgattttcattgttctgatttctgggtcttcaattcattcgtcacttttcctttttaagtaaaataagcttttttttttttttttttttttttttggagttgcattgggatttttcccaggaaaaaatatggcttttagtaatgctttgcaattggctacgcagatataaattaagatatgtttattctgagttcttattggaataagtttcaaaatcaacgagcttaagaatgaaaacaaaacttttgagagtctcacaaaatagctttctggtcaatacaccttacttgatttttaagctcgcagaataaagtatagaaacaaatggagctgaagttccatttgctaattcagagacttttgtgcttccgcaaattggagggcagcaagccatcctattctcatagtaatcgttttggctttgaaatttacatacaatttaatagcacatttttagccattatggattggcgcaataaagagatatcaatgtaatgcaatgtgatgctttatgggcctcattctaattcagaaagcttgtttaaaagaactaagactcttctgtttaataaaatagcaacaatctaatatctagattggtagtcctgcggtgccactagtgggagatgagagtattaagacaagagtaaggacaaggaaagacttaaaggttgcatattgaaaagtttggaattcctaatttgggagcactgatttcttggtgaagaagtaagtatgactacgttgccagtaattttttaaaaacatagacccagaaatagcaaatcgatttcaccctcataccttagtctacaaggccttgctcttgagaaggttttccatgatattgcttaatttcatctgcacaagatgagacacaaacataaaaattccctgctcattttaataccataaaaggctgaggttatttctctgtcataaaattgtaaatagcattttttaagtcaaaattacatttaaaacagtggattgttctacaaatatatatgtgtatatatacatatgcttctgaaataaggatatattatatgagtttttatttgatttgtggtctttagtcataggtaatcaaaaataaagagatttgaatgcaaaactttatacattaatgtacatttctaatgatggtacaaattgccactttataataaaaaagaaacaggtgggaataataatcaaagcacgtgttccttcagtactttggtgatttttaatcccccttgtgatgcacaggaaattattttttagttacaaaaagttatcttagaaatctatacttcccaatacagatttcatgttaagtcatatcaaattgagaatttgtggtgaaagaataggaaaaggatgctagatgctgatctttctttttcaggatttttcctggagcccaagttaaaaattcaatacttaaatctaagttaagtgaaaattaataatgttcagaatgatgtattgagctttagtaacagacggaagcaaaaaaaaataagaatatttaacattatgataatagccttaaaataatgtaataaaaattgcatcattaaatgttctattagttggaaagaatgagctgatgtttctttgtctttgctccaagtacaatttaaagacagtgacattcattttacttaaaattgttcaaaaagtccaaaacatactcccatggctagaattggtattagctccaatacaaggttaaatgttacaatcttaagaaattattgacactgaaatgtttagtaaacatgttgtatgagaaactaaacaaattaatgtttcatttttccattaaagca

SEQ ID NO: 2925 - DNA, 11361 bp, Homo sapiens
aaaaaaaacccaaaatgttaggctcaaatcttttgctaggccttagagtctcctcttagtgatgaagggatgtttaatgttaaggaggcaacagctttattcttttttcacttgggtaggaaactgcctcttcatacagaacaatattcatatgttaattgaaagctagtattatttttgtacattcatcctctttcacttattacggaaattcttgctttctggaagtttagtatcaccttaggtaagtggactacctcaaaatttctgaaacatttggcaccaactagaaacattagtgaagtccatgagatcatttgagtcttctgtagctgcccaggaaaccgcctgattaggttgtgtgtgtgtgtgtgtgtgtgtgtgtgtgtgtgtgtgtatgtatgtatgtagaacttgatgctttgaaatgaaccatctgcaaaatagaggcccataaagggtattagttttgatgtgcacctaattgctacaattttcttgaaaataaatatttgaaagagaaatcctccataatggaccttaattacaagagaagtgatttttcctatcttgggatatttttctttctttttttttttttttttttgagacagagtttcactcttgttgcccaggctggagtgcaatggcgtcatcttggctcaccccaacctccgcctcccaggttcaaaccattctcttgcctcagcctgccgagtagctgggattacaggcatgagccaccacgcccagctaattttgtatttttagtagagacggggtttctccatgttggtcaggcaggtcttgaactcctgacctcaggtgatccgcccgcctcggcctcccaaagtgctgggattacaggcgcaagctaccgtgcccggccggagggggtatttttcaataaagtttttctcagagaattcatgcaagaaaagttgtttattctaacaagtttggtggtaactacacagattggttttggcactgattttttattaacagttgaatgctttataagtagagaaattgggtatctcctttaagtggagattattttatgctgtgacgaaaatgttacacctgcagtgaaagtttttctcatacagaatccaaataattgaattaaagctttgtagcacatgagatgacaacagtctgcaattctaacactgtcaggtacttttatatcttaacaacaccaggccaaatttttcttattgatgatacatatacatagtgaagtagatttttaaaattgtatttgaatatgtcattctgaaccatactatgacaaaataatcacttcccaccccactgaagaaatgagaagcctttttctggcttgtctagatcatttaataagtttgtagatgcactcaaagttcagaaagaaagctaacataaaggggcaatgaaattaaccatgtcaagtttaatatgtgaattaattctttattactagcacttagaaggcatggatacctacaaagaaaaaaaattgttaggtcaaaaataggacatactgtttcttataagaccggaggagtgtagaaagcctctcctgcttatgcaagatctgcaggcttccttcctcttttcctcccaaattccatgatcttgcctaatgaagattaacttaactacctaattaactttcacaggatttttgtggggtagataatagttcttgtttttagtagtccagatgaaaagaataagctgggcctctgacattagctgtgctgatacacgtctcttctaccaccatcaccccagcatcactaatacctaaattgccaaaattcagttaaaatagaaattcatctttttcatagtttctagtatggcacttgtaaactccctatattgcttttaacaaacttggtaaatgtaaatgcagaagtcatccacttttaccaacagaacaaccatcattgttcttgatcttttatattttatatatataaggaagggaatcataactttggggattgctgtaagttggccacatacctgcctatataaactatacatctttaccaagaattgactgtgttcttccagacccgtgccacgtatagtcagacttccagtcacaagcttcgactgaagctcaaagtggatttgggagggactaattattgaagtaggtattataagaatttaaagggatgcaaaatttcatctctgtctcaaagaagcttagagtttaatagaagagggaggctaaactaaattgttcataaatataagtagaataaagcatgtaatcaaaataatacaggaaatatcacaaatgctatgaaaatttaattgagggcaatttattatagggcagtgttttgagtatatcatcttaatctttaaaacactcctgtgatacagtattgtccttatacggataagatttaactctaaaaggttaacatcgtttttattaccaccagctatgaaatagagctgggcttcaaatcaaggttttccttgttcagcactcactctttccactacatcacagctgcttactgatttgagagagaattaggcaagaagtcaatacaaactggtgaccagtagccaaacttggcttgatgtagttttgttgggtcagcaggagtttaactttattttttttgagatggagtctcgctctgtctcccaggctggagtgcagtggcgcgatctcggctcactgcaagctccgcctcccgtgttcgcgccattctcctgcctccgcctcccgagtagctgggactacaggtgcctgccaccacgcccggctaatttttttgtgtgtatttttagtagagatggggtttcaccgtgttagccaggatggtcttgatctcctgacctcgtgatctgcctgcctcggcctccctaagtgctgggattacaggcttgagccaccgtccccggcctttttttttttctaatgtgaatgtgtttgagcagtggccagtattccactctttaagaccttacaccagggccccttgagacaaatgaccgagtacagagctgcaagtcattccttcgcacagtagtcctcaagctttaatgtgcatcacagtctggaaggcttgctaaaacacagattgctgggctccatcttagaatgagtgtgtctgaggtggagcctgagaattacatttctagcaagttctctggttgcagatgctgccagtccttgcgaggatcacactttgagaatcactgcttaccaaacttgtagggcacttttggggaaggcttgttgtgtttctgttgtttataatacaaaaggaattgcttgtcagaatgtgcagaaataggttaaaaagaaaattaaaattatctatcagagattataattgctaacatttttaatggaccattcaagctccttttttctatgtgtgtatagtatgtacttttttaagaaaccaaaattatataataataataatagctattaacacctttttagcatctattgtgcaccagggtctttacatgtagtatttacttaatccttttaatatccttatgaagcaggtaccattactatcattcttatttttcagatgaagaacttgaggcacagaaaggttaagtaacttgttcagtgtctcattgctagtaggtagcataatcaggattaaaaccaaagcaaggccaggctaacacctgtaatctcagctctttgggaggccaggacaggtagatcacttgaggccaggagttcgagaccagcctggccaacatggtgaaaccctgtctctgttaaaaatacaaaaatcagccgggcatggtgcctgcctgtagtcccagctgcttgggaagctgagacagaaaaattgcttgaatgtggtagatggaggttgcagtgagccaagatcacgccactgccctccagtctgggtgacagagtgagactctgcctcaaaacaaaaaacaaaaaggaaaacaaaaaaccaaagcaatctagtgccagaaccactctgctatactgactcttctactgtgcatattgtttttcacctgtattgtataatcacatcatgaacaatcttgatattagacatttcttgtttaacatttaattttttaattttatgtaattttttgtttaagagacaaggtcttgttatgttgcctaggctggagttgaactcttgggctcaagctatcctcctacctcagcctcctgagtagctgggacctccagcacgtaccaccacactcggcctcttgtttaacattttaagtgaaagcctgcttttttctcttaaaatatttgaaacgtttaaagatatacgcaaaaataatgtaaaaaaaaactcatgcacccactactagatttaacaaaagttaatttttctgcatatttgcttcataatccccccctctttaaaaaacacattataggccgtgcgtggtggctcacggctgtaatcccattactttagaaggccgaggcaggtggatcacaaggtcaggagatcgagaccatcctgactaacacagtgaaactccgtctcgactaaaaatacaaaaaatttgccgggtgtggtggcgggcaaaaaaattagccgggcgtggtggcgggcgcctggagtcccagctactcgggaggctgaggcaggagaatatcgtgaacccgggaggcagagcttgcattgagccgagattgtgccactgcactccagcctgggcgacagagcaagactccatctcaaaaaaacacatgttggccaggctggtcttgaactcctgtcctcaggtgatccatcctcctcgggctcccaaagtgctgggattacaggtgtgagccactgcacctggcccagtgaggtggatttttaaaagtaaaagaaaaaaattgagttccagagctagaagttccatcctcagtctgtctgaagcatgcctcctgcaatcctttttcttttttaaggaccaacaaagtcatcactacaacataaaggaccctgtgtaatcaggcacctggcttctctgacattatttccgtggcttgtgtgcttcagccacactggcctccttgtgggtcctcaaacattccaagtacattcctgtctcaggaccttggcacttgctcttctgcctggaaaactcccaggtagaatttatatagttgtcagctcaaatctcagttccagtgagatggcttttctaaccagtgtctctaaaacaacacctctatcctttttctctcttcccctatcccactcattttcttttcttttctttttttttggctctgtcacccaggctggagtgcagtggcatgattttggctcactgcaacctccccctcctgggttcaagcaacttgcctgtctcagcttcccaagtagctaggactacaggcgcctgccaccacacccggctaatttttgtatttttagtaggacgggatttcaccatattggtcaggctggtctcgaacttctgacctcaggtgatccaccctccttggcctcccaaagtgctgggattataggcgtgagccactgcgcctggcccccactcattttctttataccactaatcatcaggaattatatgattacttgtctgttgtcatccttccccactagactctttagtaaggcttttcataagggcaggcagtttgttgattgttggattccctgtgccaggcatatatagcctgaatagatattgttgaatgaattaatggctatcatctatggcagtgtgtttcagcctgatattcaagcataagttcctggagaatccaccatttggttgcagtttaaaaatgtttatgttgtcattttgatgctaatctaaagcaaagtcatattgtgatttttccagatgagtaccttaaaacatgaagttttgagagcctgaattcacaccaagtttaggattttgtttttatcagttgaaagccaatgaacattgtgacaaaacgtgtaaggtttcacgatcattttgagaaaagaggtgggagagttgagtcatcacatgtcacacagtagcccatggcaaactcagtgctgtaactgttggtgccacgttcctactaaaaatagaaattgcacataacacacatgcacttacatatatttgcaacaacttagtcactgtaagtaaagtagtaaatacacaatgaggaatttttttttatttcccaggaaggcttaaattagataccatataattcagatttaaaatagtcgaaaaaatactaaccttatcttaaagtgagtagactctaatcgagtgatattcaaataaaactggctttccagggttttgtagtgccagaatttttgttaaaatttgagatctgattatttcaaactagcaacagaagaccaggaagttaataatgcagtgtatttgtgcaaacagctgtttttgcattgacattattaaatgtacagagggcctgggagcagtgactcatgcctgtaatctcagcactttgggaagcttagactggaggattacctaaggccaggagttcaagaacaacttggtcaaccccatctctacaagtaataaatttaaaatttttaaaagttagccagctgtactggtgtgtgcctgtagtcctagctactcaggaggttgagacaggaggactgatggagcccaggagtttgaggctgcagtgagctatgatagtaccactgcactccagcctgggtgacagggagagatgctgtctctaaaataaaaataaacatacagagacacatttaacgtagaaatagatcagaagttgaatcttaatgctcataaagctaacactttacaattcaagttactattgattttattttatttaatttatttatttatttatttatttgagacagagtctcactctgttgcctaggctggaatggagtggtgcaatcttggctccctgcaatctccgcctcccaggttcaagcgattctcctgcctcagcctcctgagtagctaggattacaggcatgtgccaccatacccagctaattttcgtattttattttattttatttttgtagaaacggggtttcgccatgttggccaggctggtcttgaactcctgacctcaggtgatccgcctgcctcagtctcccaaagtgctgggattacaggtgtgagccaccgcgcccagccgagttactattaattttaaatggcaaaaccaaacaaccaatattgttggagcagaagaatgcttatcactgcaattctattacctttgcctgttacctgtctttattttccctttatttagaacctgaagggtgcttttagggtggaagaatataaagtttaagaatttgcttaagtgaaacacttgttatatcttcattctagtaacattctagtttttgtagaagggcctgatccctctctctgacccatttaactctgtctcctaaacacagtctaattcagttccttttgtatgacataaaaatcagaataagaagtacctgacatactttctacatctgtagttgcggaagacattttaataggtaagagcaaaagcacaagcctgcatacttcttttttaaccctgtggatcatttaaataaatcctttcgtattattccaagatataagtgcattgtgatgatgtataagaatttaaatataaggcagtctgcaagcagggttttttatgtagatgggcagcagtttattgtaggaaattatgtgtatgtacttaaattaaagcatcagcactaggtgtccgcagattacatcaaagagggcctcaaattgagtatcagtaaaatcgcaagaaatggactacatcctttacaaggacacctctggtacaacattttcctgttcaaacattaatttccacatagcctggcatttggcaggttatgtgccatgaattctgtggatattagtaggcatcatgttgaaggaagggttctgtagtcaaatgcggactaaattagttttattctttttccactttaggtcttctcatagcctttctttgctaaggacattgtgactctccagagagcaacagtgatggctctagaatgtctaggaaaaagaagggcttaatgtcaggagtctgcttggggcacacaacactagaagatgtccttctgcacattgtttcatatcgagtgtgtattttgtggtgatctgggatgctgatagaaataattggatgttagtgccctaagccacctctgcactattttttttatttatttattttttgagacagagtctcgctctgtcacccaggctgcattgcagtggtgcaatcttggcccacagcaacctctgcctcccaggttcaagcgattctcctacctcagcctcccaagtagctggaattacaggcacctgctacaacacccggctaatttttgtagtttttgtagagacgagtttcaccatgttgaccaggctggtctcaaactcttgacgtcaaatgatccacctgcctcagcctccctaagtgctgggattacaggcgtgagccaccgcgcttggccctctctgcgcaattattgatatgtagcattttcacacttctatggccatgaaaccattttgaacctgtatcagaggcgcacactttaggaaaaaccaatacagacaatagtgcctcttgttacagtttttgcttttatcagtgtgttggaaaaggtcctctttatccccaagatcagttaatgcttccttatgttgtcatttctgtgggcttttttccatttaatgttttaatccagttgaaatgtatttttgtatatgatgtaaaagacattcaactcattttgtgtatgtatttattgattgaaaaatgccagttatttccaaaccttgcgttaaatgtgtttttgtttttcttttcaggtatggaacccttcagatcaaagcttaccaataaattcagtatgtagaacagattaacgtagttgaaatgaggaagaatgagagttatctcaaccagccagcaccccctatccccattcccacactttccctcatgggaggctgtcgggagcacttcgaaaaccactggaaaggccgggcacggtggctcatgcctgtaatcccagcactttgggaggccaaggcaggcagatcacctgaggtcaggagttcgaaaccagcctggccaacatggcgaaaccccatctttactaaaaatacgaaaattagccaggtcatactttaaggagcccaagagctttataacataacaaaagaaactgaaatgtctaataaatgtgtacataacaatatgagttgtttgtgtttttttggcctataaaattagcatagatctttaaaataatatacagtattggtaagagctgaataaatacctttaatatagagaaggtttaacttagtaaaactatgtttggtagataatgtgtgtcaaaagtttacaatgctcatatcctttgatccagcatctcacttatagggtttcaccctaaagaaataaacagaaatgtgtgaaaaaaatttgctgttgtttatattattgacaaaattgaagatatcaataacagtatgagactgggtaagtgaatcatggcacatccccatgagatgggatactcttcagccatagaagtgatattgtagaaagaaaaatattgagtgcttgtgatgaacctggcaccataccaagcacctcatttatactgtctgaagcctaacaataccccatacgataggtattattattcccatttataggtgagaacaccctcagaattctaagttaggtaaagttcagctagtaaggtagtgttggtagtgtaaggtagtgttgctggaattcaacacatgtctactcttaacccttattcttagccactgtcatgatacaggaaaatactatttactgataagtttctagtaatttaactgacattaaacacatgaaaactatatgcaattccttcctttccaaagttcctaggtttggtaattttttatcctaaaatgaatttatatgttttttattgcttatggaagtattagatgcctactcttaagaattcaaactgtacagaagattataaagtagctgcatctttagtcataaattataccctctgtatatgatacgatagattcataggctctttctgttccctcaattctgttcttgctgtggtatcagcttgtgggccctggttggggatagagatgaactagaaaggcaaactgagtggggtgcaggtgtgagtggttgactttcaccacaggtgattagaaacactgattctggagccaatctggctagatggagtcccagctcttacttaccagctgtttggacttggacaactaataggagtgcttactgtgtgtgatatgcatacatggtttccccatttgtctttatgagttagatgtttttattccctttttatacagatgacaaaactaaaattcagggaggttacgtatggaagtagaatgaatcattagacccatttctaggactacagacaagataaatactgaaagctgcttgtccaggagatagcaaaatgctgacaaatgagaaacagacctgcatagccatcacaccctctagaaccaaggggtagtgttttaagatagaggactgggtgagtatcagaaagctgtgctttgaaaacctgactgcttttaagtatttcctgttttgttctcattttgtaggtattagaattatttctgaattatcagtctctcatttgtgctttggagaagcagaaaaggcaaaaggggtctttggccatcttctgctggagcttccagggaggatgtgtctccaagagaccagatgtaccgagtttgaaatcccagaagcccaagaggaaaagaatcacagggaggaaaagactgtccaaaggcttctggagtcttctgttctctaaccttggaaggttttgaacaatatttctcagaggatagcctttcacttattcatctgtccagcatgactcatccccgggagtgttgatgctttgtttacaacgaatgtcttacaaatgctgactgaacactagcatacctgcatgaacaacagatgtctcctgtcttcctccagcattcacaaaccaggaacggctagctttttgacctgttcaatccagctgtctgcctcctccatggctatatcagggctgcagagctttgccggagaaaaaccacgatggtgaagatgacgccctgtatacaactcacagtctcccacctggactcatccttcagtgtttcttccttccaattatttctgtttctcaaatcagagctttctacttcaaacgtgtataagattttttggggtatatttttgttttttgagacagagtttcgttcttg

SEQ ID NO: 2926 - DNA, 8332 bp, Homo sapiens
tatgtagaactgacagttggcatagatcgtaaactgtcctttcataagaaaagaagtgtgaaattatggatgtataagatggacaagtagaacgcaactcagatcctgactcacttttagaacgatcaccaacaaagagccactcaattagcagactgtaatatgagagataaataaaacttttggaggtaaatccatggatattccaggatttaggtgttgcagaagtggagtcaagtgaagcacttgttcctgaagtgatgtcaaaagagagtgaccagccggataatgtataaagaagatatagtattttataaggccattatggctctagacactgtctttcatttgtgcaggttcaagctcagaggcaccaacaaaacatccatgcacaaacttataatgtaagatattgatttattagcttctaatgaaatatgtttttattaactaagagattgatacataaaacaaatcttgatactttaagcaagaaatttccttgtagtgaatagctttactagaaataaatttattattcaagatagtggtttgtgaacataggattgtaagtgagaagatgtcaattaagttagttgtctctattaattgactgtgctggtgttgcagtagtttttcagaattaacataactaattgaaagcaaaaacatctctccaaacatctctgagaaaatgatacattactgtctaattttccaccttcttttctatgtttcctccagtttatattattatttcagttaggtacaatacaactgattgatgtagaacttcttttgtactgtttataatcttctccttggaacataaactgctattgcttttatcagaagaagccttactcctacaagtaacacacaaaccacacacctaggtaattcttttatgtaaaaagttaatctgatgtattgaatgttctctttaaatttcaattccagacatctattttcctgatatattttaccaattttggggagtgtgctctatactaattgtttttaagtataatgatgatcagcataagagttattattaatatccgctagctgtgagatttgtcttggaaaataatacttctcatttgtagatcagtttttcccagaacacattatgttgcatattagataagaaaacagtgcctctgcagcaaattacaaaagtcagagcaagagagctaggggagttgagaatcagtacctcagaaagaaactttgctagaattgtaccttatttgtttgaagacctatttcttatgttggggatggggatgaggatgggaagcataaatagacaccgcttgacatcagtgtctgtaatctcaaaactgaaaaactaaagtatcagtgaaaaaatttcttcagttattcatggtgttagagtatttgaaaagcaatagaaataaaaatgttaaggtattggttttagatttgttgggaggtgattcttcctgaatagagaggcattgatatcctttgttctgaaccatcttttcgagaatatttgtgtagtacttactatacttttatttaaacattctctccactatgataataaagataatgtctccctcaagagcaaaggttgaaaaccaaaggagaaaaaaagaaatgtttattatgtatccttaaggttctgttttttatttttgtgtttattgttatcaggtttccatgtaacagagtattttcgagtgtgaggcttgacaatggctccatggatttaatgtatgcattctcctctgcctggctatcacacactagagagagggaacacaatgatatgctccctcagttttataagtttctaagcattgccacagcataattataaagtatatgctgatactctttaggggaaccatggtggtgtcatgaccatgtgaactccccatgcaggtattcagttccccttctttcaactcccagctttaacttaccctcctggctttagaaagcagaacttaaaaactgatgagtaggtaatgcaaaattacaatcattacattttagatttgaaagacatcatggagagcttctaatcttatcactccattttataaagagggagtaaattgatcagaattgctaagaagatgctagtcagttgtgaaatctcttctacccagaataggacaggagtctatgatttactctactttcttcctatgtaaaataactttacccagatcatctactttcgtactataatatagactccccaaaggcaataatgacgttttgttcaacatctaccaattccacagctccctggcatgtaactgaattcatagctaatacatttgattttacctacttgagcaaaatctccagggaataatggtgagtacctgagtaatggaggtaaatgtcatgagtaaaagtatagattcactagattcaaatactacattaatgtctactgtgtgacattaagtaaattatttaaattctctaaatcttcagttttattatttttaactttgaaatagtaatagctaaaaagtagatatgaccaacatgaaataattagggtaaaatgctgacttactaccaagtatggagcatagtaaatgctcagtgaattatagttatatttttccataaaaggtacaataacttacgaagttcttaaaaggcattatattttaaatctacttgaacatcttcttcctggattactgagcaaccagacataattcttttttccttttttgagtcagcctcttccgtttagttcttccaaaaacatcttccactcaaggctacctaaaataaacccttctgctggatctactgttaggttactcttcccatctcagttgctgtgttatatttttatacttgagggattatatttcctgcagttgagtctaatttacacccttaggttagatgaatagtttgtaatttgaagtttggaactgataagatggaagcacaactaatatacaatacaaagtaaaaccatttaaatcatcacatgcctcatacaagtatctattgactacttattatacaccaggcatctttctaacagtacagtaattaataagtctccaataatggtttatggtatttaactgcttgaaattattaacatttaaagtaataatcatagctaacatttattagatatttattaggtgccaagctttttccaagtgttttataaactgttaattcatttactccttgcaaaaaacccttgagataaatattattatctcctataaacaaaagtaaaagaagcaaaatgtgtctaagtaatttattgcacgtcaaacagttaggaaatggtaaaactgggccaaaaaactgaaatagtctggctccaaagcccttgctattaatcactatgtagaaagacaatagaggcatacaggcagtaaaatgcaatgaaaaagaaaactcaaagccacaagagatattgtattaaggttaggtttttatttgaagaattttgatctaggttagcttataatatagtactttctcaattatatcagctaattttttatgtgtcaaaatgctctacagagaccccaatggggatggggtgatgttagttttaccatcatcatcacttactattaactttctggctgttaagtttctcagctaaaataaggtgctcacttgtcttgtagataccatgcactatatattttctaagaaattccaaggttttagtaattgtgcttcatgaacatattatgttttatgtgtgtgagtgtgcatgtgtgtgtattcagtgaagttggagactatgttttaatttctgtgttttacatgcttccctaattctttctacctgacagatccataattagtatgtttttaaatgccacctgaataaatctcccaacttgataataatcctgttggttaacagactaaaagaaggaatttaaactcttttagggtgtgacctaagcccattactcataagttgttcgaaatcttttctatttgattctgtgatgctgtgattattcagaatggttaactaatcttggaaattactgaacctgatgataactttaatttcaagactttgaagtactctccttgatgcctcaccgcttttatggttgtcttcaaagttcacactgtctcatttgcagaaatttctatgtagatctattgcaaattgtatataatgtttcttgtgctcatcatatcctcatcaacatattttgaggttattaatagcatgataattttgaagtgttatgtaaaagaagaagccttttatgtaaaggagatcacattaatccaaactgaagtatatgcagtataggcttgagggaaaagaaatttgaatgcaaatcaaattggatttttttctggaaatgttctgtttaagtctgtgaggaagtcactgcagctgtgattaaaacttattttcttatatttgatcagaaataaaagtccctctccttttcaaaaggggtttgttatgaaggaactttacaacacttccaatcccatttagttattcattcaagagccattgcctttcaccagggcaatattagcagaattggaagtgtaacaaatacataaaataatcagtgggtcgaatgagagggagatcacagagacaatgagggaagacagctctttatacaagatttctagtaaagaaaaggaggatccaaatcatgagctgaagaatccctggcagcctcaatgggtgaagagaggttttaatgaagcatcaaagcaagggatggggcatcttttgccttttgaggaaaagggcatttaatattcatgtgtttctcagtgagcaggtctatgcaaacctacctccaaagtcagaggaagctgagaggcctaagaaagaggctgacaaatcccattttttagaatcaaacatttcgcagggatttaggaacagaagccatgtctgtgtctcaagcagtgttgagataagatactggatccccatgccattgtccctcagacctagggcttatataacatagggaagtggtgactcagaaggcatgtgtaggacaactgcagtacaataatatcaaggttaatttgacctaagggcaggatttatggtaagcacctgctcttacataagaaacaatagatgaactgaaaatcgtagcagcttcccagagcaggaattaatcagaagtcaacatgttgaattagcatccacagtggagctgccttggcctgcacatcatctttgcaagagagctattcttgtattgacttcatgatctcttgttttgccttcaagcttccttaaaatccatggtttttgtcatttaaaaaaacaagcagggtaaggagttatggaggaaaggtggagaaatgttattttagatagcagtcagaaaaagcttgtgcgaggggagatacttcagcagtaatcataatgaaatgagggaacaagacatgcagatgactaataagagcactccacctctgggcacagtagctcatgcctgtaataccagcactttgggagggcgaggtgggccaatcacctgaggtcaggagttcgaggccagccctaccaacatgctgaaaccctgtctctactaaaaatacaaaatttagctgagcatggtggcacatgcctgtaatcccaacgtctcgagaggctgaggccagataatctcttgaacctgagagacagaggttgcagtgagacaagatcatggcactgcactccagcctgggcagcacagtgagacttcatctcaaaaaaataataataaagataaataaaaataaaaataaaataagagcactccagattaattccagcaaaggcaatggaattaatgtcagaaagtttatgggaagtttgaaaagcagtaaaaaagttaataaaattcattatggtcaatgaagtagacaatggtaaaatgatgccataaagaacactacggacaagataacagggaaatttaacaccatgttgagaactttggatttcatctgtgtaggatgggatgccatctgagtgcactgaaaggggatgtttcatgataagaaatacattttaaaaggatcattctagccactggacattgaacagatttttagtaggtattgaataattgaggacctgaaagaccctggtaaggagtttgacatttaatataaatgtgactgaaagccatttgagtgatataaataaagtatgaaatgatcaagtgtatgactttcagggatgttttagttgctgtatagataataatttttaggagaaccaggaagataattaggagaccattttagtggtccaagtaaaacaaagtagtgatttggactaaacagttggtaggaaatggtaaaaagtagttggttttggatattgtaaaggttcagataaaggaacttgatgttagattgaatatgtgatttataagaaatgggagatggccgggcacggtggctcatgcctgtaatcccagcactttggaaggccgaggtgggtggatcacctgaggtctggagttcaagaccagcctggccaacatttagaaactctgtctctactaaaaatacaaacattagccaggtgtggtggtgtgtggctgtagtcccagctactcagaaggctgaggcaggagaatcgctttaacctgggagatggtggttgcagtgagccgagatcgcgccactgcactccagcctgggtgacagagagagactccacctcaagaaaaaaataagaaagtggagagtaaaaaacaacttcatgtttggtgcctgagcaaattagaagttacgaattaatttgctgagacagggaagcttggaggagaaatgcttgtacacatggggaatcaagtattctttggacatgctgagtttgagatgcgcttaagctttcaaattggaatgtggatttagaagttggatatatgaatgtggggttcagtagagggtatattctcaggattaaaagtatggagtcatcagaaagaaatagataatgtggtgtgagatttttcagtcctctgcttttcaggtatttgctaagatggcatttcttagctctctgtggttatgtggagccttgaaaatagctatgagaggaagctattttaggctggaccatttaacttcagttcagtatgagaacttcaagatatctttttgttgttgttcctgtggttgtctcctgacagttctccagatggtggctgctccatctgtctgggtcccagattaaggacaacttatagcataactcccagctgactcacaatgatatagcatgagtgagaaatcgaccttgccatcttggtttcctgaaatacgggagttatttgttattgcatcatagcctagcccatcctgaaaaataccagaaataaataacgctgtaggactgagtgagatcacccaaggagtgaatatggaaagaagaaagaagaattccaaggattgagccatggcatactctgacagtcactaatcagaaaatgaagaggatgaagattaggcaaagggacagattatgaatcatttatttattttctaaaacaccattattaccgttattatttattttttgtttcaaaattgataacaatttaataaaagcacttttccccggacagcggaagaaaacacttgtttaaaaaccaagtagaaccaattatagcacgcatttgtctgtataactaaaagagtatttctgtatcaaaataagtcgagtgtaaagcctatttactttcagtttatacagattcctctaaaacaattttgactactgaggctgatgtatccacaagatgaagcctaagtcataaaatctgcttaacttcatcatttcttcaatatatttgaagttgtggtaaaactttatggcaaattttagtatgtagcatagtctagtatatcatagtccagtaacatttaatagcatataccaggtttttgactgaatttcctattttactcattgcagggtcattttgatttccttaatttaattatatatctctgaacttcagttctacataaactgaatcatttggagcaacaggtatttgttgcccaggtgatagcctgaagaaagacaaattggccacacacacacacacacacacacacacacacgccccgtaactatttaaactctataatatacactgagcaatgtgcacacttggttaatataatttcattgtgtgatacatgataggcaaaaatgctggtcccatgtggattcatgacaaaatatagctgcctccgtggccgccttcccttgttaggttctgaaaagctttacaacaaatgtgaaaatgccatatttccatcagtg

SEQ ID NO: 2927 - DNA, 2292 bp, Homo sapiens
cttggagcctgagaaacatctctttgtataccgggcacaggagagaacaactggcttgtgccttcctttgctccagcttcatttcttgaacatctgttttcccagaggtgggctagggtgccaactcctgacaggcagctagagtctgtttcacgttgagctacctgagaggagctgggaacgtgctgtttctcatcattatcacccagcaagagaactggagagagagctacacccaaaccaattatggtcaggccctctgggctgttatataattttccaggagacagtggagtgaagcagacctcagcgtcccagaggtgtgctgccacgacagtgtgctttccttgcttggaagtcttggaagcttcttacctcctctaagaagattttccaggcaaaacccagatctgctttagtgacttcagaagaaaaagatctgagggaggatgagaagccgatagccaatggtatgtgtgtgaaaacacgtggcagacacacatgctctccagcattctatctcagctgatggtcagcaagccttggggcgtcttcatctccttctccttcatctcactgtctttctaccatgccatctctatcagttcagttcccagtggaagacaggtggtttagccaaagaaaatctaatgaggggtctatttatctgtggtcagggtttgggatgcccatgtgcagtagtgatgccccagggatgagcaagagtgggaagctgtggccaccttgagacctcagggccaacagaagggactatgcttctggagccctggggagcgggagcttggaagagggcaagaggggtcacctcagaagctatagtcacagggagatgcaaccactgcccagactgtggcaaggcatggcgggagcagggggaatcaacacccagcacctgtccctttgaccctttgacttgctggtggcttgcattggctaaaccagaaactggagggcaagagcccctcagtgtagcagcctatgggggccaaccttctgaggtcaaagcaggacagaaggtggagaagggacttggggggacacatggagaacaatcaacaaagtttaccccctttgtcacttggcactggaaaatctgagaagcaccagatgttgtgagttacctaagaggggtttgttgcttcaatgtctttccaatttgggggatttttgaagaaagtgtttatgagcagggcagcttgcccctttacctagtcttccaagaataaaagacaaggcctcagtttttagtcagttgtaaacacttatattctttatttttaggttatgaggatgagggtcgctatccaaaggattgagagagtaggcttttgcactatgtagccatggattcaaatcccagcattaccattgattagcttggggcttttataaagttagttacctctcttagtctcgagttgccaaaatgtaatgtgttagaaatatcaaaacatagttgaaaggatggaatggggtaagatgtataaattatttaataatgttagctgcatgtttttattttgcaaacacatggagtggagtcattgggcaagaagcaagactctctctcaagggaaagtcttggccatttaaccagttatggggcgcggggaggactttggtgacatggtaggtgcccaaggtcctcagagtggcaaatcagtgcatttaagagcagttttgtctgcctggctgaacagatgctcccccaggagaactatatccacaggtactatctggaagttagaaggtatcctggtgggctgcctgcaggcagggggttggtgaccctttgtcttggggtgtgaggtcagatgtgtctgattagacaggactaagaaggagacaggctgctgtcctcttggatggctcatctcaaataacggccaccatctaacatctgactagtgctctgccacctataaaacactctcatttcctttgtctcctaatttgacatggatagggctcagcttgcttgttcaaatctcccatgactgaccacttctgctgattcacacaggaaaaatcatctagtcaaggtgaaaaaaccaaaccttgaatgtgtctctacagactttgagattttgagtaggaaatagaaggacttgaggactcatgagttttcatctctccttcctgttaaaggttgagactttgcaagagagagggggccgtgagctatgagcagctggctctggggagggttttagaagtataagattggtggaggtgacacaccagggtgacgggttgcttgcaggaatggag

SEQ ID NO: 2928 - DNA, 2222 bp, Homo sapiens
taatgatccagcccaagtgtcactggtgctgacgttgagtaaccctatcttaagctgaactcatcatctctccattccagccttggtggattctgtctcctctgaaccattcccatctcactttagcctacctagatcacaaagcttggcactcattatagactcccctatttattactccttcaagatgtgcaagaatcttttctctgcacttttaagttctgtaagaagagtctgtgtcgttcctataataaccagcataggacgttgcacgtgttgtgtgctcagtgaacctggatttgttgattgttgactgactcactctagagttggaaatcttatgcttggggaaacttaatatctctttctttctctgtgtgtgtgcatttgtgcacgtgtctgtgcatagctgtgagaccaaagacctggttgtgcaacaggcaggcacaaacaagactgatgttgtctgtggtgagtcctggacaatgggccctggagaaagcctaggaaggtgggaactgaagggggagatgaggcacacaggaacactggatgggaaaaaggggaggggaggcagtttgggggtgtggtatcacagctctgccacttatcttgggagtctgggcaaatcacttcccctctcttagcctcagtttcttcatctgtaaaatgggatgataacagcacttccttagtaggttttgattttagagtgagaaggttggcctacagtaaagatcagataatgtaaatcagtgaaaaaggtcaggggtaagaaaattacattctctttacctaacgctaaatgaccagttaatgggtgcagcacaccaacatggtacatgtatacatatgtaacaaacctgcacattatgcacatgtaccctaaagcttaaagtataataataataaaatttaaaaaaacgaaaaatacattctctttgctttttctcaaaatgtactttcctctttgtagggctgggactagaatgaggtgagcaaggcacttgccctcgggcgcaatatttaagaaggtgccataaaagtgtagtaatcaaggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaacagaatctcaaaaacactgttgagtaaggaaaaaaaggcatgctgctgaatgatgggtatggaactttttaaaaaagtacatgcttttatgtatgtatattgcctatggatatatgtataaatacaatatgcatcatatattgatataacaagggttctggaagggtacacagaaaacccacagctcgaagagtggtgacgtctggggtggggaagaagggtctgggggagggttggttaaagggagatttggctttcccataatgcttcatcatttttcccaaaaggagagtgaattcacataatgcttatgtaattaaaaaatcatcaaacatgtaaaaagaaaaacgggggtgaacatgctgggtgacatgagctatttaacctgctgtcaggctcacggaatgagggc

SEQ ID NO: 2929 - DNA, 5989 bp, Homo sapiens
agtatacatgaatttgcttctgcctttgccacccctgagacagcaagaccaacaaccccttctcttcctcttcagcctactcagtgtgaagatgattgctgccctcagctgtgcctggagcacagggcacctccagttcggcctctccagaagtaaacttgtcttctgcctatcttgtgtttgttgggaggaggtgacctgggactctactactattgatgaagaatccgaaaaagtcttctattagccctgtgccacaccctacctatgaggcttttgggaagaagcagagaaatcagtgtttactgcagagaacacagaagccagcaagcagcagggaagggaggcgaaccaatgcagcagcccaccgggaccgaggaggacacacgcagagcaagtcacaggaagcgcagctgaaaacaaatggacgcttatcccaaatgcacaggacacttaccaagaactgatggtccgtcaaagtaaagctcaacagctttggctggcaggacagtcaaacttttggacgacagaaagtaacagtgggaaatgggacaacatctgccagcaacgcgagaggccaagaccatggctgctacaggaggggtcagcgtcacagtacacgcatggcggcggttgcacatgcatgcctggggaatgtgagtgttcagacatgccaggagtccagcctcaccaggaaacaggcacacggggacagaggcgcaaacactgaaaactctcgctgaatccactcggctgagcggtggtcacgagagcacggccctgcgctccccacaaaactgcacctgggccccagggcgagacaggcgtggaaggtgcaggggtgtgtgtgggggcaggggctcctggctcagagccgtatccaggaaccccccttcaggctggagccctgccctgagccccctgtggagagactgtggagagccccctgtggagagggtgactgtgggagagcagcatcaggcctagtctcggctgtgaagtaccccccacctccacgcaggatcccggggattctgtcaaggtgggggccgcctgctcagcccaggctccctgaacgtgtggctagctgagtttgcggaagaaaccaggagagtgccaacaccaggcttgcaagcaagaggctccctgactgcctgatcctggagcgcaccccatcctccctgtgttccctgggcctcagctgttccccagtgaccttggagacaccctgccccaccctggctccacaggagccctgcccatcaccgcctcagctctgagtctcccctggggacacaaccttcctcctggtgcagaggcgcaggatgctgcccctaaggcccatcttcctctgcagcatgttttgatgtcagctcattcacaggaaagaaacaatcacatctcagtgcccagaatggggaccaataggagaggtcactgggaataaagcccacacgcaccccagggtccatgggctccccagaaatgcaggtggcctccgccagagccaacaagcctaagttgctgatcagcccctccctgcttccctgtgtggaagaggaaacagaggcccagactagtagggctctgccgtggtggccggctgcgtccccagacctctggtcccagggctggctgggagtgcccctccctgtgctcacttcctgctctcctgggaaatggctcagggatggggcgtgtggggacagatgctggcatagctcacaaaatgcttgcacaagggacactccatggcaggtccctgcaggagagcaaagtcacaacattcagagattccctgcactctgaggcccgcagagcctggccgaccaagcgaggctgggaggatgttgcctgctggtcagggcagccctctgatcagggcggccgagtgaggctgggaggatggtgcccgctggtcagggcagctgagcgtggctgggaggatggtgcctgctggtcagggcagccctctggtcagggtggccaagcgaggcagggagggaggtacccaccggtcagggcagccgaacaaagctggaaagatggtgcctgctggtcagggcggctgaatgaggctgggaggatggtgtctgctggtcagggcagctcaggaggtgctgcccaggaggtgctgtccaggcagagcctagggctggtgtgggtgtgccatgctcctgagaagtttctgggttgtggctttaatgttctcctgcagtgagaacgctgacacttggccaaagggtcctcacctctcccctagtacacttctgagatgccaggaaggttctgaacatcagattgattcctgggactcccctccagggtggccttactggagtcaggagcccctgccccactaggatggctctgcagtggcctgaggacagtgagcactgactggtcactggtgcaaagttgcccactgtgatggttttgaccgttgatgggaaccaagtgaaagccctgcagctatttctaggcatttcagagggtgcttccctgcatgtactctgctgcagaccatcctccctgggccaggagcccgctacacagtaggagattctttttcttctcttttgagcacttttattctctttttcttaatctctgctcctcctttgaactgagaaatgtgcaaatcttttttgttagttttgaggttgcttcttatgcatatttcatctggaactttcccctttgggggtgatctgttctatcagcctgcccgctgctagagaggccgaggtggtccggccagccgtgcgctgctgctggtgtctctgtgggcatgacctggtgagatatcattctgcatctgggggtccatcctatcagccctgtgttctagattccccagtgactgacatttagccagtctcctctgtcactctccagtgacatgtacacactgttggcacgaactgcagatgtcacgttctgtggctgagagcctcagtgtgcatctgtagtaggaggatgtcagtgaggactgtcctgtcgctgctgagctggcaccgactgtgcctggtctacactccaggtctgccaaacgacccagcaaggtccttcacaactcttctgatccaggatcacacatcacttgtgctttgatgcctgcttctgaacaattttacctcctgagatgtccatttttgggagtgtgagccctcctctcctggtgacagctggctgaggccgtccagcctcaggacacacagggaacggctgcataaggagatctggggcagggggcccaccaggatgttctgccctgtggggggcaacaccggctgtggtctgccggcggcatccagggacagtctgtctaggtgaggctgaggccgcccccactcgctccctcacccccatgctgacagcagtgagctgaccacagactgggggagccccacagggagactggcctccccagcacatgccccgcagtgccagacgcggtcatcacagaggcaggtacacgacaccacggacgtgccacgtacccgccatcgggaccaaggaccactgagaaaccatgaaggccatgcagcgactgtggtggcaggaccgtcaggaggccataggtgccacggctcccctctggtggttcacctgcccacctgtagctggggtggcccctccagtgcgctccccagagcagaacaccccccaggcaacacgtctgatgaaggccaacagcgtcagtcctctggtgtttggtgacatcaaagctgtgccgaaaggccttccctcactgctaacacttgaagggcttctgtccggtgtggaccctctgatggcgaatgtggtctgtcttatgcttaaagatccacctccattaactgcactcttagggtttcttcctctgaaaaggaatgaacacgggaaccccctcaaaggcatttttaaatgaagcgtggaaggcatcaaagatgtgctcttcttcaggactcaggcttctccatcattctctgttccttggaagcgtgagggctaaggagctgctgacttctctctcttggccccacttcaagaaaggcttgcttcccacacacctctccacgctcccagtgcgggactgacactctgcaccgggaggccaagggccaccatcgtcttgctgggagaaggtgtgacgtttcttggtcataggagggagtgtgatctgacaccagaggacttaatataacattgcagtgttaacatcttcactggcagattcatggactttccccctcctgaatgcatttcaacaccttgaaatgaacgatgcctcatgtctctgcagggtggacatagctctaactctctgaagctggctgaaggaagcaggtggacacaaaagtccattctttggtgcaattttatagttgggaaagtcaacactgtgtggccaaatgaacacaactgcatttgatcaaagagatagttggctaacagaaaaaaatttcttcatacaaagagttggacaggtgaaacatccacagtctttcttgacctgaatcaagctcagagtgacagtgtttaagattatatgtcaagttctgtgtgaaatgagagaccatggggattcattattgctggagttgacggtattgcagttttataaccatctaataaattagcatttaatactgagagatttcatcttaaactcagaggattgctttgttttaaagaagatttttgcaaggagaagcaatggaaaccattcagaaaatgtgggagataaaaatcctattcaagaaaacggatcttggatctttgcattcacttgatttgtcagaatattattctgtgctaaaaaatagaagggattaaatgttaaaaatcactgaggcacaattctcttgagttcaccaattttgtactcctatttccagtttcttttcacatacgtcattctccatcctgattaagcttgttctttctgagctcatttctgataccaaaagaagtcataaagttctataagattaagaattctcttagaagtacagatttgcatgaacgtcaaagaaaaaaatatcacattttactcccatatgctttaatgattattttattaggtcaggcatggcttaggttagaacctttgtggttttttttttttttaaattccatttagttaaatgttgacacaatatttttggaattctatattttgacttttccgttaacctaggtctgttttggagtggggaagagggtaggtcatcatttctatttaaaatgggaattggctaggcgtggtggctcacgcctgtaatcccagcactttgggaggctgaagcgggtggatcacgaggtcaggagatcgagaccatcgtggctaacacggtgaaaacccgtctctactaaaaatacgaaaaaaattagccgggcatggtggtgggcgcctgtagtcccagctactcgggaggctgaggcgggagaatggcgtcaacccgggaagcagagcttgcagtgagccaagattgtgccactgcactccagcctgggcgacagagcgagactccatcttaaaaataaaataaaataaaaaataaaagtggcgataattaaaaagtcaggaaacaacaggtgctggagaggatgtggagaaataggaacacttttacactgttggtgggactgtaaactagttcaaccattgtggaagacactgtggtgattcctcaagggtctagaactagaaataccatttgatccagccatcccattactgggtatatacccaaaggattataaatcatgctgctatacagacacatgcacacgtatgtttattgcggcactattcacaatagcaaagacctgaaaccaacccaaatgtccatcaatgatagactggattaggaaaatgtggtgcatatacaccatggaatactatgcagccataaaaaaggatgagttcgtgtcctttgtagggacatggatgaagctggaaaccatcattctcagcaaactatcgcaaggacaaaaaacc

SEQ ID NO: 2930 - DNA, 13380 bp, Homo sapiens
aaaggattcattaactgagtgtcctgtgttttatgtgacaattctgtttgatagattgaaaaatggccagaatccttccgctgcctctggatccactccttttgcaatgtgactttgctgtccccccattaagaagtggatttcatttctctacccctttaatctaggctggttttgtgacttactttggctaatagaatgtgtagacataatgatgtgtgaattctgagcctatgcctcaagagcctggctcacttctgctttgtctcctctcagaaccttgtgcagtctccacacccagtgtacccattttcaggatgacagaccatgtggttagaaaaaagctgtcccatctgagactgtcctgagactgttctacaccagccagcccccagtcaatccggcagctgactatagagcatgaattagcccagctaagaccagaagaacgagctcaaattggcaatctatagaaaccaataaatgattcaggagctaataaatgattattttaacttactacattttagttagcaaaagcaaattaatgtagtttgacaatgcaaaatagagctgggcatttttaagaccagaggacagcttataggttgtgctgagttttggaggccacagataaaagtgaaatagaaggtgatattataatcaattttgagcaaataacacttggaatggcttcagtgaatcagaggaaattgcttgttgaaataaacacttgtgcccacagggtgaaaaaattacttcttatagagatattgttttccttctttaactatttaagatttaaaatatagaacctctgctgagtggcttcttccttctttctctgcagatcttatcatgatacatctcttttaaccagcccatgctgcactgtatttctggtgattaattgtcgaggtcagacctgggcagtgaggaaagacctggtctgggaagaactttcatatataataagtcttcacttgacattaaccaattttaccataggctgattagtataaacaagagttaagttcccatggcatatttctggtcataaaaacatcaccaaacttcaaaataatgaccaagacacctataatattaaacattgaaataagtgtgagctgtacgcacatttaggaaagattaattaaaacaagataattacttactcaattattccagttcagagtctcaggtgacctaagaatatcccagcagtgaaggacacaggtaagaactgaccctggaaaggatgccatccatcacagggtgcattcacacacacccacacactcacacacatgcacactcacacacacccacacaatcacacatgcccacacacacacacatacccacacacacccacattcacaaacacacacacccacacacacacacaaacacactcccacactcactccgactgggaccatttagacacagcagcccacctaacaggcacttctttgggacataggagaaaactggagaaacccacacagtcatgaaaagaacgtgcaaaatccatgcagacagtggctgtagagaggaatctatttttttctcactcatgttataacaaaacgacattgtatgtaactacattacttgaggacctgctgtatctataaatcatcaattaattagtcaaatgattaatgaacatggactatagggagtccagagaagagatatatgtggattagcagtagtagggaaagaaagaagtagggaaaagctcacctattatctctggggacccctggatgtctggattttaactcttggccaagataagggcagtgagaataatgcggtgtttaaagtgctaaactctggcgactccgagtcagtttcttcactaaaggttttctagtgatctaattggttaggcagcatgcctttgatatgtggagagaggggtatatgaagcccactgttgattttatagctttgagctctcccaaagcctagattccttgcacagatcttggtggttcaatccctgagacagagtctggtcagatccttgtgtaaccaccttggggagcttgctcatgggatgattgtcaggctcccactgcttgcctgtgctctttttctcttgctgcatcttttccatggcctttacgtaaaagccccacatgtgtatgagtatgctctgtggaatgtggtgagctctttccaatatctggacatgggaaatctttgcattcacagtgcctagggaaagagatgtctcattttcctcatctgagaaatggtgaggatgataaaaacaataattacatcatggggctattacgaagattaaatgagctaacagaggtacaacacttagagcagtatctggtagacagtaaatgctgtgtaagtgctagctattattattttcagcctgtctaaaccttagtgatatggtttggctgtgtccccacccatatctcatcttgaattgtaactcccacaattcccacatatcgtgagaagaacctggttggaggtgattgaatcatgggggtgggtttttttgtttgtttgttttgagatggagtcttgctctgtcgcccaggctggagtgcagtggcgcgatctccgctcactgcaagctccgcctcctgggttcacaccattctcctgcctcagcctcctgagtagctgggactacaggcacccgccaccaagcccgggtaattttttttgtatttttagtagagacggagtttcaccatggtctctatctcctgacctcgtgatctgcccacctcggcctcccaaagtgctgggattacaggtgtgagccaccgcgcctggccaggggtgggtttttcatgctgttctcatgatagtgaataagtctcaggagatctgatggtttaaaaaatgggagtttctctgcacaagctctctctttgcctgctgccatccatgtaagatgtgacttgctcctccttgctttcttccatgattgtgaggcctccccagccatgtggaattgtaagtcaatgaaacctctttttctttctagtttcgggtatgtctttgtcattagcatgaaaacagactaatacacttagcatgggggacttcttttgcctcaactttgtgtgtgtgcatgtgtgtatgtttgataattgcttcctgtctactcacatattattaagaaaaaaatcttgttttaaaatagctggggttttttttgttgtttgttttttgttttttgtttttgacggagtctcgctgtatcgtccaggctggagtgcagtggcatgatgttggatcactgcaacctccacctcctgggttcaggcaattctcctgcctcagcctcccaagtagctggtactacaggcgcccaccaccacacccaactaatttttgtattttcagtagagacagggttttatcatattagcaaggctagtctcaaactcctgaccttaggtgacccacccgcctcagcctcccaaggtgctgggattacaggcatgagccacctcacccagtgctgtttgaaattttatcagtaagactgaaacattccatttttgcctggagggtctgagttattttgacacagaaaagcatccaggtgcacaacttcaaataagagagttttggacacaacactctgtttatcttaatgtaatagttttcaaggaaacagggccccacatttgcttcttagctgaagcctgatgttaaacactgtcttgctttaatttgagcccatcaaaatatcacttcatttaaactccacttaacctctccccatcccgaatatcctatagtaaccttgtcttttcctgtgtttggtgggacactcagattttctctggtgaataatttgttgcatcatgttaataaacttggctttattgtattatactatagtttgttcctggtggtctttatcagacaagctttatagaaatatacatgcatggtattactgaagatttcattcttttttcttttaaacaaactatactagtattttaaaaatatctatcctttttgctttatgtaaatctaattcattacttctaactgctggatagaacttcatcttacaaacacaactatactcccacacaccatattttttttcccattctcctagaggtagatattagagttgcctccaattcctttgtactataaacaatgctatatatcctcatggatttcctcttatggacctgcttaagaattttctggcatatatactctgaaatggtactgctgagttctaaggtgtgctgccaaaattttgctaagattgctaaaatagtagagccagtgtacacacttgccagcacttggcactattatctgctttcaagtatttttccagttagatgggtataaggtggtattccattttgttctgatttgtatttctttgagcacaagtgaagtcaagcaccttttctctgtcaattgcttatttgtttttcttccatgaattacttactcatattctctctccctttaaaaaactgggctttttgtcattatgcaaagaaagcacaagagctagttgccttcttataatttataattaagcagaaataatttacaattaagaggaaattagaggacatgctgtactatgtggcacttcctgaaagtacaaaagataatcccgtgagatagaaccatcataggttgatgtttttagaggcagttgggagacagaaaatgtgagcagagttggaagtataggacagaggtaagtgacggaggagagacaacaaccttccagagtaaggcaggcagcagcgacaaaggccagaggaagaagggcaggtatttgttccagagaaaaagcaaggagacccacttaagtggaggatatggttagggtagtggaaattaaatttgtataaataggatttaactggtaggaggactagtaggttcctgtgatgattggttttttgtgtcaacttgatggggccacaggatgcccagatagctggtaaaacattatttctgggtatgtttgtggatgagatcagcatttgaattggtggacagagtaaagcaggttgccctccccaatgtaggtgggcataatacagtttgttgagggcctgaatagaacaaaaatatggaggaagggagaatttgctctcttggcctggttgctcatcctgggacattaatcttctcctgtctcaggctgcaacctttaccattagctctcctaattctcagtcctttggattcagactagagctacaccaccagctctcttgggtctccagcttaaagactgcagatcatggaacatctcagctttcacaattgtgtgagccaattcctaataataaatcatgtatatataaaatatataaataaaaaacatgataaatatctctatatgatatatattaaaatatataataaatctctacacatatttgtaatatataatatatatttaaatatatttattataaggaattggctcatgaaattatgaaggaaaagaagtctcatgatctaccatctacaaactggagtccctggaaagcccgttgtataattttagtctgagtctgaaggcatcagaaccagaagaaccagtggtctaagttccagtctgaatccaatggcctgagatagatatatatcccctattttttttttctccctctggaaaactctaatacagccactgagcagggaagtaacatggtcaaaagtagggttttagaaagattttattttccaatagcaaagggactaagagggcagaccagtgacaagagcagactataggtaaaaagtgaatgtttatttgcattgaacagaaaatatgttctgggtgttagcaatgggattgaaaaagaaaggataattagaaagatttaaaaagaaaaagaatttggtggcaccaaatcaacaataaaagagttcttgaattttcttagattttagtctgatggattggaaataaattgatattatctgaaacaggatagcttgggggggaaaataactgccaggcgaaaagcataaattgcaatggtcttgtattttaatatcatttgaataaattacagggtgtaaagggaaagcatattgctcacaagttgaggacttttgtccttttcttttcctattatcagatgcttcagccctattctaccttttgtttctgggtttttaaatcaccctttttatacgcaattcactctttctgcatacaaactcccatttatcaaataaatactatttaacaatttgtccatattcccttaaatcctgaaaaaaccaaccatcctttagtaaaacttgttatattttgtgatactctaacactacatgcaaaaacggtgactctatcaaatgatgcagtttattatagtgattgatttgtacatggtttgctaaatgcatctatgttgtaggctttttggctaatatgatttgttaaaaccctctcagcaaagtgctgttacagtgaccatctttggagacttggaaatagcctcattacacagaacttgatgttatacactaatggcatttattagaatggaattctatatgtattattacttccgacaccagcctggcctttgtagcctcctcacagcatgcaacgtcggtaattatgctaatgctagctaattcatgaggacaacttcctaaagtgcccttaattaacttggagattttgtaaacagctatacatgtaggttccggaaattgtggggatatgtcaatctgacatgtgtagagtctgccttcctaacctcatcactttgttttactaaagcttaattttaaacaagaagttccaatctgatatcttttccagcaagtgcttgaggaagattctgataagtgtcactttagcctgtatcctccagtccaagtcccttgagccagatgagttaggtagattggtgtcttttaagttggttagaagagaaaatattgaagtttatttctttagtaaagggtacaatttttccaatatgttcctgcaatgtgattttgccagtttgctaattctgccgaccaacattggtcttcaggggactgttccaaaaatcagacttctcattcagaaagcttcatgatctctgcttcccttcagtcccagctgctggggattttttgatattacagtgactcatcatcctcatttgaatgaaaataatctgatttttgacctattacattaaaatcttataccctttacatgtaagaggtgaaattcataaacctagaacaattagccaggctttagagtgccaaagaagaaattaaacacaataaaaattaagagaaaaggttagtgaatcacatcacagccaagagcaagctaataaaactggaaggaagagacatcatcaggaaagaaccaaaggaaaaggaaacttactacatacaattagaagatatagcaattgcataaagttaatgaaaacggagaatagggatggcttttaataatcttcttattaccactgcatgaaatcacactctcagataagtcctagaaactaagctagggatttgcctttcgtttctcaagggtcccagcatgtcgtttcccctcgttaatttaagttacaatcctaggtacaatcactttgggaactagctatatcacatctaaagataatcaaacatttattgcttagccttttctttgacttcaatagtaagaacctcttctccgccctcagcagaaggagccatgctgataatgagtgattgacgagaagtccctctgggtaaaactgtccttctaactgagtggggttcttcctccactgcaataggacttgctgtacattcaggtctgtccagtggcttctcttctggctctcttcctttatctttatcttcattttcttttcctttatcttcattttctttttgtttatcttcattttctttttgtttatcttcattttcttttccttcttcctctcctccttcagaattttctttcttctggaaggagcaattacaaagaactggtgttgaaatcgtaattaaaaacattggattagattttgattagcatgcaatggctaagatcaccaccaagacagactgtctgaattaagtgaatccaggaatcatgtctgctttgcttctgactatcatttgatgaagtttctggtgtgctagagaatggacttgttgcctttgactcatgatgttagtctgaattgcatttttttgtctctgccaaggaattctcttcctattggtccttatactctctgaattattagactcagtgctcaggactctgtttttgctttttaaatatttacttattctgtagagataaaattttaaatatttatttttaataaaaacatattaaccaatactatataaaaatactgtaaaaagtagggttttcctcttgcctaagcttgtgggagaacctcagggagaaacttatccctttcctagtatgatcttttccatttgtcccacaggtgcttgacctgtcatgtttgtacctatcgtgtttagcactagctatagaaatttcatagcaaaaggtacactatgctctttactggtaatgcttgggatcaatttgagaaaggcttgcctgacatatgaatgtgcacagataaagttgagattcttaacacatttacttatatatttctttactcccatacattttttatgcaaattattatttctatgctgatgcaaatgaagcatttggtttatactggatccctaactttcaccacagtgttgtatgtgtggaaaaggaaaatgcaagttttcatcttttgtatgtgactgactttataatatgtgctttacttattttctgaaaggtccacagctacccatttctacagttttagagataacataatgactaggttcagaaaacctgaatccctgctctgtctgtttctcaatatctgccctcataggctaattatgagaatcaaagaaatatgaaaccaaaaaaaaagagagagagagagagaaacaataacatttgagtttctttacatttttaggaattgaaaggcagcttagtgtaggcctgtaagtctgaacacctgagtaatagctttctgctctgtaactaattatgatcttatccaaatcccttgatctggttttcagtttcttcatctataacatgaaaagcttggatgaaatttacaaagttattttgggctttaaacatttgtgatctatagtaattgaatatttgtgaaaatgttgataaaatgggttatttatttatatatccatatgtatgtctgtatatatacagttgatttttattcatgtagttttgttctataaattttccacaaacagcaagttagcaagtactgaaccattgttcttggaggaaatacagcattaggttcctatgagatattatggttcaagccataatatttttgtcaattggtcaatgtataactttgtttcatgtgtgtttttgtttagagatacactatttaatttgatcaattgattaatttgaggtattattgattcattatattgaactcatgcaaacagcactgtaatgcctgaatgaagtttacctaacacacatattttctctggaaggcacatcacagcattttggcacttaggagcactagacagtatttcaggactatgcttgggggctattttaagcagcaaaatcacacacatgcaaaaagcacaaaaatgtggaaagcatggcactaaaagtgtcactcttttttgttgttgtttttgtttgtttgtttgttttttgagacagagtattgctctgtcgcccaggctggagtgcagtgttgtgatctcggctcactacaacctttgcctcccggattcaagcaattctcttgcctcagcctcccaagtagctgggactacaggtgtgtgccaccatgcccggctaattttttgtgttttcagtagagacagggtttcaccgtgttagtcagaatggtctcgatctcctgccctcgtgatccgcccgccttggtctcccaaagtgctgggattacaggtgtgagccaccgcacccggccaagggtcattcgtttatagtatcagagctgaaacaagaaaggagagtgcctcttttttcaaactcagctgaaaatgtatgcatcaagcaacttaaattttttgccaccctgcacgtgctgttgtccacaaatgaccacaaaagcaccatgagtattgattttaagttactaataaattatagtaagtagattcaccaatatagaatctgcaaataatctatgaataatgagggtatactctgtttataaatacatgcatattaaagccatctataaacatcctgtgagggttaaatgtgatgatatgtgggaattcagcagtttaaataataatgtgctatatataaagcaggaagtattagtattagattagtccaaatcatcccagtgtctgaaatggaattagagtgggcgtttgtgtgtatatacttagtctggggccttctccatgacagccgtccattcactccaccttattacctgagctgcttgctctcgcttcaatttgagtagtcttgcaagacttgcttttcctgtgcctcctaggagagttttaaacagtttgggtgtctcttctttcggtgggaagaggagggcaagatcttttcttggaggggttgcttctgcggtcttagccttctgctttaaaagcactctgtgggtaagagagaaaagctgttttaggtaactctgtgagagttctggcaaaatctactaaaaaaactgcaatttatcctaacctgtgtagtttcaatgggtacctacattaatagttgttcattaagcatatctcactgtgatcaagtttatcacaatcataatacggttctccctatctcagagtttacaaagtaaaaccaactccatccatctctaatggtgttttaaaggttgtacctggctttcttcatgaggatcctttcagaatctggataatgcactagaatttcttggagggtctttttgtctagagttaaaagattggcaaacccgtgggccaccacattggcagttcgacggtttcctcctcctgctgctagaaggctgtaagagagaaaaatgagtctttgccaccagtttcagttttcctccactgaaatctctttaaaaaaatagcaactattataagtatttatactgcttcagaaatcattccctagaggtgagggtccaggtgattgtgcagagagtgtcaagatgtgggaatagaaatggctcagttttcaatatattttttctctaactctcacctctaagtcccacaaatcaaggacttgtggctgtcagtatcctgtcagatccttcatcccagattccagaaatgcagaatccttttggactgggtatccctcatttgctccttcagatccacttttcacctctccccatgctcctttgtttcccaggaagctgacctctgtaggcttgccctctgacttcacttgggctcagccattggaaaagactaataggaaatcagaaagcaggaagagagtgggatcagagcatttatctcccctgttattttcctgccaagccttaggttagcagtggctgcagttctctaccaaaatctacagctcctgacacatggatgtcttctagaagtgcaattcccatcactcttgatgagttctggtaaacataccctcttcttttcccattcaggcctcactgtagtaacagttcctttgctgttgctaaatttgagatgcattgccaccttttgttggtgtagtagtccattttcaccttgctataaagatactacctgagactgggtaatttctaaacaaaggatgcttaattaactcaattctgcatcactggcgagggctcaggaaacatacggtcatggtggaaggcaattgggaagcaaggcacatcttatatggcagcaggaaagacagagagcaaggaagtgccacactttaaaaccatcagctctcctgggaactcactcattatcacgagaatagcacggggggggtggcggggggaactgccctcatgatccagtcacctcccatcaggtccttccctcaaaacatggggattacaatttgagaaaagatttgggtggggacacaaagccaaaccatgtcagttgggtactcttagacttttcctcacttctgtcagtaatctctttattaaagtttactcaattgcctcacttgagtgtgtctgtttcccacctgggctctggctgatacaactctcaacatcaaatgtgaaagccagcacttcatgatgccctggtcacctcaggtgaatccaatctcatctcctactatactccaaaatcaacttgttcctcagtgtcataagctgctctataatatagtcattcacatacatctccccacctggaatgccagggaattgtgggctttatgtcttggagggatataaaagagcattttgcatttgagaaataagcaaaaaagagtgggggaataaacacagaaaggaataagataaatgaataaaaagtctgtcgttaccggtgatctgagaaggaaggattggtttgtaaaaacagaacaagaaaaaccacatttcaaatgtttaaaaaagacaccataggatctgcattgagaggataacacaacagattgaaccccttggagttaatctgttagaaactgagaaagaaggatcacattaacaaaagcagtttctacaggtggagaagacagagaaaacactctgacctttggaagcaatgagatataagaagctgcatgggccctgtgcctgaagatttatgttatacagtatgaacaacttctgttgttgcagaaaagggaggattccagttggctgttaattgttaaaaaacttatatagggttttagctctgacaggttaagagcctggaaatcattactcctgtccttacaacaagaaaaagctgcacaattgaaaaattaacgacttttcttagatccttcagagaactgaagtcacagggcaaactaccgcccccaaatctggagagagaggtgaatccataaaactacagccatatctgcttactgcagcagaagcccctggagtcataactgcctcccactgatgcctggcattaatgaatatatggtcatcactcctggcttttagataagaactggagtcccaggaagcctgtcgactttctctaaggtcacacatgcggccctgtggagtaaatatgtgatgacatatcagataagtaggatgtcactgctggggatctgcataaagaagaaaaacaaaaaggactgaagccctgagaagctcctactcgacagtgaagatgaggagg

SEQ ID NO: 2931 - DNA, 12492 bp, Homo sapiens
agtgcctgtccaggggcacaagggttcactgaagactcaggagaggggtttagagcacagcctccctctccagggtcaggttcacgggagctgttgggggctccttccctcgcagcagtgaccactccaaggaccacggcctggacatgagcggcagcggtgagctgggagctgctggcctggagtctagatgaatataggcagcagccaaaggccacagtcacgacaaacctacacactctcaccactgtcatctcatattgtcctaaaatttccagccagtgcaaaaaaacatgaaaaagaaaaaatacagccattggaaaagaggaaaagtaattgttattagctgatgatgtgaatgtcttcctgaaaaccttaagagaaccaactggaaaacaaccagaaatgagagcatggagttaggcaaccgccgatctgctttctgtcacttgggcgagtttttcccgtcctgggatttcatatctctggaatcctgcagtacgtagccctctgtctggcttcctcgctccgtgtaatgttcttgagattcatccatgcagctgtgtatacctgcagtgattgtttctcttgttgaattgctgagaagggttccatcgtatgccttttccagtttatttgttcatctgttgttagacatttgagttatttccagcttgggactcttatgaacaaaactgctataaacatgcatattcaagtctttgtggatatgtgctttcttttgtcctggataaatgtctccacgtgggcttcctgggtctcacggacctcaccagctgacgtggccggccctggacttgccatggagaaggcagagcctgcctcccagtgggtccctgtgaggaacagcagtaccggcttgtcgtctttctgggaaatgcatttcgcctcctctaggaacctcccggatgacccagagtgttctccacccacttttcctgccctgtgcggtcacctcatttctacaggcttggggaaacaaatgcaaagtgctttccagaacgtttttgtcttacacatgacacttctatggaaaaaatgactttttttccattgttccttccagaacctgagcacatccctctgctgggaggacgctgtctgtccaaatgtcactgtcccccatttaggagcagcagcagggccttgcttcatgttcatatgggtgttgattgggatatgatggattcttctgtgtactttggaggattttctccttagtttgaatagtaaactgtaaactcagactcaggacctggctggtggagagctgggtccctggttggggctgaccacagaggcccagggtctgtctctccttggaaaatgcccaggctgggcaggcaaggagctgggctgacctctgccagtgacaattcctggcaggtacacctggctggtccccagtgccctgggccagtaaccctgcagcagagaatctaacgctagccaggcctgagccgtgggtcatctgtgaagtggcctgcccactgtcataagaggtgcacccgtctgcctgaagccaggctcagctagccgactggtgagctgcctcctgcttcagagctcaggccccggagttctgctgtggccgcaggcatgcaccctcgtattggcctgcacagcaggccttgggctgctccatgcatcacatgtgctccaaaggatcgtggatgcctgagttccaccctggagggaccgggcatggcctggacatcaggacgttcacatctcctcaaggattcgtcctccgtgaccctgctgtggctccagacggtttacaaagggcactcacctgtgcctgctcattgacacttcactgtgttcccattcgataaggaaaccacggctccaaagaccagctgaagtcacgggtggtaagaggccaagctgaggccccttgccccatccctggctccaggcagcctttgcccccacctctccctcaccgtggcctccagggtctcccaaagcttccttccctccttcaaatctcagtttggtccgtggtgagtcaggtgtgctgagtggactaaagttcatagctccagccaggtacagcccgggcagcaccagcaccttcagtttcaaggggtcctgggaaggctggcttgggaagagttccgagcctgaagggtacaggtgggtcagcaggtgggaggagctgccatcatccatgatgtgtggaccatgagtttcttctgagagtgaacatttccccaggcaggtgttttgggggaagggaatgtgccctgcaggcaggtgtggccctgggtagctgcatggtcgggtgcatgtggccccaggcagatgcatggtgggtggtgtggccccaggcaggttcatggtgggggagatgtgcatggtggtggggtatgaccccaggcaggtgcatgaccaggtggtgtgactagaaggcttcctccatccttgctggacggggggtcccacactgcctgggccctctctttgggtcacaggcttgctgccccttttgttgccatttctgggcctgtgttagccaaggtgaccttcagcagccaccatcatgcacagagaaggacctctgcgcctctcagagtccctggcctgacaagaagaaactgaagccaaaggcagcccaaacctcggggcaccatgggccccttggcggccgcggctcattaaatgccctctttctaagggtttcctcagagccttcattccctgctcagcattccaatggcctcctccgggatgccttttaatatccctgccaaattgaaatgtgagccacctaattacaaccagaacatcctgcccttggacgcgctcacttgatccatggagggactgttccctctgttgttcacgtcctgactggacttggagatgagagacttgaaacctgcatctgtgtctggtcaggaaggaccagcagctctagtgaccacagagagcagagcccaaagcactgactcaagcccctgccaggtgcagagcctggaggtcccagagtgaccactcctatcactggagccaatcccagagtgaccgtccctatcactggagccgatcccagagtgaccgtccctatcactggcgccgatcccagagtgaccgtccctatcactggagccgatcccagagtgaccgtccctatcactggcgccgatcccagagtgaccgtccctatcactggcgccgatcccagagtgaccgtccctatcactggcgccgatcccagagtgaccgtccctatcactggcgccgatcccagagtgaccgtccctatcactggcgccgatcccagagtgaccgtccctatcactggcgccgatcccagagtgaccgtccctatcactggcgccgatcccagagtgaccgtccctatcactggcgccgatcccagagtgaccgtccctatcactggcgccgatcccagagtgaccgtccctatcactggcgccgatcccagagtgaccgtccctatcactggagccgatcccagagtgaccgtccctatcactggagccgatcccagagtgaccgtccctatcactggcgccgatcccagagtgaccgtccctatcactggagccgatcccagagtgaccgtccctatcactggagccgatcccagagtgaccgtccctatcactggcgccgatcccagagtgaccgtccctatcactggagccgatcccagagtgaccgtccctatcactggagccgatcccagagtgaccgtccctatcactggagccgatcccagagtgaccgtccctatcactggcgccgatcccagagtgaccgtccctatcactggagccgatcccagagtgaccgtccctatcactggagccgatcccagagtgaccgtccctatcactggcgccgatcccagagtgaccgtccctatcactggagctgatcccagagtgaccgtccctatcactggcgctgatcccagagtgaccactcctatcactggcgctgatcccagagtgaccgtccctatcactggcgctgatcccagagtgaccgtccctatcactggcgctgatcccagagtgaccgtccctatcactggcgctgatcccagagtgaccgtccctatcactggagctgatcccagagtgaccgtccctatcactggcgctgatcccagagtgaccgtccctatcactggcgctgatcccagagtgaccactcctatcactggagccgatcccagagtgaccgtccctatcactggagccgatcccagagtgaccgtccctatcactggagccgatcccagagtgaccgtccctatcactggcgctgatcccagagtgaccgtccctatcactggcgctgatcccagagtgaccgtccctatcactggcgctgatcccagagtgaccgtccctatcactggagctgatcccagagtgaccgtccctatcactggagctgagctctgtacaggaatggaggaaacaaaggcgcccgctgccttggaggcccagcaccttcgcaccttcttcaggacttgctgttttccagggctgtggtcggcactggggacctctgaatgcagcccctccctgcaccagcagcctgggccttccgcccttcttgggacattggggtgatcagaaaaccacaggccaggcctccttcagatagtgcttgaaaagatcccagaattcagccctaggaggggctccttctcccactgcacccctgtcccagacagccctccttggtctgtgggggcaccaggccttgggtcttccaaggggcccagctccccaggtgtgagctcacagctgagaattgccctccacctggcccggggtctggccattccagcggctgtgcacatctggggctcctgttcactgcagcccctcctctgtcctgtcctcggttctccctcccagcctagaatccctaccccaaagcatacacttcccagggagctgaaaggacctcagggtggggcccaccctgctgggtagaaggaaacagcagggtgtgtagggcaggaacgtccctggagggctctcggggtgcgcctgccatccctctacacccctctgttccacccccacgcccgtcagcctgagtgcagtggttaaccgtggcatttgggaggccaagtcttggaaaaatcaggccattttttggtctgtttgtttgatattctgagaatttctatgaagcatgagttcctgcagtccgaaggctgagaggttctgcagaagggcacagaccctgcgctccctctgccatcatcagcaggagtgggatgaccctgtctgggaggccgtgggaggcaggactcggtctggtgcctgacatctggtgccagcaggactattcctggggaggcctcagcatgccaccctgagagaagggagggtctaggcagggggctgtgtgggtccagagacctcagctgaccccagaaggagctggctgctttggcaatcagggtagcctaagtctcggccagactcaagcctctgtgtcctgcactgactggacacgggatacaggccagccccagggtcctgggcagcacgtctccccagatatgtccattggtgggagcagctgtcctccaggccttgtgccgctcttactgaatggggccaacagtcagggccgccacctgagacccacacgtttcctgctggcacctgggcggtggtgccctttggcctaagcagctccctgtgcttggctcagcctggcctgggggtgtggtggacaggtggtgcattctgctcctgatacccctgcctgggcagagcccttccaagtggtggtctgggctcgtcatggaggctgagggctggcagggctggttccctcagccatagaaaggatcctcttgggggttggcggggaattctgcaggagcctttgagacaggagtcccaggccttggtaccctggcaggggaggctctctgtgcccaccccttcctccacctgggagtcctgccagggggcctgcggacaagcagccctgggtatcccatgcgctgctgctggagaggccgcccttggaagctgctcccgagatggaggagaatggggcaagcaaccttgcaggcaaagaaactggaagcctcaggatccttatggatgctgctactttctctttaacaattgaggattaactcgccgattccaggctcatttgaggtgaccccgaacgataagctcgctccgattgagagactcagaaaaacagtctctgagcaggtccttaataatcgacctgcccgaggcatcattacaatagataaatctaaataaagatttcctttgccattgacttgtcttggcctaaatatcgtggaaaatttccaagactgcttatgcccgacacacgacgtgcagcccaactgcacgtcgaaatgaaaactggggtgtggcgagcctggcggggcacgcagaggagatcagggtacatgagagcgctcctaagggtgcggcgcagtggagccaggaaggctggcgaggaccctgcaggtcagcggctccccggacgccctcgtgcacagtgaccctttggggtggaatccagttcctggcctgggttggcctagaaacatcctctgaggaaactctcgttgagttgttaccttttctcttgacacagctttactgaggtagagttcacacgccagccccacatccctctgaagtgtgcagttcagcggtcgttggtgcattcacggaatccctctgaggtgggcagttcagtggttgttggtgcattcacggacacgctcagttcagtggtcggtgcattcacggacacgctcagttcagcggtcgtttgtgcattcacggacatgctcagttcagctgtcgttggtgcattcacggacatgctcaattcagcggtcattggtgcattcacggaatccctctgaggtgggcagttcagccgttgttggtgcatgcatggacatgctcaattccggacattttcatcttcctccaaagaaaccccggggctgggcagagcagctcgtgtctgtaatctcagaggagggagagcaaggctggaggatcccttgagcacaggagttagaccagcctggacaacataatgagaccccacctctataaaaaatataaatatcagctggtggtgatatgtgcctgtggaggctaaggtgggaggatcatgtgagcccaggaggtcaaaactggagtgagctgtgatggtgccactgccctccagcctaggtaacagagcaagactccatctcaaagaaaaagacaactctgtgccctttggctctcgtgcttgcccccaacctcccagatgggaacctcagcgtcccagcagcgtccgggaagctttgggaagcccactgccttcccagtgggcagggtcaatacactcaccttgagaagatgtgttactaagtatgaaaatgtgtgcagagaaccaaacccaaagtatgaatattttgtgacagatttatgcatgtttggtattttaacactatgcaatgcttctgagatttttgctaaaaaacaggtcacctggtgggaggccgaggccagcagatcacgaggtcaggagatcgagaccatcctggctaacacggtgaaaccctgtctccactaaatataaaaaaaaatagccgggagtgatggcaggtgcctgtagtcccagcaactcgggaggctgaggcaggagaatggcgtgaacccgggaggcggagcttgcagtgagccgagatcacgccactgcactccagcctgggcggcagagcgagactccatctcaaaaaacaaacaaacaataaaacaaaacaaaaaagaaacaagtcacctgggattccaacttaaacagggtaattgggtaattgattttgactttatcagtagatacctttccaaattgatatatagctttggacacttacactttgaacatgtaaagatcagcacatgtgtaaggttaactagcattgcaagtatttgggaaagtctgtttttaggcaaatagagtcctttaaaaagaagtgaagttttacagtttcacaatttcagcttaaaaggtttaaagaagcttagataagtttacaaatgggaccaaatactaatcaaaagtgttgaaattagttaggtttaaaaatagaatatcatgaaaaaagatagaatatgtggtgtataagctaagattaacccttaagaaagaaatggtttgcagtcaaatgctctatccctgaactatatccccaagaaacaggatttgcagttcttgttttgataaactgtacttttgtgggtttttttcaaagcttttattgtggtaagacacatacagcaagcaattcagcatcttacccatgttcgcatgtacagttccatggtgttagcgtgttcaggatgttgtgacgccgtcatcaccacccgtctccagatccgttttcattgtgggaaacggaaactcggtccccatgaaacacccactccccattcccatctccccagcctcagggagcctccgttctgctttctgtctcagtgagtttggctcctctgggagcctcaggtacacagagtcaggcagtacttgcccttctgtatctggcttctctcctttcccacagtgtcttaaagacccatccgtgttgtagcacatgccaggttttccttcctttttaagactgagttaaaatccattctgtgggtattccacattctgttttccattcatctgtgacagacgcccgtgttgctgctgccccttggccatcgtgactaatactgctgtgaacatagtgagcaaatattgcttgagaccctgcttctgattcttctgtgcatatacccagacgcagacttgctgggtcctagggtgattctatttctaattttttgaggaatcatcatactgttttccacagtggctgccccatttcacattcttaccaatagtgcatgagggatccaatgtaaccataacctcaccaacaattgttattttctgttttttaaaaatagtaaccatcctcatggttgtaacgtggtatctccttggagttttgattcacatttttctacagatttgttattgtgttagcccgttctcacactgttagtaaagacatatgcaagactgggtaatttataaaggaaagaggtttaattggctggggaggcctcaggaaacttacaatcatggcggaaggggaagcaaacacctccttctcacggcagcagcaaggagaagtgccaagcagaagggggaaaagccccttataaaaccatcagatcttgtgagatctcactcactatcatgagaacagcagcatgagggtaaccacacccatgattctattacctcccactgggtccttcccatgacatgtggggattatggaaactccaattcaagatgagatttgagtggggatgcagccgaaccatataagtaatccaggaggatccaggcccaaattacaatggacacaggaccaacccatgatggaaccaggttcagcccatgataaacccaagctcagctcaggtaggatccaggctcagctaaggttggaaccaggctcagcccatgatggatccagggccagcttaggttggatccaggctcagcccatgatagacccaatcacaggccacagtaaacccaagatcagccctcaatggacccaggctcaggccacagtggacctagtatcaatccaggagggacctaggatcagcccaggatggatccaggatcaaccctggcagctttgaaggaggaaactgggtcacagtagatgcatctcattctggactcctggcgtctgggagctgtttgatgatagaatgataggctttaacactgaatagaattacatcctgcctgtcttcaagttgcttaaaagaagcattctctcacctttcctgagatcagtgggaacgtccccaggagtcagtaggtctgtgttggagatcaatgcgctggaagctgaatgaactctgccatgccagaagccccaagcacacagcaaagctacccggagggagcgtaaacacacaggatgaagctgggctaacgtccctcagcccagcaccttccactgtgccacccacaaggaaggtgctgtgagggacacggcctctgccctcaagaggctatcgcctcctgtggtcccgcggagccccaccctcgcctgctcacaccacctgctgagggtgggccacctgcttcctgccaggacagtgaccccctctagacttggattagaccatctgagcaattgcagagaattcgggggcaagtaaggcctctgagggagcggacatcccacctgggcccctgtgtccaggtggaagatgctggtcttgtcccaccacactgagagctctacccccgccagcctcctgtcgctcaggcagagatgccaaggaaatgtcctggaacgcagctgtcagtgcctggcactttccaagctaaagctacattgccaagggactgaagacaccatacagtttgcaggcctttttttaagaagacattggggctgggtgcagaggcttacacctggaatttcagcactttggcaggctgagatgggaggatcgcttgagcaggagagttggaggctgcagtgagcggtgattgcaccattgcactccagcctgggagacagagcaaggcagtgtctcttaaaaaaacaaataaaactttggggaacactgcgatggagcaagaccatgaggagcacaggagaagacgctcagcccgacgcagccgtccgtgtggcaggaagaatgctgtacatcacagctggcatggccgcccgtaccctcttcttcacgctctcatgcctcctagagcttaggctccaggacctctgtcctgacctggccctggtgtgtgtgtgcatgtgcacatgtgtgtgcatgtatacatgtgtttgtgtgtgtgcatgtgtgtttgtgtgtgtgcatgtgtgtttgtgtgtgtgcatgtgtgtgcatgtatacaagtgtttgtgtgtgtgcatgtgtgtttgtgtgtgtgtgtgcatgtgtgtggtgtatgtgtggtgtgagtagaggggctggtcggttgggtcaggggaggagtttatgttcccattgaggcataagggggggtcttctggggacttcagggaaggttttttctgctctggcagaggggcaagctagaggtttctctcttgcatgaaccacactgtctggctgttccagctgtctggtgaccagggtggcctgcccggggcactgaggatgatcgtgtggaaaacggcactaactcaggtcctggacctgctccaccgctcagaaaccactgccagggctgccccactctcacactggatgggggaggcaatgcagtgtccttacctctgcctgcaggtcctctgacccacagatggtcacagatggtatatggcctctggctaggactgcatgacctataggccacatctgggggctctgtcgtggacacacccagcgtcccagggctgtggtttttaaatccctcctagggcccttgggaaccaaaccagcctgacggacctctgctgcagggtgtgtcccccaagacagggcgtgctgtgggtgcccgcctacagagcctctccagaggacaagggtttgggccacagtggccctgccagcctgcaccatctggtccccatcaccgcctggctgatggccttaagctcaccccacacgtgggtcctgctagggccctgcagcgtctcatgcttggggcttcggcacggcttctcctgggagcgtgtggtgctctcgggaggctgtggctgaatttaggcttagccgcatcccccgccattatttggttgaaagtaggaaaggtcatttggatgatacatagccttgggctccagctggaggtgttcatttcatgtctaaaactcctctcaatgccctggttcttttctgtgaaatatttttcaaaatttctatagagaagggtttaaaataggctgcccaagagccacagggagcaatgacccaattgttggtcacaagagggaagcgggggcccatttggccgtacccgcccctgtccgggcctccccgtcgcaatgtcgaggagtctgtgccacccctggggccccttggggctggtgttggcttcttggcaagtttcaacagaaacgtgcttctgacttccccaatcgtgtctgcacctcgttcagggagcttctccctgtgggtctgccacttggccctcgggggcttagaacgccgctggtcctgagatagtgccttgtgcccgccggcacccttgctgctctcacttgggggcttagaacgccgctggtcctgcgacagtgccttgtgcccgccggcacccttgctgctctcacttgggggcttagaacgccgctggtcctgcgacagtgccttgtgctgccagcacccttgctgctctcactcgggggattagaacgcc

SEQ ID NO: 2932 - DNA, 848 bp, Homo sapiens
ccaccacacctggccccatcatgtttctttcctgagccccacactgttcgtttgaggttgtctgggtagaggtggtgccatctgaagggatttcagggacacaggcattggtaaccagatcctctgtccccaggattcagggagcttccagcatgatgtggctgcaaagcccgaggaaggcttcagaacagcacagaacctagaggcagaggcgtcccctgaggaagaactcccagaagcagatgacctggatggactcctgagtgagcttcctgaagacttcttctgtgggaccagtagttgagactgccccaacgcaggacaacccaccatgagcaggcagctctgggcatgtgtctggtcacatccaagggggagaagaaggccagcatgattggagagtggacacagccggggggcttctgtggttgctcccaccctgggtgttttccctgagagccccctcatctctgcgctgccctcactttgggccttcctttgccgttggcaccagaatccggccggagactggctctccagccaacaagaaaggcctgtcaccctcgccttgggtgtccctctcctgcctcagcttaattttagaggatattgggcctggttttcttgtcccttcataccctagtccctggacagctgaggagatgaaaggagccacaccacaacaatggcggcctgcccctccacacaggggagaagcacgctcaggcttcctctgctttgtctcttcagacctgtggttgctctgctcatccatgcccaaggttcccaggtgcaggacagaggtgtggcctattgtaccttgttctgaaataaagcatctcctgctt

SEQ ID NO: 2933 - DNA, 27507 bp, Homo sapiens
gttggacaatgctgcagtcatccagggtgggaggatccacttccaaaacgtctcactcacatgactattggcagaaagcctcagttccttgaaaatgtggacttctctgcaggccttctggagtgtcctcctgacagcaactggcctttcccagagagagtgatccaacagagagagcaagtaggatatagctgcgcctttcatgacagcctcagaagccacaaatcaccgtgtctgctatgttttattcatcagaagtgagtcgctgagtccaaccatattcacagggaggcaaagtaagctctacctcttaaaggaaaggagtatccaagaatttgtggatatattttaaaacggccacagtgagttatcaaacttgtttttatctttgccaatatgataggtggaaatggtatctattgtgattttaatgtgcaatttccttattgtgagtttttttacagctttactgaggtataattggtatacaaaaactgcatatatttaatgtgtacaatttgatgagttagaacatatgcaaacatccatgatctcatcaccacaatcaaggtaatagacatccaacaccttacaagataaacaaaattgactaatctttagctagattaagaaaaagagggagacaactcaagttaatgaaatcagaaacaaaagaggagaccttgcgctgtcacagaaattaaaaggagagagtagtatggaaaatgatatcacaacaaattggataacctggaagaagcagataaatttctagatacatacaacctaccaagactgaatcatgaataaatagaaaatctgaacagatcaataatgagtaaggagattgaatcattaatttaaaatttcccaagaaagaaaagctcaggaccagatggcttcattcatgaattctaatttttttttttttagaaaaagaaaaccattcatatttcctttctgtaaactgtctgtccattacctttgttgatttttctgttggggttttgatgtttgtctgaggatatgaattgcaaatattttccctgtttgcctgttaacttcctctgtggtgggattttttttttcatgccaactttctaatgaaattaaattttcaaatgtttctactatttggagcatcttagaaagaactttagggccaggtgcggtggctcacacctgtaatcccagcattttgggaggccgaggtgggcagatcacctgaggtcaggagttcaagcccagcctgaccaacatggcgaaaccccatctctactgaaaatacaatattagccagatgtgatggtgcatgcctgtaatcccagctactggggagacagaggcaggagaatcgcttgatcctgggacgcagaggttgcagtgagccaagattgtgtcattgcactccagcctgggcaacaagagcaaaactccatctcaaaaaaaaaaagaaagaaagaccttcagctctctgagcatatggttaacaatctgctatgtgttcatatatatacacatacgtgtgtgtgtgtgtgtgtgtgtgtgtgtgtgttttggtgggggaacaaggtttgctttgtcacccagactgcagtgcagtggcatgatcatggctcactgcaatcctcccacttcagcctcctgagtagctgagactgaagcaatcctcccacatcagcctcctgagaagctaggactacagttgcataccaccacgctcagctaattttttaatttttgtggagacaggtctcactgtgttgcccagagtggcttcaaactctcgggctcaagtgatcctccttcttggcctcccaaagtcctgggattacaggcatgaactgctgtgcctggtctgttttcttctatatttttgtggtgtatttttttctatattcaaatatttgattcacctaaaatatattttggtataagctgtgaggtaaggaatcaaatcttttttttagttccagaagttgactgcagatccttgaataacattgtttagttaaccatttcttcacaacattgatgagaaaaataaattgctttccagccagagccactctctatgtggagtttgcactttctccccacatctgcatgggctttctccaggtactttagtttctacccacatcccaaagatatgcaccttaggtttattggcgtgtctaaattgtcccagtgtgagcaagagtgagtgcgtgggagtgtgccctgtgatgggatgacatcctacccaaagttggttcacctcttatgccctgagatgccaagatagactctggccaccatgaccctgaactgaaataagccggctggaaaaggaatgaatgaatacaaataattgtaaagtaaaaattcataaagtattcaataatcatgcaaatgcacaacaataaacgatgaggtacaaaagcactcagcaaacctaccacatttatgactgttttggaactgcataggggcaagagaggctcctcacaattatcactttgcaaacatttattccttcatttaacccaccaccactacacctgccattactcactgactcaccacaaattgactagtcatttactgatttttattaatctttctcaaatgtttgtatagctcatacttatttcaatgtttaagattagaactgttggggatatttatttagaagtttggcgatttttttttgtgccagaaatatgccataggaacttagttcttgtttctcctaattagcctatggtaaaattagtttcattatgtgtccagtttccagttacctatagacaagcagtccccaaattttcttggcaccagggaccagtttcatgaaagacaatttttccatgggccagggtggcaggggatggtttaaagatgaaactgttccacctcagattatcaggcattagattctcataaggagtgtgcaacctagatccctcacatgtgcagttcacaatagggttcatgctcctgtgagaatctaatgctgcagctgatctgacaggaggtggagcttaggccataatgctcacctgccactcatctcgggctgtgcggcctggttcctaacaggccacaaactgatagcaggggttggggacccctgctatagacaatgttaagtgaggagttactgtacctagtttcaccaatatcatttgttgaataattgctatgttctcctttgatcagctagtgtcctgttaggaaatgtggaagtactctagatatttccagcagagaataaattaatgcaaacaatttgtgacaaggaattggaagggctaaagaagcaacaggggaaagagatattagtctgtgatcatgacgctgctagtgctcctgggctggaaaccaacagtttattttcactgctgagctgctggctgcagggccattgcttttttggaacatttctgtagacattgagcaggaaccccagaacttacattctaaggatgctgctcaaactaccaccattcttactaatgctggtggagcccaagttacctgctgctgatgttcctcctgcggccagaagaggcaccagaagcagaaaaatggctccttctcacctcttgttcctcaatcccaaccagtgagtggccctcagttgcagaaccttaccataggcagctgacaagaaaatccagaaatgtggcgctctggcttccagccagcatatttgtggcagaggggagcatggaaggttgggaatgggggtaaatgccaacatataatcggctcaccctctgctttgaaaaatcacaaaataaattcctcaatgcttgaggatctattcctaatttttttccactagtttatttatctacttaacattcagtgtcacgttgttttgaatattatgtttttatatctagtagaaacagttccctcattttttttcataacttacctagctttcctggattgtttattttttccatataaattttaggaggccaaagccttatctgttaagaaatcagggccatataagttttagaattagcttgtctagttctaaaagaactgcagttgcattttattggcagtatgttatacatttagtttaccttaaggagaattaatatctttataatgatataattttctatcagtttagtatattatttgttcaagtgtccttttgtgaccctcattaatatttaaagttttcatcctataaatcttgtacatttcttaagtttatccttaagtatttcacgtattttgtatttgcccttgggggcctcttgttcttattgattataatttgcatatatgaaggctattgatttccatatactacctttatttagttaccttgccacattccctgattataacaacatttcaatttattgtctcttggattttttgaggcaaataaatctgctaataattataactttatgtgctatatcccaacttttgaaccatccatttctttctcttctctaattgtgctgaaaaactccactaggccatgataaattacactagtgacgctgtgttctttccttgttcctgattttaataggaatgcttctactcttttcctgataggcatgatactgggttttgcataacacagtaatatctgttaaattctattctattaaaactttttttaaaaatcaagaacagatgttgaattttctcaaaaaattgatggaaatctttctataatatttgaatccattaatgtgaaatatattaataaacatacaaatattgaaacacccttacattcatggaataaattcctttggtcgtgtaatattaatcttttaatatgctatctgtttgcacacattttattgagggttgtggcaatgatcgtcatgactgagaatagtccgtaggtttatgtgtgtgctctttgtcctcatccatttaaagttgatttttgctagcttcactcttagtgaccttgctaccaattttctcagggcttcttacagtggcctcctatatgctgattttaatgaaattgatcttctaaacataaacctgcaatatctttggggtggaagaaaaaaagatacgaaaagaataaacataaacctggacttgatgtttatttcttataattccctcatggttttatttaattgcagcaatccaccaacatctttttgattcctgacttccctttgtagattctatactgtgacttgaagaacagttggcaaatgggtcaaaagccagtagataggctggcccataatttctcccttaccttgtgagaaaatataaaaagaatgagaatcaggtcatgactctccaccccaggaaagaagaacaatcaagaaacacctgctagtggcatgccaggccagacacacccatcggggtctcctgcagtcaagaaggagggggccgtgcaagctgggaggacctcagatggacagaattcaactcatcacatttcttggttcttgacacgctctcctcgttagtccatcacatattgcacggattcattcatatcgctgcatgtaggctgctttgacctgctgtagaatatctcattgtgtggatgcacatgtggatcactgagtatgtcagagctggcaagatacgtcagaagagaaaggagaaactcttaactaaatagagttggaaataaaataattgtctgtatggaataagatcaaaggtcccacatgttaaagtcaaccccagatgaattaaagtcttacatgtcaaaaaaaattgaaacttttagaagaaaattaaggtggatatattttagaccttaaggtagagaaagatttcttaaagaagacacttacaggattgattacaaacaaaaagactggtacatttgaatgtattatgttaagaacttttccaccaaaagaaagcctcgatttcctcatttttaagatgaggataataatccctaccttatagaattctaataagatgaaatgaagcaacatatacaaaatacttagcacagatcctaacacctacaaaataataaatggtaacgattattattcttctcaaacaacaatcctattatttatcaaataatactgagtaatatgacaagacatatttaaaccacacaagccatatgcagacaagtgtttaatatcatagtgatagtttcaagagagagataataatttattctacatttatcagaggtctatagcccagtagtcaataaatacttatctatagtcaataagtactatcaagcatccatgccaggaaccatgctaggggctgattaatttacatcaatcaccatgacttttttcccacaaactaacacacacacaatcttcatagatttttctgtgatcacagcaaggaaaagacctacgcatgtttggatcatctgtgtacagtcctacagaagaactttgacactatcagagacagaaatctcagaatagtccaactctcacttatttgtgctaatgaaagagtaaagtaaaagagacaattaaaatgggaaatgtgttttgttttgttttggtgttttgttttacaagtatgcaaaaacctcaaatcaacctgacccaacaataaggaagcaagtcagaaaaaggcagtcttccagagctgtttgttcagcagctcagtaatgccatgaaggtttgcttcctttctctgctttgtgtttctggagagagtccgcatacatttcaatatggctgacagcagttctggaatgtataaagccttgcataaagaaaatgacagttcactatgaaaatctgattcggatgatgttgaaaatagatttagtgtctgctctgcctctctgttttctaggacttcaccacctcacagactttgtacactcatggttcacaacttcctcactgtgttttctttaacgagtagaagataaataagctttaagaaatagtaaattatatcaaaatagactttatcatataatttgcctaattatgtaccttcagtaagtgtttattgaactctggggtgtcaacaattttttattcagctctcataagtaatatttgcttagaaatctacccataaataggataacaactttcataaaacaagaatttatacctagctaacatgaaaaagctaaacatcccttgaagtacaattctcctgaaaatcatcccaatatggtttattgaggctgatggatttggacaccagctcttaagaaaaaagataaagaggaaagctactgcctgccacaacatattctttttcccaagagctggtaagtttcttccatatgtggaatccaataacgttcggaacattcttttctctttctggtaatgtgatatacccaacgtgggcctatgatacaaggaaggagagtagatcaggagtcaaaaaccacaggtcctagttctggttctatcatttctttgctgtgaaagtctggaccagtgacttcatagctctgagtttctgttgtgtcattcttcaagtcaggtcatcatttgccttccctacttcacaggtagtatacagtaatcttttcaaaagccctttagaggacataacacaaccttatgtttattttctgctagagcatgactcccttgagggcttggagcatgtcttaatcaaatttgtatattccaccattcctaccccagacctattattaggtgctcaataaatgttgattttaaatgacagctgtcatgaaataaatgaaaacagaagccaacagtgacggtttgagctgcctgctggctggcatgtgacacttaacatctaaagagtgatagtggcagctaaagtgcggaaggaatccactttatgaaactatctgagcagtgaagcactggaaatcacagagtctccttttggctattttacatttagatatgaaagcttgtcaggctgggctgagaatagacaatgagaaactaacacatttcaacaggttttgaatagtttcccagtgaagaattttcctggcctctctccaccctggtttttatccctcttcttgggagttatttttcgcaaatgtaccccatgattggcaaatttcagaagaataactggggttggctcagttcagctcctccccgtccttctcctgagtctgcttccaaaggcaatctgcaagggaggaataaagcaactcagggaagggaaaaagagatgtgaagaaggaaagaaattggaagacccaaaacaacatgatggttagtagagctaatgaaaatgaggaagctccaataatatctggttttttttctctgactttgtgaaaaccatttgttattatgatacgacaatgtaatcaatggtactcagtaaagtcagtaccccaaaattcggccaggtgtcatggctttttgtgtatggttgtcctgggaattaaaggagaaggaaggggctgtgcccctgtaggggagatgatgtgcagaaacggacggtatacacaggaggaaagacaatgagaaaagataaagaaagaattcactaaaagcagggacttggagctagagaagcaacaaaagacatccataattcttggagatattaggggaatactaggcttcccaagaaaaagattcaagccattctattgcactgtcagctggaaggtggtcccaaaaggctggggaaattggaggcactcaggaagctgctgtcttggttacaggcattcatgtatggatgaggctggagaaggtaaaagacagaggaagagagtagggaggcaggtacagaaaagagactcattattacctttctctattgcaggcttcagaaggtgaacccagagagcaggctgtttctgtccatgggaaagcaggatggtacagcccatatctgattcagaaaccaacagtcaaaccattctcccctgagactaaagcagagaatgaagccatttcccagaaatttgggtatttaaaaaatcaccctggcctgggttacagggtaattgtcccatatctatgtttcacctgcagattcatgggacagaattatttcccaaatctagctccatgctcctgccctgacttaagtcagggaatacttggtatgtagtagcatttattatttcacgttcaaaatatctcaaagccttgaaaactgtaacgtattaaacggaaatttggtaggcattgcttcgcacaatcccatgatgccagcttgctagcatggatatgcccagggcaccctaccagatgctggacacaaaagctcaacatggtagttcttccctgcaagggttcacagcccagtggaggagatcgtcaggtgagtaaatcatcctactgtacagccacgatgtgcagaggactcagaggagggagtgaaactgccactcccaggcccatgtctcagaccaacccttcccctccagccagttgtgtagactgcacctcttctctccctcctcagtgaatacaggctaaggaacgcaggcttctcttacccaggttccctgaactgctttttttagcccatctcatcttcttctggttttgttcaattttctgccagcttttttatccggctcacttatctccctttatccctcagaaccatctccagtaattccattgactggcaggacatttttccatcagagagtagagctgagctgctgcagtgccacggccacctcccagcaacaacccctccgaccccagcagacccactacctggctctttcggtcagtggggacttttcagatggtatctcttttattttagctttttaatttctggctgccaggctttcttttcttaactacgtttggagcagcattttgcacatcacagaagccatgccagttttaaggtgagttaggattctgcaggggaatcccattattttgattccctcatcaaagcagggctaagtttaaccccttgcaaatatgaaaatgaaaaggacagaggagtgtattgtcatggaaaaggcaccaaattagtcaccagggaactggacacaggtcccggccccacaactgactctgccatgggattttaggcaagacacctcacctttctgactccaaaatagtatgcctgttagtcttcctcatgatgaagttggaagaatcaaatatattgactgctataaacatacctcataaactgtaaagcactgttcagtcaacttaaagacccatgccaaacctagggacactgggcagcatgtccttctgaataagcacataagctccatgagagcaaggattgggtcacctcttgctcgctatttactcccagtgcttagcacctggaaggaaggaagggagggagggacagggggagaaaattatgcacccaaggggtctgaaatgttaggtccttccacatgtttgtgaagcccatcacctgctggtaggagtaaaaatatctcaaacacaataaatatctttcccgaattagcatctatgaattgaatcccatttgtgtgagaagtgaaaaggctgaagtttccacttttcaatcaacggtaaaagtcctgacctaatgcaatgtcgcagagactgttcgtttgcacaagccaatataataatagcaatagcttacatttttatagttctttacagtttatcaagcattttcaagtatctgacctcattctgatcttcaaaatctcatataagtaggtagggtaaattaaccctgttttacagatgacgaaactagggctcggaggagcgcagaaacgtacaccaaatcacgaggcctgtaagtggcagagctgggatttgggcaggttctcttggcaccttggcttcttcagctgctaatgaagacagtaatgatgatgctcccattgttaagctgacagctctggagccacccaaaccaatatgatttcctctttattttgctagaattatggttattctgaatccctggagagtagagtaggtcctctcctcataaaataaggacaaaaaattcttttcaggaaaggaaggctacacagttggtcaataatcacatttttaatgacttcattagtcatcaatcaattgaaacagcaacaatgatgcatcatttcctcctatcaaattagaaacaataaaattaatgttgataaggatgtagtaaaaccagtgtatatgttcaatgctggtggccttgtatactgctacaaacttttagaagctacttggccacatgcctcaagagccatgaaattgttcacactctctgaagcagtaatcttacatctgggaatctatcctaaggaaataatgaactagagaaagaaaaaaaaataccttcctagggcctggttgttgatttctcccttggatagcaatgagatatcatggtatctttttcataaatttcctatttgtttaagctcattccagctggttcctgttacctggcaccagaaccatcattacaaaagcccacatacagagagctaatataaatattaatatcttcccttcccttgcttcaaacttgacctcaattgacatttccagcttcacagcctggtatcccatccctccatacccccatcaatctcaaagctccggtcaagtcaaatgtctcacagttgaccagacgggccatgaatcagcatgttctgagctttagttaggatcagaatcacctggaaggctggttaaaacacacacccttgtgcacacacacacacacacacaaaacacacacacacacatacacacacaccacacctttcactggctttgagaaccactggtttaagcaacagtctacctctggcaaaatcatctagtccttcaagtcccagctcctccctgctttttgcagccatctccaatcacaccagactgaactaattacttgtcccctgtgtttctttggggcaagaaaagcacctattacactgtataatgagggttaattgtataatggatgccagctccctgcttatcaggagtatctggagggcaggcccctggcttcattgcctctgtgcccccagagctagcacaatgcttggcacagagtagccatatgtgcatgtacgactgaattattccttgctccctccctctataggaagttatggtttattcctgtttccacaggatccattagcatattgaatagctatttttaaaaaacaatgattagccatgatagcaaaagaagaaacatgaacagagcttattcgtttgccaggctagtaaatatcatcttgctttgctttctaaactccttaatgaaaacagtggctctcaggcaaataaataaaacattaggtagacaacacacagcacatcacaagcacagtccactaatttgcctattgctgaaggacattagccacctttgagataatctccataaacatactgccccatctccctctctcaaacatgaattgtatcaagctaaatttttaatgtttttcaatgtcttatatatatttcatttcaacaacattttttaatagtaagatatccatcttaatcaaatgaaagctgtttttctgtaattgtcctaaaagccaattcattttctggaaaaacatcttcttgaatcacaagtggccgggctaaacagtgttctcagaatattaatgtgaaacttaagctattaacatgtcatggttaacctttctaaaagctaattaaattaaaataataatatgtggaatgcttttacagaaaggtaaggctcttttacaaagcacctgttccaagtctcagagctaacaccttatgaagccatggtgggaaaaaggttttgcaggcagacaaagaaagcctggctttgcacctgctgtgattaacttttagttgttggtattagagttaattattgcagcatgctggagggcagtgacaatttacttgcctgatcatacctaataagatgtatttgcggatgccagcatctcctggacttaatcaacaaactatcaagacaatcaatgctgttaggccccatgtccttgtgatagttttttccaaataaaaaagataaaaatccaaggatgcagtgctaaggatataggcaggctgcttagaaagcctccgttagctagcgtcaggcttatctccctccctgagtggctagatctattatgcaggagggttagtgcaccctaaggcccgattcaattgggagcaaagttcaaggcaaccacaccaggtacaaggaaattaagctctgagaactccagcacttcttggtaactgagctctggaaggcttcaaatgggccctttctactttatcttctatgggaaaaggttgttatacccaaggcgctataccctcttcctgctacacaaggagggagtttctgttcctttatttgataatctatgcttgaatccatggaatacatttttaaaggaaagaaactagctatgacataagacaggttggcaaattccataaaacaacatgctttagtttcaactctgttcctttttaggccccaacaaattagcaaaactcctatgagaggactggggtcatgtgtgggcacacaaaataaggagggtgctaccacctagagggatctcatacaggtaatggagaggtgcaggtgacagcaatcagcagcctgggggcactgaaaatagaactaagactgtctttgactcataagtcatccatcctgaataatgaaagaagaccaacattcagcatgatcacctagatctctaacgtcttttattcatccattcattcactcaacacatgtatttgttgaattcctccttcatgccagggactgtgctgaacatgttcctgatttcactaaatgtgagctgtgcaatcttgagctctagcagtttgcacaaggtctagctggaaaaaactgctttatgacaatgttggggatctttgttgactcccagccttccaaaaatatcaataccccagatatgacaagtatcatttccattcacattccattggtgagaaccagtcatgtggtcacaccaactgccagggagactggaaaatgtagtcttcattctatgttcagctaaaattcaggggttctgttaccatgtgaaagaagggaaaaaccaatattaaatgtctctgcttttgtaatatattttgtaatataagacactacaaaagatgtagtgtcttaatcacactgatgagtcaagaattctgggcatctccatagaccagagagatggaggaatggccaggagccaagagccatgtaggtagatttctcaaatgggatccaagcccacttcagggccagggcttcagagttagagacaggtctctggcccttaaagaactgacaggtgatccatgttggcatcaccattcataaaaacttcacaaaagacagttctctgtcctgttttgaaataagtggaccttttaaagtatcagggaagaaaaacttttcttctatcctcttaggttcagtgatttgggggtctatgaataaaaccaacaaaagacagactggcaaaagaaaagacaatgtttattcatgtatgtacttgggagctcacaaagaaagtggctcaaagaagctgttagaacttggagcttatataccattttaacaaggagaaggggttagggtttcaagggacaacaaatggtgggaaatgactgagaaatatataaagaaaccaacggaaggcaagtgaagtggtaaattttatgcgtcaacttgactgggtcaaacggtacccagataattggttgcatgttatttctgggtgtgtctgtgagggtgtttccagatgagattagcatttgaatcagtggactcagtaaagcagactgcccttcccaacaggagtgggcaccatgcaatccggtgaaggtctggatcaaacaaaaaggcagaggaaaggagaatttactctctctacctggctacttgaactgaatattcatctcctgcccgcagactaggacttacaccatcagctcctctagttctcaggccttcaaatttaggctagagccatcagttctcctggtgttcaggcctttgggctgtatggcagagggacctgacagccacaattgaagcatggcctaagagtgaccctatggtctaagaagaatatgtgttcagagtctcaagctaaggaattcaggagtggccaatgtaaagactcactccttatgtataaaggacatctgaacccctggcctatcccttggaatacaagctgtataaggaattgaggccctttgttttgggttaaatggaggttgctaggtgaaggttgctggttggagggtgctaagtgaaaatgctatataaactgcatgctttttacaaatggtagtggttctcctgtcccgcctaccaccactggaccatccctgtatgtaaatcatgccaataaaccctatgtcttgttctctgtctctaggtctcttccttggcctctcagacatgttgccatttctatcagagccaataagagtctggcatgccgtggcctctgactagaactatactaccagctatcccaggctgtagcttgcagacagcagatcatgggacttctcagcctccacaatcacatcaatcaattccttatagtacaataaggcttattttaataaggtgtgtttatgcatccagtgtcaacttctcatctctggtgacaggagtcaccccttctgcctggtacttccttaaagcaggattcatgatagcagaattcttttggaaggttctgcttttaggcagatgagggagtgcagagaaaggctcttcctgaatctgttgattctcaaatgcctttcactcaaaataatatttatgtcatgtggcatattctgatcccttccttggtcacacccaaattttatggactcaaatactttgaaagaaaaaagaaaggacggaaaaaaggaaagaagaaaggaaaaacagaaggaagaaaggaaggcactggctatgataaaacatttttcaggtgatgtatgaattttagaaaaaaatacatttacatacccaaaactagggcattatttttaaccaaacaatgtaatgtatggaaaagacaagttaaattccacattcaattggtaggatttcatattcagtgtgagccattctctccctgtgctgtgcttgctccaaacatatttccacagacttggataatttaccttgatttttgcttagtattgtaaaacgtccccaaaatttgagaaagcataggaaaaaaacttgtagaagcaagtaaaaccagagaggaaagccatgacacaggaagagaagatattactgcccacaaagcagctgtttgtcaacaatcacattagtggtctgggatcatgaaggaatgttttaagcattttacaccctaatataagttttttagttacatataggcatttttctatgttttcagaaattggctaaggatttggggttgatgcataccattttgtaatttttcccatttcaaataataggaaacagctctggttagcatttttgtgcacaacatctgattttaggaggggatgactaatattaagtgggaggtgtctgtattttaggaactggataggaaattgtattctctttacttgctcaacatccatttaacaagcatttaccgagtactacagtgagccaggcattgtgctgagtgctgagcagacagcagtggaaagtcttcatccttggctaaaaggatctagtctagtaaatgagacagagtgagagttgtgaaagggggcatggcaggcactaatccagctacaggagcccaggagagactgaaactaactttgcaaaatcatggcagtaagagaaatctaacatagttgactccatcctgcttctaacctccaagctctccttggtcattcctgagcatagaccaaccaacttcaggagcaatttagtttatagtttaatcttaaagcaagaatgataatagcccttcccaaaactaaactgcctttgcaaaactaatgaaagtccttcattctgctaagatgtaagcatagttaaatgacaactagctattgttctggaggttacaacatttgtaacgtttcccattactcctgtagataacataactattgtagaacctacgattggctttttgagatgtctttttagagttctgcatttctgactactggctgactccacctggaccagcaacttgtgattcaaccggtcctgtgaccccctccacccagagggggctcagtgcataaggaccattttccacactcctatgatttcatccccaaccaatcaacattccccattccctagccccttgcccaccaaactatccttgaaaactatccttgaaaacctctagcctcagagccttcagggagactgatttaagtaataactctatctcccacctggttggcctcacgtcaattaaactctttctttactgctataccattgtttcgaggaactggttttgtctgtcagcaagccagaagaactcacagggcaattacaagatgaataagagttaccggggtgaaagtaggggaccaagtacactaggcagagggagcagcctgtgcaaaagcccagagacagagagcaaggcagctgaatctggcatcaccaagccccagtggatgagcagtgcagatcctcccacttacaacatccccactgggccccaagaaagaggctgaaatttccagttcctctccatatcctctacccacacactcctgacactcatcgtcttcataggctacttcaggcacaaaactgtgaatgagctctaaaatgtggtttcctcatctataaaatgggataataaagttttatcttatagagttattgtaggtattgaataggttgatatacataaagcgcttttcaccaatgtctagcacattttcagtgttatatattagctattcattgttagctagaggccctgaaaatgtgtcgcagtgaagccagaggtccctgaggtcaggctggggatatcaagtcccaggttttctgcccacccacctcctcttccaaataaggcaaatgcacttttttttttttttttggcccaccattgtgcagtaaaactgcatcctacatagatttaacttaagcaaattcaagaatgcccagctggctggatgagactgggagaaaaataacttcaatactgccagtcctactccattctctgagagcaaatgccccaggtgaacctggaggagagggagaacaggcactcccctccagccacagttttccccacctttccccggtctaagcagcttgacgtatactttgttaaaggattttcaagcctaattgtgactacctgcaattttcaccccacaagccgactttaaaacctaactcttgctaaaaagaagacactccagcacctctgtccgcttagcatcaagtaaattccaatcaaattagaaatcttgaaggctttctgagagctggtctttactttaaacagtttaaatcacccctaagcttagcctgaggagtaggattaaagcctccctgatgtggaaaaaaacaaaagaaggaactgtgatttactgcctaagccaccacccttagcttcccccaccacactctccaggtaaaatctgcttccgttctgcctactaccgtaggctaaaaagagatcaccggtcctgagactctagtcacatggatgcgcagcaggacaggcacagagctccgcagcttgaaacatagatgcttgtagctcacaagcccacaagtccaccagcccgccacatctcttgaagctcaggcaggtacgttcgccccgctggctttaatttcaaaatccagcacaatcactgaaaaactagagcgatttgctctttcagctatgcacaattttcatcagcagtctccagtggctacaatctcaggcaggcttttaccaccttttctcgtcctctctataccaacacatattctggagaaatggtttttctaatggcctgtggaggtctgcctgtgttttgaggctttgtctgggcaccaagtccagcagatacaattctctttcctgagtcaagcatttataaagagctgtgatctcagatttcagcttgcttctgtcttccttcttactcctgaaatctgatcatcccttttgtctttctaccacaattatatattgaaagaaaaacatgaagatgcaagagtatgcagggacatgtgtaagtgattctctgcaagtgttaaacacagggtgtaattacagctggaaggcagtgccttgtgggagaaaagacaaaaaaagaggtggggggggatattctttataaaatgttcttgtctttatttttaagcttgatgctcacatctcactttctaacacacacggacaaagaatatactcatgtacaagcaaaaatactcatatatgcacatgtgcacaaacacacacagacaatgtagtattttagagacccttggtcttttattcttttcagcaaatgaacaattagcctcaatagtcaaataaacatcagaagatgagggtttttcccccttcctctgctgttacaaaatatagcaacaaagtggggcaaagtagcatgaaacctgaagcagctcacacagaaggactcaagagaataggatcttccaaatggaagtttcagttagcttcagtgttctcagaattgcatctcctaaattttgattccaaaagggaaattccctatggcccagcaggcccatacaatcaattttccacattatttgtgtaaatatctgtcctgttgcatattctggaagaagtgacagtttcaaaatgagacttgccaacacacccccttgtcccaaacaataagaatcagcagaacatccctatcagccctctcaatttattcttcatcagaagccagtggaaaaggaattcagcaaagtgagatccccaactgcacaaagcactaacctaatcacacccaaaggaaaatgagagaagagtttgacctagagagtcttaaattagtgggcacactcagagactcaggggaattttagctaggcaagccaccaataatttagagagaggtggctctaatgaagggtccaggctgcagggcatggtagacaatctttcaaggcaaaggctctgggccacgtgacctgtccatggcacagtgggtgtgtcaagcacagtgaagtgtacagaaggtgtctgacttatgctgctttgatgtacaatttttcagctttacaatggtggaaaagcagtatgtgttcagtagaaactgtactttgagtacctataaaaccattctgcttttcactttcaggagatattcaataaactacatgagatattcaacactttattataaaattagctttgtgttagatgattttgcccaactgtaggctaatgtaagtgttcccagcatgtataaagtaggcaaggctaagttatgatatttggtaggttaggtgtattgattgcacttcgacttacaatattttcaactcatgatgggtttatcagatgtaaccccttcataagctgatatggtttggctgtgtacacccaaatctcatcttgaattcccacgtgttgtgggagggacccagtgggagatggttgaatcatgggagcagtttcccccatactgttctcatggtagtgaatgagtctcacgagagctgatggtttgataaggggaaatctgttttgtttggctctcattctctctctttgcctgctgccatccatgtaagatgtgacttgttcctccttgccttctgccatgattgtgaggcttcctcagccatatggaactgtaagtccaattaaatgtctttcttttgtaaattgcccagttttgggtatgtctttatcagcagcgtgaaaaaggactaacacatataagccaagaaacacctgtacatgtgtttcttgctttagaaagcaggaaggcaattaggctttattttacatgaatctacaatgttggtgaaacctgctcttccaacatcctgcgggctcctggaatggactctgattaggcataaaatgaggcatagccacacacaatgactttatctggaatactgctcacctccatgtccctcctaccctgcaagaatgggaagtagactcattagcatcatttaaaaatggtctcctggctgggtgcagtgtctcatgcctgtaaccccagcactttgggaggccgaggcaggtggatcacgagatcaggagatcgagaccatcctggctaacacagtgaaaccctgtctctactaaaaatacaagaaattagccaggcatggtggcgggcacctgtggtcccagctactcaggaggctgaggcaggagaatggcgtgaacccgggaggcggagattgcagtgagccgagattgcgccactgcattccagcctgggcgacagaacgagactccgtctcaaaagtaaaaataaaaataaaaatggtctccttgcttatgtgttcacttgctctttcctctctttcctggagagatgatagcaattgcacttaccttctgtttgggaggggcttttggaaagctgagggggtcagggtgaagcctgggggaaagggagcaaagaactagctgatggggacctgctgtggctgagtctttgggaaaagagggtagagcaaattgcttaagtttctgcatgatcagcccagctccccagggcaggagaggagataggtttagtcagagaacccacccaggacaatgcggttggctggaattaggtcagtgcctatgagaggcaggaagatgtgcaaatcgagcccaagcaagggaaccctcaacatcaatggaggtccataatccaggaaacccctaatatgcagcagttatctttattttaggatgctcagaaatagacaggatggtaccacagccaggtgaacagagtgctacctgggagtcaagatccctaaatctctctttcaagtttcacgtctgactggttctcttatcataagaaaaagtattgagagcctgctacatgtgaggccctgcagatgacacagaaattaacaagacacaattgcatcctcaaagaaaaggtacggaatagaaagagtatgggtttttgaagccatcctgatcatggttctgtcatttacaaattatgtggccttagccaaattactttgtgtctctgaccatatgttttcttatttgtaaaatgggggtaaaaataccactaagcatttctgaaaggattagagataatattattcaccatggagaacctcagacttactagctgctaatagcagagcaaggaggtaatgccgaacaaacagtgagtttgcaaccagagcaaagcaggcttaatgctaataggtcaaggaaagagtaaaaagggaatgcatcagagaggagctgactgaaaatactttcccaaaacgttacaactggtctacctttaaagtggaaatatgcacaggcaatgactcctacccagggccatgtaacccgacttgttgcactaagccttgcacttagaagagtttgtgattagtttaatgatctgccatcaccatcttgaaagtctgtaatttttccacaagggattcagcatttgcattttaactgggccctgaaaattatggagccagccctgctcccacttattgagactgatggggctttgttggtgagctacctcccctgaggcagcccacctccttctccgaggttcctgagctggtcagacccagatgccttgctaatatctctgtttgtggacacactcagcatgctaggctctccttctcaacctccagactttctaatgcacatgatctgcccagcttctctgcagggaactgagtagtaaaactacaccagctcatcactctcaatacacacaggaatgtttccctccatgaaaatcatttccagcattcaagaagtctacctggcaaaaaccattcctgccatcagcccaatacacctttcctttaacagcccaatatacctttcattcaacgaacatttattgagcacctactatatacacaggaaaaccccacctggaactgacaggtgcttgactaaagcaaacaaagctaaaggaacaaagtcccccaggacctagaggagataaatctttgggcgatttgacctgggaaacttttgcctggaagatagagcaaattctgggagcagggatgggagtgtggaggtagggctatgttacctctggctccagcagctggtgcgaggcagctgaatgagatgctgcaaaccctggcatatttccctgcctgctattaataagttcctagctgactgtgagtttcattactactgactgttctgcatccatgggcaccatcctcagggatgtcagcaccatcccagtggtatgcagtgggggtagactatctgccgcctttggcctggactcagtttcactaaaggaaagagtttgaggtggtccaagaaccctaggtgtttgcaggcacaaaagcagcaaggcctgcagagaagccagacagtgggtagaggacacagcaacaaaatatcaattcctgctgactaacctctcttctattcctcagcttccctgctccatgagaagctagacctgaagtagaaaacgtcccagaagttgatctatagggtgtgccaagaaaagattccccattcttcagaatcagtgaactgtaagccataagctgtgagattaaaaatagctacatccatctcaggagaaagggagaacagaagcagtgagggaagggcccaacccttcccaataagcttcaagccagggattctcggcgtttttaaaaatccatgcccctttgtcataaatatgaacacattctactctcttttagagttgtatacattttcaggaaattaagtatatcaacttcaattaaacaaaaggcataatggtgatccaagtatacactttttgaactaagcttgctatttcttcctacctccccagttttcctatcctactgcctgagattcttacatctcctttaataaatcctgtaatgaggatattcccttttgcccccttgtatcagttgattctcactctgctataaagaagtacctgagactgggtaatttataaagaaaacaggtttaattgactcagagttctgcatgacaggagaggcctcaggaaacttataatcatagtggaaggcgtctcttcacaagaagacaggagagagaataagtgcccagtgaagagcgaagccccttataaaaccatcagatctcatgagaactaactcactatgataagaacagcagcacaggggtaactgaccccatgattcaatcacctcccactgggtccctcccatgacacatggggattataggaactacaattcaacatgacatttgggtggggacacagccaaaccataccattccaccccaagcccctcccaaatctcatgtcctcacatttcaaaacataattatgcccttccagcattcccccaaaatcttcactcattctaacattaaactgaaagtccaagtccaaagtctcatctgaaacaaggcaagtcccttccacctaagagcctgtaaaatcaaaagcaagttagttacttcctagatacaatggaggtacaggcattggataaatacacccattccaaatgggagtaattagccaaaatgaaggggctacagtccccatgcaagtccaaaatccaaagaggcagtaattaaagctctgaaataatctcctttgactccatctctcacatccagatcatgtggatgctctcatatggtgggctcccacgtggtgggctcccatggccttgagcagctccatccccctggctttgcagggtacatgcccctcctggctgctttcacaggctggcattgagtgtctgcagcttttccaggagcatggtgctagtagttggtggatctaccatactggggtctggaggacggtggccctcttctcacagctccactagccagtggcccagtggtgactctgtgtggggactcgaccccacatttcccttccacactgccatagccgaggttctccacgagggctcttcccctccagcaaactgctgcctggatatccaagaatttccatacatcctctgaaatctaggtggaggttcccaaaactcagttgttgacttctgtgtacccacaggctcaacaccatgtggaagctgccacggcttggggcttgaaccatctgaagccatggcccaagctgtaccttggcctgttttagccatagctgaagcagctgggacacagagcaccaagtccctaggctgcacacagcagtgggtgcctgggcctggaaaccatttttagctcctaggcctctgggcctgtgatgggaggggctgcagtgaaggtctctgacatttcttggagatattttccacattgtcttgatgattaatattcacctccttgttacttatgcaaatttctgcagcaggcttgaatttctccccagaaaatgggtttttcttttctattgcatcattaggcagcaaattttcccaaatctcatgctctgtcacctcttgaatgctttgctgcttagaaatgtcttccaacagctaccctatgtcatctctctcaagttcaaagtttcacaaatctctagggcaggggccaaatgctaccaggcttgttgctaaggcatagcaagagtcgcctttgctctagttcccaacaagttcctcatctccatctgagaccacctcagcctggacttcattgtctatcactatcagcattttagtcaaagccattcaacaagtctctaggcagttccaaagtttcccacatcttcctgtcttcttctgagccctccaagctggtccaacctctgcctgttacccagttccaaagtcatttccacattttcgggtgtccttatagcaacacattacttcctcggtacaaatttactgtattagtccattctcacgctgctataaagaaatacctgagactgggtaatttataaagaaaacaggtttaattgactcacagttccacatggctggagaggcctcaggaaacttataatcatggtggaaggcacttcttcacaggagagcaggagagagaatgagtgcccagtgaagggggcagccccttataaaaccatcgatcttgtgagaacccactcactatcacaagaacagcagcatgggggcaactgcccccatgattcaattacctcccactgggtccctcccatgacatgtggggattatgggaactacaattcaggatgagatttcagtgaggacacagccaaaccatatcacccttcattgaaatgtttcactataaactactttagattgtgaccttcttgaggctctgccttaatcttcctggatcttcttaagtcttctttgagtctctgactacttacagaggggtggggctcaggaagagaagagagattcctcagcaggaaactgcaactcacaggtcctatttccctgcctagttcattgcctacgaaaaagtcattgctcagtgcatgctgataaatgattgatgtgaggatggatggatggatggatggatggatggatggatggatggagatcaggaatgccagatcattatctactcttctttaggaccaaaattaattctatgctgtggccttgggccttagcggggccatgatctttgagaaaatgagaggtgcagactattctaaggagtagacagatccctgaagaggacaggcaagtcttttccaacctagttcccctatacttcttggggaaagaagctttccaggtcagactgttcccacctgggcaaagttccccaacctttgggcagccacaaatggtcactaggcacagagcaggccagactgtgccaaaaaaatcattcaagaaggctcagaaaactcctaactgccacatgcaggaaagcccagtgctatgttcctcttggcttacagagagaagaaagaggccaggccatagcacatgttgacaaatcagaagacatccaaaggagctcagagaaatctagaagtatgttctatgatcaacaaggggatgaactgaagagatttagcctgaaaaagaaaacaatgggggaagagtaaggtgggggctgaatagctctctttggaatgacagtatgttgaaagtcaatataattgtttagctctagagaggagaactatggccaagaggaggcatatttaatttcatgcaaggaagcagcctctaacaattaacgtcagcccacagtgggttgttgaagcctatcactgttaagagattcgttagtttcctgtcaatgcacgaactgaaacagaagctacaggattatctgtttgagctgttgtgtgagggattcctgcagtgggaggaaggtggggctaggtgattcaaggtattttccatgattcatttgtttagatgaggcacccatgccatcctcacctcacctcacccacacctactgagactctgaaatcaagctttaattcaagggtttgactaccaactcaattcccc

SEQ ID NO: 2934 - DNA, 24046 bp, Homo sapiens
aaggtgtcataacaaactttttatcttactggatattagttaagattattttcccttaatatatcttttatccttggacaagtaaagaaagaatctatttgtttaaaagtaaatatttatatgaattccattgaatttaatatttttacatgtacttaaattaagtttgtagggttttttctgtttttgtttgagtcatgcaaataaaattgtggcatgggacattcgtattttaatcaatatgcaacagtgtacagtacaaattggagctgtgctaataataacaaaagctaacaattttttcataatttatgagtaccaggcaccattcaatgtggtttacacatatttcccatctcatataatgttcatagaaactctatccctatttcaattttagaataagaaattttgaggcagagaatgtaattaattgccccaagatcacttagattggaagcacttaaaccaaggctaggagcaagttaatctgactctagattttatacttaaaaacacgaagttaaataaatgctcacatattgctcctattattttccctgcccagcatttctctgtagtcttagaaacagaatatttggcccaggatcctgcccatatgttaaacatatggttctagagggtactgtcaacccgtcatctttctggaagccacacttaactagttgtgatgagcaactgtgactcacacggggccattgtagtggtaatctttgttaagtaccaagggaagggataatttctctggtgttgaaattgtgaacagtgccactacaaagatatcagtagtcatgctgcccattatgtggaagaaaacgagcctaagaccgtgaagccaacacagggaggtagaacccagggccccattttgtaaaccctggcagctgttaatctgttctccagaaatataatcttgtcatttcagaaatggtacataaattaaatcataagaatatccttatgaaattggcttttttcattcagcataattcctttgaaatacactgtccctgcagtgctgggtgacatgccattctgaatgttttaatgttcagaatgctcctgtggttgcctcttgtgtgagttcaaaagcaagcgatgtaaaaaagttaacacagatatttctaaaatctcagaggagttaaactctaattcttactgttaataatgaaaaattacacaaaaattcatcatgaatattctattatagcattttttcaatattgagagtatgtcagggctaagactcacagaaaattattagttttgttttatcaattttatatgcaatctactcaattttacagataacttatggctactctatatgcttgcaccttttttaaaaatgggagaagtcatcatcagagtacagatgtcacctcttctattactaatcaacatatttcatgtgtatttttccttatgtttcagcaattgactattcagacaggaatgtgatacatagaatctcttcttgaatgtaatagagtcatttccaacatactatgtcttatagttagctcaaaatttcgtacccaaacctagtttttataatttcacccactccaactgcttgaaattggatgcctccatgttctcagacaaaaaattttggtgtcctcactgactgcatttttttcacactccttatctctacgatttttttaaaccctgttgcagccctctcaaataaatacccagaatctgacaatatctcatgacctccacagttatgctaagtgactccagcttcccaactaacgtagttgaacctttgatccttcaatccactcccccatctattctcagcccaacagtagaagaagcgtttatatgtcagattaagtcacgcctctgatggaaagactctgatggctccctgcatccttgagcatcctggaaggaaacaggtggcatcctcagcttaggtcatttgaagagtgactgataaagggacttcttccaatgttgcaggcagggtgcagtccgggcaaaccacagtgcaggacctggtggctagtaactgtaggtctgttaccccctctaaactaacagtacaaggggagcaggtagaaggttcaaatcaaacaataaacatgaaactataaagaggccatgatcaataaaacgcaaactatggaacaatgacattgttagcttataaataagtaccctttcaaaataaaggtaatcccaagtaacaaagcatatgttccttttttctctaaatataaagatagataaacagagagatgtgtggataaatagataatatgtgaatctgttggtatcttctctagtcccatgcttcgagttttattgtttacaagatgtaaccaatcttatttcaccaacctcaacctttttatctacctctacactaaggacccatttatattctctttggaagagacaataacacacttataaaataggtgactagcatatctccattgagcaaatgtacgaaattacatagatatttctttttgattatggtgacatttttattaactcaatatttatatcatgtaaaacatttacttaatacttattaaatttttaataaagtaaatcaaaatttagagagtgcagaaaaaaaaagatacacgttttccagattttcctcccagtgttccactggcattattttataaatgaatgacagctgtaatattcaatgcttcatgcttcagttaaaacatctggtgaacagagaagatacgcatttctacttgccagataacctaatatatcatgaaacatgcctaatacacaactgaaaaatatcagcatactagtaataaatagattttgggaagcttgagcaattagcagaaactgtaataattttatatatttatgtagctttttaaggaggaaggcacacagagcacttgtgagagttgtcgtcataacacagcgtgatactgctcgagttgaactggtgctatcacctacttaaggaattggcctagaaacaatctgttactttcatgaaagtaggttaatattcaagctgatatattttgatatatttttccttcattcctcaggcttcaattctagccctgtaaattttaaaaataattggcatacataactcattgacataattacatagaaatatcaagctggctcttcactgtgcccatagtgtgctggtgttgactatgggtttgcaaatccataacactgtctgtcctactaaaatgtgcaaactattttgaaatataattaaatgtaatttaattttttacctcttatgaagtcccaggctctgatttgtgttgtgactatttaatatatggtaccatgcatggataaaatgactattacatttgccaactgaaacaacattaatcttgcctcttttttcatttaaatgatataactttttgttctaaaacaaaatattataaaatttctggttgtttttgtgtaaatgaaaacccagtttctacttttgttgtttttttgttttttgcaacggagtctctgtctcccaggctggagtgcagtgacaggatctcagctcactgcaacctccgtctcccagattcaagcaattctcctacctcagcctcctgagtagctgggattacaggcatgtgcaaccacactcagccaatttttatatttttagtagagatggggtttcaccatgttggccaagctggtcttgaactcctgacttcaaatgatctacccgcctcggccttccaaagtgctgggattacaggcatgagccaccttgcccagccatctttttttgtcctatctataataattccctcaatgctggagtgccctatttgagttatctgatttagtatttgtctgaaactctgctgcccagaatctcacaaggaaaaatttacataccagaattgtttttggcgtctcgacttctattcttcttcctctttgtcactaggtcttcatcaaatatacagtttaattttaaaaacaacttaatttttcattatgttaaatctgtataattttcccaggaatttctggcttgacttatagtctataaattttaggctataggttctagactgaaaatgttgatatggtatcactttatctgtcctcagatttctaagccatatgtcagtttatttggaatattctacatagcaaataagatatgggatattttctctttaaaattatctaaatctgataataaacacatatttttttcttaacttttatgtttgagggtgcatgttcaggtttgttacataggtaaacttgtgtcatgggggtttgttgtacagattatttcatcacccaggtattaagcctagcatccattagttatttttcctttccctccttctacctcctctcttacccctcagcctcctaaaggccccagtgtgtggtgttcccctccctgtgtccatgtgttctcatcatttagctccaatttataagtgagaacatgtggtatttggttttctgctcctgcattagtttgctgaggatgatgacctctggctccatccctatccctgcaaagatgcgatcttgtttctttctatggccacatagtgtcccatgatgtatatgtaccacattttctttatccagtctatcattgatgggcatttaggttgattccatgtctttgctgttgtgaatagcactgcatgtgtctttataatagaatgatttacagtcttttgggtatcttcccagaaatgggatactgggtcaaatcatattgcttcttttaggtctttgaggaattgccacactgtcttccacaatggctgaactaatttacactccaaccacagtgtgtaagtgttccttgctctccacaaccttgctagcatctgttattttttgacttattaagagtcttatgttcatctcatagtttatctgctattaaatgattccgcatattaagtaaagatatttgatgtacacttgtgtgtactgatgtagaaaatgattaataaatatttatcaaaaagttttcaaaatgccttaaaaactgtaagtgttttaatcctattttgatttattacaaccaacagttcttgacaacatatgaagctgaagcactgggttagaaatgtgttaaataagaaatcacccattaagggctgaaggacagttagaaaatattctaaacatgataaatatcattaagggaaacacccaatacaatggtatgactttaaaagatggagaaatcacttctggatgtggctgtaatttcagtggatcgggaaagaattccccatagagatggattttgatctgttgcttaacatgttggtgagcttttgaaaagaaagttgcaggactaagagggattgtctgtctcctggaggaaaaacagaggggtgcatgagttgcaaaacactgagaagagcaagcaaccttaaaagcaactaattcatgcagggcgaatttaaagtaactctaagaatgcacggtaaagaatgcactcatatttgattccaatgcatagtaaagaatgcacccatatatggttccaaaatactaatatcaagggaaaaatcaaaactccttgtggattatcaaaatttcccacataaaattaaatgcttttttttttttttttttttttgagacagagtcttgctgtctcctagactggagttcagtgacgcaatctcggctcactgcaagctccgcctcctgggttcatgccattctcttgcctcagcctcctgagtagctgggactacagacgtgagccaccatgcccagccaattaaatgcatttttaagcactatcagagattgtttgatatttcttggcattaaactcaaccagtgctcaatcattaattttaaattacagttttaaataaatgacagtgaatgtataaaaaagcctgcattataaaatatcactttggttttatacaaagaaagtgttttcactttgggaggctgaggcgggcggatcacgaggtcaggaaatcgagtccatcctggctaacatggtgaaaccccgtctctactaaaaatacaaaaaattagccgggcgtgctggtgggcgtctgtagtcccagctactcaggaggctgaggcaggagaatggcgtgaacccgggaggcggaggttgcagtgagctgagatcgcgccacagcaactccagcctgggcgacagagcgagactctgtctcaaaaaaaaaaaaaaaaaagaaaatgttctgtatgactttagagcactttacttattttctttcaccaaaataggaatattttgcaataattttaatatttctcctaaaatataagtttatttggaacttataactactgaaaaaattaaatatgtattttaaataatatgagctagttagacatattattaaggataggtacagaattctgaaggtagagctatgctcatcatatttttttgttgttgttagcagaaggaaaagattaaaagtaggaactatactgaaatgcaatatagagactgaatttgggtaggcaaagaaatagtgtacccttaaaacacaaaatgttaagtagccaactatattattttaaattgggtaggaaattttaagaggaaataattttttaaaggcaaaagcaagttgtcctgtatcaaaaacacaaactcttaaacaaatatatattcaattaaaaagtatacaaataggcacataaatgcctacaatacactattagaaatgatgagtttgattatttagaggtggcaattgtagaggcatagaagtcagaaggatggaaaagaaggaaagcaatgtattattctgtaggcactcccacattgcaaggagagcagtgagatttccccaatccaacacctccttgctcccgagcaagctctcaaaaaggaagctcctgccctctattgcccacaaaccacttcaaatgcaagaaaaacaagcagtctcttttatcagatgattgtatattgaatcaaaataaagcaaagaaaaaaggaccacaacttcagctcccagtgatcagaagcacagtacccagaaggccgggataaattgtcagctatttgggtatctggtagtcaaatttacataatcccatgtaattctaagattaatactcttaagtaggcaatgtgagacatatttctaaatatagaaaagccaaaaatcaaacccagatctgtttgattaaaaaattgattatgtccgtctctttatgttacatttctgttcagcaaacaaaaaaaatgtcaaagtgatttttttcttactttttatttagatatgttgatattgggaagccatcaccaccaataacttttaagtgtctgtgtgtgtgtgtgtgtgtgtgtgtgtgtgtgtgtatacacctcattttccttctctagacttgggctctggtataaaatatcacaaatatttagaaactttgaaatcaggacagatgccaagttttgtttttgtttttgtttcagttgttcctgaaactgttattctctgatttttaaaaatattgttgagcttgaattgtagacagcttagaagtatttgaataatattttttaagtgtgccaagtgcttttgagcagaaaatgatggcatcttttctctaaatcaattgtggagagactagagaaatttagccaaagatgattcagttgtgtagaaggagactcacaaaggctgttaggcactgaagtgggagaaatccttgactggagaaatttaaaagtaaaagatactatttggccttttatgaacgatttttaaggtatggtcttaagaaaaacggcttacaaaaatgaacttcttaaatatcctcttgtgtctgaagttatttctttttttacacaatatctactatattatctagaagaggaaaaggcactcacatatgtggagtgggtacttttagacagaagctttacattatcacctcattagaatgttcaagtccacatgatgtttgtttaaacatatttttttttcagataaagaagtgaaaaagtaataactaaaccatttttcaaacacatgagatggtatttgatcactggtatatcttttttttctgaaataattttctttccataaatccatttttgttgtggctaatttgcttgtattaatttaatggctaagatgattagaaaaggatgaacattaaattcgattgagcccataatggaattttcaggtgcttttaaaaacaattagagcttactctttctcaataacctattctgcttatacttaactgttataagatcacgatttcgttctgctattttaaaacatcgctaaaatataatgtctaatatgattaaaaacagaagaagataagatagcctcataaggtaagaattggtgtgtttataggccttaatttcatgtattacccctttcttgtcactctttggaagtgaagaaagagaattagggggcttagaaaaagtaatggctaccatgtcagatcctcaggacttatggcttctgaaagcaaagtcattgcttgcctacctccaagcatggtgacacaaagaacaaagcaaaaaaggaagggcacagttttaagttccttgcctttgtgataatgccaatgaaatgtcacaattctacactagttaactgtaccaagaatgatgacctcattcagttcaacaattatcttactcaaattcaaagctaaaacatcttacttttacaatacatgcgaagtattataagtgaaaaacacttatgaattaaaaatgttgaacatttttacacaaaatcagtctaaaatattcttctatcctaaaatataaattaatcttataattagagtttttacccaagaaaatctgttgcttttgttttacatgcatcaaactcatgaagtttagtgttctgctttgcaaaatattttacaaaatgcctcaggaatttcagttgtggcaaatgaaacttacacaatttcttcattgaaactctattttatagataaacatgccgtcctcccgagagttaaactgcttttttttttagctttcttatttatttctttatttcttatctcgattacttaaaaattttgtacagtctttctggagtatgtgtttataagctgaatttattgtaccatggcttagaatcaactgaatattgaaacctgaacaaacacaaatataatcttctaagtaacttgtgagttttaattcatagattttaaaatcgtgtcaatattctgtaattttgaaccaagtgcatacttaaatagtattttactgcttttaaaatattttgaatttacaacctattttaaaatgttgaattacagtctgatgctcacagagtgaaaacaaatgccaacaatgtttgcctggttataatcatagaacatgtctccaaagtaaatctatattaacacaattcaatgtggtaattaagatagaaaaaagcagcactaagctgtgtgtcctatcagtttccttggggagaaaaaaaaaaccactgacgtgacttgaaatgtgtccaaggggtttagttagcctccaattagctgcaaagtcctgcaattaaaatgcacaacaaataccagcctccatgtccctgaaccctttattatttaagtcctaatttcagatggttccttcattagagcatatatcccaaaagctacctttgacttacaattacactgtacaatcagtgctgtcaggtgataagttggaaggacaacagactccagggcatatcttggtgaacctcaaaggcccaggtcttaaccagaggcaaacaacagaacaaaggcaaacattctaggaacaatctaccatgaaaataggccaaattgttgcccctgtttaaccttgcagtttatacctgtcatgaaatccatatagtaaattcaagaggccatgcagaaatatgaacacagcggatgtgtaaagagcgggaaattggaatctgtcttttctcaggttcagaaagcatatgccatgttttcatatcattttcaccttctgcatcattacttcctttcataatcatttggactcataagaaatgcttttttgcaatttaaatactaccttgacacttaatatccaggttggatgacaaaaaagtcggcttactaactgtttaatgaatacttctgagaccatagttagtttatttttggacagatatatttctattataaatagtctacttttaatttacttttttggaaattatggcccatttttctttataaaacatgtctcaaaatgttattcaattcccagacaggacaggtcagaaagtagtctaacccataatataactttaatggccttcagaattaaattttacccatttgtaacacactgaatatgtaagagttgtctcaacttccagttaacgtccaaataatattctgtgcctctgagcaaggatatttttaaaaagagccaattatttggtcataattacttccctgacaatatcagcacataaaagagagtgggcgaagggaaaactttttatatgaaaacaactttcaaaattaatatgattttataaataaagggatctttcaaaattttgttaagggaaaaatattaccaagagtcaatcatccctcagttgatctaaatgagagaaaaattgtatgtgaatgcatttttgaaagtgtgagttgacgtgtgtgagcatgtgtgcataatctatgagcatgtgtatcagcatgcgtgtgtgcttgaatttgtgtggatgtgagcatgtgtttgagtgtacaaacatgcataaatcaatatgtgtgtgtgatgtgtggaagagaaatgtggtattcataggctgagactggcaagcaatgcacgtggatacaagtggaatagttatcacctaagagaaactcacagcaattcaacaccatatggaggaattgctggaaaaagctggtggaggaatatgttaaacttgattgttgaaataatattcatctaaggcatgtaatttccatatgatctttttgcattgaaggtaaatcaaaagcaagctctcaataaccatatgaaaagaaatacaatttcataagtaaaaggatctttcaaaattttgttgagaaaaacactagtgagagctgataatccctcagttgctccaaattgcgttaaattggattgccttaaaatggcaccattaagaggataaaaagaagtcacagagtggaaaaaggtatttttaataaccaacaaagggcttatatccagaatatattaaaaacttgcataatttcattaaaaatcaggccttcccttaggaaaaaaagtgcaaaaacttgaatagctgcttctcaaaggagaatatcaaaaagaccaatgaatctggaaaaggtctcaacctcttctgtggaatgtcatacaaacccatggtgtggtatcactttcctctcaaagaatggctaaaatagcccagatgaaagtagaaccccacttgcaccatgttttaatggacgtcatattggggtgctttgtgtggctctgcacctgtcacagggcaaagcatccgtaggctaaaggcaaatgccccctaaggatctgccataaacccactaccagaccatgcttgagctaccagcaccccacattccctgtccagacagcctagaacctgttcccacaaagtgctctgggctttctcctgggtttttcatctgaagggagatgataccacctatgtgtgtagctctacatccaaggaatggttcacacccaggaagtagtagacagagccttagtgtatagatcggcttttctcaagtgtgtttctctttgtaagttcaccatttttttcactcatttaaacctatcaactttatttttaaatatttctggtatctttcaacttctgactctatctgaaatatcctttcagttatcattgattcctcattttcctgcctaaaataatccaatgctcagcactgctatggagataaagaaaaaagaaatctgtaacattacaagagcctacatttcctctgcctgaaaagtcaacaatcccttcttgtaaactctagacttcactctgattctcaactacaataccttgaaactcttcaatcttttcatttttctacctcaagtccatcttttccctctgcctagaacttcccctttcaagacactcacatttcacctcgtcgattcctatgaattattcatagctcaattcataaacattgttctcaaaaagcctatctatactccccaaattgtcagatcttctattataaaattctaatagcattctgcattactttcttagcatttacctagctctaataaaataattttattggctgttcaatatctgcctcccaatttatataaaaatttttagaacgaaactcttcatgtatgaatgctctatatgtagttgtttaataacaaaatataaacatttagctatgtaaattgggaaaatctgccatatttagattatacgaatgaaggttgaataatgtttaaagaatactttaaaatctcaatgatctgtccaagaattatttttaaaatggtgatattctacataatacattattttaaataaccctaagattatgcttctaggaaggataacagaataagcaaaataaataaagatacaaatctataaacttaattataataaggattattagttaaacaaaatatacatagatataaattcacaaaccataagttttcatattcaaacaattttagaacttatgtgtacattctcatataacatattatttatgatgcatattaacagctattaatgctgcatattaacatcatattaatagctatcacttttgagaattgagcaagtataagataattcaattatccctaatctcacaaaaagtccacaaagcagacattattcctgattcactggtgaggaaatgaggaataagtagctataaaacttgccaagattcctgagccagagcttgagtgtgtctgtctgacctcaaggcctggcccttcccctttcccctcaacaacaaaaaaatcatttttcttttgacagaattaagtttttcaatctctaagttcagtttttggatcagagcttaacttttccaaagaaaaattgcttaatcaaatctcttaaataggttagcatttagcatacatcgtgaatagtgcactaagcagaagaaaaataaggcaacagcaaactaagcaacctatcgaccaacccccagattagtttgttaagccatttgagggcaatttcaaacaaatcttttctttgtaaagtgggaacttctaataggctactttgcatttactaaaggagagtacaaacaaaatcaaaatataaaccaggaaggtactcatgatgcaatactaatgtacaagaaaataagcaaataatgctatgaaatgactgtaatctgctaagtatagaagtatattattttaatttgaatacacatattttctttccctgataagctaattgtcaatgattgaggctcaaatccaaagtaaaaatcaattattgaacactatggctcattttaagctagaatctcagtgtgcaatttattttaatccttgtcctttatctatggagaaaggatacacatgtgcatcataaaatgccagattgtttcttacattttcttaggaacatagccatattgaagacacaattaaccacatgatgttaattactgaagaaattatcattgctaaaataaagtgagaattgtcatatatatatatatctacagaattttgaaatggcatgtaatgtgttcatatatattcttacagtgtatgtatatattttagctatatataaattaactaaatatatgtataatatatacatacataccacgtgcacatgtacacacacatacatataaagtatgtcagtgatctaacttggatatatctaaactgtaaatttgaaaatcaaagaaactaccatattgcaatctatatgcaactgtatattttacatgaatttgtggttatcatatagcttaaattggaaagtgagtccctaaaagcatcattaattcagacaaagtaaatgccagaaaataaattaggtgcatataaaatgaggaactgcaaatatattacttacttttatattagtggaggcaagaagacaaaatgtaactgaagaaatgtttttcacagataacttacttcctgaaaaaaaagtattttccgttaacgctatagattttctttataattctcaacaacactacctaagcagtgttttgcaaaggtgtggaggcatctctgcttttctccataattggagatatagtcatggaaaacagaaatgctggacatgttggaaaatgtgtcctctgccattttctcatattcttgccagcattatgttgacatatctgtgtataatcacatgataataaaacatatttttacagcttgagccaccgcgcccggccctgagtcgacttttaagcataatatttcatcctgtgtgaaggtgaagtatttaactttgctgagtagatgacaatacttcaagggaacatgtgtttactaacctgtttggaggagagttaaataatatctagaatggtgtaaactgtgatactcactgtggaaaaatatgtaaaaaaattttcttaaaaatttccgttttatttacaccatcactataatgcatctcttttataaagaaatgatttacacagacttgcaatatttctacataatttaaagcaaatacttttacagcagtcctttgaaaactttaataggcctaaaattctgctgaatgtggacacatgtttcaaatgcttttggccatctgggaatgtggcgttcttcataggagctctactcccgaaactgccagtgcctttgctgcaccaggctccaaaaacctattgataactatatcatgttgtgcaggtggaaattgaccttgatcatattagacaaatacataaaaggaagactgaagaatacaggctacttaagacaaaaatatccattcctgaagatgggtgggaaaagtagatattttaatagaatgctctagatattttcttccgctttctggcaccaaagtaaaacttaggtgccaaagtggcacttatcttcaaagaaccacctttttttctcttattaccattgtatgagagaaagtcattggcattttcatcatgtctcaagatttgtaacatctacctagaggtatgaatttgcttttcatgcatttaaatgactataaacagcattcttttgaaatcacctaatgagttctatgatatgaaaacagatatgtatccccagaaataatatatataattctgattctataagagaactattggggcttttttgtgaacattattatagctcaatattatctttttgtttttcatggtattccaaagatcatttaaaggatgaggatatgtaaggttttcttcagtgcacttgtctttggtgataatgccctagttcactagttcagttgcctattatgcgacatccttttagggattattctgatgtacataaacatacccttgctaagtacatacacatatataccatatgcacacatgcacacccacctgcatacaaacacacacagacacacacacacacagacacacacacacacatacatttcttatcctggattggagttacatggtactggagggggggttatgtttctaaaaatccaatagtaattaatggaataaaaagtattcctttctttatattgtttggctattttaaaatgaattttaatactttggattatagtttaataaagatgatatggaaaagaaattatttacttaaaaaaatcaaaataatgcagaaaaaagttatttgtgagtatttatgtgaatgtgtgctgcactaaataatgaagggttttctatgtcctttcttccacctatcttgaaaatccacactcaaaacttcctttcttattaaaatgcccttggtaaaaatccatataactccactcacttattattttctatatatgtaaagaaatttttacatggtatatagatagcaaatacatattaatgttttatgtttttaatctcttacaatggactttgtgcaatgtccataatgatgaccacttttggtatgcaacaggatgataaaatgtttaactgatgcaccaaaatataaaaaaaaggtagatactaaagtaaattctgagaagaactatctagaacttgaaaattatcatagtgtgatcataaacaagtcagttaagactacaagagataataatgctgtacaaaagccaggagaaattattttcaaggacaatttattttagaggatctactagtgttttcagagttacatatcttcttcctgacccatttcttttaagttttagatctggaagaattttgttgttgtttgggtgtgcttttttggagatggggtaaaagtgcagactttaaaaatagaacttattaaatcctttaaattttaaaatttatctttaattgacacattgtaattgtgcctgtttgtggaatacatcgtgatgtttctaattttcattcaggaataatgaaaaaaaccttgagactgacttataattttattctatttgctacttgatcagaataaattatatgtgcatataggtaaagttacaagggttaaagaataggtacaaaacatcacgaaaccagcatgcctcgtttgatgcaaaattcctataatgactacaatagtaatgatagtgactatcatttaaaaatctctatgcccccaagaagtattcatatttcatgtcagtcttaatagtagacatttataaataataatattcatcatgaaatgaagaatagattgaaagaaagtaaggataaacataaaagcttcaaatcattgtattcttattcctctagattttcaacttatgtcagttatgttcacagaatatgaaaattctatgaccacacatgttcggtcagccctgccctttgacaggtaactgataatttctcctctgtgagaacactttcaggaattatttattcacagatttatttgtgtcagattcaaatgaatgttttttctatggtatattattttagcttctaaatttgtttttagaagtgatgacataatcttgacatacttttgttcatttataattatagaattcagtttttctttctttagcgtagctctggtttatgaattaagagaaaaaattagcaaaaatgatattcatgacttctcagagttaaaagaaataacttataatctaaaatatttaatatttgcaatatttcacttacaaaacaatcacactgctaataaaataagctacaatgccacttaccatgtattggtataaatttaatggctgtcacaataaagattgaagcctcctggtaggatatggaaagcagagtctattcatagagaaattagaaaatgtcagctgtgtggtttccatggaataacttggctttaattaaacatctattcattagtaacaaatgccaaataacattaagctgttagtagaatattaattacatgcttaaggactaatggtagcatattaacaattaatggtactttaagaaactagatatactatagtacataatttgtttaaattgaaagctattctacgagtgtgattttttatttcctaattgaaaaactccataattatatgcacaatatacatataattctatgtacaatatacatataattttgaagtttttttcccctgaatatcatggtatatatttgggtactatgtatatgtccaaatatacctctcttaactttaaaaagcattcattacaaattgttctctttctattcttgcctccctctggaaaaaggaaacctcactttatgcataaaatttctatttaagatgacatgatggttgagttaatatgaaaccttaaaaaagtaaagtcgaactatgaaaacacccattttaaagaactgtttctccgtcccagggtctctccttctgtctcaattttctcttctaacagaataggtatatttggtaaaaaatatagcaggacaggacccagattcaacgaaaagccagagacatcccactctggaatctgacacaaagactttctcattcaacacagacaggcactgaaatgcctgctagatctgctgccttgatactgtgaaaggacattttgaatattctttaatgtgaaggcagaggaaaagaaagtaattatattttaggattgggagctcttttatcgaaaactctgtggacctgtttgaactttgccaaaacatttctcttcaaatcaagtagaaccttgtccatatacttggaaacaaattaactctcaaatacagccagatgatgatagacagtgttgttgaccacacatatgaatccgtcttgatctttaccttataacatttcagttattcctacagatggaagggtgcactttcctgccccttgactttggaatcagcgaaagagatattagcaaaagtggtatgatgaaactgacactccatatgtgctttatggtaaggctttctctcttgtgcttgtatcattgtcatgtactgcagaataaacatggccacaagtgctctgacattccttatatagagtgggatatttatttccttcctcctggtgggtaagggagaagcttaaaagggccctgggagactgtcactgaatggtggaagagcttcaaggggattattaacaagaaatgtaaaagcagtgaggaaaatgttattacaagcaagaaggaagcaacgtgtaatcaggaacatagaaagagtaactaatgatctctgaggattggccaaggatatttgcaggcataatgttgcaagttccatactctttcttgacatctatgatgaattacaaaaaaataatgagataaagaaaaaactgttctgtttttggcagaatttagagtcattataaaggccccaagacatgctgggtttgaaaataaaattgttgcatattcctagtttctaccagaaaaagactctcaaagttataaatgaatacatgccagaaatcaaatcaaaggctcaactagttatccatagcctgagaatacagatatcaaggatgtggctgtaagatcctttcatcagatcacaaaaaagatacatgaatttgcttagtaaggcttctaaaaatataaactgaatgtctcctagactctgctgcacaagtgggtcattaacccatttatgccagaggttgcaaatttttttggtgaaaaatgagaccttggaaattaccttgagcagcaggatataaataactcccacaagcttagtgttccaataatggaaaactgggcataaatgcgttaagatttgtcaaatcatgcttccatgtcaatatgaaatgcttttacaaagaaagattttatggccccaagatatcatatcttataagtaaagctagagaagttactctatcaaaacaagtggtttggtttcggctaattgaattaatttgatacacaggaaaccaatcaacattttaaagccattgtatcagattagatgcaaaatgcagagatagtttaaaatgaaaagaggcctttgtaaccttggtattatttctacaggaagtaaacaggctgagaataatactcagctgctgtaaacatagaccacttattagtaaaattaaaaataactcataaggccgtggggagtagtactgtgtcctaatcaagaaactacaatatcaaatgaagtagatttctgaattaccacgaatccatgactgctatgtaccttcatatcactcctttcagaattagaatacctgttgtaattttcatgtctctctcttgtcattattatgttgattttatgaagggaaaaaattcacctaatttgtttcacataacaggaatcataaacagggatcaattcacctaatttctccttacataaacaggaatcatatgtgaggaagcacccctggatagtctaaatccacttgatttaaataataaaatcctgtatttgagttaattatgtaagagagtgaggctttgggggcctttggagaagaaagtacattttgtataagggaggaattttaaatacatggccacagtttgagcttctgtggattaaaagtggttaagtattcttatgcacttctcttagcaagatctgcacactatttcatcttgccattgattgtgtgagggcttggggttacttttgaccctgtcacaatagaatcaaacagtcatgtcctattggaagtccttacaatcaaaaccatgacatatagaacatcagccttgtggtagtttgttacacagtatttacattattaaataactagaaaattatagaaaggcattaagatagtttgtgtacgcacacactcaaaaacacctcatagatattgattttggattgttttaaatctataaatctgtggtgggagaatagacattttcattattgagtcttataaagtatgaatacaggccttctttatttctttcaaaaatactttatagtttcctttagacctcttgcgtctctgatttttgtgttgttgatattataatttttccttatttcttatttgtagaaatagatttttaataagtattggccttgtagtcaacagttttatttaattcacttagtaattctaaaagttattctgtagctactattgagtattctctatatgtaatcatgtaagttgtaaataattactttatttctttaggcacaattccttacatatttaattgtatttgctttctctgggactggttaggattttcagcaccctggcaaatataagcaataatgcagaaatcattgtcttattcaaagtcttagaaggaagcttttaatattttaatattaaatattatgtatgcctttttatctcattaaggactgtccctcttaatgttagttttataatttttttttaaaaagagaattggtgaattttaacatttttaaacttttttttctatgtctgtgatgatgagcatttagcatttttctgatttttggaacttaaaccaaccttgcattcctggaataatcaccgctcagtcttgctatattcttctttttatatttattgttggatttgatttgctttttcaaaaaactgtttctttgcttcattctaaatgaaagaattgggctttgatttttaatgttaacatcttcattaggattattttcaatatttgtgatcctcataaaacaagttagaaaaactgcattttccttaaaattttgtttttttttaaagtgttacttctttactatttggaaaactttgattatgggaaggttttcacttaaagatttgatttatttaatagatatgtaaagtaaaatgttctattttttgtgttgttcttgctaagtaacgtttttcagtgaatttgttcaagtgtaatagcaaagtgtaatatccatgtattatctttttaatacttgttggtctataggatctatacaaatgttattttttaaggttttttaattatgaattttcttaaaatttggaagccagaagagggaggattggtaaagaaatgtttatttctgggatgcatttgaactgacctggtagactttcaatgtgtcaggtttgtggcagctttctgtgggtgacagaaaaactttgtaatggcaagtctaagaagctaactatttcatcctccatagagcacaaaattatgacaataagggaagggaaacacattaaggaaacacaataaggaaagagccacatggcttcttcacagagtgtccccagatggagtggacacatttaaaccataattggaaacacatctcactgaatgttacacttgtgaagtgaaggtgttaagaggtggggcctttaacaggtaattaggccattcatccattcctcgtgaatcgagttaggtctttataaaaggggcttcacacagagttgagctcacttgactgtttgtcattgaccatgcaaatacacagccttcctcttctctggaagattcagccctcaccagacaactgaacctgctggcaccttgatctgggacttcgcagtctccagatctgtgagaaaataaatttctgttctttacccagcttcaggcattttgttgtagccgcacaatggactaaagcaggtcctaaatattttagtaaaatttctgtttaatatttaatatttaaattaatattttacttaaatttcaggctatttttaaatgaacataagcaactcaaattcccttaagtagcatatatagtttaacttatttatgcctaggaaaatactataatgagaagttagaaattttgattatatagatataaacactctcacgtagattgtttaaggcagtgaaaaaactgaatggatggaaccgggtggttgtcattcagaactattgaatccaaaactcaacagagacttatctgtccctacaacaggtgctaaataataattgacattcccaaatatgattctgttataagacaaggaaggaatatacagctgatacttgggggaaaataaatatgtatcaaaagagttttgaagcaggaatagtaaaattgagtaatatgttcaaatttaaaaatttgtatatgttccaaacaaagtcatgtgtcatcttcaacttaaacttttcctcacataaaagattaaacaattgctcctaatagtctttaatgtactttctgtatcttgagttctcagttattcccatcattaactttgataacatcagtactgtgtccaagatagtatttttgactctttaactgaccatgataaatataaggagaatgagacttaagtgcactgactatatctccattcctttgattaaaattttttttaaaaattgaattgtaatggaacaatgcaaacctgcagaaaactttttgcatgctatttttcatctgaaagtaaaataatacctgaatactctttgtctcaccagctttttacagaatgaatggcacttacagggctattttttctctgtaattattgagaaagattttaaggcaaagcatttaggagctaaagcctgcatgattttgcttctgtgtggggagaaaagaaacccacatccttacttggtaaagaacttaagggacaaaataataataatagattctaggaaaatatttaaaaaaccctcaaaactaaaatgtattaacattattcaaaatttatgaattgttggtccttttacaaaatgaagcaaaaattaaaacaatccaagaaagaaatacaatctagttcaacaacttatacacatgccagtgggttcaatgaagcaccatgaggaacaagggaacaagcactgagttcatctaattcagggatagcattccctagagatttggacgagatacttactgcattataacttttggtaaagaaataaaataaaatacattattattaatattatcactcaaatatcaggctttttgatatcttcatagtttgtatgactatagtttatacacagcattgattaataagaaataattttctcaacaaccacataagtgaaatgcataattgagattttgcaatcagagataggaaaaaggttgtctgaggaagggtactccaatatgtgaaaatcaatctgtatttattaaatctacatgctgctactttggaatgtttacaaaatgttgttaaaaatggtctccgtttaaatatgtttattgtttctctaatttttaactagtcagcttaactgatactcaaaactctctacaaattttattcaacattatatttttatctttacaagtttttcttgtaaattaattgtggggtattttactacatcattaaaatcaaagtagacttttttagtttttatctatgtttcaacaatcttagatcctatcgataaaaatcaactaacttctaatactacattatttgtgtgtatgtgtgtgtgcatgtatactaat

SEQ ID NO: 2935 - DNA, 799 bp, Homo sapiens
tgcaggacttgagtgtttgtagattttggtatacgcttggcttcgggaaccagtccccctgtgatatggttaggctttgtgtccccacccaaatctcatcttgaattgtaatccccaggtgctgagggagggtcctggttggaggtgattggtcatggggtggtttcccccatattgttcttgtgatactgagggagttctcacgagatctgatggttttataagttacagtttcccctggacttctttctctctcctgccgccttgtgaagaaggtgcctgcctccccttccaccacgattctaagtttcctgaagtctccccagccatgctgaactaatgttatcttatctggaagaagaggaataggaaagaaaaggagtcaggaatggatcttactcagaaggctgactagacacagccaggtggaagagctcccactgcgggaccaagatgactggaatgcccctaacagatcttcagagggaagaaaccaggagtggacagagagaagacacagaagctgggctgaaggtagtgaaagctgggaatgtggcacaggactactgcacaccaggttttgttcctggcccacaatggctctgggggatcaggttgaaggaaaattaccctggatggaagatcagaggtatagaaagaaatggagagcaaagaaagaggactgtgctgaatgagaacttgtggtaattatatgtatttattgtgagaagaatttttgcctgagacaccatcatcagtcagaccatgaatgtgaaaaactggaaatccaaaagtctcc

SEQ ID NO: 2936 - DNA, 18845 bp, Homo sapiens
ggcaggcacctgtaatcacagctactcgggaggctgaggcaggaaaattgcttgaatctgggaggcggaggttgcagtgagctgagattgtgccactgcactccagcctgggtaacaagagtggaactctgtctcaaaagaaaaggaaaagaaaaagaaaaaaagaaaaagaaagattacattttactgttgtatttacttatccttctttcttgtattccatgccttcctcttccttgacttcttcctcttccttttctatcccctcctccttgtccccccaatctttttcttcctttgtagttcttacttgaattttcttccagagggtgatattaatatatgagtgataatatttaaagtcttgcatgctccaaaaattttatatttaaatgctttattggctgagcataatagcattctattttgaaaattgtttctttcttctaacttttagtcattcaacaaatcctaaatgagcatttaataaatcaagatctgttttaggtgctggaattacagcagtgaacaaatcggacaacaatccctgtctatcttgggctgatcaccaagcctaaaatcttacattctagtaggctgtccattagatacttggtattcagtatagtactctttctatacatactctctatgtattactctggtattcaatagagaatagatactagaaatttgctgtcagtctaattttcagcttatgagacaagtatttaaaatttgcatttacattgaagtctccaattttttctaggatgtgttgacatgagtcttgttaatgtgtgtgtgtgtgtgtgtgtgcatgcttttaaaaaattaattttcttggttttcacattgcaaaaatgaacttttaattttcccttccattccctctcccatccccttcggatgtacttaatgccacatacattggtcctcatgctttttgactctcctctcatttaaaaatgtctctgcctactcattctatattttaggagattcactttaccacttatttgatcttcagccatgttcattctattattcaacatgtccactgacattttaattttgatggttatttttgaaggattaagagcacttttctgctcctgggatagctagctctttttcacagaacaatatttttgtgatataatattctcttgactcactcacagtatactaattagaagatgtttaattatttttttctaaattctgggttatttctcttcttccaaggttgtgtttttcacttgttaatttgggctgctccttgatgcttttgattttcccccaatgtcagttgtgcttggttgatcctatcttcatattagtttttgttgtaaacaaaaacactggtaatctgacttctatatttagccacattttagtggttttactttttactatgaaaaacctgtttctgaaccaggaaaatgtctgattgttgatatgtttgtagtaattttaacaatttgaaaaatatgtttctgcatctttctagacaacattcggcatcaaaatattgaagttttggattgtttttgatgtatactcttcaaggatgatgcaaataaacatctttaccatgaaggctgagcatggtggctcatgcctgtattcccagcactttgggaggccaaggcgggtggatcacctgaggtcaagagtttgagaccagcctggccaacaaggtgaaactttatctctcctaaaaatacaaaaattagctggatgcagtggcaggtgcctgtaatcccagctactcaggaggctgaggcaggagaatctcttgaccccaggagacagaggttgctatgagccaagatcacaccactgcactccagcctgggcaacagagcaagactctgtctcaaaaaaaaaaaaaaaaaaccccaaaaaacaaaaacaaaaacttcaccatgaaatactgagaacagggcagaatttgtcagcttggtctttttttactcttacatctaattccttgaaagacatattcacagaaaaaatactttggtttcaaaaaatatttcaacattgattttcaacaccttcacctacagtcttatttatatttcaacatttataatgtggaacagtgcatatcatgtaggtttcaacaattaaagtgaacatatagttcagatagcaagagctcgagttagctatcttttaagttatgggtgttttttacttacatcaaatgaaactagaggttctggtaatcagaacacaataaacttctagggtttgttttgttttgttttgtttttgagatggagccccactctgtcacccaggctggagtacagtggcatgatctcacaacctttgcctcccaggttcaagaaattctcctgcttcagcctcccaagtagctgggattacaggcatgcaccatcatgcccagctaatttttgtatttttagtagggatggggttttgtcatgttggccaggatggtcttgaactcctggcctcaagcaatcctccttcatttgaggatggcctaagcaatcctaagccttctaaagtgctgggattataggtgtgagccaccacatccggtctaaacttctgtttctgaatgcggcttttctggaccacaggccagtcagtatacactacttattcatagtcatgactgtttgtttaagtactgggcagataataatgaatcttgtttggtaattctatcacgaaatgttgtttaattgagtttatgtctttgagataaaaatttgtgcattacagaagggaaaataaactatatataagacatgaattttttcctagagaccatactggaatatgtcagaggtacataaaaaagtaatacattcagaataatctagcagcagagtagtgagtgcctgtaccagaaatacatcatacctcctcttaatggattaaaaattgctattcaatctatcatctgagcaagaagtcaactatattatagcaaagcttgaggggtattgacgttttaatgaccttccacttccaattggtttaaaaatgtttatactagaattctaattaaggtccaaacagtcacaatcaaattagatagttgtctcctggaaagggcaggacactcttggctggggagaagaacgctgaacaaggtccttgcccgctcactcttagccttcagcactgattagtttggtaatattgttacctcctttgcaactttgttagacactgaagtgtcaaatacatttcactggtcacccaacaggagtattcacttagaataatctccgatagcagcagggagccaaggaaatgccatgttggaaacactcaccacttacactcagtgctactcatgccatcgtgcgaaggccaccaccatatatagccttgcatggttttgcattttctcttatttttcctgttttctagtccatgcataatacttcctatcgaaatctcaaggcactttgcaaattgctgctgtgttttgatcttaattgctatgtgatgatagttaaataaaggcctgggaagaaagaggatgtttacctttctttgaaaagaaaattgataaaatgaggtttttactaggagtgatggaagaaccaggaagctgaactaatttctcaaaaatgctgtgattattttatggaagtgggcggtttggttactttctcaactaagaaggtgataagaattgtccactccatctccttcttttcctcaattttctccttatcattgcaaaaattgttttttgtgtacaaaggtctattttagacaaaggaataatcctaggcatgtgtctgtgcatgagaaatttgccatctaagaatgtataaagcaagcaacaatcagaaaatagtttctgaccaaataacaagaaaacagacctcttggcaatgttctagttttgtccaatggccctagaggcactgatgtggcctcgtgatgttgggaaggacagaaatggttccaccactccttagaaagcctcagtggtgggaatcctataccccaacatgccatgcactgagtcccttactagatgctttgcttacaagctcttattttcattctcacacctgtatgaattacatattatttgaagtcctattatttttactatacagatgagaaaactgtattcaggagtgtaagtaatgttccaaaaaccacatagctaataagtagtgcagtttagaggcaatctcagacctgtctgcctccaaagacctctcaagtgaatgtggttgttttccagagtttttgacgtttggtttatttttagctatttcgatgtggacccacaatcactcaatcttcaagcatccagggacttttaactgagctggagtgcttgggaaaatgtggtaaaaagtatcttcctgcctcaatcagttggaaaactagagtagccaatgccattaactctgctctcactcctgtctttcttctgacttcagcgccctttctgttttttgaaatttgagatttccttgtttgttgttatagtagacaatttgtttgttgtctctctagtatcaactcctgttttattttctcccaaaagccatgatgtcttagtctaattaattccaaggctggtctgagattgccttaagcctactagatatccagtctctctggtcacagggattggctcagagatgggcacatgatccagtcagaatcatagagatatgatgagatattggcttcagggaaagaacaattttcttatcttctggggcagccatcagaagaaactcacttgttttggaaggtgaggggtgaggtgtgaggggccaagcctctgcagccattcccagccagtggagggatccccagggctgccagaggagcacttaagcagactgaggatagacccaacacaggatggtgagtccagggccattggtgataccatttcagctgctgcagatgaagcttaatctgaagcagcatattttgcttccagacttgctaaatatgtgaaccaataaattatcattgttgcttaacactatgaattgggatttctgtcactcgtgcctaactgataaacctgtcttctagatttttctagaaagacagtcatcatgaatacacttttattattgcactttttgttagagttctccagagaaacagaacccataggacatatatagatatacagagagatgtgtcaggagggattggctctgtggttatagaagtctagatatcccacaatctgccctctgcaagctggaggtccagcaaagctgctgctgtcattcctgcccaagcctgagaatgggagaaggtggatgtcccaacttaatcagagagtgcaaatttccctttctttcaccttttttttctatttaggccctcagtggattggatgatgcctgtccacattggcaagggtggatattctcgtctcagtgtaccgatttgaatgcaaatctcttctggaaacaccctcacagacatactcagaaatgttttaccagctatctggggatcccttagcccaggtgaattgacacctaaaattaaccatcacacagttactcatttgaaaggaattcatcattgctatgagtaggaagcataattaactgggatagtaattctgtttaattgaaatttatggctgagagcagttaaaaaaccatttttatgtcaacagttgttattgaaaaatattttcttcctaaagatgatggagttggtataagcctgcaattatttaaaggcctcaggttctggttagttgaggttaattgtaaataataatctcaaatcttttattgtaagagcctcctgggatcacataattcaaaactccttcttttgttgagatattctcctctcaactggcagctgtatttgctgacactgatggtgaattgtttaaccttttgaaaccattttctataattcgagggtgatatttgcacatgtacttggctttctttataaataaacaatacaaagcttatttcagaaagttagtaaaagtggcaaagctaggagctgagggcagactgacatttttgcaaatttgaggaccacttaaaataatggtttattctgcaaacagacttcaaactgtttgcttataaacactataatataaaaaataatgagcctaacattgctttttaatatctcatttgctgccttgtaaggaatggtatctaaaagatcagttttactgacttttttggagctagacttgaggaactgaagtccattgggtaaaatagctttcattaagagcaacgagaaaaatatcatggaatgcacttaagtatagaaataattaagatttctagccaattaagatcattatgagctacttctaagattcagtaggtttcccaaagaagaaaaacgaggctttatgccttcatcaggaatccgggccaggtctaccagggaggctattattctagcctctttggggagtgggagaaagagtatatcatttacacttttatgaaggtactgactgtgaaacccaaagcaccctagctcaacatatcatctcaaacaacttgattcatttttcactggagagttttcttcagaaagtaattagaaatcatgcaggttttgccatagtaaaggaaaaagaatagatagctgagagtctataatataagcaacatctacaaagtcagtgccactttccagcagacggaggactggggaaattagctttggcagctggtcttggaagaatgaatttgccgaaggctcatctgctgccttagtacagatgggatcatctggccaacttgtgtgaggaagagggaaatgatattctttgagcatatgtttgtttgattactgtgaaacaggcaagactctccataagtattttttaacaaccggtaactacgtatctggtttcataaagaccatattgaaatgagaagaaaatgctatttagaatgtctgcaaacttagcaaggaaggatgcaaaggcaatgtagctactgcaggaaagattggacatatgagacctagctctgtacagagccctccagcattggctaattatttaacctaagtccaccatgattgaattggtaaaagcttgacaatatgatctggtttagccccttcatcagaagctgaggtaagagtctggtgggtggagaggtgagtatgtgtgagactgaagtagctgaggaccttgcacgttcatggactgatggaggctaaggtgtcaagttcatggagagctatgggggtgggccagagatgggggtttagaattaggtggaactctgttggttagaacctgatgagcacttgaaagactaggaatttcatatagaagtcactggaatgacatggacaaatttcactaagttttatgttagttttagatttatagaaaaattgtaaagagaatacaaggagttcctatataccatgcatctggtttctcctcttattaatatcttacactactgtggtgtatttgtatcataccaatgagcctgaattgatacattattgttacctcaagcccatagattatttagattgtctcagtttttactcaatgtcctttttctgttctagggtcccattcaggacaccacattacttttaggtatcatgtctccttagtctcctcttggttgtgacagtttctcagactttccttgtttttgataaccttgatggtttgaaggaggacttgggcaggtatttagtagaatgtccttctattgtgatttttctgatatttttctcttgatgagactgggtttatgggtttgtggaagaaagacaacagaggaaaagtgctgttttgatcacatgatatcaaaggtacatactatcaacacgattgatctctgttgatgttgaccttgatcacttggctgagacagtttgtcaggtttctccatggtaaagtgactcttttctccccctttcatattgtgctgtttagaacacagtcaccatgcacagacaacattgaaggagtggagagttattctcaaacttcttgaaggcagaatatttaaatacattatttggaattctacacgggagacttgtcttttctccctcatttatttgtatccaatcatttatttatattagtatggactcatggatattaattgtacactttgggtgataatcaaattctacttcatttattttgttgcaaccatcgagagttctttccattggttcctgtgtcctttagaaataaccccacatagtgaaagtctgtaattttatgttgcctcagtattcattttgaatatagctttaactttctcctattagaagcagggattagtcacccttgatccagtttccagttctctgcctcctctcagttccttaatgtggtcaatccagacatctgccttatacaactgctcttggtgaaccccttccctctggaacagctagatgcagccaacttcactcactccgctgaccctcacactccacagggactacacagatatgcctcagtgaccacctctcagtcacagcatgaccacacggaacttttgcctgtttgctttaaacccaccaattagaactctcctgggaaacctgcttgagcaatgccctggaccccaatcaaggcctcagtccttaggtccctctctttctctggctgctcacctgctggttgaatacattgtcctgtgatctttctgacggcctgccttggtatccctcttttttttttttctttcttttttttttttttttttgagacagagtcttgctctgttgcccaggctggagtgcagtggtgtgatctctgcacactgcaagctctgcttcctgggtccatgtcattctcctgcctcagcctcccaagtggctgggactacaggtgcccgccaccatacccggctaatttttttctgtatttttagtagagacggggtttcaccatgttagccaggatggtcttgatctcttgattttgtgatccacctgcctcggcctcccaaagtgctgggattacaggtgtgagccaccacgcccggccggtatccctcttttcttatagacctgtaggtaataaactgcttctgttattttctgtttttatgtatgtatgtgtgtgttgccttctctatgtttcacctgacagacctatctggacctaacttttatcctggccaaggctcttatagaaagtggttatcttcaaagaaataaattggacacaggtcagacaagagtataagggcatctgccaatataaacaaatttcctgtgagaaatttgttcaacacctggtcaggtacctggtcacaggttgcacagttaagtgctaggctgtcctccaggataagtattccatgaaaggcatgatgtaaacatccatgaccaaatcccttggagccctgtcagggcaaggctagagtatatagtcactctcctgaaaggaccgctgaaccaaattagagaaagattaaaaaaaaaaccccatcattgtatgcatgtgtgagtgtttcaacactctcttactttctgatgttataggctcatctcatatgttttctgccccagtcctaaaatctgccctttccccataaatctcaatataatcgcattggaaaatggtattagaaaccaggatctgggtgctaggtatgcttgttgttactgaggagtcattacttctaggccctgtcagctgacaaagcaaggaaatatatgtgtttatactaatccatatatatatatatatatatatatatatatatatatatatatatgcacacacacccatctacaagtatttttatatttaaccacctgtgtctgtattaagctaaacatgagctcatactgataactcacctctaattcattaccacctggataattctggcatcctcccatgcttatctgtaaacactcactccaacagcgagaaaccgtttccaccatgcatcattcatttacttaattgttcaattctattatacatctatagtagtagcagatttcttaacacatacttccattggaaacaactttatcaactagagtacagagctaatgactgtttattttgcctttaagtttataattcatttctaagtcatggataattttttaatgtgaaaatatctttctgctatgtggggaatagatttaagaagggtagagaaaactaatggggaagctaagtccagctgaaaagtaatggtggtttggtctaggataaataaaagcaaacatttaagttcttattagtaagttctatgtaaaagttagttatttttgtaccatgagcccttctaaccacttataatccttaactcactgaagcttacaaacacctgtgaactctactatcactgtccccatttcatagatgaggaaactgaggcacagagaggtccaggaagggttagaattagaattcagactctagcaatcaggttgtaggtcctgagcttttaaacagtttcaatatttcctctcagttaaatctcccaactcttgactgtatgaggggcaataattctctcattttttgcaaagtactagcatacactgttatgcactgtaggatattcctaagtaggtaagtaaacatccctgattgagaaaagattaacgcaccaaaccaaaaccaacacaccaaacccaactctgcttaaagtggtggaaagatcaactctgcttggtggtggaaagatcagtgctttactgaacaggctgccatgccgctgggccttccatcatttatggaccacagaggagaaagatctaattcagcagctatgagctgtgatggtgcctgctgccctgaggtagctataaactacctcagagcacaggttaagtgcatccaaaccaagaagaaaataatcatatgcattttaaatcttagttttttttttaaataaggaagtcattgataaacgatgaaatatagctgtctcattaaaacaatattcaaaggatatgaaaaatagtcttttgtaggaagcctgtggctatttatatttctgaatcagtttttccatttatcttaggaaatcaaaacaatgattctgcatactgaattttaccatcaggattcaaatttgttttcagatactggtgtggtacatttgtgggcatattttgccatcaccacaatcagacaaagactatctattcccagggtctcctggtaccctgaatcaccatctgaggcacaataaactccttatggtaacttattggcttcaagcagaagctggaatgccacatcccaccagattcagagcagggatgtgccaaatttaaccaaaagcaaatgagcaaggaactctcagcagctctgctttaggcaaagttataatctgattttggtcctgggaaacaaagctagtggcatatgtttttggtaaaatcatcttttgtggtagatattgggctccctactgtcatactagacccacaagcttgtgagctgggagggtaccacctcagagaaactgaagaaaagacctgcagacatgagctttattagggaacttacatagagggaatgcaggagcagcaggctggacaggaaaactgttccaatttgtaaaagcatgcaggttatacagtacccttcccacagcaacctccacttagcaacccccacctagcccaaaacaaatgggctcagttccttgtatggcctgtgttccaatgaacaggccaggctccaggttgtttctcataggtatggtataaacatctgagttggccattcttggggtctatagctgggaacactgagcaaacattcactaaggaacacaggttcattctcagggtatgcttgggttattgctgcccggcaagaccctgggttcagaggcatctcagtgtgaaagctccaaagcatcatctgccttttttgatgttttgtatcctcatggcctaggacagtcctgtttcaaggtggtcatgcaataaattgcagacatccagtaatttgaatgactggctggcagaatagaatagacaagcatttccatcctaatcacctctcccactgcacagcccacaggagagaaggagagaagctaatcattgtcatatagagcctcatgggaagttaaccaccataaaatcttaggtttccagagatgagaaaggcctcagtttcttctgtactgtttgatgaaacactacagcatatgaaagctcacttatcccaaattactcactgtatgctgaggccataggaatttgaatgactgtctccaagttacttgtcagttggaggaagtccaactttctcccaggcagagaacccaaggccacaataggctagagctagaattcaacaccctggtttctcaggttagaggccacagaatatgcctttcaatagggtagaaattatggcttgttccctgcccttcagtatttagaattaagtcctaacttggtgctctttcttcactgtgaaagtgaattcaatacacaccttttctgtttttacaatgctcagctggctaactggggaaaactacacatgcttcctcaatctaaaatcacttgtaaatgcacaattgccttttgcatggccgcaggacttcactgggaaacatggtgaacctaggttattttcttatgctctgtacttgaccctctttgcttctcaacataaggaaactaatttgcacttggtgagctaagatttgtgtcatttgctgtggataatcctttcctggatttttaataggttattttattttatttctttttttttcaacttctgggagcacagattaataagttatttttaagtgttctaattatttagagtagttgtgggaaggctgcactatttttgtaaaaaaaaagtgttttcttaaggcttggaagcagcagtttataaatggtaaaagcaacacaaagtaaaaaaaaaaaaaaaaaaaaaaaaaaaaaaaaaaaaaaaaaaaaaaagccaaaccactgcttttctgtctttaccttgtagacatctgcaatggcagttcacatggctcagatagctcacttctgcagagagctgaatttaagtgggacagggtagcaagaataattactttgacaatcattttgccacctgatgactgtgctgcctgtcctgagctgaggttaacaagagcaaaacagaagtttataaacatttgtacctcttatatacatgggagaaaatgcagagcaatgagtaaattgcctgagttgatctcaaagaaagagtgtaaacttctgggcttaaccacccactggacttttctgaaacaaagaaaggatgcagtgaaagacccagttaagagatgactgtggaaaaagcaccttaaacaaaggaggtctgttatacagatttatatcagtgccttatccattgtccaagctcactaatgatttggagtcattcttctgttcctagtgcagagagggagacacccttacaaatggagatttgctggatagaaatgtggccaaagagttcaataaaagggtaagatcatgaatattcagctatagaactccttctccgtgctgtcaaccattcctcctcagatcctctttcttttgggggtttattgagctgcttttcccaaaacagaagcactagggcttcctgaagactctgccttcccctctctatcaaccctcccattataaatatgtaagtgcccaatgggttcaccttgcccactgcctagacatagccgatttatcaagaaaggggaattgcgatagagaaagagtaattcacacagagccggctgtgcaggagactgaagttttattattactcaaatcagtgtctccgagcatttggggatcagagtttttaaggacaacttggtgggcagggggaagccagtgaggcaggagtgctgattggtcagataggagatgaaatcatgggaagttgaacctgttcttttgcactgagtcagttcctgggtggtggccacaagatcagatgggccagtttattgatctgagtggagccagctgatccatcaagtgcagggtctgcaaaatatctcaagcactgatcttaggagcaatttagggagggttggaatcttgtagcctccagctatatgactcctaaaccataatttctaatcttgtggcaaatttcttagtcctacaaaggtggtctagtccccaggcaagaagttttgttttggaaaagggctgttattgttttaggtttaaactataagttcctcccaaagttagtccagcctacacccaggaatgaacaaggatagcttggaggttagaagcaagatggagtcagttaggttagatctctttcattgtctcagtcataattttgcaaaggcagtttcaaatacgtcctcagtccagacctctcaatggggcatgggatcctgttcataatcttgcaccacctgtcttgtcttgccttatctgtgtgtatttattatggttttagttgcaagtaacagaaaatcccatcctaagaaggttaccagagcagccttgatgaaataactgggaaggttcttattcttactgtttttattcagttcctttatttataggcacagctgcttaaagactgttaccggaaaggaatcctgatccagacgccaagagagggttcttggactcatgcaagaaagacttcagaatacgagttttgaatttttgaattgctgttaaaactttcatcatgaacactgaagtgagtgaaaagagacttttgcagtcatttttttggtaagcctattacctgatctgctctgagtaattagcttccttgctcaccgagccatcttctatttctgcttctcacagtctcaagtcctctctcccgaggacatgtgcctcctgagctgcaaagcatggtatgggtgttgtccagggtgggggttttcaaaaatggggagacccccaaccagaaatattcagatttcggctttcagcaggatgacaggaaggactgggatgcactttgtagatacttgttaaacttcaacgaagaatttgaagatttgtataaatcatgggttttaggtcaatagcatctagttagcactgaggtaggtacctggcaaaggccttattcctccatgtctgattcacactgttggacatattctcttttcttttctttcattttgagatagggccttactccattgcccgggctggagtgctgtggcagacacagctcactgtagcctcaacctcctgggctcaagtgatcctcccatctcagccttctgagtagctgggaccacgggcatgcactaccatgcctggctaatttttgtatttttttttttagagatggggtcttactgtgttgcccaggttggtctcaaactccaggactcaagcaatcctcctgcctcagtctcccaaactgcttggactacaggtgtgagccaccacaaccagcctcattggatatattcttttgtagctaatttttgtgtttttagtagaggtgggattttgtcatcttggccagactggtctggaactcctgacctcaggtgatctgcccacttcagcctctcaaagtgcagcggttacaggcgtgagtcaccgctcccggccaatttaatttcaagaagacaaaatacaaaatggaaaaataaatttgaaacaagcacttacataatgaaataattatttatttggggagttataatggaaactattttgatatgcgcccgggttttgttgcatggttcacacacaaaaattctttatattttttcagtctttgatgatttctaataaaatgagaagagtttgttattgaacatcactttgcttttcttctttaattggctgcagaaatgccagttcccaaggagaaagcatttgccagtttctcttcagtgttttaattttccagttataagccatagctgccagatatttttctcctgtgaatatcaataatgtatgtttaactagatttacattttgtttcttttttattattgacatttttcataattagatgattgtggatttaacaataggaaaaaaaaggcaaactgtctttagtgttaacgtcaatccctgcctcagaacaggagtgcttcagagtaggggcattattccactcagcacatgagcatccgctcagcatcatatatgcaccaaagaagatgcactgcatgaggcaatccccttagcgcatatcctttcagatagatgagacaaatacacataactgcaaatgagaaagatacaaagtgttaaggaaacgtggcagaaagctttctgcaggtccacagttggattacattttccatggggggctatttcccagaatgtgtgccacttccatgactgctatacaaaccctccatgaatgtcctttgctgtccttttctgccagctggctgcagatgacagtgacaccctgggagttgagaaatgcttgtaagatggaaggaggctgtgtccctgaatgatcacctggaagagagccaccttagccaatgaaactcctgctatgaatgtttgctgagcaagaaatatacttactgctttatatgcctttgaagctataggttcatattgttaccacaatttaaagtgctataataaaaagagttcaggaagcaggcacatggaagcaataagagcaacaaacatttacacaggtattgtttaagtgcttttgtttaacaatcactatagctattagtagcctcattgtaataatgagtaaagcttagagattaaaaagtatttcttataacacagttatttgagaagactgcccagctgaaaacttggcctatctaattataaagaagagccagtgcatgttcctaaaatactagggtgatatgattagaataagctggcttatcaccacagatccacttaagggcaagttacaaataagtcgatgtttacaaaatcttgagagtccactgaggcatattaccatatgtttgccaggaaactctttttaattgtataggtaatattcacattatagaaacattttttaataaatagaaaaaatctttttcatcaacccacaatcttaatataatccttgtttgtattttgatgtacttctttctatactatttttctttttcttttctttttttttttttttttttttttgaggttgagtctcactctattgtccaggttggaatgcagtggcctgatctcggctcactgcaacctccatctcccgcgttcggtggattctcatgcctcagcctctggagtagctgggattacaggtgcctgccaccacacccagctaatttttgtatttttagtagagatggggtttcaccatgttggccatgctggtctcgaacacctgacctcaaatgatctgcctgcctcggcctcccaaagtgctgggattacaggcatgagccaccgtgcctggcccatactattttctatacatgtttttaactaggctataatcttattgtatgtacaattctgaattttgctcttttcacctgagtatatcacaatcattttccatgttattaaaaagttttcaaatgttttcagtataaaaaatcatatgtgccaattaaataaaattggatgaggaaaaaagtagggaaattttctctcttgcatccatcactcaagaagcaacgagaatgttctgctatttcactcaatattttgtcataacaatcttctaatgctttacataattttaaaaagctaacttttattagtaattgtaaaccaaatacaaattctatgcacgtagctgaagaacacagaaaagcacaaaggcaaaataaaatataatcttactactttaagataaacatttacagtattctattaacatatatgtatatgtgcatacattttaaaagatagtgtatcatatatattgttttgtagcattttttaaaaaaaattcagtattctatctgtaatggttaatttcatgtgtaacttggctaggctatagtgcccagttgtttggtcaaacactaaatgttgctgtgaaggtatcttttagaagtaatacttagaatcagttgacattaggtaaaagaggttacctttgatgatgtgggtgtaccttgtccgattagttgaaagcctaaagaacaaatgctgaggtttcctgcctgagtttccagcctaccatctggtattacaaattttaaacttaagattgcaacatcaatctttgcctgagtttctagcctcctggcctgttctacaaattttgaacttgccaactcttacaatcccatgagccaattccttaaaataaatctctctgtatttatatatgctttggagagccacagaatgatgttacaatatcgttaacattttctacctcagtattcttttacaagattttaatggcttcctaatgattaattaaatggtaatcatattaataagatcatagtattcaattgaatgatgttccatagtttacatatccattcctctactgttaacacctctaacaatttttttattgtggtagaatacatattaacaaaaaatttgccattaagtgtacaattcagaggcattatttacattcattatatggtgtagcataatcataatctatttccagaacttttgcatcaccctaaacagaaactgtaaccaccagatcatataccatagttgttttaagttgttaagttttgtaatattcattattccaaatagccatagataactgataccaaagttagtaccatgagtagggtgctactgaagaaaatgtaaagcaagtgtcattgtttttaggactggacagtgagtgatgctagaaaagtgatgaggtggcaattaggactgttggtgtg

SEQ ID NO: 2937 - DNA, 860 bp, Homo sapiens
tttttatcctgaggtgagaagttgctgcctgtgatccaacactcctgccagccaggacatggcagaaaatggctaggacaggcagccacagaccccagcagccacaggacagccggactgaggaggaccagagggcaccaggcacagaccccacacacgtacagtcatctcaagttctttcaatgagggaaacatcaccaacacactcacaagtattgggcctggtgaacaacccgaggccctgaagatcaggctctccccagccctcctggagccaaaccacccacggcagccaagtgacagcacccgcagagctgcccgagcctctgggaggtcacggggaggaagggaagacggaaacaccgtgacggccacttctgcctaaatcgttaggaactatttcagagtccctgcaacctgaaacggggattctccacacacctccacacggccagcagcgcagtaatcgcttttaattaaataaatcggaaacacaaatcaggccaatgtgttgaatcaaggtggcgtgcactgcgtatttatagctctatccacagaggactcctgacacatgctacgggctcccgcagccgctttattaaatggaataaataacaccgtgcaagacggcaaaacttcaccagacgggtctggggttctcccaactcaacactgttttcctgcaacgtctctgctagaatgaaaacatggtccagatgagaacagactggtgtctggtttagctaacgggtgggtggaagggaaccactctcagagcgatgctgcatcctcccgctggcgactaccccgagcccacctggcggtcaggtagcagatcctcacctgccccgagaggcgcc

SEQ ID NO: 2938 - DNA, 7539 bp, Homo sapiens
ggatggcagcagcagacacacagggtggttaagaacaacaaacacaggcaaaccacttcaatagaacatggctggcggccatatggacatatttgaatccaacaattaattcagcaaagaaagctgcttgtggcaagttttgaatgtgccattccaggtagtgctttgatgataaatgaggagaagattgcaaagaaaatgacagcaacatttataaaaggattcctcttaggactctagatgcacggagagtggccagattaatacagactggcaaaagaagaacttggcaaagtgatttgatcacacacttctcaccctcacatctcctgacagttcccctaatccctgccccacttccccgccatgggcttccatcaggaaactccttgatatcatcttcgagaagaaaactgaggcatagaacatttgggaatgaatctaagactacacatctagaatagcagagttacaggaatgcagatgtgattcctatggatgagggtaacctagaggctagaagaacaataggacagaagaagcctgggtccctgaacaaccttgtggagcatagacacctacgtggcctggactgccagctcacaatgggcctctctgtgagagaaggaaacttccctcttgtttaagcaactgtgcttttgagaatctcttggtctataccctaatgaataaggccatcataaatggatatcaaagtaaggaaatttgtgtaaatgatttaataaaacattacctcaggtatgaaataattctaccttgtgccttgacaacatcaggtattattcatgcccttttctctccctgtaatgtctcttatccacgggtagaaattatattttccatctaaggtttgctcaaatattatctacttaagtagctcttaccaattttgcctctcctcctgagctgaccctatgccttctatgctgttccaggtaatattaatctcttcctttgtacttctttcacagaacatacttttttgtctaacataataactataggcataagtgtatagattccactaggggcttcagaacagaaactatcatcttattaatttttttctccctgatatctagggaaatatgttatatataataggcccttagtaatcccataaatgtttgtgagatattcactgactataagccatactctgtatttatttagctaaaacagacgtctttcatatttagttagcagaaaatgctcacatttactcctttcctgtttaccaaatgaaagggtaattgttttttcacagattgcactagaaaagtgtcttctctctctttttcaaatagattgtctttaaaacatatgacaggaaaagtgactattgttaggataagataattacgattgtaacagctagtttaaaagaagtgtcagttgctcctgttttatttttcacaggatagagctgcggcctgtctcagtatgatgttttcaggatctggtatatatttttattttcctacatgaatctttcatccttttactgacatttattcattttatctaattatcctaaaaggaaagctctggccaggcaaattggttgttgtctgcctctgaagagacattcatatcgcgtcgcttagctttcaagttttgtgatcaggaaccctcaggcccatttttaaggaggtttcaggctagctgagcttcactgtctcccaaaatgtacaaaatgagattacatgagggacaagatcaatttactggaaggtacttaagcagtaaatctggagctttttgtccagtcactattgctttcaagctttgtagcagaaaattaagccacaagagctttgacaaattagatattactacctctaattgtgtatgtttaagcttatcacactgaattgcagcattgtaactgactattatgccaacaaggccttcgtttaatcagcgcagtgccatttaatcgcaattaatcactcaactaaaatgtcatattaaggtcacagaaacttgaagggctaaaagaaaagagaacattaaagtcagctgatggaggaaaagagcatggtgtgccaagggaagttctgagcactctttttcattagaagctggtagaacatttaatgagaattcagtcttaactttcagctgagatcagaacaacgtgcctcacttggttaagcaggagactattctgcccattcttagcgggcttctgtctgtaaataggatactcctgcccacagaatacctgaaattttacagattcatgatttttatttctattattctttggctttctggcattttcccctttcctattacttttaagaaggaaagaaatcagatatgatatggtactgaagacaagatgaaataaatagcatcattttgcacagtcacttacaaggtatttataaaaaggaacaattggattcacttgtttgccaggaagattttatttcccagaaaacttgtcaaatcgaatgttatagtgcaaaaagaaaatgactgaagcttttgttttttaaattttaatactcaagaagtactatgccagtctgaaagatctctgttagcccctcacaggacaaaacttgtgagaagtaatttcacccggaggaccgggactctgccacccatggctcattccttatgctttaaccctgcctagccctaagaaatattgttccactaactgattgactctgaaaacagagccatggtaaagggtatatagacaaagggcacacttaaggtctctctttgttaaggagtagtaggtaattttattttattttgttttattttattttattttatttatttatttatttattatactttaagttctagggtacatgtgcataacgtgcagttctgttacatatgtatacatgtgccatgttggtgtgctgcatccattgactttttcagcaacgtggatggaactggaggccattatgttaagtgaaataagccaagcccagagggacaaatattgcatgttcccactcatatgtgggagcaaaaacagtggatcttagaagacaaaaactagaatggtagttaccagaggccaggaagtgtagggggaaagaagacgaaggagaaaaaagaatataaatgtatttattaccatgaactgtacacttaaaatggtaaagatggtaaattgtatacatgcatctcctcagtaataaatagttttttaaaaaactgactctaatgaccactcttcaaacttgcaataaatagcacagacactggaaacaatgaccacctccaacaggaaaaatgaatttcagttttcatacccactgagcctatgaagcttggtgagcaagatgtctgtgtttgagcaaggctcgctcaaaccgtctcctgcagacctgtgtggaacggtgcagtccactagccacacgaggctactgagcacttgaaatgtgactagtataaattgacatgcactgcaaagatgaaatacacactaaatttcaaagactgactttaaaaaaagaatgtaaactcattaataattttttgttgattacatggtgaaataccaattttggagtatactgagttaaatgaaatatgttattaaaattaatttcatctgtttcttttcactcttttcaatgtggctactaggacgtttaaaattatgtgtatagctcatatcatatttctattggacagtgtttgtatagaccaatgagaagagtcacttacatcggtatcaccactgacctggaccagatgtgatccagtaacccagaggagaaacatttctgacctattctaatcctctaagccaaacaggctcttaatcaaagagctagtgtttttacaatatcaaatggaaaataaatataataacctcaatagtacacttgaaaaaatgaaggattaattttagaaagacaggaactggcattattcagattgaaggaaaaaacaacaaggcgaaatttaataaatatctcctggggacatatgagacaggttaagattgcagcatgaaggctggaggttaacttaaatgatttcttaagagtcagggttgtttaacacttgatacaggttgtgactcttcttttcctggagggcaatgataataaggcaaggcctcctctgaagtcctagataagcataagattggagaagccaatttaagatagctatgccatatcagcacttattcagatactttgagtgcctctgaaagttggtgatgagacgggactagattaccagccctttcaaacacactgagcctcagtcagagccatctttaatttctctccttaggtgttaataaaattcatcttaaaatttattactttatgatatctcaacattctcttacaaaatttgcacttaaaagcttatcaaaatcttatacctggaaattgaatggaagcaccttacaagctgaaacagtgtctttatttataacagtaaaaattacctttttattataacacacccttgtacgcatgtaactatatcatacatgttatataactaaatgtgtatgtgcactataggatatagtagccattcaaaaacatttgatgagtgaatatatgttcactcacaattgaaaaaaaaaccaaatgtccgcatttccacagctgaggtagagaaggcagctgaagtgtggcagaaagcccagcctctccagttctggtccagtgcatttatattgcaaaacgttgataagcaaatgctgcacatgggtataataaagtttggaaattttaccaatgagatgtagtgttagaacaattttatgccttggtaaattatcaataacttctctaaaaatatcgatgttttaaaatctcttgcaaggtaacttcctcagagagcatggctttatattagtaagtaaaggaatagtcactacataggtcagtatgagaaaaccaaatggaaccacaaatctctttctaaaaattctacctaaataaaagttcctgatcaagttaaaagcctagtttatagcacatgatgctttgtctgatctacatccaaggtaacttcttgagtggaagactttgggcttttttagacaaaggtttctggcctccatttttataaagcctagttaatttatatgctgaggtcttcggtggatcacaggtgtattttctctatatttataaccacacatcaatttttaaatggaaacatctgagctttcagtggctatgagccagtcttgagtgaggaagccatactcacacaaaacttggtataataaccaggtgtagccaaaataaggcacatccatatgcatgttgagtttctgccacataaggaatttataatagagtttatcacttatcagaatgtatttgggcttacactgactccattaccaaggaaaagcaattttaacgaggctttcctgtaaggaatctattgtttcttcttcctaaactatcaacttcacctgaaaatacttctaaaaatgagaaaaatagttaattttcagccattgagtctacctttggctggatgtattcctttaatttcagtgccaacgcataactatttggccttttataaaggttgcgtatttttcttctgagtagagttgccctcactatgtcagaaaacatgcatatgtactcttccaaatgaggggagggccttatagcctcactgatgatgagcccagagtgagtcactcaggatcttgatattgttttttgaaaacaacaacaacaaaaatactggtgtctgtatagaaaatgcctaattctttccaggtatcaataaattactttgctagtcagagtatcaatgttggatggtgttgtgaggtttacatccatgtctagaaaaccacatttatgctgcaagcaagctattataaaaagacgaaaaataatatatttttaaaggactttccaacaagttattggaactgttcctttaaatattaggaaagcactccaactagtatacctagtatactacctggtaaaaattaaaataactactacacgctttttttggaagatctgagtgatatttccaagtgtcctaaaaaacaattcttcttccccatctcaatccctaacctcttttgaaggaacagccattgtttgagccaggcaatttaattcttaggacttttatcaacatgacaggtctcagcctaaaccagggaacttttttttttccttttatttgttttcttttcaagatatagatgatatgcccctatccaatgtacagtttagtgagatggatgacacttcactcactggcagttcaaggaagtcttagcctagcttgtttacatgaacacgttttagaacagccatatagcttccagccagctctaccctgctgcccagcactaagggggaaagcaggcagtgagcccataggtcgctgataaactaactccccatttggcaagcagggaagggaatgataagggctctgatttatgttttatctgtcgctaagttttcagccagcctgaaatgacttggttctgttatcacctcagatgccacaggtttcttaagtgaggcagattctttggcgacttttaaaaagaactttatttcacctcttgcagaaggttagcttagcgatggatgctgctttaaaacactcccatctggcttcataaactgtgaggctataaaccagcttgtgggctctattccatggttagttcttgacatcacctgcatgtaactatgctacccttttggaaacacaaagctgggtgtgatgcatataatgacagggatgcttgaatcttttaaaaaaattacatacctaaaaatgtgttaatatgaaaattgcatacatcatcctacccaaacttatctaaaaagaaaactttctacaaattaattttctgtcaacatacgttgacttcagatagtaaaaagaaatgaagaagaaaaatctgtcttgagggagaaaaagagtgtcagtggatacaattagaaagcaaaaaaaaaaaaaaagcccctgttttctgtgatggatgctgcagggcagctctgggggtcagtgggagattagctgacataaaagcaagggagtgtatccttatctagtaaactaacacaagtcagtaaatgaaagccctcggtccccaacctatttcaagttgtttccccctaagtttaaattggcttgtcgttttacaaggatggatgggtattatttttaagcctttattttacaatggaagaatgtgagtgtttcacaagtgaaatgttcccatggagaagggaatagcaatgaatcataaacagtgtaaacactcccaagcttcttatatatgtaaggttatgtgctaatatcttctctcccagtagtgttttctttccaaacaccgtaagaagagaagtaggggccagggagaggcctttggagctatcttttgaaaacaatgggagtctatctcctctattctcaactgtgtaatctttttgttatctgacgtgaactcatagaaactgactatgtatttcccctcagtaatatccttctgtg

SEQ ID NO: 2939 - DNA, 981 bp, Homo sapiens
ctagagagctggcgcacctcctgggcctgacgcgggcttcctggattgcataaaggctccttctccttacatagccagggcaaaggtgcatgacaactctgagcaagtcaaaacaaccgtcagcagcgggaaacctcgatgaacaaacaccgggagagtgtttctgcagatcctgctttgtgacttcgagtgaagtgtggaagcgctggaagcacttagaccctgcctgtgccgcagacccctgggaggcaccaacaccccggatcgagaagcccgatgggaaagaatgtctgggaaggacgtcatgcccgaggcttgcgtgacagtttccactcacagtgcgctcactctgaacctctgtgcacacgatgggcctgcatctcttcccactatctgctaggaaacacgagggaggaggccatgagaaccgtcaagaagttcatggactcaggaggacgtcgtgagcagtgctgaggtcatggaatgtgggctgggaccttgtgtttggtgacatcctgtaagtactcggctcgctcaagctaactgcccggctgggatcaccgctctaggaggactcaagagttcagatgagtggcccaggggcccgtcagtgctgtgcacctctccccccatgggtgggggaggagcctggggacttggccagtcctggaggagccctgagaccaggccctgtggtgggcaccacggcacggggaggtgcctggagggctggagcccacttggggggccatggtcagtcagggctgcagaagcagagaaatgcgggatgcccatgctggctgggactcgcccactgccctgcacatggcgagtgagggagagaggcaaggcacctttccaggggtgcatgggaggctgcggtcaaaggtcctgcacacccgcatgcgtgctcacatctgtagctgcagacactgacccccagagacccccgagctcatgtggggctggtgtaggcgtggg

SEQ ID NO: 2940 - DNA, 8772 bp, Homo sapiens
gcaaagtaagttttactatgtgtgaatgcatgatgtagaaagggaaaaggaattttgagtaaaatcataatgtggagaaccttgctaagaagaatttaactgtattttcttcatttcctctaatcattttcaagaaaaggaaaagataaatattgtatctagtatcttcccttgttatttaggattctggcttccttttagattttaaaaaaaacctcataggcaaaataataaaaaataaaaatattgtatttattatatcattcaggattgcttccaagtacacacatgcacacacatacacaaggttgctgccaagtacacacaccacatgcacacacattacaaggtaaaatataaaaagcggtgaagaagtcagagtaaaagaaaaattagagtagaaaaaatatgacatgaccaaaagtgaaattaactgatgaaatgcactctgtaaagttttgtaaactggctagagggaggccatgggtttcatactaggcttgcattataatgaagtcagctagatttttaactattcggagtgattcttgcctcttgcatgcttgctatccctagagtttgagtttatactggaagcactaaaacaaatatcagtatctttccaatacaggacacaatctacagaatttctgttcatttggttgaaatcttcatggtgcttagttaaaactattctgcatccattagaaaagtgaggctgaaatgcatattcagatgatgatcatagtcagaatgggagacacaggggaccagctgagcatggctggctagagacaataccccatctgccgctctgctccagccagtctcaggagccctaggggagcctgggctggtgtggccagcgtttattcatcaatctctttatttctggggattactcaattgagcttctcagatctgcttcttttactggggaatgggtgtaataaaagtatatatgtaagtagatacatgagatgatgacaaacatcccaaacagaagaacaaactggtagctctgcataaaaaagagatgctagataaaaacagttttcaaggatgctcccttatttgacaaaattaccattgagactgctatgaagagcatgcgttcgtagacagcttttaagttttaaaatgctttcatttatggggattaccaaatttttccagttaagaatcacaaacagcagacaagaatgaatgattaatgctggagttcctggagtatgggccaaagaagttcccccaaaccttacaaacagaaacacatgcctctgccagtccccacatgggatcccagatgagaaacctctcaaggagaataacaaaatgcagttggaatcaaagtgtatgaagcctcccagacacacccagcaggagtcaccaggaagcagctgggaagaggctgacagcccaccagcaatgagaccacaggagctgctgctcccgggagggagtctgctgtcatcctccacttgctagagttctccctcctctctgcttgttacacactgcttccctgctctagagcttgctccagagatgacttcaacagaacagagtggctcttccttacttgaaacacagatccattgtacctgtggctttggctctggattgtctttctacttagaggagaacaagggtgtgactgagccacatgatggaaagtaaaggtacaaccaaaaattgtggcgtttcctcttgtttatgacattaaatttccctcagcctctaccctcatgctgcctgcttctctaaggctgctcccagggaacaagttaataatctcaaatacagtaatttttgcccctttcagaggtaagagtttaacaggggacaaaggacgaattttccatcatggcatttcaaacatcagtaaaatgttgattatttttcagcactcttgatattatatctgagtagctcttgtagaaattaatgcaagctgtgttttcactgcaatgtgcccttactgtattcacatgcagcgagaggttatgctgatggaacttggccatgatttgtgatattgtttatttacatgtattaatataaaataaaatgcaacgtgctaagtaacatttaagccctcattaacctgttcctgaactatttttccaactccattgatccctactccttgtgattcagccagtacctcaactgtttgtttctatgcttgttcaaggtttgtaatccttagtcctttgctcaaaatgagagtcagcctggcataagggaaaaagcactcaactcagacgagcctgagtgggaaacatgacttaaataagttagcaacttatgcaatatcatttatataactttgagcctttagcataatcatctgtaaaatgaagcttcccactgtgggatgttcttgaaaagggtgttataggatatggaagcactatgcacagatgaggctctcagtaaagttgttccatcatctctgagtacgcaaattttattcatcctttaagttgcagcccagatagcaccttttgcataaagtgtctactgattgcctccactgggatgcaatctttccctcttctcaactcctatctctctttgcctttatcaatcatatagtaagtgcgtctttttattttgtatcacagggtctcaaactgagactctgaatgtggcttgtgcagagtgcttcctgggattctgtgtgtatgggttactctgcatggagcctcctgttgccaaccaaaaaaggactaagcttggctcctttccaattctctgtacataattttgtattcatattatgttctttttcttgaagaaggccctgattttataggtgtcagtccccccaaatcctgattagcacctggggaggagggagatgagggtatggaactactggcatggtgtctgtccatatccgcagagctgaaggagttgtatggatgaaagacataatggtattggaaacaagtgtgctctttggggtctggataacaaagtatggcaaaagttgaggagttgagggaatatctgcaatccaaaagttgaggattagcaatgacagaaccacaatatccacaataccctggacatgcaattggcattctcttcatggatgctaacatcagtagcaacttctcatcaagtcaaatgcctcctcttcagagagtcttgctcactttttgtaacccctttcaccaacctctgtgtcatctaccctatttgtcacttttttttaagaggcaggatcttgctcttgctctatcacccaggctggagtgcagtggtgcaattataactcactgtagcctcaacttctgggcttaagtagtactctcacctccaccttctgagtagctaagactacaggcatgtatcactatgcctgctcccttatttgtcactatctgaaatcatctgatttgcctttccttaacccttcccccaaccacatatacacaaagtgccaagagtcaggggcttttcccaaagtgtttattacttacctctagaagaaaggggtgcctgtcttacaggaagtactcatgaagtatctgaggggtgagtaaatgtgaagactgttcaaggggctttataagaagaagacgaaaataaaggaagccaatatagaagaagaaaggcaggatcaatacctcatagtaacatgagctgacaacctggtttgtgaacatatggaaagcactccttaggatctcccagaaatgtttgatggggatgcttcctgtgtgcagttcctattagagcaggtgggatatttcagtcctcattggctagggagacctgggggcaattaggttatatgcatacttgagtttttttcatggatcttatcttctctattaaactcttaggagaaggtaggacaatcctcaaattgcccaaaggacctaatatatggtcttgcaaaagtgtctgttgataatataagtgtccatcaacagttgactggataaataaattgtgatgtgtatatatatatatatatatgtgtgtgtgtgtgtatatatatatatatgtatacacaccatggaatactatgcatccataaaaagcatgaaatcatgtcctttatagcaacatggatggagctggaggacattatcctaagtgaactaattcagaaacagtaaaccaaataccatatgttctcacttacaagtgggagctaagcaatgggtatacatggacataaaaataagataaatgacactggggactccagaagaagaaagggcaggaagggctaagggttgaaaaattacctattgagtacagtgttcgctaatgagtacactagaaacccaatccccaccagtatgcaatatacccatgtaataaagatgcacgtgtaccctctgaatctaaaacaaaataatttttaaaagtatgttgaaataaagaatgaatgaatcagagtagaagagaatatcttgttccatataaacagtctgtgttagaaaaagcaatataataaaccagaagtgttcagttgtgaaaagggttgaaatttttcaacataaatacgttacataaaagatttctattagaaactccttagaaggcatctattagaaggtagtgtcccttggctgtaaagtctaaaactctcctttgccacaaaatgacattgtacacaaatgtaaataagtataactggttacttagcaaccacaaatatttacaaatatggaagtcaggctccatcaaaatgtcagggtaattattggcaaattgtatatcatgcaaatgttttgcagccatgcaaaatgaacattcttgtagggtgctgccacaattgctcttcactgctgcctagaagtgtcacttagtctcttgggttttgttatgttgaattaatgggacataaaattattttacagaacaagtggatatgtaatttaccatatgcttttccacaggggtcttccacttagttgtcatggggtttaacctagttaaaatgctgcagaattcagcattatttactagatcatcttcctcaaaaaagtcaatatttttttttctaaaaaagacagggagactagaaattttgtggtttaaattttttttcaaaatttattcttttatgaattatatttgtagaaggaatcttttattacttacatttaacagtcttcagaactagtttcaaagattctcttaaggtatgcatgtgcttttttaaaaaaagaaagagagatggagagcaggaaagaacaaggaaggacagggaggggtagagaaagactgaagggaagaaggaaggaaggatggtgggagggagggaaagaaggaaggaagggagggagggaaagaaaatgaaagaaaaagaaaatgaaggaaggaagagaaaatgaaagaaaaagaaagaaagaaaaagggaaggaagtaaggaaagaaggaaagaaggaaggaaggaaagaaggaaagaaggaaagaaaagaaagaaagaaggaaagaaaagagagaaggttgagcagatgggcatgatgtgtaagagctgatggaaaaattaatactaaattaatactaaactacatgtcctttattttgtaaatctgaatgatgccaaaatggataagcagaataactgcatgatgtgccaattaatacttgaactacagacagagggattaactgagtttcttacccaactgattggggtgtcggcggtgggggggggacctcaaataacattataattacacttaaacacaattttacactccctatatgttataaaaattaatttcatctcaagaagatctcaaaaataagatgtattctaattctcctgtggtcttacatctcctctacgatagagcttacagttggagccaatttatttagcctttctcagtatttcaaattcgtgtagagaagaagctttttctgccaagattcacaccaaagcaacttgatagtcttgtccaagaaggatcaaatgtgaaactagacaacaatgaaaattgtgcaatgtgcccgtctctctgcagccagtcaagtgcaaagaaatctgggtcattgttcttgggaggcttttcaaatggtcagagaaaacagttgagcacagggcttctggcctgcagtgttgcctcactatttgttttctcctctaaaactctagggggagaatgaaaaggcaaacacagccatcccacccctccttttcaaatggggttgtcatgccagatattctgagtaacttattcagcccaaggctaataagctgaacaacttgttttggctagacattcctcatctccatatggaactgcttgtgtgagtttggggactattatgtggtcaaagggaggatgttaaaccaagaaaacaaaaaatcccagcactttccttttctctcttataaatccactttcaaggctgaagtaaagtgcacggattgcccaaatccttaggcggaagacatcacagactatcacataagcaccatctttaataggtttgaagacatgcctcttacattgggctaaatttaccgataaatccaccatatctaaccttgcctactttgaacctagccttggggacttctttagaaagaaggcatattttcactgaaccaaagtaaatcttaattacatatttgcttaccatggagagcctttttgcttctgaatgggaatctgtaaccgataaaaggtagaaagtgggttgatttggtatgtttttacagaaatctatcagaagttgtatttgaaaaggggaaaaaaagatattctcaaagttttagataattgtgaagttagtagagttggttatttagtgttctttatgtagcatttcaggggaatgacttagaatattctctgatgctttcttaaaacaccaggtagggtcctacctcagcagactgattcagtagttcttagatgagtctcagtttcctcgtgacttttaaaggttcatagattattttaaaaattactcccaagtccaaagagttgagggtaattattccttaaaatttatttatagttttccattaaggaattattccagggaagtcaactggttttccaggctctgcagtgaggtggtaggcttcagtgagaggtgctgttaattcattcacttcttcatttatttagtcgttcattcagaaaacatgcactgaacagtttttatctgctaatcaatgagttatagtgctgaggatataaataggcatgactactataatcatagcaccataaagtctattcccactgtgtggctgctatgacaagtcagactgagtaactgcccatgatgccaacttcctagagagatttgacagtcaaaggccagtgctatacatttcatcttccatctcaaaggttaggaaaagtacacatgactgcataattatggggtaagtgcccaaatatttctgttttgtgctttgcttttcaaattatgtttatgtgaaatataacctacatacagaaaagacacaataatatttgtgctaaataattttcaagcaaacacccattaactccacttaggttgatatagaatgttacaagctccataaaaaaacccttcaccaaagtgtccctttaaatcaaaacccctttcttcctcagaagtagccactcttctgacttctgaactttatttgaatacagttatactgtatggtttctttggcatcttgacactcgcacttaacattgtatttttaagattaatccatgctgtcgcatgtagttctagtttgcttattttcattgctatataatattccattgtatgaacttgctgcaatttatctagccattctcttgatgggcatttggggtgcttctagcttttggctactacaaatgttgctgcttacagtggaattgttggactatagggcatgtttacagtcaactttcacacatactgccaaacgatatttcatactggataaatcaaatttacactctgatgagcagcttgagaattcctattgcttcacatgcttgccaacattaatgttgttgaagtttagaactcttaaccaatctgaagactgcaagttgttctcctatagcacctttctgaggttgtttagctttgtcattcatatgtaactatttattccattgggaatgtatttttgactatgatgcaagagcgagcctaattctgtttttgtttgtttgtttgtgtgtgtgtgtgttttttctttgagacggagtcttgctctctctcccagtctggagtgcagtggcgccatctcagcttactgcaagctccgcctcccgggttctcgccattctgcctcagcctcccgagtaactgggagtacaggcgcccgccaccatgcccggctcattttttgtattttttagtagagacagggcttcaccgtgttagccaggatggtcttgatctcctgacctcatgatccacccgcctgggcctcccaaagtgctaggattacaggcgtgagccactgtgcccagccctgttttttatacagatgctcaatttccggtttttccattgattgaaaggcctttatttctccactgatatactgtgtcacatctgtcatacagcaagtgtcaatactcccacatacacatttcttcatttcgcctctctttttctatctctatgtcaattcacgctgtcttggttagaatagctttaagtctggtatctagaatttcagagctgctaccttgttttccttcttcaacaacatcttagctactcttattactttatatttccatacatatttcagaattagctgtcaag

SEQ ID NO: 2941 - DNA, 3518 bp, Homo sapiens
tatgcccagcctgaagtttttattttaaagcaaacttctcatggaagtctaacacacaggagattgcacaagttgtaactgtatgcttggagaatgttcacaaaatccatacctttgtgtatccagaaccccgaccaagaacagatgccgggcccccagtcgctgccccatcaaggttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgttgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaaggcttgggggccttgaaggcagggaagccctggccctctgcccaggtgacgggagccacctcctctgccgcaggactgacagctccttcagtttcatggcattcttctttaccttcatggctcagttggtcatcagcatcatccaggccgtgggcatcccaggctggggcgtctgcggctggattgctaccatctccttcttcggaacgaacattggctcggcggtggtgatgctaattcccactgtcatgttcacagtgatggccgtcttttccttcatcgccctcagcatggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccacccccaccctccacctgcccctcttgcctctggcccctctgaccctggcccagggacccctcacggggccaggggaggcatagcagaaagactggccccttcctagggttatgagctggaactgtttctactttcagtcttcctgggaagtaacagtacttagcactcttggtggtgggtgggagggtgggtacaggccagggatattcccttgctcttttgatccctccaggcctcgcctccttcagcctcctcctccctcatctgttccctgatgtcacattccctgtgcaatcttcccttgcccatggtctgtctatctctttcctatgtggcttttctttgtcttccccaaggctgagtgtcccagttttatctgctcctgagactgagcccagatccccaaatctaatctgatttacagttcaaggaagctgatggggagctgggccttacccctgatgtaggaggggcacacagctgggggtgcagagcccacctgggtacctgacccccaggggatgaaaatgcaaggatgagtctgcttgggcctgagagtttgatctgcaggggcaggctcatcttttctctcccctgccttctcctccttctctccccagagcccccttgagcccctctgcctatgtccctctgcctcctccccatgcccccagttgctgtggcttgattctgctaccctgaccccaccatgtgccaggtggcatctgccttactgccttccctgaggagctgggacatgctgggcagttgtcagatgtaaaggcacagctggagcagagggcatgtcagtaatgattggtccctggggaaggtctggctggctccagcacagtgaggcatttaggtatctctcggtgaccgttggattcctggaagcagtagctgttctgtttggatctggtaggacagggctcagagggctaggcacggagggaaggtcagaggagaaggcaggcagggcccagtgagaggggagcatgccttcccccaccctggcttgctcttggtcacagggcggttctgggcacttgaactcagggcccaagcagaagcacaggcccagtcctggctgcaagcacaatagcctgaatgggatttcaggttaggcagggtgggaggggaggctctctggctttagttttgttttgttttccaaatcaaggtaacttgctcccttctgcctacaggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcacagtccctggtacctgaaaaggtacctaggtctaggcccttcttccctttcccttcctctcccctaccccagaactttggctccctttcccttctctctctggtagctccaggaggcctgtgatccagctccctgcctagcatccatgacctgttggatgttacctccaatcagtttcctgtcctacctgcctctttggcttggacctatatggccatgctctggctctacccttgggaagcctgatcccggtgtgtggcccagcttgttcaggccctgggatgctgcatctccaggcaactatgcactttcccggggagagaaccagtatgagaagtgggggcagggcacacattcatctttgtaggaaggtctggcctggggtcgggtgaaggagggcccaggtcagttctggggtcccagtgacctgctttgccattctcctggtgccgctgctgctccctgtttctggagctggatgttccccagctggcagttgagctgcctgagccaatgtgtctgtctttggtaactgagtgaaccataataaaggggaacatttggccctgtgt

SEQ ID NO: 2942 - DNA, 598 bp, Homo sapiens
ggcagccttaaattcttaataagaaagaagagtggggcagtttgaggattattcaactggatcctaaatgagcttcctgtattaccatttaagactgccaaaaccgagggaggagccaagagggccgaataggaacagctccgtctacagcaaccagcgtgagcgacgcagaagacagtggcacaggtagcacttggctttattgacacactgctgaagaggacacaacttcctgaagaaaaagagaggctaaagagagtttgtagataaatactgcttttcaatctgaataaaattgcatgaagacttggaacatacatacttaaaggaaggctggaatgcagtggcacagtcatagcctcaaactcctgagcttcagaaatcatccccactcagcctcatgaatagctggaactgcaggagatacaaaggcttacaatggattaacaagattatacaaatgcatctaggatatacagctcatccaaggtgaagtcctatttctagtgtgtaaactagaaatagaatgttaataaattggaattttgtcctgtggccatgtgttctaaggtagaataactatcagttttaaaataac

SEQ ID NO: 2943 - DNA, 1308 bp, Homo sapiens
gagagcagccccagaggccatggaaagaagtagctttgaacaggaggttccagtggcctcccagtcaagcgagggggtggatccctgccccaccaccagcaccgcaagccccaaagatggcccacacagggaccaccccctgggcggcgttcaccccatggagttgggccccacagccactggacagccctggcccctggaccctgagaactctcatgagcccagcagccaccctgagaagcctctgccagcagtctcgcctgacccccaagatcaagtccagatgccaagatcctgcctctggtgagaggtagctcctaaaatgaacagatttaaagacaggtggccactgacagccactccaggaacttgaactgcaggggcagagccagtgaatcaccggacctccagcacctgcaggcagcttggaagtttcttccccgagtggagcttcgacccacccactccaggaacccagagccacattagaagttcctgagggctggagaacactgctgggcacactctccagctcaataaaccatcagtcccagaagcaaaggtcacacagcccctgacctccctcaccagtggaggctgggtagtgctggccatcccaaaagggctctgtcctgggagtctggtgtgtctcctacatgcaatttccacggacccagctctgtggagggcatgactgctggccagaagctagtggtcctggggccctatggttcgactgagtccacactcccctggagcctggctggcctctgcaaacaaacataattttggggaccttccttcctgtttcttcccaccctgtcttctcccctaggtggttcctgagcccccacccccaatcccagtgctacacctgaggttctggagctcagaatctgacagcctctcccccattctgtgtgtgtcggggggacagagggaaccatttaagaaaagataccaaagtagaagtcaaaagaaagacatgttggctataggcgtggtggctcatgcctataatcccagcactttgggaagccggggtaggaggatcaccagaggccagcaggtccacaccagcctgggcaacacagcaagacaccgcatctacagaaaaattttaaaattagctgggcgtggtggtgtgtacctgtaggcctagctgctcaggaggctgaagcaggaggatcacttgagcctgagttcaacactgcagtgagctatggtggcaccactgcactccagcctgggtgacagagcaagaccctgtctctaaaataaattttaaaaagacatattacacttgga

SEQ ID NO: 2944 - DNA, 6534 bp, Homo sapiens
agagactggagaggtgggagaggggtagctatgaaaggaaaatgtgtggaggtgacatggtctgtaggttgggccaggccagaagagaaggtcaaagagaaatgagtgttccagtcaggcttgatgtcttagggaagatcctggggcccagcccactgccccctcctctccgtctctcctgctcccggggctgagggaatggaaggagctgtgccactgtgaggaggaggacctgcatctgtgaggggcctgctgggaccagctgctggggagtacagctttctctcagtagctgaagggggctgcctcttttccaaggggcagctgccacgccaccgcaggaaaatctggcttgccattttggatacctggattttcccacagtgtgagggggctgggggtgtggcccaggaaggtgcacctgaggtgggagaagaaagaagaagactggatgggagtcagctgaattgggggccgcagaggctggggtgagagggagggaaggaggtgtcaaagctcagcctcccaaagctgagcgagaagagcatgacgggagggtgtttcccacctcctcgcccactccagcgcagggtcctgtctccgtccaaacgctgcaagcctttccacattcctgcactaccttcctgcgctgcctttggagatctgagagtcttcaggcatgaactctgggaagtgatggatgatgcacacacaaaagacccacacctatgagtctactcagatgaagacacaaccccacccaccccagttttgcagggaagtaaagcaatacaataattcatgtggagtaggagtggcggccacttcctgctggctgtggtggccagttgtttgcaacagtctgtgcactggctgtctcctcacccttccttcccactcaggaatgcctattgcaatgcaaggaaatcagaatgacattattaaggatgtagacttgaattgtttctaatttatttatttattttgagacagggtctcactctgctgcccgggctggaatgcaatggtgtgatctcgactcactgcaacctctgcctcctgggctcaagcaaccctcctgcctcagcctcccaagtagctgggactgcagccgtgtgccaccaccacacccagctaatttttgtctttttgtagagacagggtctcaccatgttgaccaggctggtctcaaacccctgagcttaagtgatccacctgcctcagcctcctgaagtcctgggattacaggtgtgagccaccgtgcccagctctaatttatttttaaaaggtgaattgctccagaagtgttttgaacattcttagcaacagcaattctctttcttcacctttacacctgactggggtaggcctggttgtcatgacatcactgtggaaagcaaccacctgggggactgcttggtgatcagtcaagccttcagctgaccagctttcccttctatggtctggagcaccacagggcagggacaggagagcaccaattcttcaatgtgaacagaactctccgacatcatcagaagggatgtctgccggttttgcctccccaagcatcctttctgcctttttctgctcgcagcatcttgcttcccttctgggagtgcctactgcctgttccattgcactaatgtctgccctctccaaagcttaggcatgtgacccaatcagactagagtgtctttcctgagaacccagggttgtggccccggcaacaagatagatagcagttaggtcagagtgctcttgacccatgaattcttactactctgaattttgagcagggtttacataaataataaattagagcaagctcaaagttagccctaaaatactgtcactttctcttgattttaatatactttcttgaagaggtgagagaaagcttgcactatccctaataggtaggaaattgtatgtcacctgcatgatagctgtggcctggggtcctgtccttccaaagcatggctgtccaaatcttccagtttaggaatctaaactggaaaatgtagccactgcgcagcactgccttcataccatccagaaaccagatatttcctttttccttaaagtgccccaggaatagagttactagatttaataaatacaaatacaggatacccggttacattcgaattttagataaacataaatgaatactttttttagtgtaattatgtcccatgcaatatttgggcatcctgtattatgtctggcaaccctactcagggaagaaaatgatgtttcgtctcttggggttgacttacaaacactcaccctcctttacccgattctgctgtcccttctcccccacaagcaaatggcttctgtaagagtggccgtattattcgccagatggttcgaccaagggttacatctgacaaaagatggaccaaccagtgcagcttcctaagaatttttcaaacagtaagaaagaattaagtgctttcaggtgttggagtttgagacattaagctcagggactggtggcagccttgatttccaacacatggacaggactggcctctattgagagagaatgaggtagacgcgcaggcggaagcagagagtgctgacagtgttcaaatattaaattccagttgttcttgaggggctccttgcctttgccatgtttcttttttcttttctttttttttttgagacagagtctcactctgtctcccacgctagagtgcagtggtgcgatctcggcttgctgcaacctccgcctccctggttcaagcaattctcctgcctcagcctcccaagtagctgggattacaggtgcataccactatgcctggctaatttttgtatttttagcagagatggggtttcaccatgttggtcaagttggtcttgaactcctgacctcaggtgatccaccctcctcggcctcccaaagtgctgggattacaggtgtcagccaccaagcccggcctgccttgttttcataaactaaaaataaaatcctaagccccccaaccaactaaatggaccccctcttgcccaggtgaccccagagaaacctgaaaaactgagttcttggccatgaggggagggaggttggacacacctcattataccctctcccttttggagtttaggcacaactggccagcattaatgctaaaacagagatcataagactaataaaatggactcttcgtgacaataagataccgaattataaacaggacctaaggccatgccagacaaggggtaattcacacactcctacaggttgctgcagcccagtgtattggttaatagaattccttatcttaaaacattcctttctgctgactccagatttttaaacagagctttactcctttagccaatggcaaattaaagaatctctgaatccacctataacctgtaagctcccccacttcaagatatccgcctttgcaggctgaaccaatgtatacattccatgtattgatttatgactttgcctgcaagtcctgcctccctaaaatgtataaaaccaaactgtaggccgggcgtggtggctcacacctataatcccagcactttgggaggccgaggcgagcagatcacgaggtcaagggatcgagaccatcctggccaacatggtgaaaccccatctctactaaaaatacaaaaaaaaaattagccgggtgtggtggcatgtgcctgtgatcccagctacttgggaggctgagggaggagaaccacttgaactcgggaagtggagcgagctgagattgctccactgcactgcacttcagcctggcagcagagcgagactccgtctcaaaaaaaaaaaaaaacaaaaaaaacctgtaatccccaactgcttcccgtgcactatcttggacctcttgagactgtgttcctgggccatgttcattcatattggctcagaataaacctctttaaaatatttagagcctggtttttggattaacattttgattatttatgcttttttagtttacatgaactactaagttctttttgcccaagggttgaaaccaaatacaagtcgcaacactttatcatattggagtcagctgttaagtttctgttcccaagatgtgaggaggagcagtgtcttactcatcttggtctcctcagcatctaacccagcaactggcatagagtaggacctcaatcatgttttcaaaaaattaataaatgactccctgggcatggagatgagcaatgtagtgcacatttgactgatctgatttcttcttttttaaatcatgaatgtatttctttttaattattttcgtagagacaaggacttgctatgttgcccagggtggtcttgaactcctggtctcaagtgatcctcccaccttggcctcccaaagtgtggggattacagacgtgagccaccatgcccagccatgatttgatttcttgacagaaactcaccaaacatcaggaatcttttccaccagctcactggaaaatcctgaaacttagagaatctctcactccacagctggccggaatggaaggcaaggttgtggttgggttactggtttttgcccaggtaggaaagtaagggagcctttatgataaggatcatggtcgctgaaacaaccatggttgcttcaaaagtagcctccttgcattatgcagtttttttaaaaaaaactttatttttagttatttcttagagacaggatctcactctgttgctcaggctggagtgtagtggcatgactatatctcactgcctccttgaactcctgggctcaagtgatactcctgcctcagcctcccaagtagtcgggaccacaggcacacaccaccatgcccagctcattttcaagttttttgtagagacagggttctgctatgttacctaggctagtcttgaactcctaggctcaagggattcctctgccttagctttccaaagtgctggaattacaggtgtgaaccattgcacgtggcctgtgcagttgttttgatttcctttctaaacagatgagaatgaaatatgagcaaatcctgttgggtccttctaaagaggctctgggaagatggcactggctctgtttgtctatgcccaggacagctcctggagagcagtggggaagcacaggaaagggtccctgcaaggcatgctcaaggtggtgctgtcaagaacagtggaacttggctgggtgcaatggctcacgcctgtaatcccagcactttgggaggccgaggtgggtggatctcctgaggtcaggagttcgagaccagcctggccaacatggtgaaaccccatctctactaaaaataaaaatacaaaaattagctgggcatgatggtgggcgcctgtaatcccagctacctgggaagccgaggcagaagaatcacttgaacccgggaggtggaggttgcagtgagctgagatagcgccactgcactccagcctgggcaacaagagtgaaactctgtctcaaaaaacaaaacaaaacaaaaacaaattccagcatgtcctgcctggcctttgtcctgtcatccccattaccctgactcagtattctcaaaagcctggaatatagttgccttctagtctcaggttacaccagagcggggcacctggatgcatagcactcctccaccccacccccaccccatagactttcaggaaagaggagtcagctttcagcaggactgccaacctgtctggaaggagggaggacagcaagctctgtagcatccctagagagtggttgcccagtctcccaaactgcagggagacagctctctctctctctctttgccagaggaagaatgaacttctgtcaccctctgcactcaaggaactccatcacctctaaattatttgtgtcaaccactgaagtccaaggagaatttcagagctgggagaatttgtttgtattttcacaatttataatgctctttttgtcagaccaatttgccaatacaaaaggatggcctaacataccattatggagagaggaaacacaacaagcaaactaaagcttttgcaacatcaaagtgaatattatctttggcaaaatgtaagagagatgtggggaaataaaggctgctgggaaggttctgttactaaggggtttgtcagctgatccccgaggccccttttggctctgaagttctggagaattagattctttcctacatttattctgctttctctgtccttttatcgcatgtgtttatttcaccagctttgtttcttctatgctcatcacatttgcatgctgatttttctaacaatgataaggaaagtctctctctgaacggaaattttgatagcacaatgggtggacaggacagttgtgatttgtagaaatgtttcctcacagctatcttacctgcatgaatattcttgctgggacttcctagggagtgtgtcttcttgtcttctgttccttgaataataacctgatcatttactgacatgttgacctaaaaataaattccatatcacttctctctctcattaatgatgtgtcaactgttatgctacgagatgcaaatatgttatctcatttaaaa

SEQ ID NO: 2945 - DNA, 4051 bp, Homo sapiens
aggcagggttttgctctgtcactcaggtgggagggcaagtggtgcaatcatggctcattgcagcctcaacctcctgggctcaagggatctgcccgcctcattttctgagtttttgtagagacaggatctcaccatgttgttcaggccggtctcgaactcctgggcttaagcaatccctccactttggcctcccaaagtgctgggattacaggcatgagcgacagcttccagcttttctgaggcattttaaagcaagttcccacaaaacctctctcacccaaggcttcagcctgcttctctggaaaataagaccctttcttatatcaatacaataccattatcaaacccaacaacatggcatttaacagccagtttttgaagatttcctcgtactcagtccattttcaaatttccccacaattttctgaacaggctctccacccctccgaccccaggcctgttcttggggccaactagttttaaccatttctgtttttagtgcgtctggtgggtacctttacatctctaaataatcagcttgctttttttttttttttttttgagacagagtttcactcttgttgcccaggctggagtgcaacggcgggatccctgctcatcgaaacctccgcctcttgggttcaagcgattctcctgcctcagcctcttgagcatctgggattacaggcatgtgccaccaggcccggctaattttgtatatttagcagagacagggtttctccatgttggtcaggctggtctctaactcccatcctcaggtgatccgcccgcctcggcctcccaaagtgctggagtacaggtgtgagccacggtgcctagctggctcccgcctttgtaagatgaaggcatctgtctgaatcaggatcagggcgagtgtattgttaacacctctacccatgagtagcagagtgggcccagagtcacctgtgctgcatctgaagatggtccagcactttcccaacacacgcctcgacataaactcgttaaacatttgcccactgactgaagagaatgccatttgtgtctctgctccttgcttctcagccaccctggggaaaccctttcttctgagcctgagctaccctggaggtcacagtcccacagtcaccatggcaactcccttcagggtatgagggagggagctgaggaaaagagtcagaaacttaccaggaggccccaggagaaagccactttcacagagaaaaatttcaaagtctcagtgattgggttggtatatggggcactgccttgtatgggatgtgtcatttctggaaagttaccctatgtcattctttggggtaaaattttgtgatgttactttaaacatacgctagagttccctacattgggagccttgttgtgaattcttttgcaaagtgaataaaaaccctcattattctttgaatgcaagcatagatattcagatgtcaagtggttttacagttcagcacagcagtgcttttggatttggaaggtgttgggtagtaagagtgtgagtggggcctgggaaggaatctactttgagtgatgctttggacgttatctggatgctgtcttaaggttagttgctaccaaaagaaaagcctgggctgaggagtctggtgtaggtgatttataaaggaactgctctcaggagaaatctgtaggatgggagaaacaggatagggaaaggaaagaatccaggcaaagattggatatcaggtcccagactcagcctgatcccatgaggagttctggggtgaattacaccccagcatttaccaccttgaatcaaaggagctgggctttatactctcaaattagtcagttattgcttataggtttcccaggataaagtgtaaaattttcagagggaagcagctttggtgcccccagtcagtcttctgaaagtcatcagtgcaagctgttagcaacaaaaaacacagaggtggagagtgggcatgtggagctggtgatagggatttcaggggatctaggagggcttcaatagagtctactataggtgccaaatatggtacataaatgactttccaaggtctctaccttaacaacaaaaaatcagtgaaattacttagcttcccacaacacagtattcagaaccatgttttagaagaaagataacagtgtacgtaggcagatacagaattggttgagagaatatttctgaagaatatggaaggaatggctgttgattgggtagatagctctagaagttgaacacaggactccacctggggcttgtattgtgaaatatttatatctacatcttagagcagatggagagctcttgccaagtatatctgtggattctcctaaactgagaggaaaggtaatggaacaaatgacaaaagagttgaaaggaagattccaattaatgaataactgtaagattaacattaaagaaataaatgtaaatgtaatgtgaagttaatttcattatgatcatccacataatggaatattatatagccactgtattagtctgttcttgcactgctataaagaaatacctgagactgggtaatttatagagaaaagaggtttaattggctcacagctctgcaggctatatagaaggcatggcagcatctgcttagcttctggggaggcctcaggaaacttacaatcatggcagaaggtgaagggggagctggcatttcacattgctggagcaggaggaaaagagagagtaaggaggtactacacacttgtaaacaaccagatctcatgagaaatcactatcaccattcggtccttctaggcctcagggcctgtgatgggtggggcttccaggaaggcctctgaaatgccttccagtccttttccccattgtcttggctgttcacagttgactccttctttttacttttgcaaatttctgcagcctgcttgaattcctcccctgaaaatggaattttcttttctaccacatggccaggttgcagatttttcaaacttttatgctctgcttttctttttaaatataagttcccgttttaggttatttctttgttcatgcatatgagcataggctgttggaggcagccaggtcacctcttccacatcttgaatgctttgctgcttaggcatggtaaatcatcactctcaagttcaaagttccatggattcctaaagcaggggcgcaatgtagctaggctttttgctaaagcatggcaaaagtaacctttactccagttcccaataagttcctcatttccatctgagacctccttagcctggacttcattttccatatcactatcagcattttggtcaaagccactcaacaaatctctaggaagttccaaactttcccttatcttccttcttttctgccccttgcactcttcaaacctctgcctgttgcccagttccaaagctgcttccacattttcagatatttttatagcaatgccccactcctcagtaccaactttctatattagtccattcttgcactgctgtaaagaaatacctgagactagataatatatagagaaaagaggtttaattgtctcatggttctgcaggctgtacagaaaacatagtggcttctgcttctggggaggcctcaggaagcttcctatcatggcagaaggtaaagagggagggaggcacttcacattgccagagcagggggaagagataggtagagagagagggagagaaggtgctacacacttttatactagcagatctcatcagaactcattatcgtgatgacaacaccaagggggatggtgctaaaccattcatgagaaactgtctctgtgatccaatcacctcacaccaggccccacctccggcgttggggattacatttcaatgtgagatttgggctgggacacagatccaaaccatatcagctgctaaaaataatgtcaaagaataatgacatggaaaaatgttcataattatttggttataaaaggccatcgcaatatgcatggaaaacattttcaaagacatattctaaaatggtgtgattctataagtggaatataattcatttttgctctctcgttttgct

SEQ ID NO: 2946 - DNA, 1653 bp, Homo sapiens
tgggaaaactgcccaggagccaggtctctcttctcgcctgcaggcatacgaggagcggcagcggcactggcagcgagagcgtgaggccctgcgagaggactgtgcggcccaggcacagcgggcacagcgggcccaacagctgctgcagctgcaggtgttccagctgcagcaggagaagcggcaattgcaggacgacttcgcacagctgctgcaggagcgcgaacagctggagcggcgctgcgccaccttggagcgggagcagcgggagctcgggccgaggcttgaggagaccaagtgggaggtgtgccagaaatcaggcgagatctccctgctgaagcagcagctgaaagagtctcaggcagagctggtgcagaagggcagcgagctggtggctctgcgggtggcgctgcgggaggcccgtgctacgctgcgggtcagtgagggccgtgcgcggggtctacaggaggccgcccgagctcgggagctggagctggaagcctgttcccaggagctgcagcgacaccgccaggaagctgagcagctgcgggagaaagctgggcagttggatgctgaggcggccggactccgggagccccctgtgccacctgccaccgctgacccattcctcctggcagagagtgatgaggccaaagtgcagcgggcagcagccggggttgggggcagcttgcgggcccaggtggagcgattgcgggtggagctgcagcgggagcggcggcggggtgaggagcagcgggacagctttgagggggagcggctggcctggcaggcagagaaggagcaggtgatccgctaccagaagcagctgcagcacaactacatccagatgtaccggcgcaaccggcagctagagcaggagctgcagcagctcagcctggagctggaggcccgggagctcgctgacctgggcctggccgagcaggccccctgcatctgcctggaggagatcactgctactgagatctagggccctcagcaaccagctctgtagggagctctgccagaggggcagcagctgcagatccacttaggccccagggtccacggatggccccaaaggctgagggccccaaagccacttgtctcctaggatccaggcctctgggcttctgccaagaactcagggtggccctatgacttggaggagcaagatcagaccgctcaaaggtccccgtgttcactgttacccagaggctcttgttactacccacttcattccccaccgctgccagtgccactgccaaccctgttcacaggcgcttccagcccactccagccaggggagcagggaagaagaaggggctccctcctcttcacattccccccgaccccaaagccagagaaagccagatggcaccagctgctccggatgtgcctgcccacattgggggacagggccgggcctgggctcggttcccaggtttgagctctgcagcctctctcctggagtgagggggctgaagtcagaccaaaggaagaactcagaaatgtcttgtttatttgtgtttgtgaccaagcagcctctcccttcacccaggtttatggcctcgttttcacttgtatatttttcacactgtaaatttcttgtacaaacccaaagaaaaaattaaaaaaaatttttttgtttaaaaataa

SEQ ID NO: 2947 - DNA, 5209 bp, Homo sapiens
cacaaatctggcccaacaggatgcagataatctggcccaacaggaattcagtaataaggatttttccccaaaaaatatgcactgtattcttagaaactttattcccgtcatctttctactttaaaaggcatttaccccatgaaatgtatctcttttggtattttcctgactgcaaatgcaaaaacaaggaccaacgaatcccaggactgcaatagaccactgacctttagtcagtgaagaactgattccccaaaccacacttaacactcccctgctttctccatgcaaatgcagaatttcttttccccactaagttacaaatatctttaaggcagaaaaacccatgttattaatttttttaaatctccacttctaatgtcagatgactagtaaatcaatttgttagaatacattgttttctgtccatatcttctgcgagtcactcgcccagcagccaggcttctcaagaacggaaggactgctgacgttcacaggtggctaccgggtgggacgctgtgcctgggttatctgatttcttccttcctgccacctcgggaggctacaacaggtgccctgtggccccaccgcaccagggcctgcaccccatccaccagcgccacatcactatgcccacaagcgtcccccagcagcaggtctttggcctggcggaacccaagaggaagtcctcgctcttctggcacaccttcaacaggctcacccccttccggaaatgaaaacaggaggctgtgcttccatggagctgggtgtcaagagaagaactgtctttgtttcttgtgtgcttcaatccagggaaagtttcttggacccagtgataaaaacttccttttagggatcaatgaaggagagaaggtcttggaatcaccttcagtctttggagacccagctgcctttgtggaagggaggagacggtcatgacacaaagctttatcctacacagaaacacccgtgacccactatgagatggcccagatgtgggacccggtaccatgctctaaagcgagtgattaggcagcagctgaagccacccctgctgatgatgagcaagtgcctgctgcaggtccaaacacagcatccagggctttgcagttcctaaggagtgatgaggttagaggatcacttctgcatttgattttcaaggatgccgtcaagacggggttgacacaatgctgcacgtgtctggtcacacttagaaattgagctcttactctcttctgtaatactgggggacctacagctgccgtggggctgaccacggtgttccctggcatcgtctgtgtccacacagatgctaactggtagtgcaaatgtcatcctgcaaggttcctcttcctgcaagcaaagtggagagaaagaagatgcatctgtcaccttcatcagggtcctcagtgcagagcaacttacgcatcctcaagaatccactgcttttcaggcaaggagggagaaatcctgctgcacactggctttgtcccggagtcggattccctcctgcctgcacgccttcagtaactccgagcagaaatcacatcttgcccacatgctgtaacctaagaaactgctatgcaaggctgggtgctgtggctcatgcctgtaatcccagcactttgggaggccaaggcaggtggatcacctgaggtcaggagttcgagacaagcgtggccaatatggcaaagcccagtctctactaataatacaaaaattagctgggcatggtggcgcatgcctgtaatcccagctactgggaaggctgaggtaggagaatcttttgaatctgggaagcggaggttgcagtgagctgagatcgcaccactgcactccagcctgggagatacagcgagactgtctccaaaaacaaaaacaaaaacaaaaaacattcaaacaactgtttgcaatataaaaagctcatttactgtaatatttatgatacagtgaatatgaaaatgcactggtcagaaggcactctcaaagagccgcactgctcctgacatcgtccttagcaatgaagtcacaaagacagccaaagcagtcctgcttcttggaaatcagaagctgcctttatcacatataaagccaaacagggcataaccatgtcacgtgagcatgtcatcaggcttctgaggacttgttctttataaaaaaagaccttcacaaaatatcttggcttagagatagcagtctttattaacaaaggccacctaggctgacacctgcagataatcatctccttttctttgtctatgttgtacattttcatgatataacttttaactatgtctagagaaggcaggctctgcaagagaggtgccctttcaacccgctcagtgccctggacaggagatgctgtgttaaactgttaatggatatctatatgagaagctcatttttgtatgctatccctgcagtttttttttttctaacaggcccatgtttgagaataaacaagtctgtgatgtcagagacaaaggtgtattcttcagtctgcaggtgtgtggcacctcccttctcccctgcagccccccacatccagagccgttcctgagagtgacatcatgcatcaagaaaacataaccttggtcctcaggtgaacccttggaacattctgtgaccgcctgatgtccattctgagccaccttggcacacatgcttacaggcagcactgctaagggttcaggtgccccatggctgacagcccgagttgcttctgtggaccatcatgccgctcggcacgtcctgagacagaagttgctgcaggaaggagcttctggagaggtcctgtggcatgtgtgggggtgtgtgtgtgtatgtttccttcttgaacagacattccaactttagatgtgtttatagaactgacctttttactaacaaaatacaatgatatatgttggaaactacttaatatgcttttcctgcacaccttagcaataactgtaggggtctctgctagagttgtttgtatgtacagcaattttgaacaaattgttttaaatgtaatataagagaattagtttaaggaagtaaagagaatcatttgcttgtgttacattttcagtgaggattcagtttaagagtcattcttaggacttccatttcctaatatttattcatgggtaatgaagaaatggtttgcattttgtggccagtcctaatttattttccagctgagccctaacttccggctcccacctacctccacggacttcctaacagagacttatgaataccaggatgtgtttttgttaagtcaggttcaattcgttgcccctgtcagttttatagagtgtgagggtcactccattaaagatctctcctgggtggatcctacttggatgttcaggtgattttgaaaactgctaacatttttaaaaggctagaacatcctttgacttcttgaaaatctgcatgtctggcttgggttttattaccacatgcctgagttcttcaagaatggaaggctcaagtattctcatcttccatttgccaaacttccttcctgatttgagtcacgtgttccacttggaaagaaagggaacagagagcctcctccatggacagtgtatgaatttcattgggaatcttgctctctcccgcctctatgcctttctctctttttaaccttactttacataatattatagatgggccaagaaaagaaaagatgacataacattttgatgaatttcacctattccattcttcacgtttcagaattggtcgactttgttagaagataattgaagtagccttgggtcaaaagcaaccttttcaattgtgatcatacctaaaacatataaaaaccctgccgtagattaaaagcaattataaaatcataaaattgaatgtttgcagaatcctggagcagtagatttctttgtctttggcctgcggactagaaagagggcagcagtagtatgctggagcttccctgggataccagccacatggtttcttttcattagatctgatttttgtttcccactgtagatctgattttgtagttgaaaacatttcaccaccatcaaacactatttctgaatattgtgcctttttatacctagcctagatgaaaaccgatgccattcttattcagaaaatccccccatcctacatgactgttatctagacataaagcaaagtgcatttaattcaaaatttggttcacaatataagtattttgtaaaagccagctgaaccagcattttatcaggtggaaatctctgcaagccaaattgctgatactccttcatgcagatcaacttggtgtcccagtcagaatagaacagcataattacctggagttagggggagtatttctgcactattacttgtcagggagagaagaaacttagaattgtccctcaaaggagtgtcaagaagtatgaataaatgtcctttcaccagctcacaggccagaaatggaggacccaagtcaactaggtgaaactactagcagacccagctttcccataataacctaatctgcaaattgttctattaaagtctcattgttttcaggatgcaatgaaagtggatttcaaaaggctttggaaaaataagtggaacatgactgatcttgaaaaaaaaagcaaaagcttaaatatttgatacaagtttacttagctacaacatactttacattgttgcctttagttatctcacaggcactgacattttatatttagaaaatacttttaatctttctaatctttttttgtaaatattagtgtccattctgtatgactcgctaacctactttgcaaggctttgggcaacattttagctcattaacttcaagatgatgtgtcatctgtataggtcaaagaatgggacttctgaactgaggaatttgctgttgacagccaaagtatagtgtacaagattgatgtaacttgatatgtatttttgttgaagttttttgtaaaaaaaaattatttacaatgttatttgaatgatttttttaaatgctgtgaatctatatttgttgttttgtatattaaaattcatttgccaaactcgttctgatgatgcatttgagtagcagcctttaaaaggaggaagtggagagctgggtgcgggggcttctgggatttgtagctcctctgctgccctgatgtccctagacttctcagtggcaacaactcatccattcaggagctccatgtaaccactgggtaggcgtgggagaaggggg

SEQ ID NO: 2948 - DNA, 14487 bp, Homo sapiens
gttgtttatgtaagaatttcaaggccacaactccatatttgaagtaaagtgctcataaaattaattgcaaggtaatttgccgttaatagttatctgatttctactttgatctagtggttgttaagaagagaggttttggtttttttaatcttgattttgctgttgattcctacttttaattgctgtactggagaaaatgatttctgtgggcttctttgaggtacagcacatgattcacaattgtatatggtctgataacataagaaaataacattttctcagttagtagaatacaaatacttaaaaatatatgtttttaaatatttgaaaaggggtctgctgattccattattaatgtattgcatccttacttgattaaattacttttgtttctggaggatttttttgtatatgtatatttgatgctgtgtccctggtgagttataaactccttgaactacagcttttatcatgcatttgttataaatttttattcattttatatatattgatattgtcaatcctcctttttaaaatttggatttgactttataattctgcacatccttttcttttcaacatttgccttcatttttcaagtgtgtttcttatagacagcacatgtctgtattttttaaaaacccaatttgatattccttgtttcataacaggaaaatttggttcatttgaattcagtgtgaagattaatatttcggtgttgttctcactttatttgctatttaccgtttattccttttttcgatttttacctctctttatattcttgctaataatattaagctttttgctagttctgttgtttctcttttggtttttgaattaatgttattttatgattccccatagccctaactataaacttattctaacaatataaactattctaaaaatcacatataatttatgtgtctttatttatgtgtctttattaacacataaaaattaataagtaagtgtaaccactcgagtatttaatttgccattcctcctgcccctttaaaaaggagacatttccactggcccctgctcttccatcctgagcaaactccccaccttcacagtagccaacacttgggtttacagcaatggtttcagattttcagcgtttcatatcctggctaacatttttgagataataatttcttctgtttagcaataagttcttaagatttaaatatattccagtcatatcattttattaattcatttttttctctataccttaaaatctatggcatctcatggttcgacattaggaaatccatcactatgattcagtaagtaaacaaattcaaggtgtcacatcatattgctttttatgcttttgattttagtaatatcctttcacattcataatccagatagagagataagcaagattgtatccaccaagcctcctctttattgatcttccaaactgaaaaacatagctgccattttagtcagcagttaaactttattatagaatatttttataccttttctgctaacattacctgcaactcccatggtgatgctcaaatcccatttgggaattcagtgaactagcagaatgaaattctaagagactggggcttgttgatgtgtccacgctttccatgggaactgatgttaaatatttcacaaataccataacttccaggaattcacatattctttattgaatgtagaattgtgaaatctttaagaaataactgaatcattatttcttcactgtctcctgcctgtgaaagcagaactatgaaatagctcaagggaatcagtgagagatttgtatccattatattcagtagcctgcatgtgtccaaatcacaaatgaaatgatgtgggcaaatataaattaaaattgaatgttgcagaagtggttgaggaacttcaccaggatacattaatgtacaaactgaaaactgatgaaaggtaagagtttggtcctatgtggtgtaaaggataggagcagttttgtggacatttcttcattcttctctttctgcttttccagacttctgaagagagatttgctaggaaaaataaaaagatatataaatttcagtgatgctgaaggtatgtgcaaacaaattgtcctcattaatagtaaaggtataaattgatgtggattttctagaagacaatttaaaggtacacacttggtttctaaaaagtacactttttaaaatctatctttttaatcccaatttatttacaatttattataagaaagtatttaggtaattatgcaaagatgtatgtaaagtaagttcactaattgttctcagtacaaaaaaaaggatgaaattccataaacatctattaagaaagacctggttaaataatgtattgtacctccatatgtttagtcattaaaaatggtcacttaaatctctagtgtattgacatcaaataatgtcaacaataaatttaaaaagcataactctctagtgtattgacatcaaataatgtcaacaataaatttaaaaagcataaatctctagggtattgacatcaaataatgtcaacaataaatttaaaaagcataaatatatagaaaaatatccctatctctatataaagaatgtctacatacccacttatgaatacatggaaacatatctgcaaggatatagtctaaaaccttatcggtagtgtttcttcgcagtagtgtgaaagaaatacagtagaaacatttaactccttccagtaatgggaaggagaggaagagctcacaaaaacagaaagcatatatttttgacattttgatattttaaatgtaatctcttttcttcatttttctggctacatatgttgattcaacacatattagtaagcaggatgtaatattcaataaaaacttctgtaattgtctgcattagttccaatttattcatatagaaactattcattttacatatctctttctattaaactaacatttagcatgtaaggcacagttttatttttgaaattattaataaattaaaatgttagtgacaaacataaactcttgagctttacaataggttaatgataaagaagacagccaatattagatggagaaaagcttcataaaacccacaggttagagaaaaattgttaggcatttaataaatgatagatcctttatattttgctgcacaaaaaccaaagatgaaaccttttttaaatgcatggtctcagcatgcatttcaaatcacatttttgaagtttatgaatttatgattatataggggaagaaaaaattctttgtttctccacccatcttagatctattggctggagctctgcaatttagactgacaaaagacggattaaacaagataaaaacaagtttattaacataggcacaatgcataagaatgggaactgtcactaatgtataactcaaatgagtggttagaccttagagttatataacaatctgaacaaggaataataaatatgttgagaagtgtcaggacaaaggaaaggaactttgggcttctaggggcagcaaattgtgggaaggtaaatttttgggaaaagttaatggaagatgttgggcacggtgtctcacgtctgtaatcccagcacttcgggagaccgaggcgagtggatcacccgtggtcaggagttcaagaccactccagccaacatggtgaaagcctgtgtctactaaaaacacaaaatattagctgggcatggtgggatgcacctgtatacccgctactccggaggatgaggcgggagaattgcttgaacctgggaggcacaggttgcagtgagccaagatcatcaagatcatgccactgcactccagcctgggtgacagagtgagactctgtctcaaaaaaaaaaaaaaaaagaaagaaagagagagagagagagagaaagaaagaaagaaaagaaagaagaaagaaagaaaagaaaagttaatggaggatgaggtctagttagtaggtttgttttatatactatgtagattcctctctggtgccttccttgggctggtagactttatagctgtttctggtgatatagaatcatcctgcccttcctgatagagggggaggataacagagagtttttctcgtgtcttcttgtgttttgttttgttttgttttgttttgttttgttttgtttaattgcctttgactcaaaatagtccttaggccagagtgacatattttggggtgacatcctctgaaccttttcaaatataaggtctgcctccttctttctacttcataacataaagtcttctttctcttccatgaatattacaattcctgcctgagtcttacaaggccctcctcttccctgtaggtcaggacacaattggtcctttgaattgaggtgtggtagtagccaagctttcaggagtgaggtttccacctttcatcttgtttctaaaagtaaatatctagtaaatgataaagctgtgtttttagttgtaagtctatggtgattgtatagcacagaatgattctaatgtattattttagcaatgaagacaagcagatttgatgcagaaatccttgacataaggagccaaaatatttatgttgcccttaggggatagatattaaatatatctacccatactaaactttttttttttaagagatggagttttgctgtgttgcccaggctggccttgaactcctggactcctcaagcaatcctcctgcctcagcctcctgagtagctgggattacaggtacatgtcactatgcccaactttcccaaattaagctttaacaaatcttctcaataatgttttcctaaattattcttgaatacagtcatgtagaacatataacaattatgaagttttaaaagtctttataattcaggaaattttgaattaataaaaacaaaggaaactttttgttttttgagacagagtctcattcggtctcccaggctggagtgcagtggcatgatctcgggttcaagggattctcctgcctcagtctcccgagtaactgggattacaggtgcttgccaggaaataaaggcaataaaaggtcattgctaattatctgctctaggtttaaaaagttcatctaaacttttcaagtatctttttttccctgaagcctacattttgttattactttagttggaaaacgactgcagtcaatgactcctcattccctcaccattctgacatgcactccagcatctctttgccattatttcagcaaagatagatataatatgctatagaagaaaaagagtagcaaccttaacttaagagttgagttcctattgtaaaataaagacattactgagactgggtttcaaacaaatatatttttaagctccactcctgtggatttttttgttttgttttgttttgtttttgtcttggtctctttgttgatcctgtcagccaatggtttctcacttgcctgtcagagctgaagagtccattccttgtcaattcagatgcgaagtggaacaaacgtcctttagtaacaaaacgaatccgaaatgaaaaaggatatgttactgctgactgtggtggttgtcaataaagatgttttcatagcaactattccttcaaaatacaatgaacatctgcaatagtcttttacccaaatgacaaattcctttcctactaaatcatgtctttacaaaattagaaggctctattttaaaccttgaattacttgacattgaaggtaatgctaattacaataaaatctcccacttacataattattaattcaaatttgcacctttttcctgaattttacctgcttagaaatccttatggtgctaatgatgaacataacgattaagaattttgttgctgaaatctctctatgcctcagtttaaccatgttaaaaattgataagataatacttaattgatagaaactgtgataataaaataacaccacaaatgtgattacaacagaacatggcaaaataaatgctagctaaatttttaaatcatggtttaaagatataatttgtgttactttaattaaataattgataaatagatttcttgccttgacattaaccttgagtattcatatttctgcaagtaggagaggaaggatgtgatgtctttccccatccgtcataagggtcatggccaacactcctataacaaaaggtaggctaacgagaaaaaagcatgacaaatatttaatcatgcttttacgtgacagagaagccttctgaaagaaggctcaaagaaccagggaaaactatccatctttatgcttagattcaatggagtggacagttgtgtagaaatgtgatcggacaaaggaagaattatctaatagtaatggactgcgtgtggaaacccataagaactgtctattctgattcttcttggcctctctgtgtggcatttcttcctcctgggtatggggcatgactccttctggaattagggtttgatgacctactatcaaataaggggaggtcagagaatgtctttatggccagctcctagatagaaaggcaggacaaggttagactaatcattctagcttttatttttggctttgaggaaaagcagatatggtttgtatgacccaccttagggaagaggaattccagtttttatggttcaccttgagggagaatgaggggcaaaagacatctgaatccttcacttcagggtatcattttctgaggctcaatatggacaagtatttataactaggtgcttaatatggccttttgagatacacagttcctatgctgcaatctcacaggcaatgaatggtctttataaaagtgtgttaaagttgaaaaaaaagcaacaaaacaaacaaaaacctgaagaaatattcctcattgaaggtccagcttacattaaaaagaaaactataataatttattctcttgagaagggttgtatagcaaaggaaaattcttgaatgttccctctgcttgccccatgcatcaattctattgatattaaagtaggcctagcaaatgtacttccattctcactgactcagtctttgtaattcaacaccaattctgaaaaatacttagaaattatttcagtaaacagctcttataagtgctacatgcataacaatatttcaatatcagagacttctatcccatgagaagatattttcaacctaaaatttattataaatgacctaacaaagaactattttttcagtaattggctattatggttcaatctgttatacccactttacactagaaactatcctatattttcttgttgcctacgtaaaagtgggcacgaaaaggttaaacagtaaacttcctgactcctgccagccaagggaagactactggtgttacctacgaagtgtcatggcattctcatttctgaataatgagggaaatctgctttcaatacaaacccccataagacagtcactcttccagacaaattaagctaaataatccatcatgacagctgagaagacaatgtgcaaaatgtcagtggaggccagggagagaaaggcagagatggactgtaagagctgcagcatgatgcaaatactgagaaaagacattctctgttaatacagctcttaattgtaggcattttttacagaacatattgagagtgaagcaaagcttccttagcagtactctgatgtcttctcagcaggataatgtagggtaattcacagtgaaggcaaggggttaggaaagtcacagccctaaaaatcaatgggctgcttacagggaagaaggtgcaacagatcttggagagcacagaaaagaagagatgagcagcctgtattgaacagaaaccaaaatattagttagatatatccagcaaagccattccacaagttcgttagtgagtaggtgccaaaagccaactgtaaatcctagatacttgtacatatgcatgcttatattacttatattttaagcagtcatatcctcaagctatattatgagttcagtcattctaaaaagatgcttccattgtcttcttggcacttactcagaatcttcagttatcttattcatactgtgtgcttactggttgtcttaacaggtgagggcaggggccctgtcttattcacctccatatctccaggatatagaatagtgcttggcacacagcaggaactcaataaatattcatactattttgagtcccttaatcctcatatcaactacaggatttagattttattgttatctccattttacagatgaggaaaatgaggaacagagaaattaagtaatttgcccaagctatgcatgaataagtggcagagtcaggatttgaagccaggcagtcaatccctagaatttacactccaacaactactgcctctagtggttatgtatgtatttatacacgtatatatttgcagaaataattgaaacttatttctgcctaggtgcatgatatattaaagcatcactaaatccttctgaatataattcaaacttcttcctaccatagacaaagtaatggcctatagtgaacataatgattatcccatcatacaccttgtactgtattagttttctttgcaatctcaattacacttgcatttttattatcatggttttataaaactttatgactggaaagtaccgtattcataaagagttgtgcctcatatatgttagacatatatgcatttttattagtaattataacttttatgcagccagatagccccaggtttatgattccacatcttttgtgttgtgtcatcttttgtagctagttgatattgtaatgtttgctgacttaattcattcagttattaatttctataaactagaatttaggggacatttcaatggactatggagagaaaataactgaaaattggaaattaagagcatctgagaaaattcaagttgtttgtacatcctggacataaatctcaggaaaactgacatattttccttccttgtcaagtcatacaaccaatgctatcactaaaactggtctaacatttaaacattcagacaatcagtttagtcaatgcttcaataagtttactgaactagcagtttcttaccaactagttacagaacagtcacagctgaaaatgatctatacattgtattataaatgggattaattattctgccagacaaccccaggtgtgccaaataacccaaccccttcctccaagacactcattgagaaactagacagcatctgagcattgtaggaacaaacactgaagtaaatggattctaaatccctttgagttctaaaatgctgtagagatctgagaagcccacaaccttataacagcaggcaacatagattacgcttaaaaagcaacatactttcaattgattgataaacccttttgttgttcatttattgcaaataggttttagagctcaattcacacttttgtgaataaacattgaaaatatttgattcaatggttatatttctgcctgacatgaggaaattatagaatctattaaccttaacaatttaattagcatgtcccagacttaatcactcactatctgggtagaattggcccaattagttaaccactctaaaccacagtttcctcatctgtaaaatgggatggaaaataataacaactcatagggttgttaagaggaatacataaattattcatgtgccctgtatggcacacaataagtccttattaaatgaaccggttgtagaactgtattaagaacaagtagtagtagcttccatatttagagagccatcaattctgttttccaacagctccattagtgagaattgtgctgtgtgttttccccccaccccgccccactacaactgcattgctatatgcaaggatataacttctgtctctaaaactattcaaatagtgagcctgggaaaaacaaacttaggtcaaaagagtttgactaaactggctgagaacatttaagttggataaaaatagatgtattttgtttgtataaatagattttggtcatgagaaagaaataaagaggttcctctcaaaagaaagcctggtttagcagtcagtaaacattgggaagagtcagcagttgacttccccactgtgtggaagaaactgccaaaagcccatccagaattaggtgtgtgggagggaagaacaaaggagaggcaaacaagaagctgtcactattcaccactttcaccttgaataacctttaattgaaaaataaagttgccaaaacaaggagtaaaagaaaaactaccattttattccctccttgagattgaattagagggaaacatactgaccacagtaatcccaaggttggactcacatgatggcaaatgtcacttagttctaaagctctaattagaaacagggctgaagttttagccagctcctgctactagaaataaaacatgaggcaacagcaacccaagccctggacaccccctgacagtgaactctgaggtgctttctgagtgagttgagtataaagctgacagagcctagagaattcatacttgagcaaatattgggaaagaataaactgggtcagttaccacctgtttctagattttatttttttctagacttcaactaagattgtctttcacattaataagaagaacgatgaacataatctatttcatccaacttctacattccaggcacagtatcaaccactttattacattttatcttctgtaatattcacagtgttattgggtagattaaacaacttgcccaagttcacacaactggtgactggcagaaatgggatttgaacttatttgatgccagaggaggtgtatcctttaatattttagaataacttatttatttcattatattttatgaaccttgaaatatgtttattgtaaaaaaaaaacgcagaaaatacagacaggctaagtaaaatgtgtctttacattaaagtatttaatttgcaaaagaacagttgttattttaaaatcctaccccacagtttttcatatttctctttctatgtagggttaatctcatcaggaatttctcttatccatccacagtttgtaggacaattctttgcacataatgggcactcaaatgtacgcagatcatattagtccaagaaaaagctgcttgttggggctaccaagccagcatggtaacaccttacaatcaccctttctacctgcagtcacattgttcccagagtggggtggtgatacttgccagctagcccaagtttctggatatagacctttaacaacttcacaagtacccttagaaaattcggttaagaccgaacatggacatgcttgctccatttttttccactctcaaaatatccttgagcagtaactcattcatagataagaaaaactttttctcttcagttttttcttttctttttgaatattctttgattttagcagaaataggcacagtaaaagaataaatataagagacgaagaataaaatttatgaaatttagaaagctcatgttagagaattgtactctttaggtagatccttatttaaagaataattagaggaaagaaaacaaaagatgaaagagtacaaatgagattcctgagcagttttttattttgattgataaacttttaaaatgtgtttgaattacaatatttatatatcaggaatatgaaaggtttaatcataaaaattacataatatttcttccaacattttcatcttgtccatttcttcatatctatagtggagaattatccctctgtaggcaagaagaagtctttattctcttcggaagctgctcctcttgcactccaaaatatagttctgatggaagctgccaatcactttatcccattcccagaacaggcatggtaccagactgaggtcaatcctatactccaccttatttgccatggaaaatagcctagcgatacttgcatgactcagggcagttggagtagtttgatggaattttttaaaccacagctgacaggaagtagctctgttccttattagttgcaaatgctgcaagcatatgaccctagagttatctgttgccagttgttgccttgtggagatcataggcttaagatgatgaaggcagcaatcagcaataagcagaggtgtgcttgtgtgtgtgtgtgtgtgtgtgtgtgtgtgtgtgtcagaatgagagagagagaaaaattactgcttctgaaaccaaatccatttccaaggtgtggttttagaagcaaataaattgccaatttcagagctgattcaagttgaatttttgtcctgtaaccaaaagagtcctgactaacagccaaaactcaggctgtcaagtaaacataatctgtaagaatccgctttccagcctccattccccttgacatcttcctgaaagaagatttgtataggaaatgctgacgtctctttggcaactgcataaaaattattgtattcaacaaatttattatatgtctctttgtggccaggcagcttgcttggcactggaaattggctagggagattggggcaagaaaaatacctctctccatggtggaggcatacataaaagccgattgctacacaactgcgtaagaagtgctttaatcaaagcctgaataaagtgttgtggaaactcaaaggagcaagcaaaatgcttcacatgaaagttggacattcgagtcaaagactcacaggattttcccaagcagaaaagaaaggagaggacatcatggacagaggaaatagcatggtgcaaaggcatggtatgaaaaaaatacacgacaaatttgtggaataacagaacttttgatgtgatcacagcataatgtggagttgggtaacagtgagggattaggctaaccagcttggcagaatactgactaaaaattcttaaatgctgtgctaagttgttagaattttatcttacaggttttgagaagccatctgcagctcacaactagatgagtgacacaatcagatgtgcgtatgcaagtaggtaatgaacatccatgtaaccatcaccctgagtcaataactatcccttcatgggtgaagttgggcaacttttcatatggttaacaacaattggccaggcacggtggctcacacctgtaatcctaacactttgggaggccgaggtcggtggatcatttgaggtcaggagttcgaaaccagcctggccaacatggggaaaccctgtctctactaaaactacaaaaaaaaaaaaaattagctgggcatagtagcaaatgcctgtaatcccagctactcaggaggctgaggcaggagaattgcttgaacccaggaggaggcagaggttgcagtgagccgagactgcaccactgccctccagcttgggtgacagagcaagactccatctcaaaaaaaaaaaaatccttttttttattatcatcaattttctgcagaccagtccattctactatagaattcctggcatttttcttctcaatctttaaaactttttatgttttatgaatatctttgtattgggtattagtattactaacttttctggtatagtttgcaagatatttgttcccatgctatgatttgtatttatttctttgcttatgttatatttttacagtgaaaaattttaaaaattatataacaaaatatatgttatttctcttgtgtcttctagattttgagtcatattaagcaatgtttccccattttcagaatatagaagaattcataactgctttttaaaaatacatgtacagttcctttttaaagccttgatttaaatatctgatccattgggaatttatcctggattatggtgtaagaaatggatccaattttatctttctccatatggctatccagttatctcagcaatgtttatttaactgtccatcttctacccagcaatttgagatgctacctataaagcatactaaatggtcacatgtgattgtatcttgtttctgaactttctaccttttcattagtttgtctgcctattcatgtgctaatatcaaactgtttaaataataaagtttttaatagtactttctaaagaaatctgatatagtttttccttccagctgttgtcctgaacattgcttttcttttttagagtttatctggttattcttacttgtttttaaattcctaatgaactttataatcaatttgtttaactctagaaaaaagcctggagacattgaactaagatcaaatttaatgtattaaatatggtagaaagaagagagaatgaaaaataatgttaacaatctaggtgaggaattgctgaggagacaaattaagtaaatcctgtggaaggaaagaagaaaggaggaaagaggattggatggaagaatctccacttctcataggtgtagtccttccttagcctgctttttaatgagtgctgctaaagcccttagcctgcctgtttacccttggaggtaagatcttcttctcctctgattagaaaagtcaatctccccaagcatttctgcttcattggtttcactctaccactgaatggctattatgtgccaggccttgggccaggtactcaaaactctgttagaccaagaacataactattcataccctg

SEQ ID NO: 2949 - DNA, 2696 bp, Homo sapiens
cagggaaattgagttgcagagctttgaaataacttgtccaaagccacacagctggaaagtttcaaactcaagcatgttggcccatgctcttcactgacacactctactgccttttgccaaatgtgctggacattcatgttggctgctcagaggtttctgttcctctgtaggaggatctatataaaaaggagacttataatcaatagatggcttgggcactgtctgatcatctggtcttctcagtccccggcaaagttcacggaccctgacacaccctgcagctgtctcctgaaggagtcagagtggaccactgaatcccagctgctcttctttcaaacgatgtgaccttgggaaagttacataacctgtctgtggctttgttttcttccttataaattggggtaataacacctacgtgtaaaggttattcaggtaatgtatgtttaaaagaaaaaaaatgtaaaaggaggaagtgaaaatgaggcagagtttgtgtcctgtgaaaggtaaggaaccagtcacaacatactgataatattaatagctagaactctctctgtagctgcccctgccgagtgttttataccattatctcattcacttctcccaactctttgaggaagagactgttgtacccatcatatcatcatacaaattgctatacccatcatacacataagaaaactgagactcaggaagtgaagtactggtccgagtggcagagctggaattcaaagcaagccttagaggctaagcactggcatttctgtacccatcttgggggagagctggtagctggctccagggaagcatccagcggaagacctggtcttggctgtcctcgtttgacacctactcttagtaacccagaagagtgcaggcacagtgggtattgcaaaggccggagaaggaaaccaacacagacatccgaaaaagctggtgcagagcaggagagaggaaatgggattcagtttggggaagtacagaccaagctagccacacagagctaatccacagcaaggatagagaggtcaggagagaaaaaaaaagaggagagctgggagctgaaagcagcgaggtggggtggctggctgtaactgagatgctgctctgtaaagtgatgaggccggggaggccacatctgctctgggcagcactcgcagagctgttgcagcacagagaggtcttgctctcctcttcacgtgcacagtggggaggccgcattcgaggctcagtgcgtgtgcgtgcgtgcgacacacacacatgctttgatactgagccccatgaaacccccatgagtctttttttttttaactttcctcctttctaagtttgacctatatatttccagatgcctctaagggaaattatggggctattgcatttatcgaatatggagtatagatcagagtggatgtggaggcagcaaggaaggaactgaaaaaagcagcactcagccatgctgatgagctagtcccaagttccagatctctctttagcctgaagctccgttccttcctgtccatctagaaggcaatgttgcctaaaggcaagagcctggatttatgtacggctcctgcttttactgcctatgtgaacttaattattctaccttatctggttcaatgtcctcaactttgaagtgagaacagtagtaatacctacctcctagggcttctgagaagatgaaagaccaaagtgccgctcctatgcaaaacctatccttgggaagtggagatcattattgcctttaaatctgtccaagggtttaataggagtgcattcacaatttgtctgtaggccttttattcagatgcctttagattttgctaaatcagacattgtacagattgacagattgaaatccatagtgaaaaaaaaagctagtttgagggctttcttctggagctgaaataaagcaatcctaacctttgggaagctggttaaatgggttcagagtagagcatttctatgtacctctggggcatttcaggcctggcagcatcaggagggttctcacatgtggcatgggcagcaaagctatgtggggattctgtctttcccaaacctcactgccttccatgtctcctaagacttggtaggatattcaaatacgacacacctgtctctcccagcacacagattatagctgtaggtcttcccatgacaaggtgtgggggaaatcaagtgagggattctgggagttttatctttcccttgatttggggggcataatgcctgctgggaatagaaggacggatttggacacttcagctggctgattcctgggaggggaaaaggacatctctggccttctagccagaaggggcctctggatcacccagtccagcttctagaaggctcgaggactagcattgtgtgtttgtggtcccttgtcagagtaagtgataggagagcctactcaacaccccaagactcctcagcgagtgcactcccacttcatcatcctgagtgaacacgatgcctccaggaatgtgggagacagaagccacagcggattcttttttcaaacccaagcaaggaaaatcagagagaagcaagtcaaatgccattatcttctctctgcagaactgactaagcaaaattatgaataggccaagaatgacttttctactgattgatgaacttgaatctgttcttctaggatttgattattcaattaataaaatatttac

SEQ ID NO: 2950 - DNA, 1948 bp, Homo sapiens
tgatactatgaaactttgaccaagaagatctcaggaactttattctcacacaagttgaacagcctgatctgcaagcctaagaagcactaacaggatcaaagacatcctaaaaagccagctttataaatggatcaatctccagaaatatgtcttaccaggatgggttctaagtgtgcaatgttcattgctaatctggaaatcctcatataaactcaatcctggagccaaataaaatggatttagtcctacaagtaactctgagcttctttgggacaatatatggacaaatatttggttccaaatctaaacttttttccagaatccttttattctctgtaatcacccataatatttggagatctgactcaggcaaaaacatgtggactaaggaggggagaaggtatcttagggctgaactagattgattagcaaaaaataattgccaattttctgaagaattttcaagtctaaattttcgacgaatataaaccaggcaaacatgatgcttttatccaaccttggtggaaaccattaaatgtgcttccagtgtcacggggctccgattctgaaaaatatcaaagcccaggtccctcaggtcccccagtttactcctaccctgttccagagatcagcatattgtcaaaaggacctttctgattctcaggcaaaatattttctatctcttacatagagtagtaactaaaaagactgcatctttaggaaacgaagacaaattgttgcagagaagctacctgtctttaaaagaagggatgatttatttttttctctctcttaactagaacaattaattggtaacataatagaaactctcagcagtaaatgagaaatggcctaatccctgaatagatcacaaacagagtgggaagtgttttttctgctttaattgcaggagttgatgttcaaagaattcccctgctcctcttggttctgttgtgttgctgacttcaggacttaaaaatctgagaatagaggttcaacttgttaatctaaggaaaaataaaaattaaaaattggaggcctaattatctttgttaaaaataagggaagagacagtttctacttttgtgtctaagagcctggaagtcaccactccgtcttaacaagtaaaaagctgaaccgattgaaaaaccaacaagtgttctagaatccgtaagagaagtgaggacacagggaaaataaacaaacaaaaagactgcccccaatattggagaaacaggtgaatacagggagttgtaacttaccagaatagagattctaagcggaaactgccacaagaacgagtgctgctgtgggaaagcctgaactgtaattgacaaattgctagacaactctgagagttaaaaataactgcaaggtgactcagtcataggaagcccccacaattttatgaggtttatttccaggagcttgactaggttctcactgtaaatatcagaaaaaatatcagtcagttctagccatcctatcccacctaaggggaggaaaaaaatggataaatatttgtgaagttcacagaagagaagcacaggcttactaaaaggctgagacctaatcataggccagtagaacacttcccttttcccctcatctcaccaccacattactgaatgactacttataccagtttattctgctcagtacatttatgtttgattatcaaaaaatcacaatgcaggccaggcatggtggctcatgcctgtaatcccagcattttgggaggccgaggcgggtggatcacctgaggtcaggagtttgacaccagcctggccaacgtggtgaaaccccatctctactaaaatacaaaacttagctgggtgtggtggtggacacctgtaatcccagctacccaggaggctgagccaggagaatcacatgaacccgggaggtggaggttgcagtgagccaagatcctaccactgaactccag

SEQ ID NO: 2951 - DNA, 2829 bp, Homo sapiens
ggaacagagtgaaattgctgggcatatgtgttgacacttgataagaaacacagattcccaggtcacctcatagacagggctgcactgggcctcctgcctaggcctgttcgatgaagcaccaacaagccccacagctttgttgcttttgctatgcccactgggaccagtgagagaagtgcggtcttatccctgggaggagagaaagagccagcatctgcaggcgcccacaggatgtcaagatcctctgctgatgtcacttgggaccaccttgcagatagactacttcattccttgtgactgagcctgcttgtgagacagcccagcccaagagaagcagccatatccttgtgcctgcaggaaccaacatcgtctgtgctaggttatgtgtttactcatttgcttacatcctccattcattcattcattttgtcagcccacaacatttactgagcattggctatgtaccagaaattgagaatttcatactcatatagagaaggggaaactgaggctctgagataaacatacacttcttcaaagtcccccaagaagcgagggaccaaaactagaatataaagtcaaatgcatcttatgcctaatcttactactggttgtttctcaacgggccatgcttgtaattacctggagagtcttatgcaaatacagacgtctgaaccccactccagaatcaattactgtctttagcactgggcccgggcctctgtgtttttttaaaactcactgccatccgccccacacacattgtctgactcaggatgcagcaagggagaggaatggaggctcttctgtaactggggctgaaactaaaggctgaccacccttcaccacctgtcacaagccccctgtccccttggggaagttggcatcctgtggggcaggccagctccctgttgttgacttgacatctttgctgagtcatcttgccaaattccacctagacaggctgtgctgtggtttcactgcttgtttgatgattggggtttcctgtcctgccatatggtgagtccctgtaaggcatggcggtaatggggccgcacactggcagatgggcgcttcctgacccagaagcccaacggagctgaagcccccaacttcactctcacctctacctgctccctggaagggtcagagattgaggtatttcaggctaaatatagaggcaggccattaagaaacagcatctcctcccctctccccaatctctctgggctttccatgtgatggtttaattgctcctgcaatctgttccgtttctcccttgcagtgcgggaaaagcagcagccacagcccatggtgagaagctgctttcagagatgggaacagcttttaagaggaagaaggaagcttcaggtctcagaacacagttgcaggcgggctttatttttagaggtctccgcagagattctgccccctgttcaggtctcgccagacaccaggcctggctttggaattgggggttggggggcaggcaccgttttatttggatcagtgtagcaggaagggcactgggcttgaagtcaggcaaacttgtgagaaagtcatttaacctcaaggacaggaaatgccactcgctctggcaacatggggatgtggaggaagggagggagcacagtagatggcacacagtaagcccagagtgtgggtctgccacccttggcacaatacgggtattgacaagagtcttgggctcattagttgtgtggccttggttttcacatctgtaaaatgggggtaataatagcagctgcttccaggactggctacatagtttgcagggccctgaacagaatgacaatgtgaggccccgagttgaaaaagctttaacaatttccacacagtgagagcagagcattaaaccaggcatgggagcacagccttctgagcacagggccctgtgcaactacacatcttgtcacatcttgtctactcacaggggtgtggtgaggaattaatgagacactgcatgtcaagtgcttctgacactggcagcctttattactactactaattgagcatcagatatactgtcgagagcagtgttacccattttgctatggcgtatattagagggagaaatagattaagatggaatttcatggtgtctccaatggcaagctatagttaggactttataaggtaacagtggggtgtaactgaagacttttgagccaccttcaaagttgtgtttaagaattcgaatcaggccaggcgtgatggcttatacctgtaatcctggcactttgggaggctgaggggggtggattgcttgagtttcggagttcaagattagtctgggctatgtggagaaaccacgtctttcaaaaaatacaaaagttagccatgcatggtagtgcatgcctatagttctagctacttgggaggctgaggtggaaagattgctttagcctgggaggttcaggctgcagtgagctgagactgtaccactgtactccagcctagaccacagtgcaagaccctctctctctctcagaaaaaaagaattctaatcagaacattaggtgggtaatagggaatggtggttggggggtgggtgctgaagagagggtactgcctgaatatgagtattgtgggaaaagtaaataaataaatagagacaccaaagaaatccttcctgggtcactgaagagaggtgctatgcgtaaactcagagaaccaggaaaaggagagttggggtggagcgagttgcttttggcgacatagagtgtgaggtgtcactgggaccactgtggatggatataaaacaggacactagaaacaggggagcagggcccacatttgggctaggag

SEQ ID NO: 2952 - DNA, 1154 bp, Homo sapiens
aagtggggaagccactgaatggttttgaggagagagaggacgttatctgacttaaggtttacatttaatcttaataggatgaagaggaacccaaagatgaagatttcagccctgacgggggttatattccacgaatcctttttctggatcccagtggcaaggtgcatcctgaaatcatcaatgagaatggaaaccccagctacaagtatttttatgtcagtgccgagcaagttgttcaggggatgaaggaagctcaggaaaggctgacgggtgatgccttcagaaagaaacatcttgaagatgaattgtaacatgaatgtgccccttctttcatcagagttagtgttctggaaggaaagcagcagggaagggaatattgaggaatcatctagaacaattaagccgaccaggaaacctcattcctacctacactggaaggagcgctctcactgtggaagagttctgctaacagaagctggtctgcatgtttgtggatccagcggagagtggcagactttcttctccttttccctctcacctaaatgtcaacttgtcattgaatgtaaagaatgaaaccttctgacacaaaacttgagccacttggatgtttactcctcgcacttaagtatttgagtcttttcccatttcctcccactttactcaccttagtggtgaaaggagactagtagcatcttttctacaacgttaaaattgcagaagtagcttatcattaaaaaacaacaacaacaacaataacaataaatcctaagtgtaaatcagttattctaccccctaccaaggatatcagcctgttttttcccttttttctcctgggaataattgtgggcttcttcccaaatttctacagcctctttcctcttctcatgcttgagcttccctgtttgcacgcatgcgtgtgcaggactggctgtgtgcttggactcggctccaggtggaagcatgctttcccttgttactgttggagaaactcaaaccttcaagccctaggtgtagccattttgtcaagtcatcaactgtatttttgtactggcattaacaaaaaaagagataaaatattgtaccattaaactttaataaaactttaaaaggaaatgtgctgtgatggcctttttgttattggaaaaggagggagg

SEQ ID NO: 2953 - DNA, 424 bp, Homo sapiens
ttcgtgatcacaggtataacatgatataccaatgaaagtcaagatttgctttgtgacaaaagtaattttagtaaatatttaaaaagcacaattttgaattttggttgtaaattggacgtattccttggttctaagggtctttttggagttcctgagctcagtgccccagaaggcacatacttcatatgaaatatgaaggatttcatactgcacaagaaaaagccttgagaaagacagaattgcttgtggaccgtgcgtgttccaccccacctgggccccagaccgtgctgatccttgatgagctctcggattccttgtgcagagtgaccgacttgtttcgaaatgaccaggctggcagttggctgagccagtctcttagaaccctttgaagcactggatgcaggctgatgagctgccataaacg

SEQ ID NO: 2954 - DNA, 1277 bp, Homo sapiens
ctccactatcttctggcatctaatatgaggatgctttttgagaggcactgcatggacaacggggaatactgaaagacacagcccagccattgaggagcttctccagtggacaaaatccaaataaggataaaatagatggtaatggaaaacactaggagtacttttgaattgtatttcatagtaataagaaatactccagaacaccttcctcaacatatgtgttttagacatacataattcataaggcatactgcctaagcattgaaataaaataaataatcttcaagctgggtgaccatccactttctagaagaaagcttgctatatttatttgtttatcccacaaacaaacatttttctgttgggtgcttactgtgtgttaggcaatgtgctagataaggggatacaatggagactaagactgtgcctctgctctttcaaagtttataggctaatgttctgagaatgaactctgagcatgtgtagtagtagcccttataaagatgaaaactgccacaacaagagttttggggcacatttaaaactaagtccctttagggatccagaagcactgactcctcctttacagcatggtgtcaccgacatgtcaaaaactgttttgattcaaatgctaaaaactattcagaagagaaattctgaataactactgcaggaaaaatataaaattaaacagttgtatccatctttgtgatattcatgacagcaaagggaagcatactacagaaaggaaatagtaaaatgcaaacagaaatatagtgggaaaacttacttctatctaaatagtaccagattaattatgataattttaaaagttatcagtgacacttcttagaacataaggttacacacccaaagttaaagcatgattatggtcactaggtgactttttaccaatgaactcttcaaaaggagttatgcagttggcctaattttaaaaagcaattttaatatctttagtcacacaaagtatatttcattactttatgtgatgttatgattcttttttaaagaactttgcttttacaaaaagaaagcccaaagatgcatacacatagtcacagatttttagatgggattcgttttccttttttcttggtaaaacatgtttttgccaagtttacaacccacttgaacttctgtctgttctttgattttagaatcaacttggaatccttttaacactggaaaaatcatagagttagtcataaagtttttttaaaagtcatagcaaagtttactgaagatatttattatca

SEQ ID NO: 2955 - DNA, 1900 bp, Homo sapiens
cagaggcattgctctcattcagtgctctcgcctccctcctggattgcctagtcagagtgagacatggagaggggctgatgtaaccaccccagcaggagtaaggaggctggaaggaggaaaccagtgatgaaggatttgccataaccttgtcctggatggagagccatggccaaagtgggtggagaggaatggccatgcaaggcagctgtgatggattcacctctgtgcaagacagctatgacggagttgatagaaagtgtgagaacatgggccacccctccttggatgtgtttctttccagattggaatggtgtgattctaagagtcctgggacagaaggagtattggaggtgtcaaggggctggaccggtgaggacaggagtcgaatgtgcccctgatctctgtccctctcctcggggctgcagcccttgtgacatcgaagtgccccaccccctccttcggcttccctcgctgctgcgcagaggccactggagggcgctgtctcctcacacttctggctgagctcacctccgctgtctgaacctccttttgaggctggagagaaattgagaggcctggagccagtgtctgggaggcctctggacacagctggacccaccgaggccacatggggtcagtaggatctgagcctgtggaaggaggtgccagagcaatgactaggagtcaaagtcctgggcttcagggcgagggcttgtggtgagctctggacaaatggctttgtctgttcgatcctcagtttttgtatctgcagactgtggagagtgacccaccttatggcactgttgtgagaagtgctacaaatgagaatgtacatgtgagtgcttcaaagaactcagatgttctccatgccagagtgggttttatttatttatttattttttgatggagtcttgctctgttgcccaggctggagtgtgcaatggtgcaatcttagctcactgcaacctctgcctcctgggttcaaggaattctcctgcctcagccttgccgagtagctgggattacaggtgcacaccaccacacccagctaatttttgtatttttagtagagatggggtttcaccatgttggccaggctggtctcaaactcctaaactcaaatgatccacctgcctaggcctcaaaaagtgctggaattacaggcatgagccatctcacctggctaatttttatattgttagtagagagagggtttcaccatgttgaccaggctggtctcaaactcctgaccccagatgatctgcccgcctctgcttcccaaagtgctgggattacaggcatgagccaccgtgcctgatccgccagagtaggtcttgatggttatcacccttgaagaatcatccagtaacccaaggagaagatcatttggctagggccccgtatgaccttcaaactggcataggcactgaactgttccttacgttctcacaacagccccaagaggtatgaattattatcatctccatttcatagctgggaaaacccaggctcagagaggcgccatagctccccctgggtcacccagccactgggtggccttaccggaattcagacccaggtctgtttggctccatagacttgcttaaactactggactgtcccgcactggcccatgccaagtcaggaaagggtttgatgtgacctactaaagtccctcgggctgaggtttcagctgagtgtcctttatttagtcctttggaggtgtggacccgtatgtctttggtatggatccacatttcagtggggtcagtaactccctggattggttttgccatttttttttctccccttggacttatacgcatgattcttccccctccctgggaagcagagctggccctgtgacataggtggctttacctgcagcttgacctcttta

SEQ ID NO: 2956 - DNA, 765 bp, Homo sapiens
attatctgtgtgctgtttgtggtggttgattatgggaacaaaccaaggtttagccaattcagcaaacatttatggagtgcctgcaatgtgcatgtcactgttttaaggcctgtgcctactgtaaaggtgacccacacatgatgcctgccttgcaggacttggagttcagcgataataagagatgcatacctgaaaagcctatttaagactcttccggttctacaaagaaggcttcttgaaagtggtagctttgattactctttggatttatttacatttatcctataatcagaaggtatacaaaacagactcacacatatataaaattaatagattagatagcatttaaacaaatatttcaggtaggtacttcaaatgcatttgacatttatcaaagaaatggtaagtgctgtcatccgtgggtggctggattaacatgtgggactacttatcaccaattttgttagggatcttagggaaattcctggatcttatattcacaagcaattgtataaatacttcccacagctcagagacctaataggatggggtcttagagaaacatcttttgagccacagacttctttgttaccagaaggaaaatgaaagaagaaatttaaataccacttgaagagagctgatcgccaccaactggcctctgggtggatttggccaatggaagcacctgtagagggaagagagtgaggttaggatatttcttcctgctgtctccgtgcttccctgcagagagtgtgaagaaatgac

SEQ ID NO: 2957 - DNA, 6394 bp, Homo sapiens
ggtcttgctgctgctccctctttgggtccgcactgcctttatgagctgtaacagtcaccgcgaaggtctgcagcttcaatcctgaggccagcgagaccacgaacccaccaggaggaatgaacaactccggatgggaggaacgaacaactccggatgggaggaacgaacaactccagacgcgcgccgctttaagagctgtaacattcactgcgaaggtctgcagcttcactcctgaagccagcgagaccatgaacccaccagaaggaagaaactccgaacacgtccgaacatcagaaggaacaaactccagacacaccatctttaagaactgtaatactcaccgcgaggttcggcagcttcagtcttgaagtcaatgagtccaagaacccaccaattctggacacagtaggatagtgtgttatgaagatgtatttattaggaggtaagcctcctcgaaaaaatcaaaagacctttgttgcaccaaattccttgctataatgattcctgttagagtgaaacgcctatttgcttccagagtataaatttcattccaattggaggaaaaggcttaaatgacttcaagaaacacattgtaaatttgccacctcttttgcattttcctgagatattttcctcaaggaattgacgtgcaaatcaccaaggtctacatatttttcccattacctacaaaagtagtgactataccaattagaaattttgttcactagtaaaaaatcaataagagtacactgcttggacacttacataagaagttataatttttttttctttctgaatcatttctcctaagccgttttctactgacaggagtctgtctcttcacattagtgacaggaagaaataattaagtgtaagttgtcacttgtgatcggaagatccatgaagtaaaagtgaactaagtggggcagatgaaatcctggctgtcctctctacatctgctgaaatagacttaggaatcatctctgaaacattcccacttctaatttccagaatttatgtggattacaaatgagaataatctagatttttcttgtagaatcttgaagaggcattctttatttttaatcacttacccttaggaatatcctcagaatgtgcctgaaattaggacaaatctatgtattatagttagagtgaaatattagtaattgtttaatgtcactacgcctaacttaactgttagtgtgaattttgagtggataaataaggaatatttattgctctcattgttcattcattcaacaagcatttagtgaataccttccatataccagagatttttcaagtaattgagaaaataaagataattaagatagttcacctcaagtttctcccagtttagaagaagataaattagaaaattgatggttagaatatagcatggtcagagctatgggaaaagagaatatcatatgagactggtgaacagacatgaggatgcaatgcttgttcttggtctggaaggatactttggagctatttaggagactaatgatggaagactttgctgggttgggtaaaatgtagcaactgcaataatagagaaaattgcagaaaaaaggccagtgtctgtctattctggctgctgtaacaaaaataccctagactggatggcttataaacaacagaaatttatttctcatatctctagatcctggaatgttcaagattaaggtgctggctgatttagtgtcttttgagggcctgtttcttgttgcttcgtgggatggtgtaaggaacaaagcaactttctgggccatcttttataaaggcactaataccatgcacaagggctctgcacttacgatctaatcacctaccagaggccccacctcctgatatcatcaccttgagagcgaggatctcaacatataaattttaggagaacacaaatagaccatagtcaccaacaactgcaaagtcaagtagatatgaggctgcacctctggggagcagcaagtaatgtggtctagctggggagaagggtaaggaaggaataatgtaggaggtgagcctgaagaaagagaggcaatggtcagatcataaagcctcaaatgcttccctgagaagtttgcattttattctgaagattataggagggcactgtagatttccaaacatggctagttttgtattttacaaggattactctggtattaagatattagcaagactggggataagggaccagttaagaagagaaaaagaaggaatgaagatgccctcccttcatctccatctttttaatggaaagatggttgtgcttctacctgaaaatggaaataatgagaagaagcgactttcttctttgggaggtggaggatgaagagaaaggccaagttcaatgtcactgaaaacaggacagaaggctctgagctatgtgctctgctaagtggaactattttgtttacatgcaccaacgccccatttgcagagaaccacgacgtaatcagtgcaagatacacaaaggtagatttattttgcagcctggcttaaaaacaataatgccaagacctctcaatttcaaaagtttaatttgtttgataaaatgctaagaactgtattgctcaatggtctttatcatgttcagtaaccatgatggatagaattcagatgatgtcttccctttatttaatagaagtgttttatatatatatatttctattattaatttatatagtaatggtacactattcaataatgatgagctacttgtaatggtctcatgaagattatattcttgaaaaaaaggttaaaatatggttttcttttgaaaagcattattagaatataggggtttaaagaagaaacatcatctggttgaactatctcatgcaaatgagaaaatgtcattccaaaagagaaatgaattcattcaagtgcatgcaggtaattgtatcaaaagctgtctaattctgcaaccagtgttatttctatcatactccattgccttccttgtacaagtttgttggcagacaatgaaatgcaatgttcactttcctggagctccaatctccatcctgaaatcacatttttatgcaatctgatattttgaaaaaaaaaaaaaagaactaataaataggtcagattaagttaaatgttcagttttctatatggtacactttgaaaatcactgaaggaattcacagccccaaaatttattctttatgtctgttgtggcatatgaatatatcatcattactgttactttgaaaattaagcttgtgtccttcaaattgtgtttgaagtcatctgtgccctactatattgagggataaactttagtccaaactttttgatacataaccattcccaacttgctagtttggcaatgatttaaaattcaaaggcttggaactgaaacatttttctttagagttatgattccttattacacatgtttttggtgaaatatttttaagatgactccaaatttaaagtctcatctctaagcctatcttactctcccacatcctggtttccattaatacttccccaagaggccagactgtaacatggatgttgtcacatggataaggtaaaggcgaggttgtcatcttttgttccaaaggtattaagaaaagacagcaaaaaaggaaaaaaagatacaaggagtaatatacacagcttatgtgaagaaaaaggacaggtgtttggtttgcctgcactcctctttgcttgtgttgagggcacagaaggcctctgatctttctaaaggaatagttgaaagtagctgcagtgtgaaccagcaggcctaccatgggacttgctaagtcaagggcaggatggaggacatggcagagacactgtgggtgcaatgtaatgatgagagccaactcagaacaaggaaggccagatcagatatgtgcaccgatccacaagttcagtacgagtacaagcagtttaatcagagcacaggcagatgaggaatatcctcactgtccagaaaaaccagaggatcccatagagattgtcttcgcccactgccgcagccccatactgcttccagatgaatgagtacaaagaaatagaagcttgtggaagcttctacaattatatgaataaaatacagtgaaaaactaaggggaccacttaaatgattatttggacttaattgtaaactaagttggactacatgtattttgttttcattttctttctccagatcatttataggagtggggtgtgagtaattttgcaaccctgccgtatatacacacagtcagattgactgtagattctatccctattatttaataaagggaagcagttattacactaatttgtatcttgtggctactcagtgcaaccctggactgactgtattcctaagaaaaggtaaggaatggaggtaaaatatatttaattaaatctacctatttaaattgctcttgtttacataaacttcaaaataggcatttgggggcatattctaaatagaatccctatggatcaggggttcccaaacttttagtccacagcacccttagaattcctgttattttttaaaacaaatgctgaaaaccaaacaaaatgacaatttaaataaataatttaatcttctttcattaagtaattagaaccaacagcctattatattttatgccctaataaaatcattgttattttgaaaagagtaaacagaaattaaaaaaaaatttattttataattaaataactacagttacttactaataggaggtgtatagctattgagtactgcacaatttttcaggccatgcagttatattgggcatggccatcccccatcttttcccaatccatattgatttttgcagagtacttgctttttacacagcaacagcaactgatgaaagctcaacttttcaaggatatgatgatgtcaattatgtagtttagtgcattcgaatgtagaaatggtgaaatacctcaagctagtatttcatatgatgtccaacagatattgggtattacagtgtttcccttaaaaagttaatatgtcctgcagtgtcctgtccctgtgagtttgttgtggtaggtttaggacacttacgtgcactaaaacctgaaggtacagaagctatgttcttttagcccagtgatataaattgggtaggaattatgggattaatattccttgcaatatctctagaacaatgtttggcacttagtgagtaccaattacactttatctattctaattactattattaagactgtccctgtgggaaacaaacatattctagtgaccaagtacagttttaattttgcttcatcacatttattgaaaggtgttcctcattgctccttattcaatggtcccataatacttgcttacatctctattgcagtggttatatataattgcaatttgcctatgtctgactctacctgcaagcagctcaagggcaaagaacactcagtcatttgacatcacaaagtcaaatgacatcacaaacaccacactttgcataacataaaaatatgtttaattagcatgtattgaatgaatgatcaaatgcagagtattaatcttcagtggtattgagcactgagtcataaataacatatttaattatcaacaactacttgaagttgtagaggatcttttcttgaagattttttaaatgtttgtattactaggtctgatttattgagactagtccattgaaacaggcttatacccagagaaatgatttaagcttctatatttgtagcatttgattttttccagacctctccagaaatcaatatggttgtcagggtgatctttatgtggtcatgtcaagcattagatccttacaaatctgagtattaagaatttaacaaaatataaaccaagcttcagggaatgtgaaaacttgactcaatttctttctgaggtaaaatgtgtacttactagatgacctgactcaaaatagttgttcaatgaagatcaaggaatttaactcaggattttaattccaagcatgatttaaatttgtaaggcttccccaggcacttttaagcaaaatgtcttcaacactcaactaaactgagtttaacatagttgagaataaatattttctggcttattatttaataataaaaattggaagcaattaaagaatatgaggttgctcaatttatttaatcttgagttgcagaaaatctgtgtgtaaagtaaactaaaatgaagttattgggtttttctggtaaacaaatctttcacaacatttctaggaagtttttaggtttatctttgcatgtaagtggtgatacagcaaaacgccaaactaaaccaatttgaattttcaagagaaatgattgtctcatcccctattcctgagtttgttgttgtcatcagtgttaccaataaattaataactcaatgaagggacatgaaggagaa

SEQ ID NO: 2958 - DNA, 14917 bp, Homo sapiens
gccacacagcctggtaagtcaaccaacagcctcctcacacctcatatttgcattccagttcactgagtgatttcacacactggctggcaattcttgagcctgctggaaaaccaaccagggattcacctcatccatcactggtctgcaactgccttttgagggccacagcaggggatggagaaatgtttcttaaccagggctacatcagccagtgaagggggatacgctctcaaatgcaaaccctggaaaaccagatggataagaagcagacctggagttcaagatgggctccaaagatcagatgtatttggagaaaacaaaaaacccacaacccaaaggatgggatttcacatctcaagacatctcccaggtaataagtctacagattacaaatcattttcatagaaaatatttttgtacaaattatacaggtattcaggagctgggtcattaatcaatccccatttctattttaacaggggggcaaggtaggggagagggaaaaacagttttggatacaactatttggaaggagagtagatatgaagagggcaaaccctagtttttcattacctacaatcaatgttttttttctttaaaaaaaaatctttcaatcttcagtatctctttaaaagcccacttcttacctactagccaatccaccccaattatttaaattcacttggtacacacctttgtccaccaggtaaattatattcattatgcccactgctgcagcacacataaaccaacacccctgcatggctgaacagggcctaatctaggactgatgggagaagtgcttgcaaaccaagatcaaggtgtcatttctctgctaatactgtctaccaagctgatccctacaaaaacgcacataaaagcaggcaagtttagctactgtgttgcaagagaaaccaggaccttgttaaatagttctctccattaccatttattctctcaagggaagcttaaaaaaaaaaaagaaaaagaaaaagaaaaaacaacgcattggtctggccacctcataaatcccacaagcattggtgtggcatttcagtggagaaggaaacttggggtggggaaaaacccattaaggttgtaaaaaaggctcccaatttaactgtccctgtccctatttatccacctttattcaccacccaagaccattcattaccctagagccctctgatctataaaaggggtcaaagcatcaggagcagggaaggagtgagaaccaaaagacatcaagaaactgatttgcttgagaaaagcagcgattcttcctttcatagctctccatggctgagagagaaaatgcccaagagatcatctatgtgacttagagactgctttttgggacgtcaagagtagcatgaagaacttaagataatgacaagagcctaaatatttaaagtttcaaggtttcaacagaatgtggatgtatttgaactttcaaaaatgtcctgtcacatctttcttcccattacctggagctcctccttttcccaggcattcatatttcttacctcctccccacccgctgcacaaatttgattgcatgaaggataagggggcagcatttctttctgcttctggtcctggttgcccaggttgcatggtatagggaaggaggcagcagaaactctaggccacagaggtgtggctggctgctctagggtggtgagatacaagagactgcaggtgcttggtgcccatatcatggagttaaggagccccaggtcagtgagggaagagtaaagtgaggaagagtagggatgggagagaaaaggttaataacgtgagcaagatcagctggatataacagtctaagttggaagttttttttccttcacgactttaaagactgctttctccattgctttgtagcatttagagttgctgctgagaagtctcatagtgttattctttttgataatctgagttttcttcctgtcacatgtaagatttcctcgtactctttatgttctaagtctcattacaatgctcctaggtgggaatttatttttatttattcttctggtatcaagagagaactttcaatctgagatttatgtcttttgaactggataattcttaggacaaaagctctcatgttaagcatcttatgttccttctctgtcattcttttcattctctttttctggatccatatgcatgtaaccactcattcatatatttgaactctttgtctttctgtgttgaatttggtgtgaactcctccttatgatcttcccattcaccagaacttcccttactgagtctagagttcattccatctattaagtattttttaaaatatcaagggctatatttctatttggttatttttgcatatttatctcttctcgctttatttttgcctattttagttccatgacggctagttctttttataatcgttattctcttatgggtttctttaagcttccttgttttaaccaatatgtcacactgttcattaaagttaatttccttctggagtgagttcatgttctgaatgaatttgtgttctgaattcatgttctgatttcatattttattgagtatatttttttcaggattagatttcgtgaattttgcaattttgatttgcaggtttattttaaaatgttttttgttgttttcagtctttttgtctctcctctgtccctgtgactgtttctctaaatccagtggttttgtgggtgtcttttcacccggctttctggaattccatgtcagaaccaggtgctataaatgcagctcaaggctctaggtcatgacaatgtcacagatatctcaggtccagtcaccaagccaacatgtggcttgggtctttttctggtttcaagactgcatctgtatcctcacacctccctgggcccacagattccataagtcatagctcggtctaagagcaatgcttcaaattcaggtcccttttctcaggtggagtagtagacttcccgtcacccagccaccgccacctgattctggacctggagccagcaggcccgtggcttcagcccaactcactcttttgtattctattgcttattctcatcatggaaataatcatctttttttttttgtcttgaactctgcaatgtcatcatttttttgttttttttttctagtttatccatctttgccatgtgcttggggaagaatggcaatgcgaaagtgtgagcttcccgtcccagcttattagaagcccacagctgtttttaaaaaatctacctttccggctgggtgcagtggctcacacctgtaatcccagcacttttggaggctgaggagggcggatcacaaggtcaggagatcgagaccatcctggctaacatggtgaaaccccgtctctactaaaaaatacaaaaaattagccaggcgtggtggcgggcacctgtagtcccagctacttgggaggctgaggccggagaatggcgtgaatccgggaggcagagcttgcagtgagccgagatcgcgccactgcactccagcctgggcaacaaagggagactccatctcaaaaaaaaaaaaaaaaaaaaaatctaccttgccatgctttcccttttctgtgactgttaattagtacataggccatgggctgtcatgcttaaaaactgaatgggaattttgtctttagcagtgttaggacgactggctgattataaaaataataggagccgggcacaatggttcacacctatagtcccagcactttgggaggctgaggcaggaggattgcttgaggccaggaatttgagacaagcctgatcaacatagtaagaccccatctctatattaaacaataaaaataataataataggtcatggttttccctgtcaagggtcaaactgttcttactgaacaagagctctctgaattgagttgcaaattctgtggttcctcaagatttacatacagaaaaagccaagtatattccctcaagatttttaaaaagatatgtaatcacgggattttagagctcaaaggaatatcaaaggtcttatattataggcccctcatttctggatctgcaagaagaaacagaaattaaaggtcttgctccaagcttcatggtatactggtagcaaagctagagctggttgggttcttctagattggtatttctccaacaaaatcatccacagcatatatcaaaagtgatataactaggaggcttgataaatgatttctacttaatgtttaattatttacaaagcaaaggtattttacacccaggttccttaaggtctcagtttcaatctgctgtgttttttaaataaaaatatgtgcataccagcatttttttgctccagatagaaagctgaatttagccagtatgctccttagtccatctatcacatggcagtaacctattaagtgtctaatttagataaatgtaagagatttaaaaaaataagagtagataaaataatagaagtattatgtatttcagggtccatagacacaagcatcaaaagctgactccggctgattagtcaaaaaagtaatttattacaaggattttgtgtagctcacaaacttgttgggaaggccagagaaccagacctgaggacaaactttcggaaatggctcaaaactttagaactggcctgttgagaaaaatcagtactgctccaagcactgaccactagatgatacatgaactagatgcttgcagcaatttgactttactgaagctacgactgccccagcatcaccgccatttctgatgtgaagacaccctccgcagtatgtaggtgctgtttcagtcttacctctgctgaccctgaaagccagtcacccctctcacaatcctcagcagcacaatgaattctgcctaaagcttctttcttcaagcaaggctctgctgtgcttggataatgctaattgggggactctcattcacaagctaatgagctagctgcaattgaggggctggggaaacaaattttctatctgggaaaaacagggctttaaatatggagatttacccaaatgcagcaacaatgttcatgtaccaagcaactaggaaggttaccaatgaattgccaagcacataaaggagttaaggtgtccatgaacggaggtaagatcatctactgagctagacagtctccatttacccttctaaacccttgctccacccttctccactctacacaatgcccttgaaggctgaaggctgactacatggtctgcatcaaccagctttcttgccctctgcctccagctgggtttggccagtgggaggggctggcaggagctgggaaggtggcagaaggatgaggtttgggcatttagtttcctcctggctgggttgcaggttgtttctctcctgacagcccctatttggtggccccctcctacagctgcccctcctctctcctgcccttcaggcccggtggttcccactaggaaaccctgggacacttaccccatcccttgggttttcccttacccttcactacacctggtaaatagtttattttaaattctctcaataatcccatttgcatgtactatcagttccctgccagaatgctggagtatattcaccttcactgtgacaaatgctcagatcttattttctcctgtcctcaattaaagtactggaatatatttccttttgttttcttctcaaacgcagatcactgattaattgaattagaagaagataatattttaaaatatgatagtaggagaaatcattttaaagttttggaatttattttatatatctctagccaagttattttcagtcctgggcatgcgatataaaaagctctaaaaaagcatgaatttgggactctatttcagtccaggagagactatggcatatacatctttcattttttttttttttttcttgagacagagtctcactctgacactcaggctggagtgcagtggcatgaccttggctcactgcaacctccgcctcctgggttcaagcaattctcctgcctcagcctcctgagtagctgggattacaggtgcatgccacaacacccggttaatttttgtatttttagtacagacgggattttgccatgtgggccagctggtctcgaattcctgtcctcaagtgatctgcccaccttggcctcccaaagtgctggtattacagatgtgagctaccatgcccagctcaatatatcttaaaagaaaaagaaaaagttctcctgctggttctcaagcaaaccacagatatatggtaaggaaaaagtgttacagtaggtagctagtcagacatgagcagagcaggagagggtttctccttgttccccccccccccactacacccccccttccaccacacacacacaccaggaatgtcaggtgacaggtgagggtcaggcagttgtcaactgtctctctaaaataataattggtcacagacagtgccagggaaaggcagtccccctatagatagaaaaaacctgaaactggtgaccagcagcttcccaataagatttcaggagctgggtgagtgagctcgagcatgagcattaagaagcaaaatggtggagtttaactggtatatgaccttcctctagaaatgcaagattggtaaggaaagaatgccccaagtgagcatgcatacaacttcagtaaacacatggcgcatgtccccatcccaggtgctagcaggccattgcgcatgtggacagcccatcccaagggaagaatcggggaaaagggataaaagaccccagaagtatgtcaacttataaaaccccaaagtcaaattacccacttgtcttgcaagtcacccacttggctctcttcaagtgtatttctcttccttttgtttctgctctaaaacttttaatatagttttactcctgctctaaaacttgcctcagtctctccttctgccttatgtccctcagttgaattctttcttctgaggaggcaagaattgaggttgctgcagactcatacagattcgccccagtaacttggatactggccactggtaacatattttggtgccgtgggacttggataacttctgccactaacatactttgatgctgcatgactcagatatgttccctagtggtaagagacccctctaccacaccttctttggctggaggcattcaatccttgtacatggtcttctccttttctctctcctgcttgctaaccaacccccagaataagtccttcagccataagtgactctgctcctcttggctgatttctcagttcactctgatggatggcttccaggggtgggaaggactgtggcatctgcaccgagtagatctgaggcatgaatggccctcctggacaggaggttcaccagaatggtagggctgaagcctaaaactgtgcaatgtctggggtttcctctgctttttcaactaaaattggctctttcccaagaacctgcactgcctattctcttgttttctctgtgtgtatgttctgaaaaggacttgtgcaccctctggaccatctgccacaggggcaagtctgtctctttgctcttactttgcatgccacgtgacctcttaaacacacactcccgcagctcttatgcatttgagaggcagcaaagacatgggcttccttgtggatatctcctgagatttatacttgttcttgttcttaccttaccagcttggatgactttcaaccctttcaaccctgtctgctgacacattgccgggacaaacactaattggaactccggctctgccagctccttatgacttactatatgcttttccttcctgttacaccccagggctgggtttcctggtggcttttgcaaataggtgggatgcttaaagggcagggtaaggccccatgcaggcagacaaactgcttcaaaagccacccctcttcctttgccccattcgtgggcaaaggaagaatttgccctcctctgccagttattagcccaagccccaagtcctccggaggttactactttacgtcaacagggcaaataaacgttgtcctcttgaatccaagggctgctatttttgcaagcatatgaaggctttccatgagtattcctctcacttcctcccacttcttcccgtagacttcatttctctaattacttccacattcttctcaacatgaattaggaccttcggggtcatattcaaaaggagtggggagggaagtctagcccccttgtggcagttagctgaaaaacaggcttttgtctgcttaacatgggaaatgggaatctgagaaaaaaggtcatcatttttattgctagaatgctccaagcaagagtcactataaagtcatggagataagggtataggccagcccaaggctacaggtgcaagagacaaaagtacccacaggacagagatgaagggtgctcccaggctaacagattatcattagaacagagatgaaaggttagggatatgcagtaagatcagttattctggaacctcaaggatgaacaggcgatccactgttcactccagtatctcctctgttctcaagtgggtaattgtgatgagatgggaccaagagtacacagtaaggctggttaattccggaacccaaaggacaatgggggatgctccattcaggataataggaatgtagagggaatgccttcttttttctttttcctttttttctctcctgttctctctttgcagatgggtaatcacattcccataccacaggacatgcccctgggatgcatcccccaaaactaggaaaagtttgattctaccaaatgttaaaacaaaacaaaaaaaaaccagttttcctttgtaatactgtttggcttaaaaataaactgggaggaaattacaaaagtcagccttggaacccagttcccctgtgcaggaggtcctcagattagcctcctcagtcttttataagtgagagtagaataaggaggacagggctaagaaaaaggagacatgtaggacaagaagcaggctcaactattggctgctttacgagttctccaaccccctctaggttgccctaagaacactcatacaggacaaagccaaggtcacctatggaggcggcaagtaaaattataaatttcccttttgctttcaagagctgcctactgtgtgctaatctccttctctaagcaactcccctccaaatcctgttgggtaatggggccaatggcaccccctccaagagattcacatccctttgggcaaaaatatacttttcaaatgggtgcctgcttaatacttacctgaaatctgaatttgtttttctctctaatagctatatttctcctgggaaacctacctaaatctttaaccagcaacttcaacctggatggtcttacctcaggagtttagaaatagctcaccattatttgggcaagtcctagcaaaaatataactgagcaatttcttgagggggagataacttctatagtatgtaaataacctcatttgcttccccgtcacagaacttgcacagcaactttcagtacaaatcttaactttctaacagaaggaatatgacttttgtctaattcaaaggttgtaaagaggtacttttcataaggaagatgataaagaaaagagatttcatatgagaaaggatcttgcatggtaaattattgtcctaaagtaaaatgactggttctttaaaaagagggatatttaggacaagtcagaaagtccaagcctgtcatagatgatctgtgtaaattgtgaaaaatttgtgaaagggaatttatgaaagaaatgttctgcaattttaaaggtttttagacctactaaataaatgctttatagactgccactttgacttttaactgtacaacttgactattttaaagctaggcatggcctggggacttacagagttagccattcccccaggtatgctggaaagagaccttatatgcacttctgtctagtgaatcgcttacttatcaggtttttcgcaaaagtaaaagttgtgaacagttagccatgtaacatgttcttgagactactggaaaagcagtcttacatgtaaggtacgcaaggaaagtagaatgtgcttttgttaaaagattgtaagaaggtatgggaatgtaagttttgcctagtttggagggttaaaggattgttttatgttagataggataaagctgaaggtttgagcaagttgtggaaggtttgtgaaaaattaatcctataaaagaaattctatgtgtgaaaattacccaaaattaaaggacttttattcagtttattcataaacactggaattaaagcacaacatagttttattaaagtattaatctgcttttgattaaagtgttatcagtacatgttccaaaattatgtgaaactcctataattctaatgtaacatagtatacattattaggaataattataattatgtttaattgttttgtgcctcaggggtaataaatttctttgtcaattgtgtctttgattgtggctaccctaagactttttgtcattaacagataattgttgtcttgttttaaccctctttaaaaggtggttttataatcagctatagaactctaacaggtgctcctaaatacaggcttctgataactttgaagattgagacattagaatagagaaaaaactttcaggactcttattggagagctaaaatgttcatgaatatcaagcagaacaaaagttaactgcatggactaaactaatagaagattgaaataatccttttatgactttttgcttaaaatgttgctaatcctttgttttccaaaaccaagaaaacttttcttttgagctatttacagcttttaataattgagtactcctgtaaacaaaattcgagcatatttgtttctctctacctgctttcttcaaaatttggaaactacttgtgagtattcttaacttatggcagtatagttatttgcataagtacaataagaatctgttgtcttttgcaacagaacacaactggagaagctggttattttacgaaggctttgactggaatgatatgcattcctttaaggaatcaaatttgacttatatagccaataaaagccccttgtgaaaactggcttcataccttgtctacacagtccctgtacagggttcccaacctgtggtctgtaaagaatgccactttctaacaggctcaggagccccaggttatcttgggacctcaagggagaggaatttaccaactcattcaggtatttgatggtataaaactgtggctgggtttaagccttaaaaaaagtcttgtctgagattccttatggaatgaagttccatcaaagccaatttaaacaggagcctattaggcaaataattattcttgctgtgctttatgcaaataatcaggccaagtataagacaactaaagtttattttgcaaacaaatcagttttatcatgattttttataaaaatgaggactggaaagagaaaaagtgtgtttcaaaaattatgatacacctgttatttttctattaatagatgctagtctcatcagttatttttaagtttttgcctgcattttagagtaatcctgcttattcctgtgaaccagccagtgatctctggctgcagctcagaagaaacaaaagggatgggtaatgtaaaaatctggatcagtattctaattctgagcacatattggaatctgctatcaaccccatgtacccaagtcttagtaggcatgactatagccaccagttacctgggtgtgtaggcagcctcagggttcttttttggggctgtcctcaccccattattttgttttaacattcctctaattctaataacctgatttgtctcctctagcctttaggccattgagctccagatgaacctcagtgagggatagtgtcctctcaatattcaagagttacccttctatgggggaccccctagactgcccatcagtgagacacaacagaggcaaaatcctgcccctctctcccttggacctggctggataccagtttccccaatccatggaaacagcctcctgctctgacaactagcaagaggccaagactcacagaaccacctacaaccccccaacctctgtcagcaggaagccattacagaaggctcaccttcatccattttctccaaataactggggtcttggactcttgaggggggaaatgctatagtaggtagctagtaagacatgagcagagcgggagagggctccccgccaaacccaactaggaagctcaggcgaccatcagatgagggtcaggtggttgttaactgtatctctaaaataataattggttgcagccagtgccagggaaaggcagtctccctatagatagaaaaaacctgaaactggtgatcagtagcttcccaataagatctcaggagttgggtgagtgagctcgagcatgccatgatggagtttaactggtatataaccttcctctaggaatgctagattggtaagggaagaatgccccaagtgagcatgcgtacaattccaataaacacattgtgcatgttcctctcccaagtgctagcaggccattgcacatgtggacagctcaccccaagagaagaattaagggagaaggaacacaaaacccccaaagtatgccagcatgtaaaaaccccaattcaaaggtcaaaccatgcaccatgaaaaacaagtgtgcacttgtgttgcagattgcccacttggccctcttccaagtgtgcttttttcctttcatttcttttgtaaagcttttttattttattttattttatttttgagacagagtctcactctgtcacccaagctggagtgcagtggcatgatctcagctcaccacaacctccgcctgcttggttcaagcaattctcctgtctctacctcccgagtagctggaattacaggcacgtgccaccaagcccagctaatttttgtatttttagtagagaagggttttcacgatgttggccaagctggtctcgaactcctgacctcaggtgatccacctgccttggcctcccaaagtgctgggattacaggtgtgagccacctcgcctggccgtaaagcttttaaataaacttttactcctgctctaagacttgcctcagtctctccttctgccttatgcccctcagttgaattctttcttctcaggaggcaagtattgaggttgcttcagacccatacagattcactgccagtaactcggatacttgccactggtaacaaaaggattcatagaaattcatagaaatggtatcatagaaatgattcatagaaatgaaagaggaaatgatagataccggtcccacctttgcacatattccagctgacatattgccttctcaataccacacctctgagagggcaaaaattaattacctgagtggattttttttaatgcagaataagattgtatgtgcctgaattcttataaaactctataaagggcttccatgcttaaatagctatttcctctagtagcttttgattgatggataattttctcacattctaacagatgtctcagccatttctgccacctgtagcagaaaatattctgcacataacacttttactaatataatacagtaatgaatcaatagaaatattactgcactctgctttaaagaaaagacatctcaagaaaacaaggtcagctcttccagggatgctgtctggaagcgctcagaatgtcagtgtttgacatattgtcttaggcttcctacaacagcctctaacagaactctgctgtactgaacccctagtaatagaattgtttacctttacaccaagaaggatggaaaagcaccaaaatctgcatgtggtgtgtgcccaggccgactttgagggatttctgctgtgagacctaaagttcttatgattggccagtatgaaaaaacatgtcagcagggcctaaggtgtcccatgtgtgccaaatgtgcctgtgacaagttgaaaggtgctttccttatcaagaaggagaaaattgtttcaaaggtgttgaaggcacaagaaagtaagaaagctaaatttaaaaaatgaagcttttttggttataaaaaaatcaaaaggcaacagcagcaacaagacaaggtcaaaatgaggtaactgagtgaaaaaacaaaaacaaaaacaaaacaaacgaactgggggccaagcatggtggctcattcctgtaatctcagcacttgggaggctgaggtaggaggatcacttgaacccaggagtttgagaccagtctgggaaacatagggagagcccatctctagaaaaaaaattacctgggcatggtggcccacagatactcaggaagctgaggtgggaggattgcttgagcctgggagttcgaggctgcagtgagtgagctatcatcatgccactgcactccagtctgggcaacggagtgaaaccctgtctctaaaaaaatcaaaatcaaaattaactggcagtacaggttcaactcctccaaatctactcttggaaccatgtatataattactgatcttcagaatgatgcatgggaactgcattatcatcagtctttaaaaattgttttattaagtttacaatttactaaatgtcttttatgagcccagatctcctctaaattttatggggaatgaagaaatatgatacatggcacctgtcctcaagcagcttacagtataatggaaaaaacagggaaaattatttaaatcatattaaatgcaaagttgtatggcattcaatgtagagaagttcaggtaagactgtatgatgcatatttcagtgtttctaactggtcaaccagtttggatgagtgaatcttggtggatgacccagtcggtgactgtgagcacctctccaagctttctcttaatatggcttgaaattgtgttttattttcagcatctacattataaactacttctaaaactgtttcacaataatgcttctaacactgttttttaatatcctactcttgtgc

SEQ ID NO: 2959 - DNA, 2014 bp, Homo sapiens
ctgtcatcggcaggcagaagtagaactcgtttggggccgtggagcctaattgtaaagagcagtcagacttggaggaaatggttactaaatttgtctgaatcggaaatgcacctcctttagtggatatgagatggaacgtcgcagttgcttcctaaaggtctccttttcatcatcctcctgaccttttataaaagaaagaagcaaagagaagaatgaaaaatgcacgagtcactgttttacttctttcaactcccatcgctgatgttgacatggaccaacagagatttgaaataaagccagtgtagcgggaggagtggtgaactccagaattttgggactaatccccaccatcaaaggctgggctgtgtggtacaagaaaagcaggatgtcagtgagaatccggcattgatctcccccgtctacaaacatgaatcaagacgaagtttgcccctgcaccccacctcaccctccctctcaacagggccatgcacttgcttctccttccagaggaggggcgtccccgtgctgctggaagaagcacttggaacactttctcttttgcttctctttttttgggaggttgttgtttttgtggttgccattgacttcgagtgtggctgggggtgagttgcccaatagttgtggtacgtctcagacactctgtcacccaaatatggaactgtggcagcagaaacaccttatgaaaatagcatgaaaatgtgtaatgtgccataaataaacagaaagagaccgccaggaagctgtgctaatcaccgctttgatgtcgcctgaattactgtattttttaagggcctcgtgtttctgcttgtttgttgcgactcagctgccactgctctatgaaaggttggatccagttttccagctcttctcccctttgcagtgacagctgttgtcccttgactcataggaaagcgatttctccacccttccctgactcccagccctttcctggcaggactcctgcgaaccttactcttcgtccctgccctgaggtggccgagggtgaggacggccgcttggcctgagtccatgcgctcccaaagttcctgtgtcatttgccagccggtcccaggactctgcagcaacgtcctatttttaatctctggtaacctggccttctcttatttggccatgtcatgtcgggaaatggaagtttggcttgacttatgtagcaaagagcttgtaggagcacaagcccctcgctgagcagagcttgcaggaagaaagccccagatccttcagttttgggttgccagggctttctggctttgcctacacctggcagtcactcaaaaaaagtcccaatcctgaattgcttctcataagtctacatgttcttaggtttgataagagctcaaggctgctctccttgattttaagattctatgatgtcacaaagcgcaggtgaatgccagacactgtttcctttctgtaactacccaggtaaccacttgcacaagtgacctgtgggcagccctggtgcaagttccgtccatgcccggggcaatcccggctccactgctgggtccaggaacgccctcttgtggttggaagagctttgaccgactttattttttttaaaaaagaattacattattaaacattttctcaatttttgtgttttatctagtcttgggagtgaaaaatgctagtttttagttgaggataagtaggggggagagaaattagaggtagttttaccatcatcatcattgctgtattcaagccccagtccaccgagcttgtccttccagcctggacattgaagacgtctctttaatggtctctttgccttctggattctgtgccctcacctgcgtcaaaattaaactaaattttcttgaaacactttgtttgtttttgtccctgctttgttcagaaaatgtgaaaagctgccctctggataatttaaaggctgaacccttcataggctctaggttcttctagagtcttcgtaaacccagttcgtcctctcccaggagcgtctctgtcc

SEQ ID NO: 2960 - DNA, 6779 bp, Homo sapiens
cactggcttcttagcagtagctttgctgggagctgcggtattccaacagcccctagtgtcggctgggatgatgtgacttgggggttaaatgcagtttgcagtttcaaaaaagaaaagcatgatttgttgaaagaggctcctgaagaagaacatataaactcagatccctctactttccaagtgtgagaagattttgttctacagtcgcttctgtgagatcaccacagccctggcaaaccaagagggaggaaccttgtgcctttgaagtgtgattcacagtgcttgataaagtgccagtattctctaaattttaggttcacagcaaattggatggaagttacagaaattcttctatttttaattttaaactaacatacgacaaaaggatttcctgatttatccaccatttcaaaaaaaggtccgaagaaaatgaaggagcctcttcctgtactcatggtacataaggccttcaggagcttccggattaacaccttgtattcccagaacttgttgacaatgggttcatggaggagaaacctgatgtcttcgataaggtaacagaaaccacagaaatcaaaaccgtggataagaggagactacagaaagatttctccttctggagtacatgaatcaaattgcattgaatcaaaagttttgtgaagatttgagatgagaatgagagccaaataagccatatcataagaagctgtgatcagaaataaaatgaggacaatgcttactgtggctttcaaggcaggagaaagcacacccgagggggtcgtgtcccacactaggcagatctaatggtgccacaaaagacaggtgttttgtcagatttcagccacacactttcacacctgcaacgcattaactaccgcagcaatgttaatgaagaccaggtgcctgttctccagcataaatgaggaactggcaggagatttgctgtttgctacctgacgtctacccctgagtctctgaaccccgtccttctggttgaaggggaaggtgtagtgatgtacaaaaaatgattcctgttggacattcaacacgatactccaatgtactttgaacacgtcatgttctgtgaaggtaaaaattactcctcaagtttataaagtaaggaccttcgggactggcacgacctcattatggctaaccagctagctcccctcagcactgttttttcctgctggtcaccagtaagtgagacaaacctgtcttatcaaccacaattgttattgcacctacattgaaatattatatatgcgtgtttgtgtagtttttatattacgatgtttcgacatcttaaaaatactttcttgctcagaatagcctgccctgtggtggaggtagggggctagccaatttttaaagactgctaggactctgctgagcatgacttcaatatgcaaactaatatagagccatccctcttctgtccagtttgtacactccaggaggcaatatttttctgccttaatcatcccagggccaggtaccagacaactaagaccaccattatagcttagagcccaccaaaactattcaaactagccaatgtgaaactctttatgctgcattgccttgtctttcccttgaaaatctcagttaaaggctcttgtctaaactttcccctcactcctgtcttctgcctcctgctcaccctggtgtctttcccacatagcactacacggtgtgctgtgcctcctctctctaggatctgtgaatataataaagtttcttctttcctgagcctctcctgtctcctcttgtggccactcttgactgaccatcacataaaagaacacaaagcaatttcctacagaattgaggatgtaacttgtacttctctttggcacaggggagcaaacagtttatttgataggcggagagtgaattgagtctgagaagttaaaagtaaatgtacagttttctcctgatctgtggacagaacataagcttggaacatgcagctgggaaaaatcctaaagtatggattcccgatttgtgagtttgtgaggctatagaataaatactgtgacggttgttacttagtggcagctgatatcatctgccagttttgcatatatttctcttcattttctaaggcaaaccacagatgttttatcccttgcaattgcacctgcagacctaaaaccagttaaaaaaaaaacatacacacacacacacaacaggatagcagatgtttcgaaattggaacagttatgttattggacatggaaaaaaaccccaccaaaactattctactttttgtcagtacaaatcctaggaagtaactcctcttctcaatatggtacaaagactaacagtcctgacttttcatttcccctaatccagagggcagttttgacattttatttacgtaaaaggtgataggttttattctagccctgagattcaactcacctctaataaattgtcccacagtattcctgacccactagcataaaataaaggaatgcttttaagtcatatgagggcaccacatttgctgatgcaaaaatgtgttactctgataggaaagttaattaagcaataagacatgacatgacgtgaattattgtgtaataactcatgcctttggtgtagctaggcacaaacctgaaggccaagtacccctacagcatctgggcatgaattatgctacaataattcaagccctgaagcattccaatgaagcaggggttgggagctggggaagaaaacgaaggacaaaaattgatctctaataagtaagaggatgaaaaggagttgtgttgagaactgcatatgctccccctaaagcagtgcatttatgacaagcatttgaggatgaaggacactgggattctttttatcacttctcatagctttaagaaaacactacaagcttccaactcagggcctggtaccatatgctgaggaaaatgctttgctggaagtatgggcacttggggttcagcaactgcagtggattctttttgacacaaagtgggaaataactcatctctcaataactctggacatttctcgttctgccctctgattctggggaaatagatatcttaagaatcagaattcacggctcatgggaggtgggggtccagctacacaagtcttctgatccatgaaatgaataccatttcccttgcttccctgtatcccacattaaattggggtcaggttttggcatcagaaataaggaaatgaagaagtcctggttccccaggctttcatttgacgtgaagaactaaagacaaaccatatagaagccatagcacaaagactgaaatacaatgaacctattaggtatcacgtccaaaaagtgggagcaaaattaggtccacagaaagatctttctgcttattttcttccctttcatgggcatactgatttgatgaatgatgatgtacctaacaagtcccagttagtggctatggtcctgttaatctcacagctagatgatagcttgacagccaatcagatcactctttgttaaaatccaatttaattaaacaaaaaaatctacaaaggaagcagcattttcctccatttaaatgttgacacgtaaaactgttgagattgacaagaacgtgtcctgtccagcctcactcaactcaagctgcacgcagaacagctttactccttccctcttgttctccttctttaaccttcagccacagactgcacggagatgagcagttcagcaaatctgcgacttcagatcttacaagtttgctggtaaaattccaaaattcatagtcagaccatgcctccctccataagactaacatatggtattaacaaattttatcaacactgtataaagggaacggctccagaatgtgtttctgttattcttacagttactctgttgcctttcagcatggcactgatactgcctctctttggtcctgtttgaaatgcttattttaacatttatttcttctcttaaatggcttcatcctggaattccttctttatttggtaagttgcaattcagcctctttgttgagcaagtggagatctcataatttcctatttatgttataaaagtttacagcgtatttaacaaatactccctgagggaaaaagcgcattttgatgaacaaaaagtagtctacagcaggggtcatcaaactttgtgtaaagggccaagcaataaatgctttcagctttgcagtcctgttgaaactacttcacactgccatcttggcataaaaggtgccatagacgatatgtaaaagaatgtgctagcctgtggtccaataaaactttatttacaaatataagcagcaggctgaattggcctgatagctgtagcttaccaacccacactgtagagagttcaagggaagggggccaattctgttcccgcactttagattatgaattcttaagagctgagaggagggtatggaggcagggaggttagagaggtgggaaattcagctgtatagtaaaagataaaaaatctggaatcagataggtgagtgattgaattttgatccagccactttctcctgtgtgactttgggaaagttatttaacttctctgatcttcactctcctcatgcttttataggcaatccttaactagggcagaggctgttaactattcataaacctctgtatctccttcctgggctcaaagctagactatatttcccagcttcctttgcagcgatgagcttctgtgtggttagaatctcatcagtagaatatgcagagagggtgtgtaccagttctggtctagtgcatttaaaacagtgggactcctatgtccacactctccatcttggtggctggaatccaaacttggtggtgtagccttcagcacatgtacaagataatgcaatttgggatgtggagagacaagaaggaaggggtcttatctctgaatggctgcatggcacagcactgcctcatgagcggaaacactcgttgggctgttttgtgagaggaaaataaacgctgttcttgaaactcctcattttagtgttttcttgctgcagcagtttagcctgaaggaaacaatgcagtatctaacatatgactattacaaatctataaaataattcatgtaaactgcttggcatttaatgggcattctataaaggagagagagcttttatctgtttccttattcaggagggctatggtaaattggccttctcatatccatttttcttcattgtggtaagaataatctttgcaaaatacaaaagtgattatatcatcatccagcctaaaattcttaacaggccacttcttgctgttaagataaaaattagaattcttaccataaatttcaaccttcctgatctggcccttgctgacatttgcaggcacatctcttgccactgttgccctagctcttccacctggtctctctgttctccttgcagttatctggacatgctatactcttcccacacagtttcattcaggctatgtctggaaggctcccttccccatgcaaccaaatctcttaactagagcacattctttctgatttctgctcaaatgctttggggaggcttccttgatgccaattgtatgtttttatttactaaaggtattatatacccttcgcttctaggatggatctcaattctgatgggaatgtgtagttattggaagtctcccccactagactgtaagccccttgacacaggaatctgcatatatttttgatcatgattaaatctcttttaacaactcgcaagaatttgaacaaatgttgtgccagagaagttgaatctataagtaacattttatataacataaattaacaataaattagagttatttacaagaatgaaactataaaaataacaggagaaattacagataatttgcaaaacataatctttgaatgcggaagcctgcttgagcaattatattttattatctgaaactaaaatttctaatgcaagaatactcaccatagtaaaggcacaaaagcatatttacaaaacacattagcatgaaaggataatttccttgatataggaagaaaattataaataaaacaattccagagagaattagaaacatgaataagtaacacacagaaaaaagtagtttataaatatatgataagacattcaacctaactttaaagcaatggaaattaaaattacaggcgtattttcaccaaccatatcagcaatgacaaaatgactgatgatttcttagggtaaaaatgaatcattatatactgatggtaaaaataaaaattgttgtaaaacctctttgattctatttggcaatatctgtgaaaattttaaatgcacacatcatttgacccagtaatgtcacatcgaagaatttgctctgaactgggctgtatgattgttcttcaaaatatatatgtatatgtgtatatgtataagcgtattggttacagcatagatagcagtagcagcactctggaaactgcctaaatactcattaaagtagcacaaaataaatgagttgtggtatgaacatacagctgaaaactataataacattagaaaagatgacataaatgtatcagtataaaaaatgtcaactaccagtaattaaaaagagcaagtgacagaataatgtatatgctatgatgccatttatatgaagaacatacgtagagatatataagtataatgcatgcgcacatgtgtggaatgggtggaaaacacgtgattttgagctttcgcaagtgactaccttggggaatgggtgtgttaatggcaggtaggtggggtggggagatgaggggtatggtggaaaac

SEQ ID NO: 2961 - DNA, 3933 bp, Homo sapiens
ctctattgaactggaagttaagactgccactaggccactttgggctccttatgcctgggtcaacaggccaaggagggagttatagtgttggctgcatggctgatctgactactaaggggaaattggactactgctcaacaatggagattctctctggactatttcatggctcaggaaccacatcctccttccccacttcctgagtgtatgggatggccacatatactgaagctcaatcttatgaaaagagcatttcagaggcaggaggatctggatttgaattccggcttgatcctgggctgaacaggaccagttctgctttctgccctggggcaagttacccaacatcgctgagcatctgtttccttcactataaaatgaggatgatgataccacgtgggattgttgagaagataaaaagagaaagcacttgaaaagcttctaaacatgacctctcacaaagctgttcaataactgttagctcccttttctcctccttgcagctgctgtttcctggagttgcaaacgtttctaggtgagctcatgtgagaccatctgaaacattccaagaagtagtccagatgtaaagacagctttatctttggccaggtgcagtcttactagaatggcccatcctggtagagaatcatgtggccccttagacaactatgacaccaggaattggatgaaacaaagtttcagctacaggatgaggatatatagataaatgttgatgacatatttctttccttttttggtttccttttcccttgaaaatgctttcagatctctgagacatcccgttgtcatcttcctcttttaaaacccttcgtgtgctcttttctatgaagggctggttggcagctgatgaggccccaggctggaaggaactcaccggctcatggctcaccaacccctaactacagctgggcaggcaaggagggaggctgcaatttcattcacttctttagattgatgttttgacatctttagaagcctctgttaaaatggaaatgtggaatctgagtagtgtggtcaaactggtatacgaggacattttggtggtgactcaagtctgatgaagcttttctagtaatttgtgccttccatttcctaggaacaagagtgagtgaggactaaggacacaaaacagcagcagtttcagccccactcctataatattctaaaagcttgtccttagatcttgatattcttctctcaggcagagagcttaagaatattagagaaatatcctgatacttttgcattttaaggtaagccacagccagaaagaacaatgggaggcccagaagcccacctccaaccactccaaccagatacaccaaggactctggctcagaccagatacagccaccttggtgatccagagaggcctcctgctgggtgcagtggctcaagcctgtaatcccaccactttgagaagctgaggtgggaggattgcttgaagccaggagttcaagaccagcctgggcaacatagcaagaccccatctctacaaaagaaaaaaagagagagagagtgagagaggcctcctatcaggaatcatgctcaagttccaattcaatttcaatgagagataagggagtaaacagcaggaaggagggagattccagaagaccccaagactgcattgttgggctgtcattgttcatgggaattactcacccatgggtctccatcgggtttcacccacaggtctgtgcaccatgtcttgctctctaggaaccagaacatctctatggttctttggatagaagtactctatttcagtgactcttagatttttgtttatttttaaaaagggatagttgtggtgaattgcattaggattactaaaataaaagcattaagaaactccccaaaactccaaatacatctggagtcattctttcctaatagggacaatattttattaccaaaaatggtagaagggttagaagggcctaagtctcaggataaaggatagttcattgcatttaactaattcacattcagaaaaatgtttttcaaattgatcttatttttcttattttgccatggattgataaaactttatcacaaattagaacagagaattaggaggtctatgtttaaatccagaccctgatgctatttacatcccctaggcaaaggaattattctctctgacttttattttgttatttcctaaaggaaagaattgtattagttgatttcttaagcagctctcactttctttgagctcctatttctctgattgtaatgtggaaaactgagctctatttcatacataaccacacccttcatctaacattttataacaaatattgtttccctgatttctccatttgcagcccagataacaactctcttcctaggattagtgaaagcttgtagtatcatacaaaacccagtaattttcccactaatcggggagtttcccagaattatctgccaaaggttattttggcacctaacaacgttttttacttttccgtcatcagtattatcatcaacaaaaaatatttcttaagttaacaaggaaaatactgaatacagagaataaagacataatcatagaatgggtaaaagttcaggcagtctgttagagagcagtacttttctcatatcttaaccacatcaaggacctgggacagggatgatggtgattggagcggcagctttgagggtcacatactgatgtcgtcagtggaaagagaagccagcaccccccttctcatcagtccaaaaccatcatagaaaaaaaaaaacaggattacgtaagaagttggactatggggagggcaggagaagtgagactttatggggccagatgtcaaggacatttcacaaaagagagccataccttagatcaatgctgcgactggctcccagagacatttagtcatgtctggaaacatctttgattatcacatctgtgaaggagtgctattgacatctagagagtagaagccagaggtgctgctaaacatcccagagaacacagtcaccctataaacacagggcagcccccacaatgaagaattatccagcccaaaatgtcaatggtgttgaagttgaaaaatcctgcattggagtaaacttgagagtgatcatgagactaagagcaagagaacatttgacgtcggtgtgataaacaaggaaagggatatctttgaggcagagaagaggaaagtgaggaggtacattccttaccaaaatctggacacctcccatcctttactgaggttctagaatcagtcctaagaagtacagaagatctagcatccaggccgggcctgttgtcctgagagcagaagcagggagttgggatgaaaagcagagggactactgctctccctcatcagtgcatttaccatggaaaactgctggtgtgaagatggctaagaccacactgaatgagaaggaatgagagcaagtgacgtgagggccaagtcgtcagacccagagcaaagcatggtgagcaaagtggatctgctccctcaagaggtgcaaacctaactcctggactttccccagctcagagcagctgccctgttagaacagggccacaccattgctggggtttggcacacaaaaatccctgaccttaagtgctctgagttactaaataatcccagggtaattaggtagtcccaagggaatcccatagtttaaaattatgggctcctgaaggtcctgtttggtccctaaagtcttactaagattcattatttccttaatcaatagttattgaatacctattacttgccaggtctgtccagcaggtgagaaaacaattggaagcagaaacagacatagtcctctcatgcctagcacttagagtctttcaggagaaatagtaagtaagcaaatcatcacgcaagtatcatagctgaaatgcatgctctgaaggcatgagggagtatcatg

SEQ ID NO: 2962 - DNA, 2540 bp, Homo sapiens
aaatcaatacggcacttaggggacaccaaggcgcagagacacttgccccaaatcatgcagtaatgccctggtgccaccgtgaacagtgctgaagcttcctgaccccttgtccaggggacctggctgccttttatagaaagtttccacacaccttctattcctaacctcgatcacaagcatcgccggcccagatgctctgtgtcaccggcttagtaacataccccatttaggagcatgagcacaacttgtttgcagtgggaatgaattaactgaattctagatattgttttttggctgcctttttttgtttgtttttatttcaaacacagctaactaatcagggctgtggacaccaagaatgccaactttgattcttcaaggaaaatcagcagctgaccacacaccacccttcctggtcctccccgagatgccaagaacatccaaagtctgcagttttgagatgttacccttcggatgcatacctcaatctgcctgaaaatcatggaattctggagatggaagggacctcagagattttctggttctctctgttctggttgtaagtgttcttaccacacaccactcccaaccatggggagcctttccaccactgaagagagctggggttactaaagccacaatcagcttctctgcaacttctaaccatttggctaagatcagtttttctgaaaccacaaagaaaaaaaatctacgaacaagtactagcgtaccaatgttcacagtagcattattcacaagtcataaggtggaagcaacccaaatgtccatcaacagatgaataggtaaacaacatgcggaatatacatccaatggaatcctcttcagcctcaacaaggaaggaaattccagtgcatgctataacatagatggacctcaaggacactgtgctaagttaattaagctagacacaaaaggacaaatgctgtatgactccacttgtatgaggtctcttgagtagtcagaaagcagaatggtggctgccaggagctgggggggggggcaggaagaatggggagttattgtttaatgggaacagagtttctgtttgggatgatgataaagttctagaaattgatagctgtgatggtcacacaacattgtgaatataattaatgccacaggactgtatatttaaaaatgattaaaatggcagattttatgttatgataaaaaaatacaaaaagataaatctactctcccttcaggggaagacagccattcacctaaatctttttcaggctaacagtctccagttttttctaacaatctttaggtggtatgatttccaggcccctgcagcttcctggccaccctcctctggctacacttaatgcctctttgaaaacctggtacccagaactgaatggtggactgcgctcagcttctccttccaggtcccgccctgaggcacccggcttaacccccaagtcaaacgctgcacagagcaggcctgctgcctgcccactctggctaccaggccaaaggcccaggtctggaagaataaaaagatgccaccaccctactaccttgctgctgctccatccccagacagctgtgggcagctgcagctgagaagtgaaactaacaacagcatctgggggagggggcggcacccagctgagccctttccataggtttcccgtttctggttgggggggggggcgggggtgtctggccaatggaaacagggcaggccctcagggatgcctcttatcagcaacccactggaagtctgtaacccccttcatggtacggtgtgcagggcagggatgggaggcacagctagatgtgtgcagccccagcctaagccaggcctgttgggcaccacaatgggctcacccgcctcggtccatctggaaaaggtttgaaagcttgaggcaggaaagttcccttttgcattttaaagtgtgttgaaactgagtagcctgggtgttggtctcattccacaagtgagtaatccatttcctgaaagtaagctgctccccctttggaagtggcccagcgatttgggggtgctgttagaggtgtcactaactcggtaaatatttattggcacaagcaaggagcttttctaggaatatcagttaatttgctaaactaatggctttaaggtagcacccttgaaaaaaattaattcctttctgatgggtgagcaatttatgcctgggacagggcaccagacaggcagtgtgtttcacttactagttagaataaccacaaataaattaaaaccaggcctgactttaaaatctctaccttcttccttttcttgactcctgattttctattaatatctgagccagtaatggattgactttggaaaactcttttctatggcaatattttgctgggagtttgaaatgatggggtttgaaaactccctttcctgtgagtcttttggcttctgggatcccatacggatgatctcatatatctacccctcactaagactgtgcccacctggatctatctggagacgtgcctcctgttcttctgtgtagagcaatttagactttcat

SEQ ID NO: 2963 - DNA, 1095 bp, Homo sapiens
attgtagaattgcataatatgctctatctcatccaaaaatagtttttgatgtcagagtagtcatatgaacgcaacattgacccctttacccccctaaataataaatcttgagcttcttattgtatggtaatagatttctttcatgagagaaatttctcagggagttaatccactctctctcccctactgcaagatcccgctgcagtggtcctaaaaaagaaaaagaaaaagaaatttctcatactacagaagaataaagtagccacgctctgtgttttgaatcaattttcaaggattttttttccactttgcttaggcgttctttcacccacaactacacccccaggttccagattttggaatggtgtaaataacgccccccggcgcccatccacttagcggaaggaaagtcagccactaggctgcgggctccgggctgtccccagcgtgggagaggctgtcctgctggcccggctgtttattgcagcgatttggatgttccaagagtcacaagggacactgctcacgtccccatctagggggtcacttcatagcagcatcagctctttcttttcatccttcttgcttgagtctgcctccggtcctctggatggagcaggctacaacggacgctcggagtttgctttcatccacaaccacgtgcccaggttctaaatttggaatggtgctaatagtgtcaaatgtgcaattctgggtaggtatatgtgggtggatgggatggcttataggttgtattaaaattttattttttttctccgttgaaatgtcagccccaccagaaactattaatattatgacattatctccttcaagaaatggatgtgatgataaaatgctttagtaattttgaatattataatattatgaccactaacattaaatgctgtgatttttaaaaatggctttcaattagaaggttttgataacttgagtctttctgtcatctctcagtaatgtgccattactaaaatatttttccccccctctctccaaggcctcaacattttccttactgcattcatgtaagagctgtggttttggtatgaaggttaaatcccctcacttctgacttac

SEQ ID NO: 2964 - DNA, 1115 bp, Homo sapiens
gtttgttagtcattacaaagttatttctttccttagctgtgaatgggaagtgattgcggatgatcttcaactttcatcaggaacggaggaagagtccctgtggcccacacctggccagactcacctgaactcaccctccactgctcaggtgggaaggcagggagaggtcggaggtggaagactatttgttgcactctctctgtacccacaggctgggagctgctggcaggcaggtctaagcttggtaacctctgtttgtctcatactggaggctgagttcatttttgctgaaaagctacagctgttcatactctctaaagtttacaaatccagaggaatgcagaagtttgggtgatagtacaaatgagactctctcctgggagaccgtagggacgcgtatgctcctgagaggcggcggggtttggggacaaggaagcccaagcttcacggtctctcgcgctggtatttgatgacagggccaaagcacagggcccaggtgcagccagcgggagcttgctccttttcctcaccagactgggcaaagttgcagaggccagccaggcttgcaccaaagtgacggctgtgaacacggaggcctggctccaccttgtatctcggttttctcaccaggggcggggagagttaaatgaaggcagccctttccagtccaacagcccctgatgttcgtcctgttcatgaaagaaaacggagagtgtttgctggcagcttagcaacatcactgtcgacagggctcttcctgcccggctacattaaaaatggcttccaaaataacattacaagactagtacatggccatgacagaactttttaaaaatgtaaaaaattatcagaaacattataatcggccataaactcacctccttttgttaatattttggtaaatgagcctttttttttaacctggacgttgaattattgatactattctgtacataggcttttgtgtgccttttcacctaatgtccagtcacagctcttccctattttgtgtaaaaacatcctttgtaaatggcaagtactatggcaaatgcactgaacataatttattaagctgattggatattttggtggttttgctcttagatacacccctg

SEQ ID NO: 2965 - DNA, 1105 bp, Homo sapiens
gggccacatagggtggacaggggctgtgagttacagcctttaggtgctaccctcagcctgggcttccctccaggcctggcgcaccttgatcttcactttgaaagagtcgatcagaaagaccaccttggggatgccttccagggagggcagctgcccatcatctggcacctccaggtcgaacctctgcagcagccaggccatgatgaggaagagctcctggcgggccaggatctcacctatacaggagcgaggtcctgctccgaagggcaaatagcttactgacggtgagatgagctgggtccccgctggattcaagaaacgctctgcagcaaactcaccgatgctgctccagagtggaagaggaaaagtgggtctgggacttcgtactcccttccttgctcagcctcatgccccctcattcttccgccgtgaggaaaatgccctttactccctcattcccactcactcatgttttcctcagcttctgccagatcaaacctaaatccagcccttctccatcccttccctcctaacaggcgcttctgtctgaacacctgtgtctgtggactttggtgtctggcagtgtatgtgggtgtgcgtttggagctgcagcgcatgttatgtgcgtgctgcagctggttggaacatggagctcccagcctttcatcccagaccacatgtctctgagggcagcaggaagctcctctgggaagtcaggcagatctgtggatgagtcaatgcgtgtctgtaggtggtagagacatggagccacggggctgggggcaggatgatttttatatttaattaattaattatttattttgagacagagtcccgctctgtcacccaggctggagtgcagtggtgcaatcttggctcactgcaacctccgccgccttggttcaagtgattctcctgcctcagcctcctgagtagctgggactacaggcacgcgccacgatgcatggctaatttttgtatttttagtagagacggggtttcaccatattggtcaggctggtcttgaacccctgacctcatgatccacccgcctcgacctcccaaagtgttgggatgacaggtgtgagccaccgtgcccggccgg

SEQ ID NO: 2966 - DNA, 6791 bp, Homo sapiens
agtaaccaccctgctggctgctcctctaatttgccctggcacaaggacagaatgtgttctgctgatacacgtttctaaagcaccaagcagcctctgctgacagctggcttggttgctgtgtcaatgcagaaaaagtgagagagcaaaagaatttggttcagagtggaagtttaacaggtgaaagaaagagaagggttctctgcacagagaggagtcctggagaaatgggctgctggccaggcgtggtggctcacccctgtaatcccagcactttgggaagctgagatgggtggatcacctgaggtcaggagttcaagaccagcttggtcaacatggtgaaaccccgtctccactaaaaatacaaaaattagttgggtataatggtacatacctgcaatcccagctacgcaggaggccggggcaggagaatcacttgaacctggaaggtggaggtagcagtgagttgagatgatgccactgtgctccagcctgggtgacagtgcatgactcatctcaaaaaataaataaacaaataaataaaaggaaaagagaaaatgggttgctgcttccacagtgaagtgcacgaggttttatagatgagcttgaggaggtggtgttttacatagggtacgaaagattggttggatcaggtatgccattggcatagtgcatgaagaagctggccaccccaccctaatcttttaagaataatatttttaaaattatatattgtcttagtccatttgtgccgccatgacaaaataccacagactgggtaatttatacataacagaatcttattttttacagttctggaggctgggaagttcaagatcaaggcgccagcattggtgtccggtgggggcattcttgctgtgtcctcacaaggtagaaaaatggaaggacaaacactgtgccctcacatagcagaagagcagaagagcaaaaacggcctaagctagtcccctccaggttttttataaggcactcgtccattaatcacttcccaaaaggccccacctttcaataaggattgagtttcaacacttgaatttggggaccattcaaaccacagcatctatatacatctgtaaaataacttacacttgcagcactatatgcctagcaatatactgacacattaatacttggagattaaagtgacttttgtggtcacctagctaattggtgatagagcttgaaatgaaaactccagcatctaactccaaaatatgtgttcttaactattaacttgtttactccttgttcaattattattcccattcacagaagtagacattattaacactcccattctactgaacaggaaagagaggaatacaaagttcaataacttggtcacagccctaaaatagaaaagcatgaatttgacccagtaagccaaacttggagcctgtgcatgttatgttaaccatgacattatgctgcctctctgaagacatcttatcaataaggcttagtaattcacttctttagataatgaaacaaatgaggtgtaaaacgaacctgaggttttaaagttaagacagctagactgtagtaaaaatctagcttagctccctattacctgctctaacttgagctaagctcaagctccttatttatgaaatggctcaataatcctttcttcatgatatggtattgaggcttggaggagaaaacatccataaatggtttaatgtgggccttgtacatactatgtagttgaagacaacaatcacacctgttcaccttgtatgtccagcatcacaccagactcataggagacaatgtaaattttgcttaatgtatgtattaatcaattaaataactgattgacagactgattgattaatagagttctgaatcacccatctgattccaacaacccacctctcttttctggctcatttctagtctatcattttaaacttgaatcaattttctgtatatcctatatccattagtagatttaaaaagagatgatagcaattttagaaaacataaggataaggcaagtctaatacataaagaatttcatccatttaatcataccatcatccttttagactgttcattgcacagaaaaattacagtttcagaaacctcactctttctccctcccaaataagatctaaaatgttttattgtatctgactcccttccttcctctaaaaaccatgcttcggttttttaatgaaaaaaaaaatagacaaaagaaaaagaagaatataattctgagttattgaatttctgattcatttttgttcactaacttttttttttttttttttgagacatggcctcactctgttgcccaggctggagtgcaatggcgtgatctcaactcactgcagcctcaatctcccaggctcatggttctgcccacctcaggatccccaagtagctggagctacaggcatgcaccatcgcatttggctaatttttgctttttttttttttttgccttttttttgtaaagacacggttttgccatgttgcccaggctgcactaacaatttgaactgggtcttcagtcaccaggtaggcctgtaagtaaatctagagtcttgaatattggtggcattccaaaaaattagcacaaattgaatgaaaaatttgtaaactttccttcagttggccaaaaaacaaaactaaataaaatttatattataaaaaataatatttaaatagattattaaattttattaaagtaaaatttatattataaaagataatataataacattctttgatttttcagtcttgggacagttttctgaaggagacataaatgatgctttaaaaaagaatgtactcatggtcatattttggtaaattttggtaaaatgcctttccgtttcccacattttgccctcctccccttcacacccccctccccattcacactggcatgtcaagttttcgtggtagtcagctcagtcagtaaagatagagactttatgttttcaaggcataggtatggcaacatcatgcttggaagaaaataaaatgtgcctgcaactgtgatcgcacatgccataaaaataataccaccatctgcaaataggaactcacatttgtattaggctgtggcttattttctacagaaagaggactcgtttaatcatttttcatggaaagcaaaacactacaaaggaaatataagattttttttgacattttactctttcaatgcagatctttgttctttttcagagaataatattctcttagtaagtacctctttcgctgtcatgaaaagtctaactttttaagaatgagaatctaaaatgtctgtcttctagcacagattaggagggactcttcaaaatatgctatgctgtaaatcggggaggcttctggcccttgtctcaagctgtgttgtactaaacatgttaaataaatcagcaaagaagtatttttaaagataaaaataaaaatattcatgctcataatatatcaagtgacctctgaaataagaaatggcataaaaaagaggaaaattaaaatgcgggatgggttgcaaattcatgaaaacatatatctccacttttccacgttcactccctgctgctgctgctgccactcctgttctcggatgctcagaagaagctttctcgtttacgaacacactgatatttcctctagggaaggaaaacagtccactagtggtgcaataacctaaaagggaaacatctgtttggagcatggagcaatttgttggcccagttcacaatacaaagattgcagctgaaatcctctatacaattctgcaggtctcaccagatcacaaggaaaggaaaattggtctttataggagcatctcctgggacctaactggattaaagaataggctgtgtttttcatttagataaagtttttttagataaagatttttttaatagtacagaaaattcgagaaaaacagcacttaataaaaggatacggctaaaacagtaaattttacgttatgtgtattttatcacaaaaaagaaagataaaaggaaaaaaacaagacacatcctactcctcacatttcagattctaaaacaggtgttaaaaaccccaaatctgaatattaccaaagtaaatctaacttgaaggagacttttgctgtaaatttgcatcctcaacttttactaagaggccttttgtttctgtagagactaatgtcatttttaaggttttggtccttcaaaagggccatcctctcatcctatcaagcctgtgttcactgagagggtttagaacatacccagaggtgtgaggatctaacattaggtgttacatgtacatgaaactagcatgaaaaagaagagataggaatatgttgaaaagttattggaatataaactaatctaaaaataaatacataaatactgtacctcttttcaaagcaccatactgaattttacaagtagacaataatgaagtggctagacaaatctggcaaacaaactaggtgcattaattaccatgaggctgctgctaaccgacaactgtttggtgtcacccaccatacatttgaaaataattgcatttaaaactgggtatcactggttatatagtttggggctaatttatttattttcaaattgcttcataaaacataactgataaaagagaaaatagatacattaggcaacatactcacatttgagtcatatctaatacttgtatgtcaataaattaaataaaatctaaactaaccattgttaataaaaattccatttgaacttctataaatttgtggtcatatgaaccactgtagaatgtaacttgattattccacaatgtatatgtacttcaaaacatcatgttgtacatgataaatgtatacaattttatccacaatttaacaataaaaaactttttaaaaaattaagaggattaaaaaatgatatgtcaggttaagtgcagtggctcacaactgtaatcccagcacgtggtggcaccaaggtaggaggactgcttgagtccaggagtttgagaccagcctgggcaagacagttggactcagtctctaaaaaagaaaaagaaaattagacaggcgtggtggtggtggcgcacacctgtgatcccaactactcaggtggctgaggcgggaggatctcttgagcccaggatttcaaggattcagtgacctgtgatgatgccactgcgctccagtctgggcagagagcaacacctagtctcttaaaaaaaattttttaaagatatgtcatgctggccaagcacagtggctcacgcctgtaatcccagcactttgggaggctgaggcgggcagatcacctgaggtcaggagctcaagaccagcctggccaacatggcaaaaccccatttctactaaaagtacaaaaattagccgggtgtggtggcaggcacctgtaatcccagctactcaggaggctgaggcaggagaagcttgaaccagggcggccgaggttgcagtgagccgagattgagccactacactccagcctgggtgacaaaagcaagactcaaaaaaacaaaacaaaaacaaaaaggtatgtcatgctaactaatcaaaaataaataaaacataagtttaaattaggggaaaaatataattcaaaattattaaaagagaaaagaaaaaaattttatctctttattttaaaaaaattccaaagaaactacagacaatcctttcacaacatgaatttagaacttttcctcgtcatcctctattttcaaagaaatgactacatacatttgatgtatgatccgattcaacacagggctacagctatcagtgttttaaataatctattattagttaacaataaactgactggtacaacaaatccttacttgtcaacaggtatttgtcaggaggccagacttctagttatgatgatgagtgtttgtgttacactgctaagtttgcaaagtaatttttcacatgcagtatttcatttgaatcccactgctccctaataaagtattatcaccagtctcctttgacagagaagtaaagtgacaaagtcaaaacgttagtacagaaaagagtttcaaatagaactctgctgctataactccagttacgcagaatctttccaaaaaaaaaaagctcaaaatacaacttgaaatgcagaaataaaaacaaccacaaaggctttgagagttttaattatttgtatcaagtgaatattctagtattcaagcacttttaagtaatagttcatagttgatactttgagacctacgaagaaggcacaagacaaaaaagaaaggaaggaaggaaggaagacataagaataataaaagcataaggttctgttggcaaactttgttctctcatagggcaacataggattatcatttatcagtactttctagggggttgtcataacaaagcgtcacagattgggtgattgatttaaacaacagaaattttgttctcctggttctggaggctagaaggttgagatcaaagagcaatgaccaccttttccctgagtcttcagatcatcttccttctgtatgtgtctgtgtccaaatttcctctttttatgagggcaccagtcatactggattagagcccaccttaatgacctctttttaacttaattacctctttaaagaccctatttccaaatacagtcacattttgtggtactgggggttaagatttcaacatatgaatttcaggagacacaatttagctcataatatataactcacaaatatttaccacccacttactatgtgcagagcaccatgctgaactcagagtactaatccctgcccttgatggaatatcc

SEQ ID NO: 2967 - DNA, 1180 bp, Homo sapiens
ctgacccctcagggagcctcgggcacactgtcagtgttgtggctgtaccatatggatggggtttgtctgtagcgccccgtctcctggctttgttaagttagtgcctgacgcacatgttggatcttgtttaacagacaccctgtagaccttgaatctgcagaaagcagctccgagccccagaccagctctcaggatgactttgatgtgtactctggcacacccaccaaggtgagacacatggacagtcaagtggaggatgagtttgatttggaagcttgtttaactgaacccttgagagacttctcagccatgagctaactgccccctggcggccaggaagagaaacagctcctccccgactaggtggaaggctggccaggcaccaagcatgtgtgtgcacttgtacctggtggtttctctgttagcagtccattagctcatgctgaattatttttgccttactttcttaagaaacattaattttatgtatagtgagtatattttgcatgttttaaattgtaaatggagctaagtccaagaaagtacttgaagctctcttccagcgagcttaattgcgtaatccctgttgtcctccagggtaagctgacacgtctacataactggttttccacaggcatcttcagttattgcttgtcaggtggactgttttggatttaaccatgtaatccatgggaccaattgagagtcagctacttttataggcatcaaagtattctcagacacctttaatatctttatggaaacttaatttttggccttttatcaatatgtcataacagcattctgaagtcagacattgttaaattgagctattaaactaatgagttttatgtaagttatatggtcttaatttggtacttgtaaatagcactagttagactctttagaatactccaagagttagggcagcagagtggagcgatttagaaagaacattttaaaacaatcagttaatttaccatgtaaaattgctgtaaatgataatgtgtacagattttctgttcaaatattcaattgtaaacttcttgttaagactgttacgtttctattgcttttgtatgggatattgcaaaaataaaaaggaaagaaccctctttcactgactggggctgttgccaggtgggccagctgccgtgagagctgacatgtttggagggtc

SEQ ID NO: 2968 - DNA, 14976 bp, Homo sapiens
attacctttcctgtcattttcttcttgtccaaatgaagttattacaatgaataattttaatacaactctctttctccaaaaatgttcagcgttctcatcctgcttaaccatcagctggaaataaagcttggagatatttcacggttgtaaccacagtggtgaaaaggtgggagacttttaggaagacatcaaatgcctttttatatttcacacaacctcctgggaggtggaggctaggagtctctggcaaaactaattcattatctgtaaacctgttttttatgccaacctagacctcacagaggaccaggacagaatgctatctgaattatgctgtctctctggggcactgctgtctcttcatctttgatgttctgtgccacatgctcatttttctgggccatttgcccatgtactttgttctggataggtttgcttttttaaatttcacatgtaaacttgagaagaaaggaacttgggagtttttcatgattggcaaagcaatgagctctgcagctatccatggaagattatggcgatggatgaaaccagcattctggaggtcatctccagcaacaaaaaatgactagaactttcttatctctgttaagaattttattgatgataacttttagtaacttgaggaaaccttagcgtattcgtctttactatggcatttttcacaaacgtagaaagctgctaatgttaattttaatgtaatttttaagttagcatacaaattacatccctcttgacttactgcccatatagctggagtcattcaaaaagtcagaaatatcagcctctttgcagtggtttcctttagcttttcaggaatatagatgtcgaacaattagtaaaattctcaaatgacagacactttttttcctcactctgagttatatgtgtttgctgatgtgaacagatggactcggtgattgggtgagacttctttagctctgccttctgggtgtcactcattgtcatcactcgtggttagggaaggacttcccttcacattctgttatactctgattccctgtaaaacctaaagattatttctaaaagtcattggttcaactcaccagatttctcattggttctcagagggtgtattcacttagcctataaacccaccactgccatctaatcatgcaatttcttcatctctaaatgtatttgctcacaattctctgtataacacaaagtaaagaaataatggaaaataatattctgcttctaatgctgctgcctgcttagatgtatttcatttcttctaagaccctatcatattggctagtaattatttcctgactcttattttctgctttattttctattcaacctctcaacctctccttcatgagctgctggtaactgagtttgattcattgctcaacaagaattttcattgttcccaatcatctttgtagatgtggttacttcaaaagcgtgtgcttaaaaatatgaagtatatgattatcgagatgtggaaaaattcataataccttatttgtaccattcttagtgagaactgcagctaatattccttgactccttaccatgtcccaatgcccgggccatgtgtgtgctctgtttgtgtatgcacatgaatgggtacatgtgcatgtgtgtcttcaagtgcatgtgcatgaatgagatctcatgtaattcttaaaacagctctatgaattttgggtatactcactatcttccttttacagatgaggatacaaaaattcagagtgattaagtaatttccccaacatcacatacctggtaagcagcagaactcaaaatcacattgggtagctacccaagtcttgcttttgatgccagcattgctcccttactgtacttttctttttgacttatggcatagttatttgaggatgggttttgctcactgcagcagattaaagatgctgtaagttctttgacatcttcccatcaagagttgagttctatttccccttttctatactctggacttgcctgagactactttgataatagagtgtaatataaataatggcggggcattctgagccttgccctaaaaaggactggcagcttccactttgatctctaggaactctgagccagtgtgtaagaagtccacataccctggggctattctacagagaggaagcttaaaccagccacttggaaaggcgaaagagagatagagaagacggtccagccagtcccacctgttccagccctcagtcgttctaactctccaactgtacaagccattttagctcaggccacaaacttcattgagcagaagctagcttattcttactatggattgtcctaattcttgactagtggaatcatgaaatacaatgataataaattgttgtgtcaagccattaagctttttagttgcttgttactgaggaggagataaccaaaacatccacgtttgtgaatgatatattctttgaaaacagagatgatgtctcattcatctttatatttctagcatttgtgtcactggaggtcaattaattttagatgattgaatgaataaatggatgagtggaattaagctattgggaagacaagcacacaaatctcatggagcttctgttccagagggagggagggggagacaggtaataaagacataaataaacattctcaggaggtggtgagtactatgattggaaaataaggcagtgtaagaggacatttttgcagagactggatgagggaattgagtgagccttttagtacctacaggccacatggactttgactttcatgcttaaaaacaaagaatctggcttctatgttctctatgtccatatacccctgagttttgtgatggctgcatcacatctcagggtctgaaaagaggttggtgccagggcagaaagcgtgggcagaaaaagcattggttatgatatcactcaacaaaaaccacccctggaatatgctgcattctctcttccaaatccttgcaagtatagtcccctctgtgtgaaatgttctttacaactgcaagccctttcatcgttttcttgtcaagttaaaatgttccattctcagacagataaatttcttcctctactgtgttacagatctttgtattaatagtacttttttcaaatgcttgctcatcctctctaatataaaagctattgttatatagctttcccccagctatttgtgaaataaatgagagtaaagtatctgtgtcttcccatcatctccactatagctcttagtacagtgtattgcagtagaagatgcttgttacattcaaaacaagaaacagagggaagagataaggaaggaaagggccatgcctccttaactttactcatgtaagaaacacctggcacataaaatatattcggtaaataatgaatgaatgaatacatgaatgaattaattcgtgggtaacttggtactattttcagtatttttggtcataggttcattttctctcctattaaattcctaaaggcaaatatatttttttccagtagttgagtagtcctcattgatgatctgggcatcacactttttgtaatgtacataaggaaccaaattacctggtattgtaaaaattggtcaccagagcatgtcctcaagttctgcacatttaattaaactaatgtcgtaatggtaaccagattctcacagtgtgaaagctccttctgggaagtaacttaggaatttttagacgctaatgttcgttctctctctttctctctatcagaacataacctataactatttaagttcaccaactgaaatattaatgagctaaaaatgctaatttttaatactgaaattgcccaatttatatctagaaaacaatttatgcagtaagatgccttaatgtgatacaggcacacacacccaccacccccctccacacacacacacatgtgcgcgcgcacacacacacacacacattttaactattttgctataatccaaatgaataatttgcaaaaatacatttcccccatacatacctgtggactctttaatggtagctgaacttaaaactttctttctcgtgtaagtttttggaaggatattgattaattaggatgtaatgacattaactatgccactcttgtttcagtagcaatttcaattaatagtgtgagatgtagaatatgtaaaaaaggagtcagatatattgtctttgcattaaaatgacaatggattctgtttatatcattccattatgtcagacagtactgaatggtttagatgtattaatagacaccccaaatgttacctctcccttttaaatatcataactggcagaagtacaaatgttagtgaaggtacaaaactatttcctgattgaatgggagaaaatgaccttgaatgagtcgacacagttaaggaaattaattattctaattcactacatttgaagaattaagtcagagactttaaactgggacattagaatgaatgaccatatcatttgctatataaatatcaggaatagaaagcttgtttgttatttgctgtttgtttaattggttggttcctggctgtaaagggaacattgggctcatcctaattgattaagtaccttgtttctccatattctttaattttggattcaaggcttgtatgtaatctgtttgatggttttatttgcttttttctgtaatgcaactttgctgactaggaattggtttactctttcatgtctgacggctctaataaattgaggagcttaggcagacagctcttttatccaagggcccttactgggctggtgatactgctgaaacctgcctagcctcaaaaaatgctcagagagggataagagtcctgtagggaggaagaaacaggggaatttttttgcagtgacctcaaaatagagacagagagacagagacagagagagagagagagaggacaaatcactcacatggaagtctgtcaaaatgagaatgagagtaggctggttctgctttggctgatgaaaggatggtgaattgaaaaaatgatcaaaagtgacattgtgggccaactaagaaatatcaaaggagaccgtactgccgatcagtcatggaattcaccatctgctagggagcagctgcacaaacatttgctgagtgattatatagaaactgtagtggttggtgggatagatgcagccataatgaacgctcactgggttctgtctgtctcttgctttgctccttgtctttccttttgccttttcccttgcccttgaccttctctttcttttcacaaagacagagctatgtcagggacattctgggagatacaaagatgcatgagacataattcctgccttcagggaagtctcaatctgatggaagcgacagaagtagaatgggcaatgtttacctgtattttttgttttgcttgaaaacagattctgataaaattgcaggaaatcaatggggttgggggaagtctagttacattaattaatgagatgtgcattttattactgtcaaagggcatccattttatctgatttcctctattttgggagtgccagttgattaaaagctttactaattatgttccaagtggatggtatctttctctttctgagaaatttaatctacattcctgtctttgcctgtcttagtcacacatatcaacttaggattctgacttacaaatctgacatgaatatggcgacatgcagtgtgttcttcgggattcatctttaatattttcaagatccacatcagttgaaggatctgagctgatgaaaagatgactttcagctttctggaggaactcaagagggactggggagtttattttgtccttggatgaaagagaaagggttttgttgtggggataaagcgaaggcactttccatggtgagctgacatcttggtgttttttttgtttttgctttattttctggctgcctcgagcaactcatcgtcagaggagccatcagtgcctttggtcttttatgtacaaaaacacaccaaccagtggaggaatatggtgtttgtgatcagtgcttatgggtagtggtgacttttgatagttttgggtttttagtgctagcaagctacctgagtgtcagtgaagagtggccccagtgatactgtggcacagacacagttcataataaatgctctctctatgcctggaaggcccttctccactttttccaaatacatacatcatcctggcctcatggactttcacctgcctagaatccattcctcctcttcctgtaccaccatcttgatattttggagagcctcttttccctcaagctgaatctgtgggaaacggtgtagtatagtgttgaactggatggtgtctagagccagagttcctgggtttgaacccagtacacacactcatcatcagtattggatatactctgttctttgtattgatctttctgtatctgtcctcaattgactgagctccttgggagctcctctagttgtcatttccatatggacaacttcagctgctagcgcagagcctggaacatgataggagctcataggattaaatgaaggaacccctgtcgtggataatgacaggacttgctgtggaacactggcatggcattttgcctattccacctgtatgtccatcaacattgatataaaaaaagttttcttctgaagttagagaacaatgtctccttccacctaaaaaataaccctatcactttccaaggtgcctttttcttgtaatttttttcaaatgtgctatgcatggtgtccagatcattgaatgagtggagtgtttaaagtagttcaatcctttggaaattgtcaatagacttgaaactttggtgatattgccttattatcactaatttaatggttttttggtgtgtgcagataaggtctttttgacaaattgaaaacatgtgaacccatatacttcatgtattttggcagatgcatttgtgatgaggacttcttgaagataatagcctaacttttataattatttctctatggtaaataatattattttaaagaagaattgttttcttcccctattaagtgctacatgtcaaagaagtaggaggatggaacaaatttgaatatgaatttctcctgcagtagaaaagttaacatgtagctcactgaaaactgtcttggtcaaataaatgaatattgactttggggaaaaaagaaaagtgaaggagaaagaaatgtagaaaaaagtataattcattcttttaacgtggcgggttatatgctttagcgtgcatctttttgttgttgtttgtaggccttgatgtattgatgtcttacatcatagatgctaaatcacctctcagtgcatttttaagtgcttaaggcagagttgttcaagtaatagagaaaaagtgctagctcatgtggtctgaatcttgatttccgggtgacaattttcttcttactcctcccatttacatttttgtacgaattgggacatgctcctaataattccttcttctctgacttcagtcactatttccttttgcatttccataggctaaatatccaagctctaagactggaagagttttagttataatataatggatagaaacatccattattataatataatggataaaaacatccattattataatataatggagagaaacatccattatattataactgagataaaatattattactgttatttaacagttgattgttagcatgcattgatcgatatttaataaattaaaaattcagagcccacccttctcatttagcttcttacagaggaaaatcatttcaggctctttagtcttggtacaactgtgctataagaaagcaatttcagtagaaaaaatggatttggatcacagtttcttgatgggttttgtagaatttgtcagttagaaaaaaaaaatggccttactgaaaatgtgtttgcttctctgcttacaccttctaactcagttctgatgctatttgaacaattgttgacatgcctctttacctttcaatagttaggagtaaaaacatttattctcaattttgttttgctcttgcgcctttaaaagttgattaaaagtcgccaggttgctcagagttctaagtgaatagacattgtcattagctctttgataatgttctctgtgttctataaaccaagtaatcaggtttcgcgtgtacttgtgtcaacgttcccagagggattgctaatgaaaacaaaaaggcaatatatgtcattatagtaaaccatcattttgcttaaaataatttcaaaatgagtattttagcccatgtactacatttctgaccttagtttccccaggttcttctctgtcattatttcagctattacaagtcagggtgaattaaccaaggttatgactacaccaacattttaattatctggctttgttgatggcttgttgaaattgctttcatgtggcagattgaaacacagcaaatttatagtagggatggttacccagcattcaaagccttcttcatgtacacttcttttcataggaagagtatttttttaacatttagaaaatatactctatttaaccttattttttaaaaaatcttgcacaacagaaacattattgtttagagaccctagaggtttatggcattataacatagactgtaaattaggattcgttaatcaaggcacaacttcagttgtcaggggctgttctgtgctttttagggtgggtagcagcatctctggtttttactcactagatgccagaagcacctttttttccaccagttgtgacaactagaaatgtctccagactttgccaaatgtcccccaggggaaattattactgggggttgagaaccacagctcttaattgttatttcatataggttttattattttgccccatttatgttaccctttggcatgtttctatgacataggtagtcaaattttagctaattttcccctaagaagctttttttcgtggatgtaaaaataaattttaatttctatggaaaatttgcctcgtatcacagcttcctatatctgatttaaattctcttgattacaggtagattatgctgattcaacttgttggaccaaatgtttctgctattaagaacaaaacaataaattatttctagaagagagagaataaagaagctttaaaaaagtccaacggcctacccaagtcaactattactcaaggccagcagcatcagtatcacctgggagcttcttagaatctctgaccctgctacggattaactgaatcaggttccctaggtgatatctattgaagctgggagggtcacagtatcagtgagtggtcccccaatttcttcttgagcatcgatgaattagcaggtaactctccaaattttacttacattatttactgttgccttatcttttatcatatgcttttaagggatctgctagttaataaacatggcttgcgtttccttttatttcttttttttctttgtttgccagaaggagcctcaaagtgtctagtgattggcagaaaaatagaagaatcaaagattttaatattctgatgattgtattctctgcctcattcttaaaaatgaactatttttcctgaataccaactctttagactcctcttctacctgcccccacaattctcaatatttagaaacctgctcccatgtcaaaaaccaaaaccaaaagtgatttctgtgtagacatgtgaaaacatcctactgaaatgctctcaggttaacgtctttttgcaggtgacccttgctccgtctctgtgggtttgacttacgggtcacaacacgcgatcgttatttcagcttatcactctcaacagaatgaatagagtccattttcacaattgttactttcaaagcaaattactcaagatgaaaatctttgcagggtcggaaagtacataaatattcttagcagggaataaaggtgggggtgatgagtgtatcatatgattgatttcggtttttttttgcaacttttctgtagagagacttggattgcaagaggaaggtttggagtcagagagaggacccaacagaggcatttgttgtgaaaatctcactatatagtattagaggctgttcatgctaatcaaggtgatataacctccttgatatttggggcctcagtttacagaataataacatttttggatcaaaaggattttaatgtaatgggtcatcctgtgttgaagagacggtacattgttaaagaccactaccaaaactgcaggtttccacaggcactcccagaatgtggcccaataaattgagggtctgcaaatcttcaagatttgcgacctctctgccgaagtccttatttaattcagagaaactttattagagatttgtgacataccagaccttatgccaggtagtaagatgaatggaaagatggtaagaaaagcctggatagggatttctgtctgcctagggagccaggtaagtgaacacttgtcattgttcactggactgtaggccagtgctagggagcaaaatgtcctgggactgcaacagggaaggtaaaaagaggaggaattgctactttttgagcatcagtggtgtagcaggcactgtgttatggaggggagactgaaaggaggacagaaatgtgagggaattgagcattgggtaggtaaataagttatgatggaaaattcccatctggaagtgaacacgtttaaggaatggctggtgacaggaggtttgccagtgaaggctggaggtgaagctgacaagagttaggtcattattctgccaacaggtggcaaccatccaaggcttaaacacagaagaaatacatcgttagatttgtgacataaaaagatagagaagcatggaggatgagttggagaggagaagctcaagaggtagaaagtccagttagaatgggactgtttgccaaggcaagaaataatgtgagccaggcagttgtgttcaagggcagcaaacatttgattgaagcaacaggacttgttaatggattcatggcagctactgagaaaggtggagggctgtctgcctttcccagcaccaacagctttgtgcacctgatggtgcagtttcttaagagagaagaagaggaaattaatgagttaccctttcctaggtgagtaatgcctgcgacagctttagtttccatccatacaaagagaataagaatatctacagtcagagaggttgtgaggattaaataaaataatatgtgaaatcaatgtgaaacaatgctcaggacacaatgccttgcaattcaagtgttgtcttctcttcagcacacacacacacacacacacacacacacacacactctcatggaaaactctatagcctattgaaatttttgaaatcgtgccccgacattaaataatattttaatgtgagaaacttacttttaaaaatccaataacattgctgttaaagagacagccaacagccaagtgactttgaatagaattctttcccagaattgtaggtgaaagttaaaggatgctatgcttttgtaaggaaatggtaatgtacactgtgtacatttcttttgccatctattgaatagcttggctatcctcctgtttgccctaaattttttattaagtacttcactgagaaccatagaatgtcagatgctgtaccaagggaattaactgacatagctgtgaaatacttttcctggtctgttagtagactgccattaaaattgaaaacatgactggtctggtgtgagcaagatttacgtgtataacatagtcatagtctgggaaaatgtcgggatccagcattcgttgttagttgaagtgtttttataatcagaaaacaaacctatagcaaaacttcgtgtgttaaaaaaatgttgtgtaaagggctagggcatctttctcaaaacaaactggatatcctcttcacagaagctagtctgggcagatctccaagaacttgcagcttcatcagagccttgtcattaccctggacaaaggcacaatgtagttattgccccttcaggtacctgatcaaggctacagtgccccaagggcatcttctgtagtttcaagcattctagggtgatccctccctccccagtagaatcctgagcctcatttggtaggtgtccaagccagttaccaccattccagcatgactttagttagccacaacacacacataatttttatatttcagtaagaatatccttcttttaaagtatacattttttaaaaaaaagttaaaaaactaacatgcagccacttgaatggaactatcttaagtggaataactcaggaacagaaaacctaaatactgcattgtcttaagtgaaataactcattatcttaagtgaagtaactcagaaacagaaagtccaaatactgcatgttctcacttataaatgtcagataaataatgtgtacacatggacacagaaagtggaataatagacatgtagacttggaagggtgccagggtggtgccggagggacgagaaattataatacttaatggatacaatgcacactattcaggtgatggctgcactcaaagcctagacttcccaacttcacagtgtatccacgtaaccaaactgcccttgtgcttcctaaatctattactttttaaaaagaaaaagtcattaccaaaagaacacatacataatttttatatttcagtaagaggatatctctcaaaaagttaaaaaagcataccactttgcagttataattttatgactcaccagggggaaaagtacttctaaaaggaaggcagaaaacaacttatccaaaattttaaattatttagtcttcagttttaaataccatctcagaagatttaatatgacatctatttttaatctttaaaatcttccttcttttcagccaggatcaatttttatatagccctgacacactacagggaaacagttcactatcccatagacttctttgaacatttacaccattgctcatatcaacagggggcttcttagaattcagcagcaatttttatgaccatacatgttttatacaatgttgcactttttcccccttctttttctgtgtaaatttttcaaaagaaggggataggagaattcctcatcctattaaaaaaatgaagatcaccttctggcctaactctattacagagaacaagttttcaggtgatatgaaagaaaggaaagagctttttttacaacttaccatggtatgagtacagacatgtattaaaaataacagcagcaacaacagaaacaaatggatttctagaaactgtttgaagaaaaaaataggagaaatatcttagtaattttgactttgtcaaagactttaaaatatgacaaaaagaacacaaaagtataaaggaagaagtcatttttgctcttctaaaagcctcggttaaaaaaatgaagtcagtgcacagaagaggagaaaacatttgcaaagcatatataaacaaataacttgtatccaggctatattaaaaaagagaacaatttttgtaactcaaaaagagaagcaacccaatgaaaatggggcaaagatttttacagacatttcacctaggaacatgaacgtgaatggaaaatgagaaaagatgctcaatgtcattagtcaccgggggagatgcacgtttaaaccacaaggagataccaacacatacccctagaaaggccaaaattaaataaagaaactgaaaataccaggtattggtgagtatgtggagcaaatggaagtctcactcactactagtgacaatacaaaatgctaccactgctttggaaaacagtttaacagttttcgaagaagttaaacttaaaatcacttattatccaaccattgtcctcctaggtatttagccaagagtaaagaaagcgtatgtccacataaaagaactgtagatgaatattcactgcagctttatttgtaatagccaaaactgggaaaaaaaatggccggcaacagatgaatggataaacaaattgtgatatagtcacacaatggaaaactgcttggcactaaagcaaactattgatgcaagcaatagcatggaggaatttcaaaatgatgctgagtgaaagaaaccagacaaaaagtaaatacgtattgtataagcccatttatatagaatctcagaaaatgcaagctaacccatagtaacatgtcatgtcagtggttgcctaggttggaaggaggtacaagtaaactcttaggtctgatggatatgttcatcatcctccttgtagaattaattaagtaattccataggtagaattaattccataggtcaaaacttctaaaactatacttgttaaatatatgcagtttcacatatgtcagttatagctcaacaaatattttaataatagcataaatgaagatgatagacatgaatactttgcagagcattttatttggggaacttacatcaaactcagcaacctggcacatctgctgttaaggactcatgtaaaacttgtgatgtttctctaggtcttcatcggccttgcacgaagctgtgacaatttaaaggcatttcaatttattatttttagatagaattcacattttcaagatggctccactttttttttttttttagttgttatggtatttttaccccctctttatagccttaatagtaactgcctgggtcagaggcaaaagcatctgacattcctgtgacagttctgccatgttcttttgaggagcgagtgaaatctcctgatacccactgctgtgagcaatacttctgttgtacaggtataatgatgacaccttttggaggacctgctagagttgtagaattgtagctttgtaacagtgcatatcattgtgatatttcgaggactgatgagcaaataaaaattgaagacatacctaacaccctgtgcaaattgggtctgttcatctccactgtacccttagccttcagcttaattttcaaagttgtttttttttttcttggtcctcttgttttatttttttatttatttttttttattatactttaagttttagggtac

SEQ ID NO: 2969 - DNA, 9623 bp, Homo sapiens
gctcactgcaacctccatctcctgagttcaagcgattctcctgcctcagcctcccaagtagctgggactacaggcgcccaccactacgcccggctactttttgtatttttagtaaagacgggggtttcaccatattggccaggctggtcttgaactcctgactttgtgatctgcccacctctgccttccaaagtactgggattacaggcgtgggccgctgcacttggcccaaactgccttttttcattgtgttggtgaatgcgtgcagagatggaggtctgctttccaatcttacaggaatttgcttttcggtgaaaaggaaggaattgatgaacacaaacagccttgtggcccctgttcagagaaagccaatggaagttggtggaagaccaaaccactcctttctgttccttagaaccacggggctgcccaccaccgggcaagtgtctggcttgtgagagtgttctgacttttctgcagagaacttcaggtctcattgtcccatagagcaactttgaccattgcccaaataaatccttggatctggctggttaacagcagctctgttgctaataaatcctttgaaatcttttgccttgtgtttttcatgacatatttgcatgtcaggatcatttgggttttggagttgcggtctcctgctgttcctaacgtcataaacggatagtaataacccaggaggggattatgttttggggttgcaagtagatgagctttaaaaacattaatcttatttgtgggcaaatatggctaatgatagactagggaaaacaaaataattcaaaatctgcaatgaatgcttggttatttccaaagggcctgctttttaatgaagtgcagtaaataatgaagaataagaggggaaaaaatgtagaaacagcatcccaggagtttcttggtggtgttgtttttgttgttttaataaaaattaaaatagacaaaccaaggcaagggagtagcattgacctccactcccaagtggggctggggctggacctcagggctggatcctatctgtgggtcactggtaaaagcaaacctccattactggggttctctgcgatgggtgactttgccccaggggacactggcaatgtctggagacatttttggtgtccctgggggtgctaaacatctaacagtgcacaggacgtcctctcttaacaaataattatccaggccatgcgtgttgctttatgcctgtaatcccacctgtctgggagacccaggagggaggaacacttgaggccaggaccagcctgggcagcatagcaagaccacctctacaaaaaaattttaaaaattaggcaggggtagttgcatgcatctgtagtcccagccacttgggaggctgaggcaggaggatcactggagcccaggagtttgaggctgcagtgagctatgattgtgcctctacgctccagcctgggtgacagagtgagaccctgtctcaaaaaaaaaaaaaaaaaaaaaataagatctatccagcccctaatgtcaatggtagggagaaactctgcttcctggctgccccctgtcctggcctcatctcccgtgtggattggctcttgccacactttcctgggagttatttcatctcaaagtgaagcctgcaaggggccttaacattatctaatactaagttttactgataggacttgcaggacttcacatagattgaatggctttccaaagttcacagtaacagaggtgggatcaatcaacaggaaaaattattaggagcatttgtaaaagaagaggctttacaggctttttacattctactcttggatgcttactttgctgatgcttacaagaactgtttgttgagtgtctgttaccatctatctgctctgctaccatctatcacccgaagaaacatgaaggctgtcttaaatgggccgtaaaataataataatagtaataataatgttgagaacatttgctgagtgtttactctgagccaggactatactaaaccttttaataaatcctggatctcattaaatcctctccacgaccctgcaagcaggcactattaatgttcccattttacaggtgataaaactgaaacgcaaggagcttaggaagcagcgggtgaggaatctgagccttgctcttctggattgcagagcgggcactcctaactgctaagctcaccccttttcctccctgatgcttagcaattcagttgttcctgtagttaggaggcattgttttcagggtgtttgaacctaaactcaaggagaagaaatgtacatacatccttctggctcacactgctcaggccatcagtggggtttttgccagtgttttggttgctgctggttttggatttttcagtcatatcaggactttagtttgacttccacaaatacttttggtgaagatttactgtgcccaggaggtagctaaacattgggggttcagcactgagcaaaatacttgtcttagtttgcgtttattttattttattttattttatgagatggagtctcgccctgtcgcccaggctggagtgcagtggcgcgatctcagctcactgcaacctccgcctcccgggttcaaacgatgctcctgcctcagcctcccgagtagctgggattacaggcacccgccaccacgcccggctaattttttaaatgtattttttagtagagacggggtttcaccatgttggtcatgctggtgtcgaattcctgacctcgtgatccgcccgcctcagcctcccaaagtgctgggattacagacgtgagccaccgcgcccggccagtttgcgtttcttttaaagcagaccttgagatgaggatttggggtaggaagtttgcttgggtacagaaatgaggaggaagagggaggtaacagaaaagggagagagctgacaaagggtgtgctcatgaggcaactgcggtgacagccagggctcaagccctctgtggatcgctaagagtctatgtggaacacatctcagaattgccccaccaagacccctggactcagggttacctatcaactcccacccttattccttcattgggtgcaggttgcttttgggggcacgattccttggtacctcccaggcctgagagcacccccagggagagaggcagaactgtccttaggtgatccaggcagggtggcttgggagctaggaccacgatgtctgctacaatccattcctactctcgaggaactctcagtcctgtgggccaggaggattcacagaagtcagtcacagtacagtcagacaatgggaagataagtgcaaggaatggagtacaaccaaaaagagatgatgatttcatcaggggcattaaggagggctttccagaggaggtgacatagaaagggtaagagcagattgaaaatagttccctgttatcaacgtcttccttattctcactgctagggcatagtgtgtgtaacgctgtgtccatggttgctggcatttgttgtctgagagctttgaaggcttcttttcctgtgcaatgtcatgtcaggacactcctgtggtcagcatcaggactgggagctggcgtgctgtgctcatagcagcggcacaacctctaagccattgtccttgaagttgtgtctcgaagagcctggtgccagtcccacggccccccacatgcactagtgcggccctccttcacattcagatcatggttgctcctgctgtgaaatcttgggcaagtggccagcctggctgagcctgagtttcctgatgactatccaaggccaggcacccgcggcctccactaatgcttctcaatgcaaaattcgagaaaccagaaagcctgcatgcagatcacatggagagctcgttcaacaccgattcctggggcccacccctgcaaaggctctgagtctgtagttatgcggtcaggtctgaagctttgcatttaaagggcttgcctctctgctgaagctgctggtctgcagtcctcacctggaggggtggagctctaggacctctcctcagttctctcctggatgttttcacctagatcaggggattctcagcattagcaattctgatgcctgaggatggataattgttgtgggagctgcccatggacagtaggaggtttagcagcatccttgacctctacccactaggtgccattagcacctcccaatagtgatgaccaaaaatgtctccagacattgccaggcataccctaggaggcaaaatcactccacctcgagaacgactgtcctagatgttctggaatactgcttctcagacttgaatgtatgtaggaatcacctgggggtcttgttaaaatgcagattccaatcggtaagtctggggaggggcctgagagtctgcatttctgttgccctcctcgccaaagctgctacagccaattggtgggtcaccctctgaggagcagcaatctacactccagtgggtggtatgctttggctggacccaaaggctcaaaggtgtacctgccagtgtgggatttggccagtccctctagttccctctgattcccccaggctaatggaatccatggctgctgcttctcttcccctgccaaccccacctccagcccagggcctcctgccccacttgtccagggagaagctagccttcctttcaaaagcgacaggaagtcagtgttccttcagggtgcataaggatctctcgggccctctcagtacccaaataacccactttggagtctagtattttttctttactcagaatttctaaagaggaaaataggaggaagggcaccttccttatggacagtgacaggcacaggtctgccaacctgaaattctaggaggtttagaggaaattgtctctgtgcagtagggtgagcaggtggttctcagagacaaagaagaagcaattatggaacatgaagggcctaaggcatatggggttggacagagcgggggctccctttacataacactgaaccccaggaattattctgataacgaaacactttgtagacttctagaaatgctgtcactttgcccattgttatttttagccattgtttccttattgggaataggaaacattcttaggagaccttttttccatggtttagtgagaaggtttgagatactacggggaaagaaaagtggctactgccctgtagagctcctgtacggaaggtactcaggtgtgaggaaaggggaaggggcagctgacctctaaaagtcagtggcagggctcccctgggacatctcaggtgggaacgtgggctcttttccagagcgacacgcttccctctgaccactggttctgtggggctgtgaggacaggcccgccctgcacaggacagttctgtactctgcacaatacagagtgagtatgtatgtgttgatgtgagggagtcttccccatttcatgtttgtatgggggaatgcactgcgagctccaaaatgccagctgttactttgggacaagtcacctgcctggacctgggatgccatgtttgataagtcctacctagaacaagaggttatggctccttggttttcccataggaagggtgtgtgtgcatgaggtgagttggggaaagattggtgtgggatagagcagatggggattagttagtgctacaaactgaatgattttgtcccccaactttatatgttggaacctcagtcatcaatgggatggtattacgagctggggactctgggaggtaattaggtctcgaagatagagccctcacaatgggattactccccttataagaagagatactaggcagggtgcagtggctcacacctgtaatcccagcactctgggaggcagaggcaggtggatcatctgaggtcaggagttcaagaccagcctggccaacatggtgaaaccttgtctctactaaaaatacaaaaattagctgggtgtggtggtgcacacctgtaatcccagctactcgggaggctgaggcaggagaatcacttgaacccgggaggcagagtttgcagtgagctgagatcacgccactgtactccagcctgggcaacagagcaagactccgtatcaaaaaaaagagaaaagagttaccagagagcttggttcctctctctcttcaccattgaggtcataaccaggaggagagccctcaacaagaactgaatctgcctgagccttgatattggacttcccagcctccagaaccatgagaaatacatttcggttgttgataagccacccagtctacagtactttgtgatagcagcccaagtggactaagccagtcaggaagatggcttagaccaacaggcttcaaatacagtctgtgaaaagacaggtaccggtcagcagtgaagtttcagtctagtgagaaatgagaaaaatcgagtcaagagagtgactaatgagtaagctaattactcactttaaagaacagagctttatgctacacttatggcctttctcctttggaggaacttgaactgtcttgtcattaatgagagtatggtgtttctcaatgatatttatttagtatctttattagccaaaaccaaaaacacttagaaatagtttggttccaaaaataatttgtaaaatgtttattggcctgtgaaagccagatgtctagaaaccgctgaattgggcaattagaacagtgaaggcgcaagatgagagcagtctggtcttgggtggtggctgtaggaggggagggaggacaagatagaattttgtggctgactggatgcctctgaatctgggcgactgagagtgatgatgggaccttttatggaaatgtgtaagttggagagggaacaagtctggggacaaatgaaacacttgggagtcataaaacatgaatggctgctctttgtggcgggtatggtactgtgagctctattttccattatttcatgtaatcaatgtgaccgcccttccaggtgggggctgttgttgcctcggtgttacaaatgagggcagagagaaggagaggcacattgtcctctgacccaggggggtggaggactcaagtgtgggactgtgggatcacgaagccccagaaggcaccagatccctgttctgtgctaaccaccctgtatgtgggaaccgggtgctgtggagtggatgggatctgaggagagaggatggaaaggatgagaacagagcttagagtaagaaaatatttggctgggggacccagaaaccctcagatcctgtctcctatcagccaatcctctaaaagatgatagataacagggtccacagagggcattggctggcaagtgggaccatttatttctgggcacttttgctctcattgtgcagctctttgcgtcagtgttggaggtaggctgaagccccaaagctggtaggctcgtgggctccttctccccgctcccacccattttccaagtctgccctgagttctggatcttacagtaggaaggaaaggctgtgctggccatgcccaccagcaggaagcaaagcttgtggaaaggcctttggtaagatggcctcagctgcccagctcagggctgctcaggccctgtctgcgttggctgccaatcctatcaaagggataataataataatagtagcaatgattttgatctaggcattgtactaagcactttgcatggaatagaaaaaatgctccaagaaagaaacaagccagaaaagcagttgttccagaataggtgccctttccactaaggccttgcactccagaatcacgtggcccaatcgatgtcttacattctatcagtccttatcagcattcttatcccttgaaggacttttttatttttttatttttagacgggctcccactctgtcacccagactggagtgcaatggagtgatcttggctcacagcaacgtccacctcctgggctcaagtgatcctccaacctcggccttgcaagtagctgggatgggactatgggcacgcaccaccatgcccagctaatttttctatttttggtagagacactgttctaccatgtggccccggctagcctcaaactcctgggctcaagcaatctgccctcttaggcctcccaaagtgttgggattacaggcgtgagccaccgtgcccagcctccttgaagaactttgaattccttacccataaaaacttagttgagcgctctatgtgttcccaattcatcacaggaaaggaaaatgcctattttatactcttaagtttatcctttgaacaaacattggactggccatgagttagccttaagcttttttcattcattcattcatttattcatgtatttatttattcatttaacaagagctcattaatcactcagtgtaaatccacagcgcagagggtgaaataaacaaaagtgtccagtatgatccctgtatttcaagcactcataggtcttaacctacttgaaaagacagaatgcacaggattcaatggacagcactcttgttctgacacatacaccgaaggcctcagaggtcagaaggagtgacaagtggacgagagggactgagagaggcagcatgcacttgaaatagacttgaaggccagagagattggggtatgatggagattgtggggagggcaggaagagacattgtaggaagatgagcagaaatataacagcaaaagaaagggacttgtagaacaatttctttgctttctcttttttttttttttttgagacagagtctcgctctgtcacccatggcatgatcttggttcactgtaacctccgcctcctgggtccaagcgattctccctccctcagcctcccgagtagctgggattacaggcatccaccaccacgccctgctaatttttgtatttttagtagagacagggttcaccatgttggccaggctggtctccagctcctgatgtcaggtgatctgcccgcctcggcctcccaaagtgctgggattacaggtgtgagctaccacggccggccctgtagaacaatttcaagtgactcgtctaaggcatacggcttccccagaggagatttttaaaaaggggggtttggctttgaggactgctttccccaaggccagagacatggcggatcctattccttcccctgccaggtgacttaactcactcccttgttgtaggcctttgtgtcccctcgatagggtcagccctatgaaaaaaggatgaatctacctaggagcaaggccctgcttggggaaaaacaaccaaaatgaaaagtggttcatggctgataagagctgaaagctttgaaagcttcagttgccaggaagggttgcattactgtcaagccgaggcggtggggaatgacagcggattattgtgtcctgccctccctagccttgcactgggtttcaggggagcttctgggacaaaaccattcgagagtgagaccctgtctctaaaaaaaatttttatttgtttaaaaaggaggtatatccatgtgatggagtactatttagtgataaaaagaaatgagctattgacacatgcaacaatgtggatgaatctcaggatcattatgctgagtgaaagaagcaagacaaaaaagagtacatacggcataaatgcacttatatataataaaattctagaaaaggcacgctgatctttaggggtagaaagcagaccaacgtttagggggtcgaatggggatggtag

SEQ ID NO: 2970 - DNA, 933 bp, Homo sapiens
ggatggcagcagcagacacacagggtggttaagaacaacaaacacaggcaaaccacttcaatagaacatggctggcggccatatggacatatttgaatccaacaattaattcagcaaagaaagctgcttgtggcaagttttgaatgtgccattccaggtagtgctttgatgataaatgaggagaagattgcaaagaaaatgacagcaacatttataaaagggtctcatgaatataacacgatgcccagcacatagaaagcatacaataagtgtttgttggataactgtggacagttcagtcgaccagcaaattcctcttaggactctagatgcacggagagtggccagattaatacagactggcaaaagaagaacttggcaaagtgatttgatcacacacttctcaccctcacatctcctgacagttcccctaatccctgccccacttccccgccatgggcttccatcaggaaactccttgatatcatcttcgagaagaaaactgaggcatagaacatttgggaatgaatctaagactacacatctagaatagcagagttacaggaatgcagatgtgattcctatggatgagggtaacctagaggctagaagaacaataggacagaagaagcctgggtccctgaacaaccttgtggagcatagacacctacgtggcctggactgccagctcacaatgggcctctctgtgagagaaggaaacttccctcttgtttaagcaactgtgcttttgagaatctcttggtctataccctaatgaataaggccatcataaatggatatcaaagtaaggaaatttgtgtaaatgatttaataaaacattacctcaggtatgaaataattctaccttgtgccttgacaacatcaggtattattcatgcccttttctctccctgtaatgtctcttatccacgg

SEQ ID NO: 2971 - DNA, 1500 bp, Homo sapiens
gccaggagagagggaggctgggaggcaatggctggatgggagtttatacccctgataattaatacatcgccctcaccacgtgcagggagctgttcttggcaggtatcgtaacagagctcctctgcaaatagagggactttcagagaggagaagcaggattcgagtttccaaaactaacactagatggagtcaggctgagtcatgaggaagtcagacccaaaagagcaagctaatgacaagcaagccactctcttgcagcaagttttgcattgtctttctggcttctaaggcttaggcaatgaacacccttttatcttgttttgcaggcgaaaccacaatttctccaaaagagatgcacaggtgattgagctgtaggtgagcagtgacgtgaagaggggttctagccccgtggaaaacagcccatggttaacatctcaggatgttctgcattcaaacacccaaggctggtaatgaactttcacatggactgaatattggaggcaaataatagaaggaatagaatatacagtgcctctgtcctgaaggaaaatatcatgcctcttctggaagaaacggactgcacagaggaaggattgagcaatttagcctgcagtggaagaaggtggacaccaaaagcttcaccctgtgttggagctgttcatgcttccatgaggccatggtgtccatgtccgtggaacctaccacagaaaatggctcatgaaaaggggaatccgacccaacacacagcttcctacacactgccatcttatcaacagttaggcactactttgtagaacgattagcttcaccctcttagctgccaggagatcccttcttaaagatggactatgtgaagattcgggagtcctgaaacatggggactccgggatggtctctagccctatcgatgatgaacactggccttctggaggggaaatggcagtctgggctggcgtggtaggaagggctttggtgttcatggaatgggcctgctgctctcagaccttcaaaggatggaaccaacgaaggaccaaatgagaaagcagatgctgtgccttgcagagggccatgaatgtcagttattatttttctccttatacaattattttgtggttattattacaatgtacatggctgttgcatagaagacatgactggtggaggctgaggaaagccatgacattctacaattgccatcaggctaaggccccgtgagcatttctctcccttgtaatattaaccctgtatttctgggatcacatcacggaatattctttgcctttccactttccaggaaatctctcggactgggctaccctccttgtgtgtgatgaaagatgagctatatttcagaacaaagtgctgtgttgtcatgatttgcctggactcccagggcgtctcttacccaacttgataacgatgctgttcattagcagcctttgttaactgataaccaagagcggtaatgtgatactcataagcaattttctgtgtgtagga

SEQ ID NO: 2972 - DNA, 1797 bp, Homo sapiens
gccgagatcccccgcgaggtgatcgagaggctggcccgcagtcagatccacagcatccgggacctccagcgactcctggagatagactccgtagggagtgaggattctttggacaccagcctgagagctcacggggtccatgccactaagcatgtgcccgagaagcggcccctgcccattcggaggaagagaagcatcgaggaagctgtccccgctgtctgcaagaccaggacggtcatttacgagattcctcggagtcaggtcgaccccacgtccgccaacttcctgatctggcccccgtgcgtggaggtgaaacgctgcaccggctgctgcaacacgagcagtgtcaagtgccagccctcccgcgtccaccaccgcagcgtcaaggtggccaaggtggaatacgtcaggaagaagccaaaattaaaagaagtccaggtgaggttagaggagcatttggagtgcgcctgcgcgaccacaagcctgaatccggattatcgggaagaggacacggatgtgaggtgaggatgagccgcagccctttcctgggacatggatgtacatggcgtgttacattcctgaacctactatgtacggtgctttattgccagtgtgcggtctttgttctcctccgtgaaaaactgtgtccgagaacactcgggagaacaaagagacagtgcacatttgtttaatgtgacatcaaagcaagtattgtagcactcggtgaagcagtaagaagcttccttgtcaaaaagagagagagagaaagagagagagaaaacaaaaccacaaatgacaaaaacaaaacggactcacaaaaatatctaaactcgatgagatggagggtcgccccgtgggatggaagtgcagaggtctcagcagactggatttctgtccgggtggtcacaggtgcttttttgccgaggatgcagagcctgctttgggaacgactccagaggggtgctggtgggctctgcaggggcccgcaggaagcaggaatgtcttggaaaccgccacgcgaactttagaaaccacacctcctcgctgtagtatttaagcccatacagaaaccttcctgagagccttaagtggtttttttttttgtttttgttttgttttttttttttttgtttttttttttttttttttacaccataaagtgattattaagctttcctttttactctttggctagctttttttttttttttttttttttaattatctcttggatgacatttacaccgataacacacaggctgctgtaactgtcaggacagtgcgacggtatttttcctagcaagatgcaaactaatgagatgtattaaaataaacatggtatacctacctatgcatcatttcctaaatgtttctggctttgtgtttctcccttaccctgctttatttgttaatttaagccattttgaaagaactatgcgtcaaccaatcgtacgccgtccctgcggcacctgccccagagcccgtttgtggctgagtgacaacttgttccccgcagtgcacacctagaatgctgtgttcccacgcggcacgtgagatgcattgccgcttctgtctgtgttgttggtgtgccctggtgccgtggtggcggtcactccctctgctgccagtgtttggacagaacccaaattctttatttttggtaagatattgtgctttacctgtattaacagaaatgtgtgtgtgtggtttgtttttttgtaaaggtgaagtttgtatgtttacctaatattacctgttttgtatacctgagagcctgctatgttctttttttgttga

SEQ ID NO: 2973 - DNA, 1087 bp, Homo sapiens
gtgctgtcaacctaaaggttaacaggttgaagggaccctgggctaaggaagcacaagctggagacaccaaaatggtcttcgcaactcgcctctatattttctgccctgctcctaagccagcctgttggccgactggcccttctccacagatgtcatcttgagcctcttacagagtttcagcactgacattaatgacaagatggatcacctacaggacaaccttggatcctcaaccagcctgattaagcattgacactgcatttgtcaccaccagctctgatggtttggacatgtagaaatgtattgcaggagaatatgcaaacagctgctgtaaggtgagctgatcgggacaactgccagcaggcagaagggaaggcataattaatgggcacccttcagcagagctcagagcagaccaaacgccaatgcagaaggctcaagaaagaggcaaacagactagccactgctccaggatgactgtggctctttatgagtgaagagaaagggtggagactgaagacagaactggggacagtgacaggcttggggaagaacagctgattcagcagtcccaagggtgacatcgcaaaatacatgggtgaagacaacctagtggccgtgacttggagcacccttcctcacaatgaaggcattctgggccagcctgaaaaacagcatggaaataaatcacctaagtacaagggactggcttaaaaatggtctaatgaaatgtcaaaagagttctcctgtggagcttcggagaagtttccttaccctttaaaaaaagaaaagaagaaaaggaaaaggtgatgatgatgacacacagaaggcatacacatttccatttctccctttggaaactttcatgtctgggttgagaagttaacagaaaggcaaacagcctgaggtcaaagatgacacactgaggataacaaaatggaaagacaatctgagctcttgatgatgtgtgactgaatgagccaaattaaacaactatagagctgttctacttccaatctaattatgtgagggataaatgttaatgcgctttttctttaggttttcatttagattttgtagtttctac

SEQ ID NO: 2974 - DNA, 7190 bp, Homo sapiens
ctggatggggcggctgactgctttataaaattaaaaaaaaaattaatattggctgggcatggtagctcatggcttttgtaattccagcactttgggaggctgaggagggaggatcacttgagcacaggagtttgagaccagcctgggcaacaaagcaagaccccacctctaaaaaaaaaaaaaattaggcatggtggcagtggcagtggtgtgcatctgtaatcctagctactcgggagcctgaggagggaggatcccttgagcccagaaattcaaggttgcagtgagctatgatcatgccactgcactccagcctaggtgacagaatgagactttgtctcaaaaaaaatttcatatttaatctctttcatcaaatactcttagaaaacatggtttgaagatacataagcaatctccaggcagtatagtatagtggttaggattgcaggcctccatgccagactggatttaattttcagctttatcattgaccaactgttgatcttggggagttaactaattgctgcctcgattttctcttttatttttattttttgagacagagtcttgctttgttgcccaggctggagggcagtggctcaatcttggctcactgcaacctccacctcccaggttcaagtgattctcctgcctcagcctcccaagtagctgggattacaggtgcaagctaccatgcctggctaatttttatatttttagtagagatgcggttttaccatattggccatactggtctcgaactcctgagctcaagtgatctgcccaccttggcctcccagagtgctgggatcataggtgtgagcctgtaagtgtgggcccgccagcctctttcattcaacatgtactttcatccagattcctcgggatctgaattcctgcaggctttctatcctagaagcactggcttttccagaatctaggcctgagggcaagaacttgcttgtcatagtagtggccaagtcataaaaccatattctcttccgactagggtaggctttagggttcagcttacttcccttcttggaacttaggttgcagtatcaggctttcaacagagctaggatatgctgagtctccttgagtagaggcggcagtgggaacaacgtggtttcaggagacataaattgcacgaaaccaattaggttatttaggggaaagaaatgaaaggtctgcactgaatctagggtaagacttcggtaggataggagaattaagttggtcttgaaattgaggcatgagaggggtccggcttgttggttgggagactgcctaaacaagttatagccacgccattctagacacttccatcctagaagggagggcccaggaagtctgtatataaccaactctagggcagaggctgccagctggtggcccgtgagccagacttgggccccagagatagatttgtttggtttgtggtgttgtaaataattttgaattagttgccaacatttgaaaatcaggacttgccttttctcttgaaaaatcaaaagttcaggcatcattggacccaaattcctgcccgataaaataagctggatttcagtagtcgtagcttctttaaaaaaaaaaaaaatttcttttttgtttatttaaaaggagtatccctatgttgcccaggctggtctcaaactcctggctcaagtgatgctcctgcctcagcctctccaagtgttgggattacaggcatgagcctctgtggagggctctggctccttttttttttttgagacagagtcttgctctgtcacccaggctggagtgcagtggcgcgatctcggctcactgcaagctccgcctcccaggttcacgccattctcctgcgtcagcctcctgagtgctgggacaacaggtgcctgccaccacgcctggctaattttttgtatttttagtggagatggggtttcaccatgttagccaggatggtcttgatgtcctgacctcgtgatccgcccacctcggcctcccaaagtgctgggattacaggcgtgacccacggcgcccagccggctgtggctccttttaaatggagtatggactccccagtccactgtagtcctccacttcttgtattatccccagactttcttgcctttgctcactcatattactttcctggcctctgaaggcactgcactttcagatcctggctttctggctgtaccccatccccttcccaggttatactggcaaggagatccaagcagctttttgcagatttcaggctattttattttacctactaattatcctagaacagtggttctcagccagaggggagtttatcttccaggagacatttagcaatatctggagacacttttggttgtcacaactcctggaagggggtgctttttgcttctaatggtagaggtcggggtgctgctgaacataccaccatgcacagaacagcttctcacaataaagacttacttggcctaaaatgtcaatagtgctgaggttgagaaactctgtcttaagggtgcactctgttcatatgtgttctggggttttggaatcttatgtggtgaggcagggccacaggctgctgactgaactcagtaagtttaggggctcatactcacttgtgggactaatggggagaaatgttggttcttgaggtaggtacatagggtctcctctttgcctaggtgaccagcaggattcacagtaacccaggtgcccagtattataagagtacttgatttgactgcagaagggtggtgtttctgccttgggtgttgtcagcccatttagctttgtgggctttgacctcgggatcctccctcttgtgtaggcttatacacatcaatggaaagtatttgctttgaagatttcaacatggaagtagttcattgctgacacagcggcatcaaagcccagcgcctgctcacagctgagactccattccccctgagtttgtttggcaagggtgacagtgagcaggaggaagagaaggagggagactgggaaggatgagactggagggaagaagaaacactgtatgatccctgagtatccattgtttccatgctttcctgctctcttggacccaggcctggtcagagttctcagtagaaaagatacgctcctcattttggctagttgctatggacagacaactttcttgttctgagagtgatacggggctagggaggactgggtcttgatcatagttgtttcaagactccaaccctatatatagttcgaatgctttcataatgggactaaatgtatttgtgtaattaaaaacaaagacactggccaggctcagtggctcatgcctgtaatctcagcagtttgggaggccaaggcaggaggatcacttgagcccaggagttcatgaccagcctgggcaacatagcaagaactcgtctcttaaaaaacaaaataaaacaaaaaaccacaaaaaaacaaggatactttaaaaaaagacacatacattacatatttatatacatcccaggaggtagccactgattctgggatccccatttggaagggtttacctcccctggagtgttggagagcatttcactcctgaatgtcttgtagttgtcccctccctaccctgcctttcttcctttcttccttccacatttttttttttttagatggagtctcactctgttgcccaggctggagtccagtggcgtgatcttggctcattgcaacctctgcctcccgggttcaagtgattctcctgcctcggcctgctgattagctgggactacaggcatacgccactatgcccagctaattattttgtatttttagtagagacggggtttcaccatactggccaggctagtctcaaacccttgaccttgtgatttgcccgcctcggcctcccaaagtgctggcattacaggtgtgagccactgcgcccggcctttcttccacatttttgttgttattttttgtttacggttgcactcctttgtccttgaatgcccctttataacattcagcctgtctgggaggaattggaaggtttccctccgctctctgttgcctgtgggaaaagagagttgtgactactgtcagcgtagctgggagtacagcttcagattgccaggcaatctcctcatcagaaagagagtatgaaaggcacagttctgcgagagggtgcatatgttattcactattaacttgggtttcagacaacagaaaacctttagcagcatggctcaaacatgttgatgtttgtttctctcacatgttaaaaggaggcagtgtggtttggatgacttcagttcttcagggagccaggtttattccttctgtcttcctgccatcctcagcctgtgacttctagctggtggtccaggatggttattgaagctctagctgtcatgtctgcactgtaactgacaagaaggacaaagacactgcctcccccatttaaagacactttctgaggtcttatatgaaatatttgcatacatcccgggagaaaacctggttgcacagccgtacctacctgcaggagaggctgggcaatgtcagctttattttggacagccatgccttcagctaaaatttctattacgaatgaaaaagggaagaacagatagaggaagataactagccatgtctgccacagagactttggggatttgtttctgctttggctttcagtttggatctgccatttgagtactcctttctcagcaataagctcccagagagccttgaagaccctcacgtgggtcccacgctccttggtgcaggcttgtccagcaaggaaatgagatcaggagaagagggaaggcttggatgttttaattgtggtagctgaatcttagcatctggctttaaggcccagttgttgactttgtttgaactctgatagtttatggtaagctaggggggctgggagttctgggaagcaatagaggagtaaggatcagatggtgaaattttgtttcttaattagaatcaggagaacagtcaagggacttggcttctgcttgacagactgttctaggagctctctgttctctggcagggctgatagtagggtgaggcaaacgaggtgcctggggtcagcgttgaagggcgtactcactctcaggttccggcatgtggtcccctgagagtgagtgcctccttaaattttgtgccctaggtgcctcctagcttcacactaccctggctctgccttctggtgctacattgttgctaatgaaccatttttatttttaaacaaattcttttaaaaattttcaggggccatgctaatcttctttgcgtcgttccaattttagtatatgtgctgctgaagtgagcacgaactatttttatttttatctagaaagaggcgtatgttcacggtaaaccatggtaaaccacagagtggaaaaagtctccttccctctccacagctttagtctttctccccagaggagccactctgaccaggtgcttttgtatccttccagctggtctattggaatggactctgcaggcatttccacaagcagccttctttattcattagtttagcacatagttgaatttccactgtgtgtaatatttacctgtgcacagagaggaccaaacctgtaggacatttatggcaggatagaaggaaggagaaggatcagaagtgagacccagtgccagttagtgggtctgaggagtgtatcagcttctcttccccttggagctgcaaaccagaagcacagttagcactgccaggatattgtcagacagtctctttctccatgtttatttccacctttttgtgtttctctccttttatcctcttctgtctctgcctccttgtctcttatctctcacccctctgtctcttctgtgtattttctcgtcttttttttttttttttttagagacaagttctcactctgttgccctggctggagtgcagtgactattcacagatgctattacagtgcactataggcccggactcctgggttcggcagttctcccacctcagcctcccacacagttgggactccaggtctgctgacatttgtgaactgtgcctatgtcaagtggggcacacgtgtgcaggacacgttcacttacgccaaggtcgtagcgctcattgccatcattgtcatgggccttgttaaactgtgccagggtaagtggtgggaaggggggtaccaccaacagttcctctggattccctgaggagaacatggcgactctgttagcttcactgctcggctgtttctatgtacatgctagcatgtgtcagtgagtgcaagagatgggagtagatttctttctgggctttttgggccaggctggcttggccaagtggacatgagtcagcctgtccctcagggctggtttcctttggtggaggctgggagcattgcaggaagccagccaagggcctaggagctcctgaagcttgggtcatgattgggtcataaaagtaatctgtggggatagagtggctcctgtttgtggtctgtgactgccaagctacaagtaggaagactgggccctccttgagacaggtggcagggtatatggagctggaagtggggtatggaaatgggtggttattttgcagcctttacttttcatctggacttgtattcagcaatccctccccaagtcagctctcagaaaaatattaaaatattgtgaaattggcagtgtctttcctaaatgttggctttagaaagcttttcattcctggatcagagaggactggcagtgagggtaacaggcctaccaagatctcatgagccctagagaggtcttgaggtgtctttagccacagatatctcaatcatttcacagcccagttctctaggtcatcagtccctaaatgtggctgtgtacagtcacccggggagctgagaccctaatctcaaatctgttggatcacattctggttggtgtggagtctaaaaagctgtgcttttaagaattgcccttggcccggcacggtggctcacgcctgtaatcctaacactttgggaggctgaggtgggcgaatcagcaggtcaggaattcgagaccagcctgaccaacatagagaaaccctgtctctactaaaaatacaaaaattggctgggcatggtggtgcgcgcctgtaatcccagctacttaggaggctgaggcaggagaatggcttgaaaacaggaggcggaagttgcagtaagccgagattgtgc

SEQ ID NO: 2975 - DNA, 4618 bp, Homo sapiens
cggcggcaaaactctgcctctgcctggaatgtaaaacccctacccccacttgctaggtgcttcagtctccttggccaccaccctgctgcgtcagccctggctggaacgtctccagtcatggagagctcattacctccggaagcagccttcccgttttcaggagactccacctgttatagagttcccgtttctcaccgtatagctgggggaggaggctctgggtttctgcagacctgagatgccttaatgaggaacagagcccacgtggcatgggaactgttctctgtgacatcatcctgctcaacttcctcaagggggccgaccagtacaaagccaagaagtttgaggaggtgaatgagactacgctgaaaatcgcggctttgaccaacccagtgtaccccagcgaccagaccacagcggagaagcagtccaccgattcgggggccttctccataggccactagggcctctttccagggccccacactcacaaaggctccaggcctccccacagaggaccctgcctgagcaaggggcatgggagggaagaggggctctcatttctgctgctcattccatgagcatagctgggacccaagtgtctgggcctccgactgctccagcagacaggcagtgctccctgctgagaccccaatctcaccttcactccttgcctggccccatctgcttcctaggacccctggggcaggagcacctgagccatccccttcccaaagagtagagattataatgtaggacagatggccacaagggcctaccaagtgccaggcactttcacacacgttatctcatttaatccttagaataatcctatgaggtagatattagtttcccttgttttgaagataaaccaaggctcagagagactgagtcatttgccccaggccagatagccaggatgtgagagagctgggatttgaacgtccgtctgactaactccatcgcccacaccccatgagagaagaatgaactcccagggtccatcagccctgctgcttcagccgcctccaccctgacggtgattcggttaataaagagtaagccccatgcctttcccagcaacaaagtttgcattttagggagactggttagacagtggtgagggaccccatctctgacttgggtgcatcccaaatttagaaggaaacagaaggcatggctgtcagtgaatttttcctcatcactccccatagctctctccccaaaccagggaaggggtcattcttgttcttctctgggaccccacacccacacacatctgggccccctcactctggggatttgattcccggacctgggatcctgtcgtaggctgggaccctgttccaggagttcagcagtcctcatttacaacaacagtgaaaatgctccagtaaggcctggtgccttgtgagctgctcagctgggttggccaggcctgtccccatagggtcttaataaggtgccccattttctaaggttagaagctaaaggggccttttaaaccatcttatctaaccctcttgcttacagatgagcaaactgaggccagaaagggaaaatgactggttcagtgccacagttcatggccaaaaaggaacccacatgtcctggcccttcagggaaggaggcaagaacaggaagctggatccattgacccagacatcctctatcccctttctgtcctctcctacagtgagaggcccagaaattgccccagggcagggctctggggcagaaccaggttttgtgaatcctaagcatatacaatttgggggcatctctttagaaagaatacaaaattaggtattagaaggggctcatgcaagtgaatgagcctaaagaatgtttcaatagcttcatgataaatctgcatctggcagtcagagtgggcatgatcatgaggtcttagctgcaccagctcaactgtagatggagggcggcccctcaacacacggcacaggaagtggggaagggacagcttcaggagtagttcaggaggctcaaatggtgggtacttgcaaaggccttgcccaatgaccccccgctccagggggagaaggggtaagacccaccccacataaagctcaacaccccttccctcactctgccctaacccacagccccatgcccaggatggtggggcatatctccccagggtcagccttgggaattgggcagtgcctggagatctgaccagactatgcttctccagcagagacatcagtgaaggcagcaccacattctccacctgggactcccccaggcatccctggggaattcagctcttgggaggctggggtcacagggattctctctaatggggagatggaggcagtggtgtcctgaagggaccctcccccccaacccctcccttttacccagatggaggtggtcctcctgtaggtgcctccgcccctctggagccggccagcaagtgtgtgtgagcctgaggttgtcctccgcatatctgaactaagttaccacttctgtgtgctagatgtagggttaatatcagtagtgataaaaacagctaccttgtctctgttgcattatggtttactcagcacaatcaccaacataatcacatggaccctcacaccaacgctggtgagtccgctatggtttgtcattaatcctatttgatagaaaaagaaatttacagtacgtggaaatgagatctggaacctatgcccattcctaacactacattgcctctttaatcattcaacataaaagccaacactgattacttactattggcaggcaatggaccaaatgagtgacagggattgtctaactcaacccccactttacagaagaagaaacagatgcatactaaaataaagaaactgaaatagaagaactgggatttgaacctagaacttaatgactctggagtctgagatcacgacttctatgctctatctggggaaaatccagaaacttgttagtacctttttttcctatgtgtgttcgttcaggtaatacaggttttgctgcagtgacaagtaaaatcgcaaggtttaatacagcaaagtaggtcagacagccccctccatctggtagctgtgccatctgagacacttggactcccaggtcactgtcacagggaaagtgaaaactggaggatcacagggggtaatctgaagatcaggcctggagtgggcttacttcacctccagccactttccattggcaggattcagcagcgtgctacagagcccagctttactgtaaggatactgggaaagtcctagtcctcttgggtgtctaggaagagaaaatagtgagcacggccctggctctgcttcgttatctccattttaatagcttctcttctccccctcccaccccactcccaccatttccactgacaattccacacatccttcccttctgtgttccttctcacaaaaccttgttctcagcaagctgccaatcagccttccaggggtattaatagataacattctggggaatttcttctctcaagagtatttcctttttaatcaggggttattcaagactggaaggccttaatcagccaaaggaatgaaaatataagaattgacgttgaggcctaatgctagatcgtgctggagatttgagggacatcttatctaccctggtctgcctcaagtaagcttcagtctggaggagtcttagcccctcttctttcccctccctacctctacccctggttttgactggcaggatgttgggctactggatttggctaaagttcgttctccatcagggagataagtagaggttatacaaagggcttggcattcagctgaaatcccaatccccagaccacgtgcacagaacttcctttatcgcctgtccttcccacccccacagacagacaacactgttcttctagaagcatagcatcaaaagtgggcttattctaaagcatgactctccaataggaaaaaaagaaaaagaatgggcttattcatataaaaaagaaaagctcagtatcactgatcattagagaaatgcaaatcaaaactacgacgagataccatctcaccagtcagaatggctattactaaaaagtcaaaaaataacagatgctggtgaggttgtggagaaaggggaacacgtgctcccttggtgggggcgtaaattagttcagccattgtggaaagcagcatggcgattcctcaaagagctaagaacagaactaccactggacccagcaatcccattactgggtgtatcctcagaggaacataaatcattgtaccatgaagacacaggcacgagaatgtttattgcagcattattcacaatagcaaagacatggaataagcctaaatgcccatcaatgacaaattagaaaaagaaaatgtggtacatatacactgtggaatacgatgcagtcataaaaagaacaagatcatgtcttttttgggaacatgggtggagctagagaccattatccttagcaaactaaagcagaaacagaaaaccaaatacttcatgttttcacttataagtaggagctaaaggatgagaactcatgaacacaaagaaaggaacaacagacactggggtctccttgagggtgaagggtaggcggagggggaagagcagaaaaatattg

SEQ ID NO: 2976 - DNA, 495 bp, Homo sapiens
gtagcctacaggagagcagaactcactgcaagcaaaaaggggaagaaacgctcacaaaagggaaggcagcaggaaaagtaatcgggttgagctgtggaaatgtgttcttcaacgttggaggtgggatctggtgggcagtgtttggatcatggggatggatccctcaggaatggcttggtgtccaccccacggtaatgggttcacaagagatctggttgatgaagagtctgggacctcgctcctcttccttgcttcctcactcaccatgtgatatgcctgcaccttccaccatgattggaagcttcctgaggcctcatcagaagccaagcagatgctggtgttatgctggtatagcctgcagaaccatgagccaaataaaacttttttttttctcaagatgggggtctcaccatgttgggcaggctggtctcaagcaattctcccacctcagcctcccgaagtactgggattgcagagtgagccaccacacccaac

SEQ ID NO: 2977 - DNA, 26089 bp, Homo sapiens
cccgcctcggcctcccaaagtgctgggattacaggcgtgagccaccgcgcccggcctagtgtctgcttttaactgataatttccattcagcgctagattgcaggtcccaaggaactaccaatagatcattatgttttcccaaaatgttctttcctgcttgtcacccaactgatactggatatcacatgtaaaactgtggcacaggtcatttattccacagagcaacaacaacaacaacaacaacaaattgtgggcttttgaaactagcacccagttccatgcctgggaattggcatacagttaaaaggtgtttgtagaataaacctggattcttatgaagagacatgtttcttagagaataaatttggccaaaaaagaagcactcatttatggtccattgttcagaacagtgctctaagccattgtcagtctgatcttgctgtgataattttgtattgaagtcattaagctggggacaagcatcctcagaacacgaaaaaccaaaaataagccaccatacgtttatgctagaaagttattgtcagttcttagttattgcgggatctggccagcagcccgcaatgcaacggggctctctctttgttcccaggtggatcggcaggttgagaaataatagacacacacaagatagtgaaagctgggtccggggggtcaccgccttctggtttcgcagtgtcaataatgcactggatataccagcatttattattaagtttagtgagggcaggggtaggttagtgagggatttagggtcatttgattatgaggtgagatggtcacatggggatgaagtaattctttaacataacatttgtatgtagaagtacagtgcatttgtatgtagaagtacagtatacagagattagaatttacaatatagtgtgtgtgtcagtaatttctaacagagccttaaaacggaaacacagtctttccataatctatgattagcaagatattaatcagcagtaacaattgcaacaaaagctggttacaaacaatccatggaaacaggacgtgaagctagacaaccggttagaccagaaattctcggaagggagtatgccttaaccctaaagaggcctagaaaagcagtggcaagatgagggtgtttatagccctatgttatacatatggacaggtgccccaccatgtgtccatttataggctctccacaagggttgcattccattcccagagctatgaacatctgcttttctgggataggaatcttggtgatgtgaaacctccctgactgcacgtccattcataggctctccgcagagggaagcacatcacgcgctgttggctcgttctggcggtccaacctggcattgtctttacacaatcctgcatgcaattttgtatttacaataatcaggagcatttcatcttttattcagtagcagtagtttcagggggtctccctacacttagtttcttcaagaaaaaattttggtcaccaaaaataggtaagcagctgaattctgccttcagcatgtcaatagggaaacataattaatcagaagaacaggctatttgaaatattgcaagttcacctcaacactggaaatcagtgtttctcaaagtatcttcgatgggacatttgaataagaaccaatgtatgagtccaatcgccaatgcagatttccaggccccaacagcctgtttacactcattatttgggggtattcacaaaaatctactttttcaactggttctcccagaaggtcctcaactagataaagttaagtaaccttccccatgaagtatcattaccatagttctagttgggaaaccattcagggaacaaatcaggcatcactgcagttgtgttttgtgcagaggaaagtgatgctttaaatgagacacctggaatgtttgttttagacttgcatattttctgtgtctttgggcatcttatttttagttgtagagctaattatctgatgataggatttttttaagaaaaggaagaaaggaaggaaaaaggaatacaagaagctagttttctttgtcattgcatctagtaagcaaaaaaaagggcttgatcacaatgactatgtggaggggatgcgagaggaggttagacaaacatattggataggtgagaggtatgggatgctatgtagcaagcttagaattttcaattttattctgtaggcaatggtaagttagtgaaggtggagtagaggaatcagatgatcaaagcttgtcttgaaaaagtaaagaaagaaaggcaaactatcaagtggactacagtggagagagcagtatgtttaaaactgcaagagatttttgcttgcatgcatgaaaagaaaaggcctgcgcatgcctgaattcaaccaagagcaaagggttagttgccagctagagaataaaaacaaaatacctgctgatcagaaaaacaccctgtgagcagattttaatcaaagccctaaatatgatcactgagaagtgatcatattcccaggtcactgttggaggacagcatttctcttctagatattttttgtgttgttgagtttggcatcctgcttgggattcttctgaaggtttatgtaggttgactctataacctcagaatatttgcttaggatttgatggtttttcaggcagactgcacagagattctgccttggctagacttttcctttgattatagaggggtccatttgtctggtagcctcttcatgtattcctttgaatgttagttgcaatataatgtcaccataaaaggatagatagtaaaatggtagtgactgaaatctttcctctcctaccaccattaaatcagagtcctcaataactcagaatctcattattattttgatggagagatgaagggcaattcattctttcagccctccggtaaacattgaatgccctctatgtgtcaggtactatctgagatattggcactgtgaaactatgaaacaataattttcagtcaagtgtgggggaatgggcacctacatggctaattagtggttaccatcactcttaggataaaatcacaaatccctcatctagtcttaaggcctcaggtcttctagcctctctgttgtttctaggcacattttgtttcactcttttcacattaggtgtgccacccacgtggctcttgtttctaacattaccttggtcctctccacttcagagttttcttgtttgctctttctgtatccaggaatgttctcctatttcccatttgtctggctagcctccatcattcttcagaatttattttaaactgtcacttctctgaggacactttctttatcctccaacactggttattcacctcttgctacgtattctcattgctccttctgtttttctttcatagcacttattaataagagaattgaacattttgataatttttggttaatttctatttcctgttccagactctaagcttcatgggagtatggggagtggcagaggcattcactgtggtaacttcagcatgctgaccagaccataaatggcacttggtacacatttttaaaaatatttgaatgaataaatagaagatcgtgagtgcaacagttgaatatgcatggagacagaggatgagcatatcaaattcaatttggaaggatcagggatatcaatactttaaacccagtatctactaaatacacaaaataatgccctgtatctcttcaagatcctaactcatcaaccacaaactaaactctaatgactatgtttactatgatggtaaaagttactactattttaggaaaagtttcaacaaaagtcaaaacagaatgatttctaatgtaaatcttaactataagaaaataagcacattttcaattaatggacatgtttctgtagaataaaaaatggctatttctatgtttgatcagtttatatataatcctttctgagtaaacattccactatctggtttaataacttcaatatacttcttaaagattaacacgattatttgcttcatttagtcttagtttttattagtgtacttgctgtaaattgtttctctcacttattttttatttcggacatatctgtgttgttgtataccaggtcaaataatattctaactggaatatacatttaagggttctgtattctctcaccatctaagttgataatgaccttagtcatttttgtctttaccaatttgcctgtttgctatatattcttaaggtagttcattgaggaaattataatcaaaatctatgaagtttgactaattattactctcaacataaagttaaaatccaaaagatctctgtggaatattggtcagacaatgtatgaaggcatatacatgatgtatagtaaaactaaatccatttgagctatccattatcctaggttatcacatatatgtcaattattaaccaaaattggcagtaaagtgttatattagtctgttctcacattgctgtaaagaactacctgagactggataatttataaagaaaagaggtttaattttctcgtggttccacaggctgtacaggaagcatggttagggagatcatcaggaaacttaaaatcatggtggaagcaaaagggaagcagacacatcctacatggctggattaggaggaagagagagcaggggaaggtgccacacacttttaaacaaccaggtctcatgagaactcactcactgtcatgagaatagcaagggggaagactgcccccatgatccagtcaccttcctcagactcctcttccaacactggggattacaattctacatgagatttgaggggacccaaatctaaaccatatcaaatgtaaaggctggaaagaaaaaaaaagtcaaatgtacacagttttgcacattggaaaacatttactggtggtcgtatttacaagtaacctgactagatattttgaagttagaaaatttagggttcagtccattgagcaaatatactgagctttccctgcatgaaaaccattgtactaggctcaactgaaaatagtggtggtggggagagaagatttgttctttcaagaatttgaaatttgttcagaaggataaaagcaaatagaatctaacaactgaataatgcttgaaacatgacatatgagctaataaaaatacatcaattacagtggtctttaattacaagttagaggtgccaaccccctgcacaaatgaccatcctcatataacttttgactcccccaaaacttaactattaatagcctactgttgcctggaagtcttactgataatatagataaccgattaacatattttgtataatatgtattataataaagcaagctagacaaaagaaaacattattaggaaaatcataaggaaaagaaaataaagttactatttattaagtggcagtgtatcattataaagatcttcatccttgttgacttcaagttgagcaggctgaggaggaggaggaaaaggagagtttcgtcttgttgtctcaggagtggaagaagcagaagaaactctacatataagtggatccatgaagttcaaacctgcattgttcaagggtcaactgtaattagttttgggtatagtgatagtaaataaatgatgtgagaggcactgaaggagagcttcctagagggggtgagttttgagcaaaaagttgaacatgtgagagcttatggatttgtggggacaaggcagggtcatgacttggtttcattggaatgagtaagtcctatgcaggtcccaataatagtataaaaacaattagaaactatgtcagttggtgactaaatggctgctaaaaagtagtttggttcataaaaattatcaattttaatgatgttttgaggacattatacgttaaaaagtaaattctttattagcctgatgcctaaatgcaactactgcacaactgttttcatttttatatggtgctctacaagccttcactacatatgtatattttacattgttgcaatcatagtatatacagcattttgtattttgcatctcttatttaactgtgcatcataaacattttctacctttctatatagttacaataactttaacagtataaattttatcatattgatctattgcaatttactaaatcattgccttaatattgcatatttagattgcctcctggttttattttattcttggtaatgctgcaatgaatactgctgtacatacaatatgtttttcttctgtccaattatgttagagtacaaattcacaaaaatagattcatggaatgtaagggttagaacatttttatagttcttgctgttctgccattctgatattagggtcctgcaagttttacttggccactagcaaggtatctaggagccgcttttctcgtgtgtatgccaacaataggtttaattactagaaatgtttttgttaattttataagcttgaaatgctattttaagataggtttatttagggtttcttactttcttgtgtgggtgattattttcttagtttgcttattttttgtatttccattcatataaattgtatgttactctcatttgcctttttagctaaaatgaaaactcttttcttttccaaataataagaattatttaaagggcatgagatttatgtaggaccaatggaaaatattcactcaagaacaaaccaggagaattttttgtccttcccctgtgaagtctgagcatatcttaatacataaaaaaataagtaaatgtgctgctgctgtctccggttgaaacggcaggtagggggtccactttcttaggctctttactttcctggctgctgaaacagctctgcagaatgaacattaacattgttttacagtaacagatacatatacttgacaaaatagtctatggctgagttcaaattgtaagttaaaataaagcaaagttgttttagaataatgacactataaggaaagtttcactgcagattttttaaagactcaggcatgcagaatatattttttccttattcagtttagtaaactataaaacaacatattgattgccgagaagaatactaaagtgagccaggttatgatttagaaagctttcaacgtagaagaggagataaggtacgtatacaaatagcaacaagatgtgggattatgagaacattctctaactgaagagtaaatagattttattccatacagaggagaaagagaattactttattggggtggggggccagcaggactcatttcaaagtcttgacaggagattctagtaggcagcattcagggttggaaggagggtattccaaaaagaaaggccagcaagaggcaggtcagagcaacaggtgtgcagggaggagatcgaaggaatgggcagagttcagatttggctggacatgcctcaggtaagaggggtaaggctgaaatcatcgtaggagaggagaggggtgcaggcctgagaggtgtgacttagggattttagacttcttgttttggaaatggagatactttatttatgtttttgagatagagtctcacgttggcatccaggctggagtgcagtgacaggatcatggctccctgcagcctcaacctcctgggcccaagtgatcctcccacctgagcctcctgagcagctgagaccacaggcacatgccaccatgtctggctagtttttaaatattttgtagagatggggtctccccatgctgcccagactggtcttgaacttctggcctcaagagatcctcccaccctggcctcccaacataatgggattacaagtgtgagccgccatgcttggctgggaatggagatacttacggagagtgacaggattaaaactacctttactccacttccaactttttttttgacataaactttcaagtaatgaatttttctttggcaatttccatccttacacattttttttcaagaactttctgtaaattgtttgtgtccatgagaaagagtaacatatgagaaagagtaacacatttcagaaagagaactagactgagtgtcatgaaactggattatagtcacagcatactgggttatttggggtaagtaaatctgcctctctgggactcagcttccccatgtgtcaaatgagaatgaactggatatttccactgtttcttccacttcaaacattctgaaatcccaaatatattttgagtacattaaagattcattttctaaaatctatatatcttctctataaacttgaaattccatcttgagggagtcatttctttgtattttagcttttaaatcatcagtagttctctttccaaatgagaataacccaaaggtaatatggcaaatcagtggggtgttgagaattcaacacgacttaattatattaacgatctctcacttggtgtctgggggagtagaaatgtgtcatgtgaaaagtgacgattgaaaagagggaatacttaataatggtaataataacaaaaaccacttacatagcacttaccatgtacttttatgtggattaaatcacataatcctccccacaaccttgtaaaattggtactactgtattataatcacttcacagatgagaatgctgaggtatagatatataattacttccttaagggcacacaactcattagtggcaaagccagaatttgaacccaggaagtccgactgagcatccgtgtgtttaattaccacacagcactttttctgaagggtctccggagagaaacatctgtagagctggattatgtctatagaaacacaaagatctcagtctccaggggacatgagtacaaggttttaggaagggaagatacaaatgtgccagtaacactcttgtgacctcaacattttgctcaggaatgtcatcatcagaagtatcattataactaatcaaaacaatattagcctctcccttatctgaactgtgttttaaaatgtagaattatagttatactactttggcatgcattgatttcagttagaggaattcggaggtggatagatgagattgttatttggagctcttagtatattgcaagaccagaatgtccaagcagtgtggctgtgagaatagggaaaaccagttgggttttctagtccttgggtcatgttgagggactaggactcctttatgcatttctcagctcaactctttgaaaggtcaagctttcatcaaagtcttagtattttttgctggctttctttaagaaatagttttcctatagaatcccttagaaaaactactttttgttttttctgagtttggcttctcaacccagcagacaggcagaattggaaagaaaggtcttgtcttcaatctatagaggtgatcaggtgatcaattaaaatactgtatgtactgtccgggtgcagtgactcatgtctgtaattccagcactttgggaggccaagaggggtaaattgctcgagctctggaattcgagactagcctgggcaacatggtgaaaccctgtgtctactaaaaataaaaaaataaataaatgaataaacaaacaaacaaataaataaaactagcccagtgtggtggtgtatgcctgtagttccagctacttgtgaggctgaggtgggaggatagcttgagcccaggaggtcaaggcggcagtgagctgtgattgtggctctgcacttcagcctgagtgacagagtgaaatgttgtctcaagacaaaaataataataaataaaatactgtatgtgactgcgctttgtgacttattaactgccctacagatacaagagttgtggttatatcccctgaacatttatattccaagtgaccatcaccagagaaattcctctgttgaaagcaagtatttgaacagtcaagatcacagcttttgacaccaagcagatcagggtttcaattcttaagtctctgtacttcatagaccacagagagagcatgggattgacatccacactgaccctgtaagcttgttttggggcttcgatggggtagtacatgtgaattgccaagtccagccccacagagagtactcaataaatcttaacttttattggtagtgttagtgatagtcatagaagcaccattctaaagcaagagccagaaaaagcaatagaacaactctaattacccagcatatacttgaaacctaaactgaaattaaaaggtaaattttaagaaaacaattgtgtatcccaagtcttcagaggcttattctctttgacccagttatttcacatctaggattctattctaagtaaatagtcagggattaaggtaaagacttatgtacaagaacagtcattgaagagtttttttttttccttcttgagacggagtctctttctctgttgcccaggctggagtgcagtggcccaatctccgctcactgcaaactctgcctaccaggttcaccccattctcttgcctcagcctctcaagtagctgggactacaggtgcccaccaccacgcccggctaattttttgtacttttagtagagatggggtttcaccgtgttagccaggatggtcttgatctcctgacctcgtgatccacttgccttggcctcccaaagtgctgggattacaggtgtgagctactgtgcctggcctgaagagttatttttaacagcgactgttagaacctacacgtccatccataggagagtgctttaatagagtgcaatgttgttatgagatatttattttgcagattataaaaaataattcagaaaaatatgtaatgacaaggagcaatactatttaatctttcagagaaaagtcaagattatattatggttttaatgctattaattatactaatatttataaaatatgtgaactaaatagatgtcctttgctgaaagtggagataaaaataataacgataatgcctatcttagaggatttttgtgaagactatatgatggttactacatgcctgacatataatacatgttagctttgtcattggatgttggctaaatttaacttattttctaaattttacttaaacttcatcatacactaatgagaatcttttattttacaggaactgagcaagatgctggggatacagaaatgattaagtaggtacactgagcatatgacattcacaatccagtgaggagagaggcatataaataaacaggaacagtggatttagaactatttaaattctagagtcagctcctaagacatgaaacacatattatcaaaataattaggtgcacagccattataggcaccttttcgtgagttttaaaaaggtggcccctctctttaagaatgaattatagaaaggtacctcttgcccccagctgaatcagctgcacggtagggtacaggctgggtttcagcccctactgccctctcctggtttattcctgctggatgcaggctgctcacctgttcacagaggccctgaaaatacctttgaaatgtcctgaaattgacgtgaagcacagtaaatatgatttggtgtctataaccttgaacaataattattttgcacactgaggtttgagaaatactgaactagattaaatgatggaacaaaggaaaaaatctataggcagttgtccagataatcccttgtgttgtatgggaaatgtgcagagaattctgaagtgtttcttcttaactgcagagttgtctccattatattttaatagtgtcataagttgaatacacattgatagttttgttttcttgagcattgcataatataaggaaaagcatcgagcccagggattcacatatagcaaatgtttactaaatattagttaatccaagtattaaccttgtttcatcatatccacaggcatagtgtgctttgaaaagttatagaatagtgcttgcctctcattttttgttttcctcactgaggtcctgctaaataactctgagcagttgtcactcccaaacccatggccattggattaggcagagttcttcagagacaaagaaccaatacaggatatttacatatccttgtctctgtctgtatctctctctctctccatatatacacatctctatttctatatctctatatctctatatctatctatctatctatctatctatctatctatctatctatctatctatctggctagctatctagctacctagctagctatctaaaaggagatttattatgaggaatatgttcttgtgatgacagaagctgagatattccacattctgccttctccaagctggagacccagaaaagttatggtgtaattcagtcctacagcaggacaagatgagctgtcccaggtcaaacagtgaagcagaaaaaaaaaaaaaaaaaaaggtcggggggtggtggatttctttttcctctacctttagttctattcagactctgagtggattggataatggccgcccacatttgggaggaaaatcaactatactgactctactgattcaaatgctcatttcataggaaaacacccttaagtaaacacacccccagaagtaacatttaatctgggcaccccatgacccagacaaatggacacgtaaaattaaccatcatggttatttgtcttctgcaaagttgggaatccgcccatgagctgaatggtgcatgatgtggctccgcgggaacacaatgtgcattagcatagggttctggacaaaactgtaaggtgtccccaagagaggcagaacagcttctggtgactagctgcacattcactctcttgctacaagtttaaatagtaagcagtagctataaactttggtttcaatttgttagacaaagcattgcctggctctttcttctttacagagttattatttctagtttgcttgtacctaatgctttcctccagggatttcagaactgttcagctgcaaattcatatttgatgttcttgttctaatcccagattaccgcatgaggacagctggaacagaccaaaagagagaaactcatagggggaaggaaatcattagcctgtcttgagtcaccaggacctgataaaaagtcagattaacaaggcttaagctgctatagaaagccagagaaatgccctcaaatattaatcttgaatatttccattccactaacattgcctggaagtattttaacattcaccagataggcatcccatcttgaagaaacgatatggttctgtaaaaagaataatgaattatgtgaggattgattttcagtatggactttagtcctgcatagtaatggaatgtggactggggagcaaggctgtttggattcacatcctaacatttcacttgataagttgcctcatttgtaaaatggggactgtaataacatctacctcctagggctttgtgtagaatattaacaaaacagaatcttgcaagggttaagcactcaataaatgtgagatactattattattgtcattattgtaacagataaaagttggcagatattggtggatgtattcattgtcaaatctccctttattagtctttatattattaaataattgggaaaataaattcattttattttatatgcaccataacttgttcaaattttatttcttaatattgataatgatttatcataaaatttatagtttatggagtaccttcacatgcatttcttcctccaagccccacaaggatgatgcagctgaggctctgggaaattggttatttcatccagggtgcctgattggcgagtggttaagacttgaacccatgtcttcacaccccagatgcattactgtagctgttacactgagtggaggttgtaaacatacacaggcttcgttgttgttagaatcttgatttgattgtatcgctaccacttactataggtcattttgtgagcaactgcctaatttcatggaatatcagattttatatcagtaaaaattagaggacaatgacttctctctacttgctatataaattaaaaaatatatatatcagatcacatatagagatggagctatcccagctctgggtccatggtagttaacgcaaaggcagtctcttccttcatttatcgttgataatgtaccacacatagtgccaaactatcattttttaaaatcagatcaatgttttcatcaaagaaagctgatgttagagtttgattctagtggcaccaagatctcctgtaatccatgattgcgtttgccagccattcatggtgattaacatacttttgcgaaaaagaagtgacaatgaggagaatgaaggtaataaggaggaaaaaaagaaaagcggacttcctctagacttagagaacatacaaacttcattagcagctaaatagcaaggggagagggtcccgaacaatgatttcactcctttgctgctgtgaactaggtgttctagacataaaaatagaggaaagactagaacatatgttcagtgggtaaatggccctctgcgttatatcatcctggtgaggttttctaattattcagaattatcattttgattgtgaaacaaatgcttggtttaggggaatctttggattagactgtgtgctccttgtacttcgtctccatatggttcaaggattttaaggtgaaatgctacaaaaatgtaggtgaatgataaagttgctagaagtatgtcagagaggtgtgagaattttgccttttcatactgtggggattattttgtacactgctaattttatgattagtcctggatcgaggagtgcaagcaattgatatatcttagatgtttgactttattatttgtttttttttttttgttgttgttgttgttgttgttttttgagacagggtctcactctgtcacccaagctggagtgaagtggcacaatctcggctcactgcaacctccaccttctggattcaagcaattcttgtgcctcagcctctcaagtagctgggattacaggcacctgccaccacacccaactaatttttgtatttttagtagagatgggggtttcaccatgttggccaggctggtctcgaactcctgacatcaagtgatccacccgccttggtctcccaaagtgctgggatcacaggcgtgagccaccatactcggcctagttgactttaaataacacaaaaggaagttccactgaaaaggtgaatcctattgctggtgtaaagtgcaaaccattagtaagttaagcaagtctagctctaaaataacccaaatctgcctattgctttccaaactcagggctgctatcctatgtctgtcacatgtgtttctcatgttgattacagcattgggctcccaactggtctccctgttgccactctttcaggctcataatctattttctactcagtagccagagttatcttttaaaaacataaatgagatgatcttacttccctgcttttgaatcttcctgtagtttctaattttacttactatacttacaataaattcaaatttactgtgatggtctacaagacctgatggagtctgacccttctgtctatgactgcatctctcactcttcccactgtggctccatatcatccactctccctggccatctttctgatgtcagccagactttcttctggcttacatatttgcatttggtgttccctctgtctgaatgactagagccttcttgtcgtaaaagtctcagtccaaatatcacttcttcaggtagatcttccctttctttccagtgtaaggaactttatttgaagaaccctaaatgaagttatgttactcaattattcactcgtttagctgtctctccctcaactgtagtgcagtttccatgacagcaaggatgatgttcatttcttgctgttaccattcctggtgttcagaaggcactcaagaatctttgctgaatgaatgagtaatacatcttagaatgctagtttccatgaaagggctacaaccagtctgcaggatcttcaggtcaggaactgggccttgtgctggtttccatgatactgctctatacgtgctcaggaaatatctgttgaattggattcaaccaaaacatttgaatttctgttcagtgagaagtgttccctatgtaagaagaaatttaaagctatgtttgataacactcttctgagagaaagcctgctttttagttgaccagccatcccagtttgccttggactgagggatcttctggggacatgagactaatgggtcaccctacatgccttccacagctttagagccagaaatacctaacggatcagttaggaattatatttaggtgctagtaacaaaagccagaaataacagtatttaaaccacaagagtttactgtttcatgtaaaatgagttcaggagtggggacatcagggatgtatggcagccctggtgcatccacttctgaactcatttcatgtgaaaggtcatcagtgacccaggtttcttgtatggtgtccactatccttagtgtatgactctcatctcagagtagcctcatgttccagtgtggctgctgcagctccttcagctatgacataacatatacattgcagccagtcacccaaggagtaaagagggacagaaaagcacgcttttctgtttgttttctgtttgtttttctcttaagaagactgtttcatttaaaatctgtttgtatttcacaagctttctgttaagtaaaggagagattgggtaatatgagataatctttcagccgggcacatagcctcttctctaaataattctttttttttttttttttttttttgagatggagtttcactcttgttgcccaggctggagtgcaatggtgtgatcttggcttaccacaacctccatctcccaggttcaagcaattctcctgcctcagcctcccaagtagctgggattacaggcatgcaccaccacacctggctaatttttttttttttttttgtatttttagtagaaacggggtttctccatgttggtcaggctggtctcgaactcccaacctcaggtgatccacctgcctcggcctcccaaagtgctgagattacaagagtgagccactatgcccagcctgaataattcttattaagaatttctgttactaagaaagagagatggggtgatgagtaatacacacttacttagcatcttctgccacatctagtttcactacttattgacttagtgaccttacaagggttgtttcatttctctgtgcctattttaaaatatgcattatggtgatgcaaacaaccataatagtaatagctacctatctacggggttatgctctttgtcaggcattttatgtacatgatggtcaccctcacaataatgccacaaagggtaggtaattatccttgtttagatcagaggagtgagacttagctatttgtggtaaagccagaatttaaacccagagcagtttggctcaatacccattctttccattacactttgctttctaccttattggctgtcaagattcaatgaggaaatgaacataaactgcttgacctgtaaatttttgaaataaaccaacgcaatgattctgttaagaaaatatcttggttttctctaacaacaacaacagcaacaaaatatctatggtagatgtgtgtaggaagtgatttgaggtcaccttgaagccagctgactctgaagaacaacccttcttcttcccaacttctgatgttgaaaaactctctttttcagaaaattatattactggtctgactcaaatcacttctttactttttatttttttttttatattttatttttttgagacagagtcttgctctgttgcctaggctggagtgcaatagcccgatcttggctcattgtaacctccgcctactgggttcaagtgattcccctgcctcagcctcccaagtagctgggatgacaggcatgtgccaccatgcccagctaatttttatatttttagtagagacgaggtttcaccatgttggtcaggctagtctgaaactcctaacctcaggtgatctgcccacctcggcctcccaaagtgctgggattacaggcttcaaatcacttctactattattattattattatattattctattttgtctttgcatggttcggtcctaatggagagctagatgacctggctgtgattttttatatgccacgagaaggcagttattaagtcatttctcactcttctctctaaaagtaatcaagaggtgaaaaaaagtctcccatgagttgttctaaggagacaaaaatttcctagtcctgggggcaggatgaactatacacctttcttgacatttggcaataaatattctatatagtgcagctctttgctttggcattcatgtcttcatgagcccagagcccaggaaacagttcccacattgctccatgttgaagtgagttgagttgttttgaaaactcgtgaagttttaagataccttcttttgtgaaatttgctacagccatcagcctcactaataatgccttgaaaatagctgattcctgtaagatgcactatgctcttctctcatctcaaagccttcacaagaaaatttcccccagacacaatgaactcctgtgcagagagtgatggctgtatttatttccagggaagaataaatcagaagaaagcagggagaatattcacatcttcaggcctcgaaggaggctgctgggaaacaaatgcaagacaactggtttttgtaagataactcatagcctgtttgaaaatccactttgcaggaaatagaatagaatcaagaagccaaagtagcaatttctttacgtttccattgatcattgtgttccctgttttaaacattcttggtttggaaaaagtgtagattacatgtaacctttgtgggtatagtttcatacaaaagtattagaggattgagtgagaaaaccaggaaatggaaagtctcaggttgtattaccaaccaagcatcatacaatcataattaaagtgaatgcttatcaagggcttactatatgtctgacattgtgctaagatctttaattagtgatccctcatttaattatacaaataaccaaagtaacaatatgtagtagaaaatgacatcatttctatgtcacagatgaggggatggaggcccaaagtctctcagtaacttgccccaagtcacttcattgtaggtggttaagatgtgatttggacccatttctgttttccagggaattacagtgtattagacttctaaagctgccatgacaaaataacacagattgggtggccaatacaatagaaatttattttcttactgtgttggagtctgggatttcaagataaaagtgccagcagggtgggcttctcctgaggcccctctccttgtcttgcagaatactacttttttgcagtgtccacacaaggtctttctccgtgtgtatacactcgtggtgtctcctcttcttataaagactccagttctgttggattagggacacatgcttatgacctcatgtaaccttaattacctccctaaagcctctatctccaaatgcagtcattttatggggtagggatttaacatacgaattttagggggagagtgttcaatccataacaacagccaataaattgaaccagcgtattcagctcttgctctgacagcaggactttggttaaaattataacttctctggccttgtatctctcatggatctaaaacaaagataatttgatcatttagtttttaaagacttctgttaaagactcttaaaaaccttatgattatgaaagtaatactttatagtttattaataaattgtcactatttgtataaaattaaaatgaagtcattctcatacgacctgttgtgaaggtgggaaggcatagagatttcttctgggggccacataagttcttccccctgatattaccattttccactggtattattggccctctttgttttttaaacacagatgaatgcactttttctttttgcttctttactactttttccagcaaacaattattgtttatttgatatgcaccaggcattcttcttttcaagcttaaattcattaaatgcttgttacgtgttagatgctctctgaaccccatacattcattgagtcagatttagcctttcaataagcctataaggttgtgcagatagggaaattgaacctttctctggttagataatttactcaaagtcaatcagctagaagaggtggagcttgtatatgacttcaactctctctgattccgcaacctgcatccttagtccttaagctactgagatgaactgttacttgtgctcttgcagactctgtgatatattcctccacctgctcttgcggttttgatttttgctcctgttgactgcctctccttgatatcagggtctctccctttctccgtgcctccgtctcctagttcatttcatcttgtacaatgcacacaatatgaaagggggagatttaccattgttttaagtttaattgcattgcctcttttaacctcttgctgattaaatagtgggaaacgtagaaataattgtcagatttttaggagaaaacaggttgagaagtgcacttgcttattgaaggatgctttcccttttcactgaaattacctggacttttgtatgcaattgctttgtgccttccattatttttaatttcggcttacaattagagcttgcaaattgaattgctttctctgaggagctgtgatttctctatttggcaagtgccaggcatcccccgtcacaaatccccacttgctcagctgaaattaacatggttgattttgttctcttgtactgcaatcgggtctgatcagtagaatcatgatctcacttagtaattgcttccacagagtctgtagggagagcggatatgagtggtgctctgcctgatgaggagaatggaggttctccaggggagtacaagggagctttaggcaatgatcttggggattatagagagctgtccctctttacttgcactcagaagtcttgtggtatttaccaaagccattaagggccctgatgttggaagtgtcctctttggaatcaggataaattcaaagatgtggttagctgttatcactcacagatgctgcaaaggaaagcgtattaactgtgggtattctagctcaatgccagcttagttctggttatttttattagggaaaaatcttaagatatagtcaattcttcagttcttcagtttcatgtttcatctcaaaaaagttgatttgagttccgcaaatgaaagagagattagttttgcagggtgcaaaatgagatccattgtagctttatgagtggcgagtggcaggtcactggaggtattcaggaatctagactggatgacctctaatgccctttctaatgctgagatgaatgatccactccctcacctctttctgttctccatatggtagcagcctataactctaacatttatgatctaacatttatgaactttgtggtctcttaatacctcagtatcttttgtgtctctatgtctttgtacttccttttccctaaatctgggaaacttctctctggtcttctgcatggttggctccagtctatttttcaggatacaacgcaagcattgctgcctctctgtataccaagccccatctttaggactgagttagggattctagtctgctccttatgcttacttgtcaccctgtgttataactgctggcagccttgtccttcctcctgatgtgagctcaatgataatgctacattgattgattaaatcacacattgaagatataatagacatgcaaaaaaaattgttgagtgagtgagtgaaaccaaatagtgtttgattacttttgtgtagagaattatagattttaaaaataatattttgaatagcattttaaattttaattaataagtaagtttcatggtacttagttttctcttatatgtaccttttcagccatactctttctaggaatcttgcgtacttgtcagtgagcatgtatctcagtttttaagaaagtcagggctgggcacggtggctcatgcctataatcccagcactttgggaggctgaggcggatcacgaggtcagaagttcaagaccagcccggtcaacatcgtgaaaccccgtctctactaaaaatacgaaaaaaaaaaaaaaaaagaaaaaaaattagccaggcatggtgggacgcacctgtagtcacagctgcttgggaggctgaggcaggagaatcacttgaacctgggagatggagattgcagtgagctgagatcgcaccagtacactccagcctgggtgacacagagagaatctcaaaaaaaaaaagtcagaaggtactgagatcttctaaagttcagtataaagaagtaatcactgtgcagtgcttatttctatagacaaaacattttatatttgttacattaaatataatggataggaaaatctctttaccatttggtgagtggttatgaatcacatggaagcaagtatcccttttatttgcaaattggaaaggtttttctggtagtgatgggccttcaagagacctcctttccaatagagggtgctgctactccacaagctatgagggaccccaacagatgaagacatcaaaagaattgttctaagtgcatcacagctggctacttggaattatgatttatgttcagctgtagcccagtttgaagaatttgaaaccaaggggggaaaagtctatctgttcattttgcgagctccagtcttgttacatgcagtgtttcagcacttctcagtttaatgttttcttcttcgtgacaagaaaaagtcacccagcctttccctgcatttctctcctacaccaactttgtggtgaagacatggtgccttgtggtagattatgctgattcaacttgttggaccaaatgtttctgctattaagaacaaaacaataaattatttctagaaggtaaaaatgtttgtattggacatttaataatatttgaattgagacccagaataaaactcttgtagtgtggaacttccaatattgatgtacccttatctcttaatagaagtattacatgtcatacaaatctcaccgttttaaatatagtaataatagaaattattataacagtggcagatattcaccaagcattgattgtacctggtaatgtaccaaagcttcacttaagtcgagacacttagtgcttacaagggcctcaaagcaggtactactgtcattttatagagagagaataaagaagctttaaaaaagtccaacggcctacccaagtcaactattactcaaggctcacctctgtagtgcactctggaccgacctttaactgccaacatctgaatctctgcctgagggaatttttggtgttagggactgccctgcccacattcagagcaggtcagaagttccagaaaatcagcacccccctcggcaactctactgactggtgggagttttttaaataccccaactccttcaaccctaagctgagataactctgaagctgttctacactggattgcaagattctacaccagcattgagctccttttgcccatgatgatagagaatttgtttgataatatgccctttgttaactgccttccgtttcctgtttcatttacctacccccttccagtgtttcctgaatcgcttcccaaataatctacttgtagtggaatccttacctcaaagtcagcttctggaggaatccaaactaagctggttatttttccaaaatgtgctttgatgaagaacttgcttgatatatcattgatgttgaacccatactagagttccacattgatcggctaaaaacttaaaattttatatttttatagagtggtagaccaacagttcacatattttcagctaatgtattacagtgtatttctcatgttataaaaatttaccagtttactacttggagtgaatttccgggttgagattcagagaggacaaaaacaggtggaatcaacagtcttcttgagttgaggggatggaactgggagttcagggaggtcaagtcaggagaatttgcaaagtacagggcaggagagagctgcacagagagaggataatccagagatttttagcaggtaagtacattaacacacttgtaactgtattccatatgttaaggaaacgataggaaaaattgattatactaagaaatggaaaagatcttatatatattttcccaaacttgtacagatggatattaaaatgttggaaatgaaaaatataatgaatgagattaatgacagattaaatgttgcagaagaaacttttaatgaacttgaaaaggtagcaatacaaactattcaaaatgaaacacagacaatagactgaaggaattgaaataacacacacatacatacatatacatatatacgtactctgtatatacacgcactatacattctaaagcaaccactaaaataacactaccatgagttatagttaataagccaacacaagagataaaatacagtaataaaaacattgacccaaaaaatgcagaaaaagagaaaaagaataacaaagaacagacagcacaaatggcaaacaaatagtaagatggcagatttaaactcagccatgttagtaatcacattaaatgtaaactgcctaaaaactctaaagacatagactgtcagtttggattattaaaagtaacctctaagtacatgctgcctattgaaaaccattttaaatatacagacaccgaaaggacaactgttttgaaagacactgttaagaaagtgtgaaagcaagcctcagagtgggaaaaaaattttaaatcacagatccgataaaggatctgtttatagaatatataaaaatttcttaaattttaataagaaaacaaaacacttggaatttaaaaaatgggcaaaagatttggacaaacacttcaccaaaaatatatatggaaagcaaataaggacgtaaaagcatgattaatttagttcttagagaaatgcaaaggaaaactacaatgagataccattacacatctattagaggggctaaagttaaaaagaagaaccataacaattatcggaaaggatgtggagcaacatgactctcatacattgttggtgagaagatagtgcaaccacttcgaaaacagcttggccattgtaaaagaagttaaacaggccaggtgcagtggctcacgcctgtaatcccagtactttgggagacagaggcgggtggattacttggggtccggagtttgagacaatcctggccagcatggtgaaaccccatctctacgaaaaatacaaaaaaaattagccaggcatcatggggcatgcctgtaatcccagctacttggaaggctgaggcaggagaattgcttgatcccgggaagcagagattgcagtgagcccagatggtgccactgcactatggcctgggcgacagcgcaagactccatctcataaataaataaataaatgaagttaaacatatatctgccatgtaactcagtcattcaactcctgtttaccaaaaggagatcaaaatatttgtcaatataaagagttctgtagcagcttactttgctatggacaaaattggaagcaactcaaattcccattagcagatgaatggataaacagtgtgatctatccatgaaatgaaatactaagcagcaatgaaaggagtatactactgatgtacagaacaacaaagatgaatctctaaacaattgtgctgaatgaaaggagccagacaaaataaaaagtatatatttgatgatttcatttattaaaaaataattctagaaactgcaattaatagtacctgaacacaagccactaggtcactgggaagtgggggtggggatgggtgtaagggtaagaaggcaggaaggatagattataaaggggcacaattaggggcacaaaatagattataaagggacttcttaaagtctaatttatctttctctttctttttttggttgtccttttagtgtctatatatttaaatttgttttcaatgggcagcatgtacttagatgttacttttaataatccaaatggacagtctgtatctttagagtttttagacagcttacatttaatgtgactactaacatggctgagtttaaatctaccatcttactatttgtttgccatttgtgctgtctgttctttgttattctttttctctttttctgcatttttttggttgaatgctttttattctattttatctcttgtgtag

SEQ ID NO: 2978 - DNA, 1114 bp, Homo sapiens
ggaggacaggctggcagaggagggaggagggtttctagctgagagagactgcggctgtgggcctgcagcctacccctcttcaagctctccggagccgttcctgcgaaaccagcccccacaaataaggaagctgggattcagagaaattaagggacttggtgaagcagagaatgccaagggaattgattcagtagtggacggggagtccctgaagactgttgagcagtgaagagacctgatcgcatactaaaaaagtacatgcaatggcaagaagatcaactaagaggactcaatgtacaatattccattccagcattgaatttggggtcaatggatgacattcagatgctctactcttgccatgctttctactttcatgagaattttgatttattctatgttaaaattaactaagttaattttaatcaatccctacccttgatgtaaatgtacacttccagcaaggtcctggtttggggagtttgttcatttaacaaatgtttaatgagcacctgctagtttctagcccagtgctaaatgctgagttactgaagtaaaaattgtgttccctccaggagctcccaggctggagggggcagaaaattattacatgcaagcacagatgacttgtaagaatctttgctgatttggatggaaattttctgcccttggaatttggtatctaatccctaaataaaacactttaaagaatgccaattagaaggaataggcaagactaaaatcagttgttgtgtttgtggattagggatgatttatattctaatttaaaatttcctttaatgataaaataatatttaggcaatcaattcaaatgtaaattttggataatgtcactgtgactcataaactcactatccacctgccacactggtggagacatctgaccaatgaggttagaacaggtggctgcctcagaatcccacataggagctgtggacaatgtctgccgcccctctgcggacactgaactacatggttttgggtgtttttgcatctaaaagttgccttttggcccaccgcacccccctatcctgtacccatataaaccctaaacccctggctccacaagaggatgaacagaagaacagaagag

SEQ ID NO: 2979 - DNA, 1117 bp, Homo sapiens
ccacaccgctgggccccgagccccatgccccgatccagctgtggctcctttacgggggccttgctggcctttcctaagggaggtgttttcccgagggcaggtggactgctcctcagactaggggccctcggagggccaggcctgggcttctacctcctctcgcaggctggtgtttctctgcaaatatggctcgtgtgtcctccttcctctcagactgggggcccctgaggactgggcctgagtttccctctcccccttcagaatgggggttccctgaggactgacccagggcctccccccgtcccctccatctggctgttaatctccaacactttcacctccagtcctattctgcacagcgctccccagcgctgggagctcagaggcctcttcagccttccccagggctggggctcagggagggcttcctcaggcgctggccccagagtcaggctgcacattggcttggaggacaggcctttcctctgggactgtgaggcccagagtgcccacccagaactccacctctgacctcacaaaggcctgcttcagaactcggtctccactgcactgctggccagacgagggatgttattttgggcagtgcatctggacttggttcaagtggcaccagccaaatccctgccttactgacctctcccctggaggagcaggagcagtgctcaaggccgccctgggagggctgagaggcaggctctggactggggacacagggatagctgagccccagctgggggtggaagctgagccagggacagtcacagaggaacaagatcaagatgcgctttaactgagaagcccccaaggcagaggctgagaatcagaagacatttcagcagacatctacaaatctgaaggacaaaacatggttcaagcatctgggcacaggcgaacatacatatgatagttgagaaagacacatattctgatcatgaagaaataaacacaagttaaatatgactaagcagaaagatggaaggaccaggaatggtgatgctaacttggaaccacgatgcaggctctaaactcctctacaatcatcctcccttgtgagaaaaatacgtaagtcacttttaaaataaatagaaacctgaac

SEQ ID NO: 2980 - DNA, 4833 bp, Homo sapiens
aagcgacggagatgcgcgcggggcctgttgggtgaaggagcagagcggccggaagcgcggagggagccgcgggatggaccgcaggtgaggccgatcgctcttccagggactacaggaggctggggaggaccaacggcgagagcagcacagcctaggacgggctggatacggtctggagtcgctagggctccaccgcactggaactacaattcccaacatgctccacagccgttggcctctccagccgtagccgttagcatcccgggggtcccctaagagtcttatgttcctctctgagtgggccccaaggaattattgcctctaaaggtgtccaagaaaggcttgagatctgaatttcttcattttgaaatggcccccagacacgcctgggcgttgtctttgaactttctcgcggaggcggagcccagtggatcctggggcttgtagtccatctaccctttgccttcgtgtcccccaggaatgtatgggaaatgctcggtgatataatccagccgcggttctttctttctttctttttttttaagacagagtctctcgctctgttggcccagactggagtgcagtggcacaatcttggctactgcaacctctgcccccgggttaaagcaattctcatgcctcagcctcccaggtagctgggactacaggcacctgccaccgcgcctggctaattttttatatttttagtagagacggggtttcgccatgttagtaaggctggtctcgaacacctgacctcaagtgatccacccgcctcggtgtaatcccaaagtgctgggattacaggcgtgagccaccacgcccggcgagccgcgattcttaacctgaactccacttcgcaatcacctgggacgctgcggaaaagacacggaggcccagccccactaatagatattctgattctgttggtctggaatgggaaccgcgcgcctgtaacgttgaaaagcccctcctagactggatccagggttgagaaccaccggctgtcagttcctgagttgctccctgttaagactgctccaggggcgggctcccaggactcacccttccactgtcgatatcctgaatgtgcaacggtgcttcatggaaatgacagtccgtctcctccaggaatctatgggaattgtctggttctgccctcctctaatgtccccctccccagggctgcggcgaaaccacgtgctgcctgaaccccactttcctcttgcagcctgccagttttctccattcaagatagtccctttggagatgcgcccctgggtcgaagccactactggccatcccagagccagacctggtgtcccaagaccctgagcccatccaggtctcagagatccaggctcccacaagctcccaaggctctagccacaggtcccaactcccctgagctgtttgaggagtcctggccatccagttcagggaccccctccctgcccagcaccactgagggacagatgtgggcctccccagcacccaccctgattgacagcggggactccgtggtggccaagtatataaacaggttccgccaggctcagcccaccagtcgagaggagcgccagcctgcaggcccaaccccagctgacttttggtggctgcagtctgactctccagaccccagcagtcaaagtgcagcaggagccaacaaaccagaaggaagaccccatacagctgtccctactgcggtcaacgtgaccagtgcatcccatgctgtggctccccttcaggaaataaagcaggtgacatccccattcactccctcccttgggtgcctgaactgacaacaccagccctaggacagaattagaagatcaggagcagtggctcacacctgtaatcccagcactttgggaggccaagaacctccacacatggaactcatccctgctggacctggagacgctgagcctacagagcagagctgccaggctgctcaaacgcagcaaagcctccatctcctcctcctcctccctcagccccagcgatgccagcacttcctcattccccaccagctctgatggcctctctcccttctcggagaccttcatccctgactccagcaagggccttggccccagggcacccgcatccccggcaccagcccaggcccagacccccacccctgctccagccccagcctcctcccaagcaccccttcggccagaggatgacattctgtaccagtggcggcagcggcggaagcttgaacaggctcagggaagcaagggtgacagagcttgggtgccgcctctgacccctgccctccgcacgttgacctctcctgctccagtggagaccctcagttctctggggacccagcctaaccatgtcccactgtggagcagtgtggcccagcctggtccaccagaggccttctatgtggagaggcctccttttccctcagtgtcctctccacacatcttttgggcccccagctcccacgggttcttctgggccccacagtctgggccttgggtatcccttggggctgttcctcccacgcagcaggcctccaccctagcacatctgggctctaccctcgcgcccccggcttccctggcctccaccctcgaacccccggcctccaccccagctcccctggcctccacccttgcacccccagcctccaccccggctcccctggcctgtacccctgcacctccagcctccaccctcgcatccccagctgtcccccagggcctgcccatccctgacccaagcagctgtgcccagcctaagagcctggggcccaagtctcggaggagcagagcccctcgcccagaggctgccgagcaagtccctgcagctggccagggacctggccctcagctcaggggtgtcctgggccaggtagtggcagctcggctgttccctgacagcctggaggacacgcctcctcacttcgagggcccccctccacccaaggctggatctccgaaagtccaggccacacaaccccaaaccaaggtcactccccctccatctgaatcccagtgtcgggccaaggccgagtctctgaaagccaaggccttgccgcccgcagcggggtcagtgatacggaagagcgaagccactccttcccctggagcctgcctgcagcccgaggtcccactctctccagctgagcaggcaaccacagtcaaggcctcgccgccagccttccaggtggggtctccggaggccctggccccgcccccgcccgctgctgaccacgccccctcggaggccctgcttgcccagggccgccctgctgctgcaggctgcagaagactccgacggcagcgagttccaggacgatcccgtgctgcaggtgctaagagcccatagggcagagctgagtcggcagaaaagggaagcggatgcccgattatcgttcctgttggaccaggctgaagacctgggatcttggtcccctccagccgggtcgccccctaggtccccaaggaggctgctaagaagggaaggagattccctggaggccagaagactttgaattgtacagattctattttacccagtgaggctctttttttttttttcatacagttactggttatctgtgagaaaggggttgtttggaaaggccaaggggtcatgccaatttaaggaaatgccccccatcctccgctgccccatggctctgccctgccccccaccccttcctgaccacggaaacaagatctcctttctggttatatcttccttggggcagagggagtttcagacaagacttctggcaagactgggacccaccttatctggcttcactcaggagccctggctcaaatggaccaaaggactgccctccacggaggaagctactagggtcatcagagtgttggatgatggtcaggctatagcccacacatgcttgagcagcagcagcatctggtgcagctgacccctccctccttgaagcactttctctccctgcttccagcccttctctctgcacctctctggtcaggcctagtcactagcccagcatgtcaactttggcatgacccagggccatggcgttgacatctctatctgcacccacccataggtgctcttgtctagcttaatgactctaaaccccgtctctattctgataatcctcaaatttctgtctgtaacctagacctggccacgaaaccttgggctcctacctcattaccatttctacccaagggtttaaaagacatctcaaattccataggtcctaaatggagtttccaatctttccccctaggcgtgcctctccccagcttctttttttttttttttttggatggagtctagctctgtcacccaggctggagtgccatagtgtgatctcggctcactgcaagcttcgcctcccgggttcacgccattctcctgcctcagcctcccgagtagctgggactacaggtgcccgccaccacggtcggctaattttttttgtatttttagtagagacggggtttcactgtgttagccaggatggtcttggtctcctgacctcgtgatccacccgcctcggcctcccaaagtgctgggattgcaggcgtgagccaccgtgctgggccccccctccccaactttcttcggctctgtcctttgccgctcagaccaaaaaccttagagttgtctttgacttctgtctttcccttccacccacagttaaccaggaaatcctgccatctccgcctttattttattttattttttgagatggagtttcacccttgttgcccaggctgtagtacaatggcatgatctcggctcacggcaacctccacctcccgggttcaagcgattctcctgcctcagccttctgagtagctg

SEQ ID NO: 2981 - DNA, 3581 bp, Homo sapiens
ggaaaatgacctgcaggattttacatggagcttcctgtgtgcatgctggtgactgttggcaacaaggtgtcaggaagaaagacattgctttccaaactccttttcccaaatgatcctttcttacccagtctgccttacctgcttctgtactgttcaacagaggagggggaacagggaaaagcaggggcagttgtgaaaaatagaagggaaacttgagtgtgcctttttcttctccttctctttctccaccctcagtcatcattaacagaaaaatatttttaaaagatcccttgatggcatccccaaatgttaagtctgacattttcttagctgatggcctcctttgtgaaggtactttgtgtccgcccagcatgcctgctggatccctggtttgccgcagttgctgaggtaaatactctttccattaagcaccacagcccaagagtggcctaaagctcaaataaatgaccaagaagcaacttaaacattccctggggcgattttaacctatgcaatggctttttgaaaaaattgcctattttttcatgttttggccgggggggtgtctcttattcccttcttttttattttcctttcagctgagtacaccttctctttcatttattcatgcactgcatgaaggatggaagcaggatgaataaatcacagagcattgcccctctccccactcagggtctgtgaagagagctggagcagaatacagtccaggcattatgtcaactttcaggggacctggggcaggtggccgattctcacagagaccccacttccctttcctgtgaaaaataccacagcccaacagccactggagaacagtgttcttctggaagcttcctctgggcaggaggagtcaaagatcctggtcctcagggacacttgagatgggtgtgcccaaagctgtgcaggatggtttggtttgttttgtttttctttgcctcaggaagaatgtgttcacaaacctcaggacaaatcgtttaaaaaagtgtcctgacagttgtcatgcttcatcacttgatttagaggcaataggacagccttattttcttctaatctctggtggttgaggagtctggttggcctggcagaaggctgagattggctgagggagtcatgagcgagcaggggcctctggtgcctgaagcgcccctcaggaagagcgggtctcaccggaaggccacactcatctccttcctggttacccagtgtggggatttgctactttgctgagtgtgttttgtctacattcatggtgctccagaactgtgtctgtgtttctcacattctctttcgtgtctgccagagcaacattctcagcaaaccatctgaatgcaactcctgtgatcacaaaagtcaatcactgatggaaatgaagaccacgaccctgattcctcaggcacaggttttcatctgtcactatgtgctaaaagcaaaccagcaagtgagggtgtcactgtcaactgctccttgtcgtgagattcccacctttccctcaagacatctcagatatcatatgtaaccttgaccctgtgtcccacagcaacagcggtcattgagtgtaaagccttttccttgaggattgtggtagacagaatgccccccaaaggtgactatgcttgaatccatggaaactgaacatgtcaccttctatggcaaaagggactttgcagacgtgattaaggttaaagaccttaaattagagggagtaccctggactatccaggtgtctaatctaatcccatgagacttcaaatgcagagagctttctctggctggagtcaaagagatgtgacaaaagaggtcgtcggagagattggaagtgtgagaaagacccgacctactgtttctggggagcccacctggaaagcacgagaagggacacaggcaacctttgggaacaaagactgccagccacaaggaaaagacagcagtcctctagccacaagaaaccgaattcagccagcaacctggacaagctagaagagcattcttccccagaacctttaggaggaagtgaggccttgcagataccctgattttggcttttgagacactaaacagaggatccaactgagttcaactggcccagaaactgagatatgtttggactgttttaagttgctacgtttgtggtaatttattttggtggcaactgaaaatgaatgtaattgtatattagaaaaattgaaggtagaagctctaatactttctccccacaccccagtggttcatcatgtgcagcactcagggtgtggaaattccattttgaagacaccgtcttccaggattctaacccccacctgggaaaggtcctggagagaacttctagcatgtatttctgagccattcacatttaacccagagagagaaggtgtcctgcccaaacgcaaagcagcatggcggtagttctggacataaccttaacaattgccaggaactctctggatgtccatccatcagccctatctagtctttttgtctgcatggcattgtgggggatgtggcgatgagggccaggatcgcagaagtcagagtacccgtggctggagcttccattttaaatgaagtgttcttgcttatggcttgatggtatcctttcagattttgcatctggctgtactccagatgtttatatagaaacttcacagtagacatgatggtggcgtaggtttgcaggaaggatcctttcctacttacagagtgacccaatgtggccgatcccttcaatatttacaacagctgggtgagtggaggcatgatcaactccatttacccgtcaaataaatgaaatttcagagcggttacacaatctgcttgaggtaacaaggccagcaagccacagagccaacatacccctggtgcctggctccacaggagtctgggaagagggagaggaagatggggacaggatgtatcaccaggatgctaggggaagagagaatattgacgtgtggggcagcctgcatccccaaatcaggagcactgggtgctgctgtgttacagtgagtgtaggagcatgccgttctgggcttcactctgcccaaatatgtcttgctcattttcaccgccatatggctgctcgtcccggtctgtttgaggttccttcctgttccctctctgcctctaagtccttcaaaaagccaactggaagtgcctcttccaggctttccttagcctttctttattcccttgaacttctattatgttaattgttcaaaagattagttctgacacttaccctatgctgctttgtattactattggaaaacaacagtagctctctcaacccattgggtggatggtacatgccatgctttatacattcccgtggccctgctgtacctggcacacacaaaaggggattaataaatatgcatatgttgaatgaaagaatggagagatgctgttgattttctttgttcttctttctttttctctgatttcatgtcaaacatagttttctcccttaataacaataattgtttgtcttatgtgtacagtgggaaatgtgagcctccacagccttagctgaatgactaatagtatatccacttctgcctgag

SEQ ID NO: 2982 - DNA, 26892 bp, Homo sapiens
cccaaagtgctgggattacaggcgtgagccaccgcgcccggcctagtgtctgcttttaactgataatttccattcagcgctagattgcaggtcccaaggaactaccaatagatcattatgttttcccaaaatgttctttcctgcttgtcacccaactgatactggatatcacatgtaaaactgtggcacaggtcatttattccacagagcaacaacaacaacaacaacaacaaattgtgggcttttgaaactagcacccagttccatgcctgggaattggcatacagttaaaaggtgtttgtagaataaacctggattcttatgaagagacatgtttcttagagaataaatttggccaaaaaagaagcactcatttatggtccattgttcagaacagtgctctaagccattgtcagtctgatcttgctgtgataattttgtattgaagtcattaagctggggacaagcatcctcagaacacgaaaaaccaaaaataagccaccatacgtttatgctagaaagttattgtcagttcttagttattgcgggatctggccagcagcccgcaatgcaacggggctctctctttgttcccaggtggatcggcaggttgagaaataatagacacacacaagatagtgaaagctgggtccggggggtcaccgccttctggtttcgcagtgtcaataatgcactggatataccagcatttattattaagtttagtgagggcaggggtaggttagtgagggatttagggtcatttgattatgaggtgagatggtcacatggggatgaagtaattctttaacataacatttgtatgtagaagtacagtgcatttgtatgtagaagtacagtatacagagattagaatttacaatatagtgtgtgtgtcagtaatttctaacagagccttaaaacggaaacacagtctttccataatctatgattagcaagatattaatcagcagtaacaattgcaacaaaagctggttacaaacaatccatggaaacaggacgtgaagctagacaaccggttagaccagaaattctcggaagggagtatgccttaaccctaaagaggcctagaaaagcagtggcaagatgagggtgtttatagccctatgttatacatatggacaggtgccccaccatgtgtccatttataggctctccacaagggttgcattccattcccagagctatgaacatctgcttttctgggataggaatcttggtgatgtgaaacctccctgactgcacgtccattcataggctctccgcagagggaagcacatcacgcgctgttggctcgttctggcggtccaacctggcattgtctttacacaatcctgcatgcaattttgtatttacaataatcaggagcatttcatcttttattcagtagcagtagtttcagggggtctccctacacttagtttcttcaagaaaaaattttggtcaccaaaaataggtaagcagctgaattctgccttcagcatgtcaatagggaaacataattaatcagaagaacaggctatttgaaatattgcaagttcacctcaacactggaaatcagtgtttctcaaagtatcttcgatgggacatttgaataagaaccaatgtatgagtccaatcgccaatgcagatttccaggccccaacagcctgtttacactcattatttgggggtattcacaaaaatctactttttcaactggttctcccagaaggtcctcaactagataaagttaagtaaccttccccatgaagtatcattaccatagttctagttgggaaaccattcagggaacaaatcaggcatcactgcagttgtgttttgtgcagaggaaagtgatgctttaaatgagacacctggaatgtttgttttagacttgcatattttctgtgtctttgggcatcttatttttagttgtagagctaattatctgatgataggatttttttaagaaaaggaagaaaggaaggaaaaaggaatacaagaagctagttttctttgtcattgcatctagtaagcaaaaaaaagggcttgatcacaatgactatgtggaggggatgcgagaggaggttagacaaacatattggataggtgagaggtatgggatgctatgtagcaagcttagaattttcaattttattctgtaggcaatggtaagttagtgaaggtggagtagaggaatcagatgatcaaagcttgtcttgaaaaagtaaagaaagaaaggcaaactatcaagtggactacagtggagagagcagtatgtttaaaactgcaagagatttttgcttgcatgcatgaaaagaaaaggcctgcgcatgcctgaattcaaccaagagcaaagggttagttgccagctagagaataaaaacaaaatacctgctgatcagaaaaacaccctgtgagcagattttaatcaaagccctaaatatgatcactgagaagtgatcatattcccaggtcactgttggaggacagcatttctcttctagatattttttgtgttgttgagtttggcatcctgcttgggattcttctgaaggtttatgtaggttgactctataacctcagaatatttgcttaggatttgatggtttttcaggcagactgcacagagattctgccttggctagacttttcctttgattatagaggggtccatttgtctggtagcctcttcatgtattcctttgaatgttagttgcaatataatgtcaccataaaaggatagatagtaaaatggtagtgactgaaatctttcctctcctaccaccattaaatcagagtcctcaataactcagaatctcattattattttgatggagagatgaagggcaattcattctttcagccctccggtaaacattgaatgccctctatgtgtcaggtactatctgagatattggcactgtgaaactatgaaacaataattttcagtcaagtgtgggggaatgggcacctacatggctaattagtggttaccatcactcttaggataaaatcacaaatccctcatctagtcttaaggcctcaggtcttctagcctctctgttgtttctaggcacattttgtttcactcttttcacattaggtgtgccacccacgtggctcttgtttctaacattaccttggtcctctccacttcagagttttcttgtttgctctttctgtatccaggaatgttctcctatttcccatttgtctggctagcctccatcattcttcagaatttattttaaactgtcacttctctgaggacactttctttatcctccaacactggttattcacctcttgctacgtattctcattgctccttctgtttttctttcatagcacttattaataagagaattgaacattttgataatttttggttaatttctatttcctgttccagactctaagcttcatgggagtatggggagtggcagaggcattcactgtggtaacttcagcatgctgaccagaccataaatggcacttggtacacatttttaaaaatatttgaatgaataaatagaagatcgtgagtgcaacagttgaatatgcatggagacagaggatgagcatatcaaattcaatttggaaggatcagggatatcaatactttaaacccagtatctactaaatacacaaaataatgccctgtatctcttcaagatcctaactcatcaaccacaaactaaactctaatgactatgtttactatgatggtaaaagttactactattttaggaaaagtttcaacaaaagtcaaaacagaatgatttctaatgtaaatcttaactataagaaaataagcacattttcaattaatggacatgtttctgtagaataaaaaatggctatttctatgtttgatcagtttatatataatcctttctgagtaaacattccactatctggtttaataacttcaatatacttcttaaagattaacacgattatttgcttcatttagtcttagtttttattagtgtacttgctgtaaattgtttctctcacttattttttatttcggacatatctgtgttgttgtataccaggtcaaataatattctaactggaatatacatttaagggttctgtattctctcaccatctaagttgataatgaccttagtcatttttgtctttaccaatttgcctgtttgctatatattcttaaggtagttcattgaggaaattataatcaaaatctatgaagtttgactaattattactctcaacataaagttaaaatccaaaagatctctgtggaatattggtcagacaatgtatgaaggcatatacatgatgtatagtaaaactaaatccatttgagctatccattatcctaggttatcacatatatgtcaattattaaccaaaattggcagtaaagtgttatattagtctgttctcacattgctgtaaagaactacctgagactggataatttataaagaaaagaggtttaattttctcgtggttccacaggctgtacaggaagcatggttagggagatcatcaggaaacttaaaatcatggtggaagcaaaagggaagcagacacatcctacatggctggattaggaggaagagagagcaggggaaggtgccacacacttttaaacaaccaggtctcatgagaactcactcactgtcatgagaatagcaagggggaagactgcccccatgatccagtcaccttcctcagactcctcttccaacactggggattacaattctacatgagatttgaggggacccaaatctaaaccatatcaaatgtaaaggctggaaagaaaaaaaaagtcaaatgtacacagttttgcacattggaaaacatttactggtggtcgtatttacaagtaacctgactagatattttgaagttagaaaatttagggttcagtccattgagcaaatatactgagctttccctgcatgaaaaccattgtactaggctcaactgaaaatagtggtggtggggagagaagatttgttctttcaagaatttgaaatttgttcagaaggataaaagcaaatagaatctaacaactgaataatgcttgaaacatgacatatgagctaataaaaatacatcaattacagtggtctttaattacaagttagaggtgccaaccccctgcacaaatgaccatcctcatataacttttgactcccccaaaacttaactattaatagcctactgttgcctggaagtcttactgataatatagataaccgattaacatattttgtataatatgtattataataaagcaagctagacaaaagaaaacattattaggaaaatcataaggaaaagaaaataaagttactatttattaagtggcagtgtatcattataaagatcttcatccttgttgacttcaagttgagcaggctgaggaggaggaggaaaaggagagtttcgtcttgttgtctcaggagtggaagaagcagaagaaactctacatataagtggatccatgaagttcaaacctgcattgttcaagggtcaactgtaattagttttgggtatagtgatagtaaataaatgatgtgagaggcactgaaggagagcttcctagagggggtgagttttgagcaaaaagttgaacatgtgagagcttatggatttgtggggacaaggcagggtcatgacttggtttcattggaatgagtaagtcctatgcaggtcccaataatagtataaaaacaattagaaactatgtcagttggtgactaaatggctgctaaaaagtagtttggttcataaaaattatcaattttaatgatgttttgaggacattatacgttaaaaagtaaattctttattagcctgatgcctaaatgcaactactgcacaactgttttcatttttatatggtgctctacaagccttcactacatatgtatattttacattgttgcaatcatagtatatacagcattttgtattttgcatctcttatttaactgtgcatcataaacattttctacctttctatatagttacaataactttaacagtataaattttatcatattgatctattgcaatttactaaatcattgccttaatattgcatatttagattgcctcctggttttattttattcttggtaatgctgcaatgaatactgctgtacatacaatatgtttttcttctgtccaattatgttagagtacaaattcacaaaaatagattcatggaatgtaagggttagaacatttttatagttcttgctgttctgccattctgatattagggtcctgcaagttttacttggccactagcaaggtatctaggagccgcttttctcgtgtgtatgccaacaataggtttaattactagaaatgtttttgttaattttataagcttgaaatgctattttaagataggtttatttagggtttcttactttcttgtgtgggtgattattttcttagtttgcttattttttgtatttccattcatataaattgtatgttactctcatttgcctttttagctaaaatgaaaactcttttcttttccaaataataagaattatttaaagggcatgagatttatgtaggaccaatggaaaatattcactcaagaacaaaccaggagaattttttgtccttcccctgtgaagtctgagcatatcttaatacataaaaaaataagtaaatgtgctgctgctgtctccggttgaaacggcaggtagggggtccactttcttaggctctttactttcctggctgctgaaacagctctgcagaatgaacattaacattgttttacagtaacagatacatatacttgacaaaatagtctatggctgagttcaaattgtaagttaaaataaagcaaagttgttttagaataatgacactataaggaaagtttcactgcagattttttaaagactcaggcatgcagaatatattttttccttattcagtttagtaaactataaaacaacatattgattgccgagaagaatactaaagtgagccaggttatgatttagaaagctttcaacgtagaagaggagataaggtacgtatacaaatagcaacaagatgtgggattatgagaacattctctaactgaagagtaaatagattttattccatacagaggagaaagagaattactttattggggtggggggccagcaggactcatttcaaagtcttgacaggagattctagtaggcagcattcagggttggaaggagggtattccaaaaagaaaggccagcaagaggcaggtcagagcaacaggtgtgcagggaggagatcgaaggaatgggcagagttcagatttggctggacatgcctcaggtaagaggggtaaggctgaaatcatcgtaggagaggagaggggtgcaggcctgagaggtgtgacttagggattttagacttcttgttttggaaatggagatactttatttatgtttttgagatagagtctcacgttggcatccaggctggagtgcagtgacaggatcatggctccctgcagcctcaacctcctgggcccaagtgatcctcccacctgagcctcctgagcagctgagaccacaggcacatgccaccatgtctggctagtttttaaatattttgtagagatggggtctccccatgctgcccagactggtcttgaacttctggcctcaagagatcctcccaccctggcctcccaacataatgggattacaagtgtgagccgccatgcttggctgggaatggagatacttacggagagtgacaggattaaaactacctttactccacttccaactttttttttgacataaactttcaagtaatgaatttttctttggcaatttccatccttacacattttttttcaagaactttctgtaaattgtttgtgtccatgagaaagagtaacatatgagaaagagtaacacatttcagaaagagaactagactgagtgtcatgaaactggattatagtcacagcatactgggttatttggggtaagtaaatctgcctctctgggactcagcttccccatgtgtcaaatgagaatgaactggatatttccactgtttcttccacttcaaacattctgaaatcccaaatatattttgagtacattaaagattcattttctaaaatctatatatcttctctataaacttgaaattccatcttgagggagtcatttctttgtattttagcttttaaatcatcagtagttctctttccaaatgagaataacccaaaggtaatatggcaaatcagtggggtgttgagaattcaacacgacttaattatattaacgatctctcacttggtgtctgggggagtagaaatgtgtcatgtgaaaagtgacgattgaaaagagggaatacttaataatggtaataataacaaaaaccacttacatagcacttaccatgtacttttatgtggattaaatcacataatcctccccacaaccttgtaaaattggtactactgtattataatcacttcacagatgagaatgctgaggtatagatatataattacttccttaagggcacacaactcattagtggcaaagccagaatttgaacccaggaagtccgactgagcatccgtgtgtttaattaccacacagcactttttctgaagggtctccggagagaaacatctgtagagctggattatgtctatagaaacacaaagatctcagtctccaggggacatgagtacaaggttttaggaagggaagatacaaatgtgccagtaacactcttgtgacctcaacattttgctcaggaatgtcatcatcagaagtatcattataactaatcaaaacaatattagcctctcccttatctgaactgtgttttaaaatgtagaattatagttatactactttggcatgcattgatttcagttagaggaattcggaggtggatagatgagattgttatttggagctcttagtatattgcaagaccagaatgtccaagcagtgtggctgtgagaatagggaaaaccagttgggttttctagtccttgggtcatgttgagggactaggactcctttatgcatttctcagctcaactctttgaaaggtcaagctttcatcaaagtcttagtattttttgctggctttctttaagaaatagttttcctatagaatcccttagaaaaactactttttgttttttctgagtttggcttctcaacccagcagacaggcagaattggaaagaaaggtcttgtcttcaatctatagaggtgatcaggtgatcaattaaaatactgtatgtactgtccgggtgcagtgactcatgtctgtaattccagcactttgggaggccaagaggggtaaattgctcgagctctggaattcgagactagcctgggcaacatggtgaaaccctgtgtctactaaaaataaaaaaataaataaatgaataaacaaacaaacaaataaataaaactagcccagtgtggtggtgtatgcctgtagttccagctacttgtgaggctgaggtgggaggatagcttgagcccaggaggtcaaggcggcagtgagctgtgattgtggctctgcacttcagcctgagtgacagagtgaaatgttgtctcaagacaaaaataataataaataaaatactgtatgtgactgcgctttgtgacttattaactgccctacagatacaagagttgtggttatatcccctgaacatttatattccaagtgaccatcaccagagaaattcctctgttgaaagcaagtatttgaacagtcaagatcacagcttttgacaccaagcagatcagggtttcaattcttaagtctctgtacttcatagaccacagagagagcatgggattgacatccacactgaccctgtaagcttgttttggggcttcgatggggtagtacatgtgaattgccaagtccagccccacagagagtactcaataaatcttaacttttattggtagtgttagtgatagtcatagaagcaccattctaaagcaagagccagaaaaagcaatagaacaactctaattacccagcatatacttgaaacctaaactgaaattaaaaggtaaattttaagaaaacaattgtgtatcccaagtcttcagaggcttattctctttgacccagttatttcacatctaggattctattctaagtaaatagtcagggattaaggtaaagacttatgtacaagaacagtcattgaagagtttttttttttccttcttgagacggagtctctttctctgttgcccaggctggagtgcagtggcccaatctccgctcactgcaaactctgcctaccaggttcaccccattctcttgcctcagcctctcaagtagctgggactacaggtgcccaccaccacgcccggctaattttttgtacttttagtagagatggggtttcaccgtgttagccaggatggtcttgatctcctgacctcgtgatccacttgccttggcctcccaaagtgctgggattacaggtgtgagctactgtgcctggcctgaagagttatttttaacagcgactgttagaacctacacgtccatccataggagagtgctttaatagagtgcaatgttgttatgagatatttattttgcagattataaaaaataattcagaaaaatatgtaatgacaaggagcaatactatttaatctttcagagaaaagtcaagattatattatggttttaatgctattaattatactaatatttataaaatatgtgaactaaatagatgtcctttgctgaaagtggagataaaaataataacgataatgcctatcttagaggatttttgtgaagactatatgatggttactacatgcctgacatataatacatgttagctttgtcattggatgttggctaaatttaacttattttctaaattttacttaaacttcatcatacactaatgagaatcttttattttacaggaactgagcaagatgctggggatacagaaatgattaagtaggtacactgagcatatgacattcacaatccagtgaggagagaggcatataaataaacaggaacagtggatttagaactatttaaattctagagtcagctcctaagacatgaaacacatattatcaaaataattaggtgcacagccattataggcaccttttcgtgagttttaaaaaggtggcccctctctttaagaatgaattatagaaaggtacctcttgcccccagctgaatcagctgcacggtagggtacaggctgggtttcagcccctactgccctctcctggtttattcctgctggatgcaggctgctcacctgttcacagaggccctgaaaatacctttgaaatgtcctgaaattgacgtgaagcacagtaaatatgatttggtgtctataaccttgaacaataattattttgcacactgaggtttgagaaatactgaactagattaaatgatggaacaaaggaaaaaatctataggcagttgtccagataatcccttgtgttgtatgggaaatgtgcagagaattctgaagtgtttcttcttaactgcagagttgtctccattatattttaatagtgtcataagttgaatacacattgatagttttgttttcttgagcattgcataatataaggaaaagcatcgagcccagggattcacatatagcaaatgtttactaaatattagttaatccaagtattaaccttgtttcatcatatccacaggcatagtgtgctttgaaaagttatagaatagtgcttgcctctcattttttgttttcctcactgaggtcctgctaaataactctgagcagttgtcactcccaaacccatggccattggattaggcagagttcttcagagacaaagaaccaatacaggatatttacatatccttgtctctgtctgtatctctctctctctccatatatacacatctctatttctatatctctatatctctatatctatctatctatctatctatctatctatctatctatctatctatctatctggctagctatctagctacctagctagctatctaaaaggagatttattatgaggaatatgttcttgtgatgacagaagctgagatattccacattctgccttctccaagctggagacccagaaaagttatggtgtaattcagtcctacagcaggacaagatgagctgtcccaggtcaaacagtgaagcagaaaaaaaaaaaaaaaaaaaggtcggggggtggtggatttctttttcctctacctttagttctattcagactctgagtggattggataatggccgcccacatttgggaggaaaatcaactatactgactctactgattcaaatgctcatttcataggaaaacacccttaagtaaacacacccccagaagtaacatttaatctgggcaccccatgacccagacaaatggacacgtaaaattaaccatcatggttatttgtcttctgcaaagttgggaatccgcccatgagctgaatggtgcatgatgtggctccgcgggaacacaatgtgcattagcatagggttctggacaaaactgtaaggtgtccccaagagaggcagaacagcttctggtgactagctgcacattcactctcttgctacaagtttaaatagtaagcagtagctataaactttggtttcaatttgttagacaaagcattgcctggctctttcttctttacagagttattatttctagtttgcttgtacctaatgctttcctccagggatttcagaactgttcagctgcaaattcatatttgatgttcttgttctaatcccagattaccgcatgaggacagctggaacagaccaaaagagagaaactcatagggggaaggaaatcattagcctgtcttgagtcaccaggacctgataaaaagtcagattaacaaggcttaagctgctatagaaagccagagaaatgccctcaaatattaatcttgaatatttccattccactaacattgcctggaagtattttaacattcaccagataggcatcccatcttgaagaaacgatatggttctgtaaaaagaataatgaattatgtgaggattgattttcagtatggactttagtcctgcatagtaatggaatgtggactggggagcaaggctgtttggattcacatcctaacatttcacttgataagttgcctcatttgtaaaatggggactgtaataacatctacctcctagggctttgtgtagaatattaacaaaacagaatcttgcaagggttaagcactcaataaatgtgagatactattattattgtcattattgtaacagataaaagttggcagatattggtggatgtattcattgtcaaatctccctttattagtctttatattattaaataattgggaaaataaattcattttattttatatgcaccataacttgttcaaattttatttcttaatattgataatgatttatcataaaatttatagtttatggagtaccttcacatgcatttcttcctccaagccccacaaggatgatgcagctgaggctctgggaaattggttatttcatccagggtgcctgattggcgagtggttaagacttgaacccatgtcttcacaccccagatgcattactgtagctgttacactgagtggaggttgtaaacatacacaggcttcgttgttgttagaatcttgatttgattgtatcgctaccacttactataggtcattttgtgagcaactgcctaatttcatggaatatcagattttatatcagtaaaaattagaggacaatgacttctctctacttgctatataaattaaaaaatatatatatcagatcacatatagagatggagctatcccagctctgggtccatggtagttaacgcaaaggcagtctcttccttcatttatcgttgataatgtaccacacatagtgccaaactatcattttttaaaatcagatcaatgttttcatcaaagaaagctgatgttagagtttgattctagtggcaccaagatctcctgtaatccatgattgcgtttgccagccattcatggtgattaacatacttttgcgaaaaagaagtgacaatgaggagaatgaaggtaataaggaggaaaaaaagaaaagcggacttcctctagacttagagaacatacaaacttcattagcagctaaatagcaaggggagagggtcccgaacaatgatttcactcctttgctgctgtgaactaggtgttctagacataaaaatagaggaaagactagaacatatgttcagtgggtaaatggccctctgcgttatatcatcctggtgaggttttctaattattcagaattatcattttgattgtgaaacaaatgcttggtttaggggaatctttggattagactgtgtgctccttgtacttcgtctccatatggttcaaggattttaaggtgaaatgctacaaaaatgtaggtgaatgataaagttgctagaagtatgtcagagaggtgtgagaattttgccttttcatactgtggggattattttgtacactgctaattttatgattagtcctggatcgaggagtgcaagcaattgatatatcttagatgtttgactttattatttgtttttttttttttgttgttgttgttgttgttgttttttgagacagggtctcactctgtcacccaagctggagtgaagtggcacaatctcggctcactgcaacctccaccttctggattcaagcaattcttgtgcctcagcctctcaagtagctgggattacaggcacctgccaccacacccaactaatttttgtatttttagtagagatgggggtttcaccatgttggccaggctggtctcgaactcctgacatcaagtgatccacccgccttggtctcccaaagtgctgggatcacaggcgtgagccaccatactcggcctagttgactttaaataacacaaaaggaagttccactgaaaaggtgaatcctattgctggtgtaaagtgcaaaccattagtaagttaagcaagtctagctctaaaataacccaaatctgcctattgctttccaaactcagggctgctatcctatgtctgtcacatgtgtttctcatgttgattacagcattgggctcccaactggtctccctgttgccactctttcaggctcataatctattttctactcagtagccagagttatcttttaaaaacataaatgagatgatcttacttccctgcttttgaatcttcctgtagtttctaattttacttactatacttacaataaattcaaatttactgtgatggtctacaagacctgatggagtctgacccttctgtctatgactgcatctctcactcttcccactgtggctccatatcatccactctccctggccatctttctgatgtcagccagactttcttctggcttacatatttgcatttggtgttccctctgtctgaatgactagagccttcttgtcgtaaaagtctcagtccaaatatcacttcttcaggtagatcttccctttctttccagtgtaaggaactttatttgaagaaccctaaatgaagttatgttactcaattattcactcgtttagctgtctctccctcaactgtagtgcagtttccatgacagcaaggatgatgttcatttcttgctgttaccattcctggtgttcagaaggcactcaagaatctttgctgaatgaatgagtaatacatcttagaatgctagtttccatgaaagggctacaaccagtctgcaggatcttcaggtcaggaactgggccttgtgctggtttccatgatactgctctatacgtgctcaggaaatatctgttgaattggattcaaccaaaacatttgaatttctgttcagtgagaagtgttccctatgtaagaagaaatttaaagctatgtttgataacactcttctgagagaaagcctgctttttagttgaccagccatcccagtttgccttggactgagggatcttctggggacatgagactaatgggtcaccctacatgccttccacagctttagagccagaaatacctaacggatcagttaggaattatatttaggtgctagtaacaaaagccagaaataacagtatttaaaccacaagagtttactgtttcatgtaaaatgagttcaggagtggggacatcagggatgtatggcagccctggtgcatccacttctgaactcatttcatgtgaaaggtcatcagtgacccaggtttcttgtatggtgtccactatccttagtgtatgactctcatctcagagtagcctcatgttccagtgtggctgctgcagctccttcagctatgacataacatatacattgcagccagtcacccaaggagtaaagagggacagaaaagcacgcttttctgtttgttttctgtttgtttttctcttaagaagactgtttcatttaaaatctgtttgtatttcacaagctttctgttaagtaaaggagagattgggtaatatgagataatctttcagccgggcacatagcctcttctctaaataattctttttttttttttttttttttttgagatggagtttcactcttgttgcccaggctggagtgcaatggtgtgatcttggcttaccacaacctccatctcccaggttcaagcaattctcctgcctcagcctcccaagtagctgggattacaggcatgcaccaccacacctggctaatttttttttttttttttgtatttttagtagaaacggggtttctccatgttggtcaggctggtctcgaactcccaacctcaggtgatccacctgcctcggcctcccaaagtgctgagattacaagagtgagccactatgcccagcctgaataattcttattaagaatttctgttactaagaaagagagatggggtgatgagtaatacacacttacttagcatcttctgccacatctagtttcactacttattgacttagtgaccttacaagggttgtttcatttctctgtgcctattttaaaatatgcattatggtgatgcaaacaaccataatagtaatagctacctatctacggggttatgctctttgtcaggcattttatgtacatgatggtcaccctcacaataatgccacaaagggtaggtaattatccttgtttagatcagaggagtgagacttagctatttgtggtaaagccagaatttaaacccagagcagtttggctcaatacccattctttccattacactttgctttctaccttattggctgtcaagattcaatgaggaaatgaacataaactgcttgacctgtaaatttttgaaataaaccaacgcaatgattctgttaagaaaatatcttggttttctctaacaacaacaacagcaacaaaatatctatggtagatgtgtgtaggaagtgatttgaggtcaccttgaagccagctgactctgaagaacaacccttcttcttcccaacttctgatgttgaaaaactctctttttcagaaaattatattactggtctgactcaaatcacttctttactttttatttttttttttatattttatttttttgagacagagtcttgctctgttgcctaggctggagtgcaatagcccgatcttggctcattgtaacctccgcctactgggttcaagtgattcccctgcctcagcctcccaagtagctgggatgacaggcatgtgccaccatgcccagctaatttttatatttttagtagagacgaggtttcaccatgttggtcaggctagtctgaaactcctaacctcaggtgatctgcccacctcggcctcccaaagtgctgggattacaggcttcaaatcacttctactattattattattattatattattctattttgtctttgcatggttcggtcctaatggagagctagatgacctggctgtgattttttatatgccacgagaaggcagttattaagtcatttctcactcttctctctaaaagtaatcaagaggtgaaaaaaagtctcccatgagttgttctaaggagacaaaaatttcctagtcctgggggcaggatgaactatacacctttcttgacatttggcaataaatattctatatagtgcagctctttgctttggcattcatgtcttcatgagcccagagcccaggaaacagttcccacattgctccatgttgaagtgagttgagttgttttgaaaactcgtgaagttttaagataccttcttttgtgaaatttgctacagccatcagcctcactaataatgccttgaaaatagctgattcctgtaagatgcactatgctcttctctcatctcaaagccttcacaagaaaatttcccccagacacaatgaactcctgtgcagagagtgatggctgtatttatttccagggaagaataaatcagaagaaagcagggagaatattcacatcttcaggcctcgaaggaggctgctgggaaacaaatgcaagacaactggtttttgtaagataactcatagcctgtttgaaaatccactttgcaggaaatagaatagaatcaagaagccaaagtagcaatttctttacgtttccattgatcattgtgttccctgttttaaacattcttggtttggaaaaagtgtagattacatgtaacctttgtgggtatagtttcatacaaaagtattagaggattgagtgagaaaaccaggaaatggaaagtctcaggttgtattaccaaccaagcatcatacaatcataattaaagtgaatgcttatcaagggcttactatatgtctgacattgtgctaagatctttaattagtgatccctcatttaattatacaaataaccaaagtaacaatatgtagtagaaaatgacatcatttctatgtcacagatgaggggatggaggcccaaagtctctcagtaacttgccccaagtcacttcattgtaggtggttaagatgtgatttggacccatttctgttttccagggaattacagtgtattagacttctaaagctgccatgacaaaataacacagattgggtggccaatacaatagaaatttattttcttactgtgttggagtctgggatttcaagataaaagtgccagcagggtgggcttctcctgaggcccctctccttgtcttgcagaatactacttttttgcagtgtccacacaaggtctttctccgtgtgtatacactcgtggtgtctcctcttcttataaagactccagttctgttggattagggacacatgcttatgacctcatgtaaccttaattacctccctaaagcctctatctccaaatgcagtcattttatggggtagggatttaacatacgaattttagggggagagtgttcaatccataacaacagccaataaattgaaccagcgtattcagctcttgctctgacagcaggactttggttaaaattataacttctctggccttgtatctctcatggatctaaaacaaagataatttgatcatttagtttttaaagacttctgttaaagactcttaaaaaccttatgattatgaaagtaatactttatagtttattaataaattgtcactatttgtataaaattaaaatgaagtcattctcatacgacctgttgtgaaggtgggaaggcatagagatttcttctgggggccacataagttcttccccctgatattaccattttccactggtattattggccctctttgttttttaaacacagatgaatgcactttttctttttgcttctttactactttttccagcaaacaattattgtttatttgatatgcaccaggcattcttcttttcaagcttaaattcattaaatgcttgttacgtgttagatgctctctgaaccccatacattcattgagtcagatttagcctttcaataagcctataaggttgtgcagatagggaaattgaacctttctctggttagataatttactcaaagtcaatcagctagaagaggtggagcttgtatatgacttcaactctctctgattccgcaacctgcatccttagtccttaagctactgagatgaactgttacttgtgctcttgcagactctgtgatatattcctccacctgctcttgcggttttgatttttgctcctgttgactgcctctccttgatatcagggtctctccctttctccgtgcctccgtctcctagttcatttcatcttgtacaatgcacacaatatgaaagggggagatttaccattgttttaagtttaattgcattgcctcttttaacctcttgctgattaaatagtgggaaacgtagaaataattgtcagatttttaggagaaaacaggttgagaagtgcacttgcttattgaaggatgctttcccttttcactgaaattacctggacttttgtatgcaattgctttgtgccttccattatttttaatttcggcttacaattagagcttgcaaattgaattgctttctctgaggagctgtgatttctctatttggcaagtgccaggcatcccccgtcacaaatccccacttgctcagctgaaattaacatggttgattttgttctcttgtactgcaatcgggtctgatcagtagaatcatgatctcacttagtaattgcttccacagagtctgtagggagagcggatatgagtggtgctctgcctgatgaggagaatggaggttctccaggggagtacaagggagctttaggcaatgatcttggggattatagagagctgtccctctttacttgcactcagaagtcttgtggtatttaccaaagccattaagggccctgatgttggaagtgtcctctttggaatcaggataaattcaaagatgtggttagctgttatcactcacagatgctgcaaaggaaagcgtattaactgtgggtattctagctcaatgccagcttagttctggttatttttattagggaaaaatcttaagatatagtcaattcttcagttcttcagtttcatgtttcatctcaaaaaagttgatttgagttccgcaaatgaaagagagattagttttgcagggtgcaaaatgagatccattgtagctttatgagtggcgagtggcaggtcactggaggtattcaggaatctagactggatgacctctaatgccctttctaatgctgagatgaatgatccactccctcacctctttctgttctccatatggtagcagcctataactctaacatttatgatctaacatttatgaactttgtggtctcttaatacctcagtatcttttgtgtctctatgtctttgtacttccttttccctaaatctgggaaacttctctctggtcttctgcatggttggctccagtctatttttcaggatacaacgcaagcattgctgcctctctgtataccaagccccatctttaggactgagttagggattctagtctgctccttatgcttacttgtcaccctgtgttataactgctggcagccttgtccttcctcctgatgtgagctcaatgataatgctacattgattgattaaatcacacattgaagatataatagacatgcaaaaaaaattgttgagtgagtgagtgaaaccaaatagtgtttgattacttttgtgtagagaattatagattttaaaaataatattttgaatagcattttaaattttaattaataagtaagtttcatggtacttagttttctcttatatgtaccttttcagccatactctttctaggaatcttgcgtacttgtcagtgagcatgtatctcagtttttaagaaagtcagggctgggcacggtggctcatgcctataatcccagcactttgggaggctgaggcggatcacgaggtcagaagttcaagaccagcccggtcaacatcgtgaaaccccgtctctactaaaaatacgaaaaaaaaaaaaaaaaagaaaaaaaattagccaggcatggtgggacgcacctgtagtcacagctgcttgggaggctgaggcaggagaatcacttgaacctgggagatggagattgcagtgagctgagatcgcaccagtacactccagcctgggtgacacagagagaatctcaaaaaaaaaaagtcagaaggtactgagatcttctaaagttcagtataaagaagtaatcactgtgcagtgcttatttctatagacaaaacattttatatttgttacattaaatataatggataggaaaatctctttaccatttggtgagtggttatgaatcacatggaagcaagtatcccttttatttgcaaattggaaaggtttttctggtagtgatgggccttcaagagacctcctttccaatagagggtgctgctactccacaagctatgagggaccccaacagatgaagacatcaaaagaattgttctaagtgcatcacagctggctacttggaattatgatttatgttcagctgtagcccagtttgaagaatttgaaaccaaggggggaaaagtctatctgttcattttgcgagctccagtcttgttacatgcagtgtttcagcacttctcaggtgagcagcggaaagtgtagttcatctagcagagctgtgcttttagagacccccctcatgttgcccctgcatgatgtatgagtacctgtgcttctcaaggaacccacatttgctgagtgcatttctatttcactgtctctttctaataattttagatcaggtcaacctatttggcctctggctacatgagaacagtgaatacagaatgcaaaatgattaacagatacagtgaaaggcctagataacttgttttcttagagaccctacactgagttgtggaaggacatcagtcttcctttcacacctgcttagttttgctcatggtgtggctatggcccttgctgtttctctgccttttaaatccttaccatcctttaaaggccggcccaaatgcccatgcagagttaaatactcattcccacatactatcctgctctggttattattaatgtcacttgctttattttgtcttgtgtaattattagttgcttacctatgtgcccctcctttaagactaaatactccaaggcaggaactgtgtcctgatcctccttgcacccctcagtaccaagagcctgcacataaaaagtgcccaataaaccttgattgatttgaaatgagtatttctgagaacggtactgcatgtaaatattgaactcagaataactaaagcacagctttatgagttctttagaagtgcagttggctatatatgttcataacaattgaaaggataaaaagtaaatggtaggtgaaatatgactcattttgtggtgggcataggggtggtgctccaattcaggagatggtgttttgtaaccttatcgtgtgattctactcaaaggttttacttataattaataatatgttttccatttttgagaaaaattagtgtttgggtgagttttacacaagtggtgcttgccacgtttcacacactatattatggcttgtgtcatgtacgtttgacaattctttcgtgcttttcacagtttaatgttttcttcttcgtgacaagaaaaagtcacccagcctttccctgcatttctctcctacaccaactttgtggtgaagacatggtgccttgtggtagattatgctgattcaacttgttggaccaaatgtttctgctattaagaacaaaacaataaattatttctagaagagagagaataaagaagctttaaaaaagtccaacggcctacccaagtcaactattactcaaggtgggtgccatgacttgaaccaagggtttctgattcttaaagatgccgctttcaactcctgtgggattcttcccaccactttcggttcttctctgttgcatctcctcaggctcacctctgtagtgcactctggaccgacctttaactgccaacatctgaatctctgcctgagggaatttttggtgttagggactgccctgcccacattcagagcaggtcagaagttccagaaaatcagcacccccctcggcaactctactgactggtgggagttttttaaataccccaactccttcaaccctaagctgagataactctgaagctgttctacactggattgcaagattctacaccagcattgagctccttttgcccatgatgatagagaatttgtttgataatatgccctttgttaactgccttccgtttcctgtttcatttacctacccccttccagtgtttcctgaatcgcttcccaaataatctacttgtagtggaatccttacctcaaagtcagcttctggaggaatccaaactaagctggttatttttccaaaatgtgctttgatgaagaacttgcttgatatatcattgatgttgaacccatactagagttccacattgatcggctaaaaacttaaaattttatatttttatagagtggtagaccaacagttcacatattttcagctaatgtattacagtgtatttctcatgttataaaaatttaccagtttactacttggagtgaatttccgggttgagattcagagaggacaaaaacaggtggaatcaacagtcttcttgagttgaggggatggaactgggagttcagggaggtcaagtcaggagaatttgcaaagtacagggcaggagagagctgcacagagagaggataatccagagatttttagcaggtaagtacattaacacacttgtaactgtattccatatgttaaggaaacgataggaaaaattgattatactaagaaatggaaaagatcttatatatattttcccaaacttgtacagatggatattaaaatgttggaaatgaaaaatataatgaatgagattaatgacagattaaatgttgcagaagaaacttttaatgaacttgaaaaggtagcaatacaaactattcaaaatgaaacacagacaatagactgaaggaattgaaataacacacacatacatacatatacatatatacgtactctgtatatacacgcactatacattctaaagcaaccactaaaataacactaccatgagttatagttaataagccaacacaagagataaaatacagtaataaaaacattgacccaaaaaatgcagaaaaagagaaaaagaataacaaagaacagacagcacaaatggcaaacaaatagtaagatggcagatttaaactcagccatgttagtaatcacattaaatgtaaactgcctaaaaactctaaagacatagactgtcagtttggattattaaaagtaacctctaagtacatgctgcctattgaaaaccattttaaatatacagacaccgaaaggacaactgttttgaaagacactgttaagaaagtgtgaaagcaagcctcagagtgggaaaaaaattttaaatcacagatccgataaaggatctgtttatagaatatataaaaatttcttaaattttaataagaaaacaaaacacttggaatttaaaaaatgggcaaaagatttggacaaacacttcaccaaaaatatatatggaaagcaaataaggacgtaaaagcatgattaatttagttcttagagaaatgcaaaggaaaactacaatgagataccattacacatctattagaggggctaaagttaaaaagaagaaccataacaattatcggaaaggatgtggagcaacatgactctcatacattgttggtgagaagatagtgcaaccacttcgaaaacagcttggccattgtaaaagaagttaaacaggccaggtgcagtggctcacgcctgtaatcccagtactttgggagacagaggcgggtggattacttggggtccggagtttgagacaatcctggccagcatggtgaaaccccatctctacgaaaaatacaaaaaaaattagccaggcatcatggggcatgcctgtaatcccagctacttggaaggctgaggcaggagaattgcttgatcccgggaagcagagattgcagtgagcccagatggtgccactgcactatggcctgggcgacagcgcaagactccatctcataaataaataaataaatgaagttaaacatatatctgccatgtaactcagtcattcaactcctgtttaccaaaaggagatcaaaatatttgtcaatataaagagttctgtagcagcttactttgctatggacaaaattggaagcaactcaaattcccattagcagatgaatggataaacagtgtgatctatccatgaaatgaaatactaagcagcaatgaaaggagtatactactgatgtacagaacaacaaagatgaatctctaaacaattgtgctgaatgaaaggagccagacaaaataaaaagtatatatttgatgatttcatttattaaaaaataattctagaaactgcaattaatagtacctgaacacaagccactaggtcactgggaagtgggggtggggatgggtgtaagggtaagaaggcaggaaggatagattataaaggggcacaattaggggcacaaaatagattataaagggacttcttaaagtctaatttatctttctctttctttttttggttgtccttttagtgtctatatatttaaatttgttttcaatgggcagcatgtacttagatgttacttttaataatccaaatggacagtctgtatctttagagtttttagacagcttacatttaatgtgactactaacatggctgagtttaaatctaccatcttactatttgtttgccatttgtgctgtctgttctttgttattctttttctctttttctgcatttttttggttgaatgctttttattctattttatctcttgtgtag

SEQ ID NO: 2983 - DNA, 9266 bp, Homo sapiens
ggaaacagttttccccatcctcacggctctggaaaagaggaacaaaacactaccagttaaataaaaagcttcaaaaggcatcgtaaattcccgtagcaggatatttaaagaatggttttaacaatcagactaaataaggcgacctgactccatgcctggaaaactcaccaggctcaggagagctttgtcattattacctcatctgagagccacttaacccaggcaggccctggacgtgccttgctggctgatctcacgcaggagagatcggtgcagtgcaggcaggtggcagactggccgtgcctccacacgggccctccctggccaccactgttcgggattcagttcttgtttctgttgttactcagagggcatagaggagaccggcatacccagcggccaaaggcagggcccaggcgggggtgagcacaggctgggactctattccctggggtgatggaagactggctcttgagctgcatccttggtagcttttccttcttcatctcattgccagtgaggacactgaggaggagaaggaggtgaggaggaggaaaaagatgaggaaaaggagaaaaccaaccacgatccactgtcaccaaatgagcatgccaggttgccatgctgcacagctccaagaagcaccactgtccatgtggtcaacatggatggatccctgaggaggtgtccagcagcagcctgcatgccatgcgtggctctgaagtcaataatcctggaaaaagggtcattccttcccaataaacgacagtgggctatctcccgcagacacccacgaaatttccctccttttccttccatggaggactggtgaaaacgtcatcatggacctgacctgcatctggagaccatccctcagaggtgctgcagagctcctttctgcccaggcatttacggtgggtgagaacttggagaggcgagctcacgagggagttggggttttgacttggccatgactactcagctcaggatgaaagctgatactttctgagtgcattctttgattaacccttcaatcctcacaatcaccccatgtcaccaggaggaaactgaggcaaagtccacacaactggcaaatctggtatgactctctttctgtcacagcagtttgctggcaacagacctacagccagatgctcaggtgagttagttccagtggctgcttttttgtggcacccagacctccattctctcccttcatcactgacctgttgctggtgccttcttgggactctcccaaggccttgctgcttttctctcctcctgggctttgaccaaggcttacccatgtggccacacagtttcagcaacttgggggaaaatgataggaggttgaatccctttcccttaggaagggactgaggcttctcatgctccatctagcaattgtgtctttctcaaaatgtacaacattatgttccacgagagactcaacacacaggtgcacaggtgacatataggtggctttttgcctatggagaaagtggagcatcggaggagccacagagagggaagtgagggctagcaggtgagggcggtgtgatgtttcttctcctctcagccaagctctgtcgctccttgctccaagggacagactgtgctcctgtgggaagcctctgacctcactccagtgagaacagcaaagtgagtggaggtgacccagccgcccttctgcccaccacagctgcttagctggaggatgaaatacacttattagccaaacccaatgacaggccttcgtttctgctttttaatccctcagtagtttataaatgttcctttctcttttgcagctttgaactacacccctttctttaaggaatgtcaaattaaacttgaatacaaaagaatatttctcaccatcataccatataagtttttatgtgtaattttatggctacgctttccgactagatattagtattataatattccaaagcgaaaagcaaaaaagagttattgccattgagatgtaaatatgaataaacaccgtttttagaatccagtgatttttgtcaggcttttgggagtgcttgcttgtcattttataattgcaatgaaactgaaaaatagacctgaaattatataaaaatacatcaaggagtgccctgcatctatgttctcctagtctttgaaggcaaattctctatgaatagaacttatagagattctaattggtcttacaattgagtttccggtaattgaacataccttttagtcttctttacttcatatcatcatttcacatcttcttcatttcaattactggtgctagaaaataaaacgcaatacactgtgattcgtgtgtagaatgctggttagttcagctccaaagagcaagtaagatgttctatgctcagctctctcctgggtctgctcataataggtattcagtaaatagttgttgaatgattaaataaatgaatgagcaaatggatacaaggatgctgctatgtagcattatgtaacttgcttagattgtatgtattttttactgtctgtctcccctcaatgggatgacggcctctcgagggcagacgttttcgtatgatttgttcacaggtgtatcccaggcacgtagtaggatgactgacacataaggtacttggcaaatatttcttgaacaattaacgagtctggggctgtagccacagattgcactttctcatctcagccagatggttcttaaatgtatatcttcagtcataaagggaattgggagaaatattttagatgtgttaaagaatgaaagcagattgctcgctgttcctggtctctttacacaaatgagtctgcccacaagagccctcacggggaatgtgtgaaaggcgactgtcgaccccagcgtttctttcttaggaattccttcagaccacctttaatttgtctgctgtgtagtttctcactttttggctcctcactatactcacttctcatgaaaacagggactcaagtggatgcgtacacccatgttcgttgtgtgctcttcacagtagccaaaaggtagaagcaacccacagtgggtgaatagataaacaaaatgtggtacgtgcatgcaatggagtattattcaaactttattttattttacttttcaagtctaagtgtttaattattattcacctatttcacagaaaaaagaggaatgtagcaaatgggtcggggttgtagaaaaaaaaatcccggactttacgtgtcattctgttttcatccgagagcagggcagtcccgacatcaggcacagcagctgcacttttccgaagcccctttgcggatgcagccctgggcacacttggcacagcccagggggcaacaggagcagcagctcttcttgcaggaggtgcatttgcactttttgcacttgcaggagccggcgcaggcgtaggagcctccagcggcgcaggagcagttggggtccattgcaagccgaggtgagaccggcgttcccaagcgagaagagaagaggcagtggaacacgtggagggcgtcgtggattgattcaaactttaaacaggaaggagattctgacacctgctacaacatggatggactttgaagacattatgctgagtgaaataggccagtcacaaaaaggcaaatacaggccaggcatggtggctcacacctgtaatcccagcactttgggaggccaaggcaggtgggtcacttgaggtcaggagttcgagaccagcctggccaacacggcgaaaccctgtctctactaaaaaatacaaaaattagctgggcgtggtggcacatacctgtagtcccagctactcgggaggctgaggcaggagaatcacttgaaccagggaggcagaggatgcagttagctgagattgcaacactgcactccagcctgggcaacagagcaagattccatctcaaaaaaaaaaaaaaaaaaaaaaaggacaaatacaattccgcttatgtgagtttcctcgaggagtcagattcatggagacaaaaaactggatggtgggggaagaggagattggggtgttattgttgaataggtacagcgtttcagtttgtgaagatgaaaaagtcctgaagacattgttaatgataaaacaacactgtcaatatacttaatgccatgaaactgtactctggttaaaatgataaaatttatgtcatgtataattttactatgataattaataatcttttaaaaagacccatccataaccacccatttgggctctatggttccactcatgcctttggctttgccttgaggtcctatttctggagaaatcttcaggtatgaatcttggcctgcctcgaggacttagctgtgttccttgactcaggtttgagtggcaccttctcgtgttccatttgttcatcatcttgaacctaaagcaaagaatccactcttaattgttgtcttggtttaagtcaggggccagcacgagagggttctttattacggttttcagttaaccattcagccttatgcaggtcccttggaggagaagttgaagagattaatggaagccgaaatggctgggaactatagattgtgattattgtactactaagatggtgttgcagctaggaaggaagtaaataattcaatacaatacatatgtatatacacacatcaacttctgagtccatatataaatgagtaggtgacttgggcacttgcttatttatgtattatcctagagcatatatgttatgaaaggagggattttttgttttgctcattattccattcccactgtgcctgttatgaattaggtggccaatcaacattagttaagtggatgaatgagtacattttacacacacacacacacacacacagacacacacacggagattgagagagagggagggtcattgctgcttctggcttagtgccaaaaagagttacatgtaaagaaactcaaatctattatagcagttagcttgtgataggctttctttcctgccaaaccataattgtgtgctgttgtaaatgacatctcctcccatgctttggaaacttgtcttcatttcgaaactggtttattgtccaagttaattctcctcccgcgttttcttttcttttctttttttttttttttttttttttttttgagatggagtttcactcttattgcccaggctggagtgcaatagcacgatcttggctcactgcaacctccgcctcccgggttcaagtgattctcctgcctcagctttcagagtagctgggattacaggcacccaccaccatgcctggctagtttttgtatttttagtagagacagggtttcactatgttggtcaggctggtcttgaactagtgaccttaggcgatccacccgcctcagcctcccaaagtgctgggattaccggtgtgagccagtttgcctggccaactctccctttctatactgttttgcatattttcattttatgagcaggttggaagatgaattttaagggtgtttggaatacagaaaggatgaaacctctgaaattttctttgtacaatttttaatgctgtaaagtctcatggcaattaaacaattattatttaagcaggatataaaaagttatgcagagcgtggatctatttaagacacatgtaatataataattattggtgttattaataccagttagtacatagcacccaatatttgttaatcattgtgtaattaattttgttagtttactttgggtgattcctctaaggaatatatgtgactacatattattattcctcataacattcttgggagctaaatattgtagttcagaggtaacaacatctcagatgttaactgatttgccatacaagaaagggactaaacattcaggaacaatggaagattatatggtacatatattttctatttcaaattgctctgaaaaatttatgcctagtccgttttatcaagcaaatgtgcagcattttttttttctataagtctagcttttctttcaacacaagactgagctggagtattttgcctcgcagacagtgagtctcagggcacctttttggtggggacagccatactcaggtctccactccacggagacctgagacttctgaataccaagagaaaagagagagattgaaaggaagggttcagtccttgaattcctgtttaaactccatgatgccaaaggggttagatacattgccaaaagcttaagcaactgagcaaaaaataaagctgaattggaaatgatacagggagagaaaaagagttgggtcagcaggtaggagttagtggcttcaccccatctctttagcttccctaaggcctcttggaggatatcttttccactccttactccacgtctgcatcacctgcctctgtccaggctccgtggcggcatcagcaaaggcaaggcagccagggagggccgctgagaactgaggttccaaaatagggaaagtagaaggggagggcttggctctcaaactacttcagttcttcctcctcctctctccctctctctcctccctttactggctcatttcattttcccatgctgccattctttataagtgcaaccacaaagactctttaatatagcattaaaaatccagttaccgaaaatcaatttgtctatacaaaataaggatgcaagataaacaggatgctcgttctgtaactgtctgaggactctccacaggaaagggagaaatgccgtggggagacattgacgtcctgcattcatcatgtgattatccttgtcccgctcgtcagcggcggaatgagacagaacaacttgacctcgcccatcaggactggagaggtcgttgttgggattagaaacccagaaggtagagagataatattgcaaataggaagtgcttcacacacagtaactgcatccatggcccagagaacaattgtagcacacaaggagcagggctgtggctaaagtgttggcatctggagctaatagttctaaaaatgatataaggtagaggtagaaaaacaactatctatgtccgaaatgaaggatgaagagctgaagtcactatcgaaagggcagaggcctactaaccagcatacaaagtaaaacattttctaatcctatgttggatatacatttaaaatgatttaaaaacaaattctcacagaatctcacaacaatcctctaatgtaggcaggaaactactaccaccctcaggtgacaaggagatgggctaagtgtcttgcctaggtcacctggcgatcacgtctatctctggcgccacagtctctcactcaccctgcttggaaacctgcccgtttctgaatcatgtgaattttgtgtcccccatgcctgggcagtacctcccacttctttcaaggcaacagttttctcctctccattcccaccatgtcctcagcagcccaggtccctgtggcatcacttttggttacctgtccagagtcgcccagctaaggtttatctcttctcattaggctcctccaatcccaatgctatagagcacaattttcattcttcctggtgacattgtcatccccagatgtccttgcagtgcccagcacacggtaggtgttgactaaacgtttgataatggaagtccttccacgttaaggctctgctcccctgtctgcccctccaagttcttcgtctacccccgttttctctggtctcactgagcaaagacagacagccttccaccttcacacctaaacttgctcttcatctggaaggtagtgtgctcttgaaactacctttgcaaatttatgacaataagagaaatatgacatagttgactccgtctttcttctaacctccaagctgtccttggtcatccctgggtataggccaagttaactttggtagaaattcagtttatagtttaaccttaaagcaaggatgatcatagcccttcccccagactaaactgactttgtaacactaatgaaaggctgcagggttaggaagatgagagggcctgaattctcagatgtaggcataaatgataagcagccattgttttgaaggtcacaagatttaaaactttcccaattactcctggagataacgtcactattgtagaacctaaaattagtcttttgaggtgatttttgactcctgtattcctgataactggctgactccacctagacctgcccattttcctgcatccctatgatttcatccccaaccaatcaacattccccactccacagccccctgccccccatactatcctggaaaagttacaacctccaggcctttggggagactgatttgagtgataactccagctgatccagtgtgagctggcctggcgtcaattaaactctttctctttttgcagtgctgtggtctcagaggatcgattttgtccatgaagtggcaggaagaatctgttgggtgattatgctctcctccttcctgtaaatgaaaagtaaaattctaaggccctcaactgactgagtggacccttctctaggccaaggggacccaaagaaacctgaaaaactaggtcaggccatatgggaagtgggggttggacatgcctccttatactttcctccctttagtgttcaggcacaactgaccaaacttaacattaaaacagagatcttaacactgacaacacagactctttgtagcaataagataccaaattccaacctgactctagtatagcatcacatgacaaataaagaaggaaatcaaaacatttcaccccaaaatatgtttctttgtcatattttgaaatgacccagcaaagccatcttttgtgggggaaaatatccagctgtaaagaatgtctattaacataaccaagtctttccctttccaggccctcccaatcctgaggaaattaactgagagtctagcaccttttaaaagtctgaataggaaacatttgccatctattgtctcgaagggtggccacctacatgatttcatctacataataagaaccttggtctccacaaacccttttcttgacccagatgctcctttctattcatcccaggtcttcagataataacttagctgtttcgacaaatttccgattggtaaatcttgaaatccacatatgacctagaagcgtccacttcaagatgtcctgcctttctgggatgaaccaatgtatacctcacatgtattgatttatgtctctgtgtgtaacttctgtccccttataaggtgtaaaaccaagcttaacccagtcacctggggcatatgttcccaggacctcctgaaactgtgtcatgggtcatagtccttacagttggctcagaataaac

SEQ ID NO: 2984 - DNA, 22564 bp, Homo sapiens
tgatcactgttggaaggcagctgcttgaggtccaaggcagtcagtgtcccctctcttttgcctcgggacagctggtatttatcagactcctaagaagttttccttgctccctagtagaagagagagattatgcagcgggcttttgattgatccaatgggaattacattgatctggtgtctggccttggttcttatcaagtggatcacctctaagaggcgtggagctatttcctatgacagttctgatcagactgcattatacattcgatttgaatcagaaagaagaggttctcacccatatattgattttcgtattttccactctcaatctgaaattgaagtgtctgtctctgcaaggaatatcagaaggctactaagtttccagcgatatcttagatcttcacgcttttttcgtggtactgcggtttcaaattccctaaacattttagatgatgattataatggacaagccaaggtgtgtatagtttttttaagaaaacattaattttttgataagtttactgaaggcctttattccccatacagtaatgatttatagagtctttttctctgtctatgaaaagcagttgagcctattttccaggtttttttctttagagcagctgtttgttttataattagccattacagagcaagggaaatttctgaaataactaaagtagtgacaatgttttcatttattattataacattacgtaacaaggagatcaataaaacattaaactataagatctcacagaattgtaatgctgggaagacttagagattacctgatctaatcatgtccgtattccatcaataaagaaactgagtccaagagagcacgagggacttgtttgcgcccacccagctggttagaggtaaacccagcacagaaagttaggtctctctctcttttttgtgtgtgtgtgtgtattaataacatcttttcacaaaggtctcgtgactttcagtcaaatgagtcttgatagtctcttgcattgagagagatttttgagggtttagatgtatcatagttaaacttgttgattgtgagcattatttacttcctctttatataatttaaaagaaatgtcttactgaacatcagggttaaatgagcttgtttttaaccaaatgaggattttaaataatattaaatttccaatgtattttaagttatatttgacttaatatttacagaccagattcttgagtttgtgtagataagtttttaagttgtgtaggtaaagctggggtgtcttctttacaattacatgaaagtgaagaaaattacttccctgtttagtaaaagaaatcagtggaaagcgttcatgcctgctttaaatgttaaaatgtttacaagttctgccttttagaatgagaatattgatctctatgtcatttgttgttattagtactgttataattaatgatttctactagtagtatcttagtgttgctcatgtcagtgtattcataaatgtatacaacagtgaacttttggatataaaatataagtttttttctagaaaaagtccacaaaaggttcaggttaagaatgtatggtataaaaatatttggtttttagggcctttgtgggatttatttgcttggctgaagtacacattatcctaaaagttaatgtagtaaattgtgttattttataagcatatttagataatataaatacatatccataagttagaagtgtttttttaaaaactgaataacaaataatttaagcatggtgtggtatcagtgtcagatgcctaggttctagaaacagactacctaatttaagatcccagctctatcactttatagctgagcaagttagttattttttgcttgtttctacgtccctaaaatgagaattgaaaacaatgcctgggctgggtgcagtggctcatgcctgtaatcctagcacgttcggaggccaaggtgggagaatcacttgagtccaggagtttgaaaccagccctgggcagcatggtgagaccttgtctctacaaaaaaaaaaaaaaaattagccaggtatggtaacacatgcttgtagtcccagcttctcgggaggctgagacaggaggattgctcgagcccaggaggtcatggctgcagtgagccgtcttgtttgtgccactgcattccagccttggtgacagtgagtgtgagaccctgtctcaaagaaaaaagaaaacaacatctgatagtgttgttcttagtaataaaagagtgagtaacttataacagtacctggaatacagtaaatactcagtagtgtcacttatttttattagattgtttgcaatttagtttctaaaccatacaacatttgaaccacacttctgtgatgttaagtgatactagaattcttaaaggtttgcaagactgtagcaataagctgggaaacataaccttcctgtgcattcattaattgaaaaacaaaataatgtttcatttttcaaatggagtttatccctttggcatttttttggagccagttgaaaaagtcatgattaaaagaaaaatgatacttgtattttttaaagtaaatcaatcactttacattttctttaacttctctatggaatatctccaaaagacaatgttattgaaattaaattacagtagaaatgtttggttttcatttcagtgtatgctggaaaaagttggaaattggaattttgatatctttctatttgatagactaacaaatggtaagtgaagaatttgacttgctcaagttaatgtagtctagattactgcattgatggtgcagccgctggtgcgttgctttcatttactgtactaaggttgttagccctctgctggaagagagtgtattagtccattttcacactgctgataaagacatacccgagactgggtaattgagaaaaagaggtttaatggactcatagttccatgtggctggggaggcctcacaatcatggtggaaggtgaaaggcacatcttacatgttggcaggcaagagagaaatgagagccaagcaaaaggggaaaccccttatgaaatcatcagatctcgttagacttatccactaccacaagaacagtgtgggggaaagcacctccatgattcaattgtctcccaccgggtccctcccacaacacatgggaattatgggaactacaattcaaggtgagatttggctggggacacagccaaaccatatcagggagcatcatttttttctctttttaagtgacttttctaaaagcctacagaatcaatctcataattttatgttttgattattgtccttaaaagtaatcaaatcatcattagtatcatcatcatcatgacttggcagattggttggcaattgccgctgctattattaataacccaaagtaaacattattatctcatgttttttatttttattttttggtttcttttagattgtggccatttataatcacatctgatgttgtatgcctgtttcctgaccaaagcagtggttccttgctttcagatagggaatggggaagagctgtagcttctttaagagcgcttatcagaatctacagagtatgggtggtttgggggaaaatgcccacaggtgattctaatcactcctgagtttagtttggttctggatggaggggtcatgttttcttattctctttgcggacagaaacatgttctgtaggaaaaggaacagggaatcactcttatttaggataaaattgtgggcataattattggtggtacaattgaggaccactaaaccttaggcagttctaccttttagtatatttttatttgggtagcttttctagaaatacaatttcctttatcaagaaagtgttcatttccatttccatttttaaaaaagttccttcatgcctgtttttttttgttgttttgttttgttttgttttgttttgtaacacaactaagcatctcttatttgaaatattttgttgatttgtgttcttattcactggtaaaagcagttcagctaggctgggcgtggtggctcatgcctgtaatccccgcactttggcaggccaaggctggtggatcacatgaggtcaggagtttaagaccagcctggccaacatggcaaaaccccatctctactaaaaatacaaacattggctgggtgtggtggttcatgtctctaatcctagctacatgggaggctgaggcaggagaattgcttgaatctgggaagcaaaggttgcagtgagctgagatcgcgccattgcactccagcctgggcaatagagcgagactgtctcaaaaaaaaaaaaagcaattcagctaatgttttgccccagagctgaaagtacactgagaggaagtcagtgctgactttagaataatgaaatcactgctgtactttgaaatcacctgctttttcttattgctttggaatgaagctcctttgataaggatgccaaatatgtaaaatgaacaaataaattacctttatttttcttgagaatcaatgtgggtcttttagtatcactccattattctctgtaagctgtatggcaatgcctagtggaaatacctttgtctataccttctgtttgcttatgcagtgttgacagaaaataaactggactgatcctaggcaaaattgtgaagacagtgaagtttgtctttatcagcagagccaccctcctgcctccctgcctttttattcctccccttcgctatctctcttctacttttcctttgcccttggtgattaagtgttctgttcttctccctgcccccaccttggcccgtacacacaggaaaggctctgatatcatttacacagttagccttcccttggcccttctcctttttgaaaatacaggtagtgaaatatcaagtggcccaccttcttcttgctcagggaaattcccctttcctaacttaacacaaatattattttaggtattatctcaaggcaaatatagatgaaacaatgccactcttaacattttcaaggtttagccttacataaactctcacagctcatagcctattattagtctactgggacacttgtcactcattgaaatagttgattgttcttctccaaattttatttttaaaaagtacatactctgctagttgggggcatggtgatgaaagcggcgtgagctcagcagtgcactggatgggcagaagaaatagccagcagtccacagtagttaactaagcacttcgctttccttttgatcacctcactctttgaatgggatttgtggacagggtggctaactagtttccccttagggttcattccagatcattagggtttagtagaaaccactcatggttagctacccacctttgattttagaggtggagatttatacattcagttaactacagctattcaaaagctcaggaattttctacttaaagagatgttattggggaacaaatgggcagaaaaaaattcctttagcttatattatataatgagaatggctttccttttaaaactgcttcacctgaagtgaattctggataacatacattcatggtatccaagtgtatagttttcccttcttgcttattgatccagtgctttcttgtgtttcttatgctggtaatttcccagttgatattgggggaagaacagcaaggcagaggaggaagcaaaatgcagtgattcgtgccaagacaaatcgttcccagcttgtctgctacaaggagggaagtagttattgtctggtaggatgcatttggagttccttttgtaggattgagggagttaagtgatgcgacatagcaaaagcttgtcactcctaaagccacctggttcatgaggacactagctgccaggcctgcgttgtcagggtggcctactccttccaaccagatcccatctgggatcaccttctaaaaatgattgaggaccactctttcataggcagttctatcttttgatatatttttatgtgggtagcttttctaaaaatacaattttctttttcaagaaagtgtttccatttccattttttaaaaagttcttctgtgcctggtttttgtttaacacaactgagcatctcttgttttgaaatattttgttgacttgtgttcttactcactggtattataatcctcagttggtatcttgcatgcagcttttcaattacatatgggtagtacactttaagagactgattcttgtcagattcctttggtggggacattacatgtgtttcttcactgcactttgcctgaattccaaaagagggtattttcccattagattgtagctttcttaaaacttattctacatcctagaaatgggtaatttgttttgttacatttgaaaaacaatttggagaaccttatgataatctaaatatacagagaatgaataaacattctaaaatatttatatactcgaagatggttgttacagcaatagcaacagacacgttgttcacttcttcagaaatggctccacaccacatggactcgtgtttgtaccaatagagcatatcaggacctgaacacattttaacatttaatttatttaaaatgtaagatttgaaatgcttttttctttccacatgaaggtgatacgtcaggtagtttttaaaaatagtctcttttggcctgccacatcttttctgtcattgcttatgcaaataatgctccaattaatgtactttttcatcagctgtggtcttttgttggcagttggttaggcagttttagataacaaggttaaccaaacagtcctttattatccttcataaatattattattataaattttcaatttgggactagtatgtcttttatacatttttgtaagagtcatcatagacgagagaatactagaatcgtgtattttattgcattatctgaatgttggcagtaatttatgagtctatgtgaaggatgtagtctacttaaaatagactttttaatatgtagcctatttaaaacgtggtctatttaattgttaaaataatatagtatatgtgtcctatggaagtttacaaaactgagaagtataataggaggtataaaaaatggagagttacaccatggaagggaaaacgaaacatcataaaaatggtagtttttccaaatttaatttctattcttggtgtgactccacttgttagtgacaaaggagtggacgttgaggacgaaaacagtccccattgcgtgtagcagctctttccaaaaactcggctctgtagggggatggagcaggtgaaactggagggggccaggagaggctgtgattctttattgtttcagagatgagagaatctagaacatgtctgaatgctgatgcttgttgagacaatatagaaaagagagagagattggtggggtggggtggggatagttgtacctgatagaacaaggaatatctctgaggaggtgtggatggattggcttttgaaagaaagggaaacttggccaggcgtggtagctcacgcctgtaaatcccagcactttgggaggccgaggcgggcggatcacaaggtcaggagttcgagaccagcctggccaacaaagtgaaaccctgtctctactaaaaatacaaaaaattagccgggcttggtggcgggtgcctgtactccctgctactcgggaggctgaggcaggagaatcgcttgaactcaggaggtggaggttgcagtgagccaagatcgcaccattgtactccagcccaggtgacagtgctggactccatctcaaaaaagaaagaaaaggaaacttgagggcttgtattatttctgtgacatatgaggctgtggagaatgagggggtggatgggaactaagtatgttgaaagtttaagaagagcataaaaggcttgaaaataggcattttaaaacgtgaaagagccatttcactggaaagacaatatgattgctgggcagtgttgactacgagtttgtagcgatattctgcctagttttgtgattccccctccccacccccccaagcaactctcagattttctgcagctactctggaaaagcaagtggctgagttcagagtttttaatcctgatgatcttgaggtcattgatgcctcctcctaaccctgtatggatgagaatagacacattctccacctaacaaggctgcagccaaggaagtgtgctctggggcagtcagtttcagtgaaagcaagatggcagaggcaatgtcaggagggaggtcaggtgcagccacactgagttaggttactatgtgggacaatttttaaagttttctattgtctattctcattattttggtgtctttaaaaaattaatctatttgaaaatgtctagttttcagttctttggttgtggaaaagtaaaacaacaaaaattaaatttttcttataatgaaacaagatgtgacatataaagttcataactggtaagaagatgcatatttttgatagacaaaaagtgggaattattactctttccatgttttatattcaaaatctgtatttcaaagcataatataattgtgttgacttgtatttcctactaatgtaatgtctcttctttctttttaggaaatagtctagtaagcttaacctttcatttatttagtcttcatggattaattgagtacttccatttagatatgatgaaacttcgtagatttttaggtaagtgattctaacccattaacagtaacaagatttacatttatacaagaacctgtttaagttttatctcagttatatcggttagctattgctctataacaaaccagccaaaattagtggcttaaaacaacacacagttatttagctcttgcatctgtggggctgttaaatgcttcttttggtctggtctgggtgagctcatttgtgcacctgcagacagcaacaggtgggctgcatgttggttttgtagagacctcagctaggataccaggcctgacccatctcggctctacatagtcttctgttaaatttaaaagaagcagaggagtttggcaccataatagatttacattaaaaacaaaaaagaattatttattttacaattagccgagctggttcaaacagtagtggcaggtttccgagagagctgatatccccaggccgctggagccctgggctcagaatcggcccaccttcacttctgcatgcagcaagtggccacagcaagtcagaccagggatgcactacacctgttggtgcaaaggctgcaaagtcacagagccacagatacaggaaattgtggatacttgatttcattttgcaatgttccttacattggccacagattgctgacaaagatgacacaatttctgtacttttctaaatttttgaaggctaaaactttaaaagagcaggtatattgcagttaggtttcttctttttctgacccctagaatctctttgacggtaggctttaaagattatttggggccaggtgtggtggctcacacctgtaatcccagcactttgggaggctgaggcgggtggatcacgtgaggccacgagttggagaccagcttggccaacatggcaaataccccatctctactaaaaatacaaaaaaattacccaggcatggtggcgcacgcctgtaatcccagctgctcgggaggctgaggcacaagatatcaactctagtcttccttcttgtaataggcaccagtttctcctagttggttctacctgaggaaggaattcatgattcctggtaaagtctttgtccgtcctttaggtggataggagaacttctgagaaagtcctctcctgcatttgctgctctgagtttgaagtccaaagcagcatattttggggtctcattttctgaccctcattgtgatatttcatatagtgcccagatcaagagatagcttaatttgtaatttatttggttatatacaattttgcttatatacagcaaaaagattacaacttaatgaaggttcacataatgattagcattttatagcaataaagtcttttaaattaaggtgtatacatcgtttttttttaaagacataatgctattgtacacttaatagactatagtgtaaacatagcttttgtatgcactgggaaacccaaaattttgacttgctatattgcaatattcactttattttagtagtctggaacttaacactaaatatctcactggtatgtctatacttaatagtgagagaccatcacattgatttgatatcctttttaaaatctttcaattttaagtagagagaaattacaaattattcaggaagtaatttattactgtaggaaaatggtaaaactgtggaactataaaataagttaagatgttgctggtggggacatttaatatttcatacatgctgggcatggtggctcacgcctgtaatcccagcactttgggaggctgaggcaggtggatcacttgaggccaggagttcaaaaccatcctggccaacatggtgaaaccccgtctctactaaaaatacaaaaattagtcgggtgtggaggcatgtgcctgtaatcctacctactcgggaggctgaggcaggagaattacttgaacccaggaggcagaggtgagattgagagagagagagtgagccgagatcgcgccactgtactccagcctgggcaacagaatgagactctgtctcaaaaataataataataattaatataaccatttttgctaatctgcaactgctttatctaggtaaacagaagcctgtgtgactctacagatacaattttgcagtaaattctcaagtttataattaatatagtgtgagtagccccagtagctatactggcaattataaagatgcatatccccactttgcacattgttcatatgaatacttggctgtttatcccttcatcctgttgccgctaatgtggaagccactagaacaggtttatgagagaattaagccttaaagccataaggaatccattggcttcaatggattatcttttgtgcagcatatctggaatggctttggctctatactgtccttgggagaattgagaaaataataactcaggtgtttttagttagtttgtttgtttgagacagggtctcactatattgctaaggctggaatgcagtggcatgatcatggctcactgcaacctcaacttcccaagctccagccagcctcccacctcatccaggctgaggcaggagaatcacttgaacctgggaggtggaggttgcagtgagccaagatcacgctactgcactccagcctgggcagcagggcgagactccatctcaaaaaaaaaaaagcctcaataccaagaatgtacagccaaatgaagagctagaaatattaactcagacttcagacttctacttagaactctggcaaaaaaaaaaaaaaaaacagataaatttattacatagggcttttgagaagctttttcttttggagagtcttgctctgtcacctaggcttgagtgcagtggcgtgatcatggctcactgcaccctcaacctctcggctcatgcgatcctcccacctcagcctcccgagtagctaggaatataggtgtgcaccaccacaccagactacatttttatttttagtagggacaaggtcttgctaatggcctaggctggtctcaaactcctggcctcaagcaatcctccagcctcagcctcccaaagtgctggaattacaggtgtgaggcagtgcacctggccttgagaaactttttaatgtgtattaattataagtagtatgcctgaaatactgtacagtagtccgcctttatctctggttttgctttctgtggtttcagttacccatggtcaactgtagtctgaaaatattaaatggaaaattccagaagtaaacaattcataagttttgaattgcacaccattgtgagcagcgtgatgaaatctcattgcatcctgaaccgtgttggttatcagatcagccatgttggtatcacagtgcttgtgttcgtcacccttattttacttcataatggccccaaagcacaagagttgtgatgctggcttattgttataatcgttctattttattttaattattgttaatttcttactgtgactaacttataaattgcgcattatcgtaggtgtgtttgtataggaaaaacatagtataaatagggtttggtactatctgtggtttcaggcatccactgggggtcttggaacatatcccccaagaatatgaggggactactatactaaaaatataaattataaaacacatacggccgggcatggtggctcatacctgtaatcccagcattttgggaggccgaggtgggtggatcacctgaggtcaggagttaaagaccagcctggccaacatggtgaaaccccattgtgacaaaaatacaaaaattagccgagcatgatggcaggtgcctgtaatcccagctactcgggtggctgaggcgggaggatcacttgaactcaggaggtgggcgttgcacagttagctgagatcatgctgttgcactccagcctgagtgacagagcgagactccatctcaaaaataaccacatacaaaaatagcttattaggtggggcatagtggctcacacctgtaatgctagcactttgggaggccaaggcaggtggactccttgagcccaggggtttgaaaccagcctgggcaacatggcaagatcctgtctttataaaaaatacaaaaaaatgagccagacatggtggcatgcacctgtggttccaactacttgggaggctgaggtggcaggattacttgagcccaggaggtcagggctgcaatgagccatgatcatgtcactgcactccagcctgggcaacgaagtgagatcctgtctcaaaaaaacactattaaccaagggtactgaaaggctattttaaaggatgggacggaagcaagtgcagaattctgatggtctgtcccgctcactcggcgattgtgtttccccatcacaggtaggctcgctttcctttgagaccactggatttgtgtgttatgctgctagggctgtcaagtaggttgatggcagggggcacagctccaccccgaagcctagtctgttcgtccatgatagcatagagagtcaaattgatattgattcttttggtatacatgtgagttgtgaggtgattatcatctgcccgaatcggcacgattttagccgatagctacatgaaaagtatgagtgggtaactcataattatcacaatttttgtccttgtatatgttgctcatatacaataaaatcgggatctctttctttgatgcagttatgattcaagaagattaccacagtcaaaatccttaccataacgcagtccacgctgcggatgttactcaggccatgcactgttacttaaaggaacctaaggtaagaggttgacattgatttcaggtgaaaatcataagaaaattccttttgatttactttcacatacttctcctgaagttactgctttgactgaaaatcacagacttccttcacaagaatgagatctagctggatcaagtttctgaatctggctgtgtttcagagtgcaacagctagagaattgggtggttgttgagagagaggctggagaagcccaagcaagggccaggtcacttgaaacctcgactgctggcatttacactgagctccacatgggctccatgtgggcagggacagccttggtctgactcagtgaatgaatgaggagctacagagaggaggcaggagactttagaaaattatcctggctgtgatgtgaagataaatcgtatcaagaccaaaagcctgaacacctgccaggagttacttcagtgctccatggaagagagcagagtggccttggtgaagtagggatgtggatagtttgcaagttctcttgggaattagaatgaacaggatgtggtggtgaatgcatttcggggaaagaaacagaagtcagtgaagactggtttgggcagttgagtagaaggtggaagtcttccatgagaggaggaatgtagagcagaacaagttttgggggtaaggcttgtagagacagtgagcaccattttggatccgtggtattaaatgtatttgacatcctaatatagaggtctagtatagagttacataaaagagtctgaagtatagaagagaaatcagacttaatgtatggatttgggaatcattgtctgcaggtgttaatgaaagccatgtttgcccctggacatttcctatccctggcagttctgcaattatgtctgcctatcccatctctacttcaaaactgctctctccctagatcttagttctggctaaggtgttaggcgggaaacaggatgaccaaactggcttgtgcccattgatgccaacttaagaacacagctagtcttctgattatttaagagatcatagaatatgtgaaaatgcccgttttttagtatatatatcatgacttttaaaaaatcaactttattgtggtagaacttacatgcagtaatacagtgcatacattttatgtgtacggttttgacaaatgtatactcccaaccacccaactgtttttttttctctaagagacagggtttcacagtgttgccaggctggagtgcagtggcgtgatcatggctcactgcagcctcgacatcctgggctcaagctggaggccagctaattttttaaattttttgtagagacagggtctcactctattgcccaccccaatttttaaattaaacttcaaaaaaatctctgggccaagactgcatcctctgtttgagaatgttgtgggagagattgatgagtaatcaccatacaatctggtaagtggaaagatggtaataagttctctgcagcacacaaaagggttaacctggtcagcgaaggcttctgcactcccatctccctctgggcacacccaacccaagccaggggcagggaaatctgggtgatgccaggtgagcagggtggggatgcatgtggacaaaaattaataaaaacatgattttgaacactttttgcctgtggagttctgataatacttaaacacttttcatccttaacatactcagtgaacactttacccaaggcttcaattaaggatatagataaaatcacaaagccctacaatgcaggcatttcccttctcccttatcatagtgaacattttaaaatggagtcacccaggactgggcacggtgactcatgcctgtagttctgcactttgggaggctgaggcggatggcttgcttgagcccaggagtttgagaccagcctggtcaacatagcaagacctcatctcttttattcaaaaaaagatagaaagaaaaaaaaacagagtcactcaaagttttaaaaatgacttctgaaaaatttgaagtaggtccaagtgcggtggctcatgcctgtaatctcaatactttgggaggccagggcaagaggatcacttgaagccaggagtttgagaacaacctgggcaatatagcaagatcccatctctacaaaaaataaaaagttagatgggcatggtggtgtgtacctgtggtcccagctacttaggaggctgactcaaaaggatcacttgagcctgggaggtccagcagagagtagtgatagtgccactgcactgcagcctgggtgacaacctatctttagatagatagatagattagatagatgcctgaagattgtatctcttttactcctgagcctttgcacagcatcacgttttatactctttgagcatctgccacatgccaggctctatcctggtgcaaggaatgtggtggtgagcagggcaggaatgatccctgtcttcatgaagtgtacatcctagtgggggaggcagtcattaaacaaatagataaatagaattttgatcaaaataatatgttagtggctgggcatggtggctcacgcctgtaatcccagcattttgggaggccgaggctggtgaatcacctgaggtcaggagtttgtgaccagcctggccaacatggtgaaaccccgtctctactaaaaatacaaaaattagctgggcatggtggcgggtgcctgtaatcccagctacctgggaggctgagacatgagaatcccttgaacctgggaggcagaggttccagtgaaccgagatcatgccactgcgttccagcctgggcgacagagtgaaactcagtctaaaataacaacaacaacaacaacaacaacaataataataataataataatatagagaatgaccaggtggatggcaagagttttacaactttagatagggtgatcacaagtcacttaagtggacagtacataactaaggagtcagccataagaaagtccaagtacagagggaatagtaaatagacttaagtatatatattttgtgagaaatttgttttcagtttttataccttataatttatatggaagagctaattcttggactcttgtctatgtggaaaaaaaaatatttcaagccaaagaaattactggaaattttggagacaaactcatctctctatatatgcattgtcactaacttgagtatttattttttatgtcctcaaggctgaactcatgtggattataaagcattttgttcaagttgagcccaaagtctccttgattgattgacactggtaacattcatagttgtcagctgaagagattgtgattttccctttgtttcctattttaatgtttagtttcatgtttctataatgagtttaaattagctattttacttaataactatacttaaactaagtctggataagaattacgcttacatgtcccagagataaacccactctagcactgaacctttaaaccttgctctacttgtccctggcagttgacaaaagagcctggccctgcacgtccctccctggcccccgcatccttccctttgatgtcagcaagactgatggttgagttgcctttcttgcagatgtacacttattcatgctctgagtagatgctaattgctagtgacaaaaatatgagtaagataggaattttggcccccagaatcttacttgtaaaacatatgggaacctgacatggaaaccacaggaatgtcaggcctccagggcaggaatttttgtctgtctattccctaatatttacctgtcccctaaaacagcaccagcacatggtaggtacttggtcaatatgagctgttaatgaatgatattgtatatgggctttatcattggctgggtttactctaactgttctctgtttttatgtttttattttgttctgttttgtttttcagatggagtctcactctgtcgcccaggctggagtgcagtggcacaatcttagctcactgcaacctccacctcctgggttcaagcgattctcttgtctcagcctcccaagtagctgataggcatgtgccaccatgcccaactaatttttgtgtttttagtagagatggggttttgccatgatggccaggctagtctcgaactcctgacttcaagtgatctgcctgccttggccctgcaaagtgctggaattacaggcatgagccaccatgcccagcctagttctctgtttttagacctctagagcagtggccgccaacctttttggcatcagggaccagtttcacggaagacaatatttccttggatggggagggggatggtttcaggatgaaactgttacacttcagatcatcaggcattagattcttataagaagtgtgctggctgggcttggtggctcacacctgtaatcccagcactttgggaggctgaggcaggtggatcacctgaggttgggagttcgagaccagcctgaccaacatggagaaaccctgtctctactaaaaatacaaaattagctggttgtggtggcgcatgcctgtaataccagctacttgggaggctgaggcagaagaatcacttaaacccgggaggtggaggtttcggtgagccgtgattgcgccattactctgcagcctgggcaacaagagcgaaactccatctcaaaaaaaaaaaaaaaaaaaaaaaaaagaagtgcgcaacctggatccctcacatgcacagtttacaatagggtttgtgctcctatgagaagctactgcttccaaggcagagctcaggcaataatgctcactggctggcagctcacctcctgctgtgcacctggttcctctcaggttcctaacaggccatggaccagtaccggtccatggcctggggattgaggagccctgcgaggaccgccttgtccttttgccttctgtgtgtgggaggttcatttctttcagtaatttctcaggatggacataatgtgtcaagaatctgtcttcactaggcagggcatggtggcttatgcctgtgattccagcactttgggaggccaaggcaggcggatcacctgagattaggaattcgagaccagcctggccaacatggtgaaaccccatctctataaaagtaccaaaaaaaaaaaaaagtcaggcatggtggtaggcgcctataatcccagctgctcaggagcctgagtaagagaatcgattgaacctgggaggcagaggctgcagtgagccgagatcgcaccactgcactccaggctgggcatcagcaagactctgtcacaaaaaaatagaatctgttttcagaggtagcatcattaggaaaaataaaaatacaatactgattcaggacattttatgtcactaaactgctctcctccatgatagtgccacctcctctttaccctcagcaagccaccagtatctcaggtaccttctttctgctatttctactatatttttgatttgccaatttagccaaaaaaaaaaaaaaaaaaaaaaagctaccaccaacgaaactcactgtgataaccattacaatgggaaatgataagggctggcaggcagtgaaaacagtaagcttttcactgaacacagcaaaactcaccacttaatagttttctattttattgaaaaagaaccctaatgatggctttgcagatacaagtaaaagctgaccttcacatatgttaaataatctgtagtttcttttttgacatttctttgttgtcagctcttaacagatgtaatcacagaatggaaataacatctgtcttttaatccaccttaaaaagttaagttattgaagtccttgtctttgttataatattgaaaattttgtttctgatgaaaggtttttttttacaagcagaaatgttacatttttatatcaaatatttttttgcatgtgtgatttgtttttaaagttactttctcttcacagaatttttgagaattcagttgcttattgtcatgttcctatttttaatggttaactctttaatatacctgagaatgttttgatgtcatgtgcagtcatacattaattttttaaatcagtctaattttggattattgtattctcccaggatgtctattcttctgccaataagaatgtaacccctttgcatactgcctaataaattacatgttcataagacatagacacccatgcccattcatgtatatgtcaaggaggggagattgctttatatgcagtatgctttatatcctatgcattctgttcatcttgattagtaagcagcgctttagaatgctttattttttcaatgcttttgtatatcctaaagaggaaataattttcttcatcttctcctattcattgaccttctccgtgtactaattatatgcgatacaaaaataaataatatgcatctctgcttccaggtagcttacagttttccaggagattcaagccctcagacagtgatttctctgactgagatgaacttaacacagggagtagaaagagatgattgattcgttctagcagagaaagaaaacaatagaatttgaatctaaaattatttttatctcatttttaaaattttcagtttttatctttgttgtataacatataaatgttagttcagtataataatccataagtacatatacttaatataagtggtgtatgctcaaaaattttcactgttagagcacaggatcattacagtttagtcagcactgtcctaacgtaaacctaaataataccatgctctgatgagtggtattgtggcaggtcatgaggtgctgtgggaacacaaatctggccaagtttgccagaaaatgagaggcatttcatgaaaagcagatgatatagtcaaggtgatcttttttatcattgaacatttgtcagctaatcataaacttttatttattgtgattattaaataagtttggtaatgattattgagagtaaagttacaatttctggtgtgcaagattgctttccctgacatgaatacattgtatcattgttatgaatgtagccatccgttaggggaggattttatcacagacttgacatagacttccacttaacatgattactcagtagcctccttaaacatcaggactaaaggaataaccttacatcttagattacattattgaaatccaataaccaatttgttgataaataaacacccttaaaattttagatcttttgttcagtaatggctacagtaataaaaatgtgccaaactatgtttgtcattttaaagccattatttctcaaaaagaacggtttatgttttagctgccattttaattaagcttgttaaaaatgaaatggcctaaggatgaactctgtaaactccacatgggcagggccactgttgtatcatggctttgccagtgtggtgatgagatcaggacctggcagatgtgcttggtgaacctaatgaacaaccacctgaggaatgacgtgaagggggaggagattaccaccactaccattggctgctaattcaaaactactgtgatggcgtagagcttattttagatatatctgtgattcattattcttttgtcacacttcagcttgccaattctgtaactccttgggatatcttgctgagcttaattgcagctgccactcatgatctggatcatccaggtgttaatcaacctttccttattaaaactaaccattacttggcaactttatacaaggttagtgcaattttatcatcaagatttattatttttgcattctagaaaatctttcatattttgaagaaatgaaagtaatgaaaataaattctcaatgaatgttagaattttaaccagattaatattgctaacagtattgttagtaatgatatgtccagaaagagacgtatcattaagtaactcagaaacgtcctttgttgtagaatacctcagtactggaaaatcaccactggagatctgcagtgggcttattgagagaatcaggcttattctcacatctgccattagaaagcaggtaggttggattaagacaaatttaatttgttactggttatagaagttaagttggcaaagtaattttataaagttttaaaaattgttatgttcaggtgttccacagttttcagtgtttgtcaaatttaataaattatatacaattttagtaatttagagctatcctactatatagtcggtaacattttaatggatagttatttttatcaaagactattccatgggtttgaatactataaaatttactcaaatacacaattgctcagccatagtttactacttatttacataaatagatattacacatttccatactcagctgaataaaaccttaaggtctaggtataaaggtaaattggatggaatgtaaacattctattacattaaatagattcattaaaatctgttcccagaagttttcaaaactgacaagaaagtaaagagagtgccttatgtcctcaatagcataatcctggagtcacacttctagagctataggatataataatgaatggaaaaaaccctaatattttaggaaaaaaaaataaatgggctattttagaacctaataaaaaacattaatgtgaataaggctaacacgatggtgatggtttataaaatctcacgtcattgccatagtgtggtccacacacaagctttttagtaatgttgcactgagggaaaatgcacgtcagcaaaccatgaaagtggattgaaaccatccacttcaagaaaagtggtgaggtataaaaatatgtttgagtattaaaatttaagttccacttgctgttctctggtttccctttcataatttaaaacaactgtataaaaaactgttttgtgtaatgaccatgagaaaaaagctggactttattttttatttttttaaatctttattcacggataccatttggagtatgacaatacttctggtaagtaaaatcattttttgctgtagtacaaatacgaaaattgcttaaacacactgtatatgtaaattatgggttcttaaaattaagacagattaaaatgtttgcttcattattccctttttaaaaatcatgtttttcatttgatgattaaccctgttgagttctcagatttaataaaaatggaaataaggaatactacctaatagcattatttaatgttttcttcatttagggtttgttttaacattcaatattgtgagtctttttatctatttgacagctctttactgatcattatacagagatagtatttgctatggcccattaaaacaaaaggcaagaattttttttaagtatgtttatcttgttaattgatctgag

SEQ ID NO: 2985 - DNA, 1055 bp, Homo sapiens
ctggcggcccgtcccaccggccccctcgggcgcactgcccacagtcttcaggggctggcttgggctgttctctaagaaatccccccgtccttgtttctagctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaatcctacccagcacccttcccccgcgtcacccacctgccagagcctaaggcccccggctctcgcactctgtacagcccaccttccctgcctcacagataccaatagagaggttttcttaattaacaaaaggacgtatgccatggagaaacacacccgcgcacacagctgctctctacagaggctgcaggctccgccgagtcccccctcagtgttattttatttatgacttacgctcccgtctgcccatgcaccggcatgcagtggtaattattttagaaatattgttccttggtgtcagcgtagctgtctgtcttaggagctgggtcggcgttccgacagcacttcctgtccgcccttctcctctgccatccagaaccgtccagaactgttgcctgagacccctcctctctcacacagccctgccatgctgactcggtttcccctcagagccattgttgtctgggctcgagtttctgccccaggttgtgtgctggaatcggggggtggctctcctgccacccatggggagcgccaggagaggagggtcatggaggatgttggggctctgaccccaggagtggggtggagggcggagcctgctgggggccctgccttcacagagatgccgcgtgctgggaaggctcttggggtcccctgagcgtcttccagggtggctggagagcacagacgcgccagggagccccctctgtgctcctcagagttcaataaatgtcgtggcccctcctca

SEQ ID NO: 2986 - DNA, 1283 bp, Homo sapiens
gcgtttgcgtggcacgtggtcgggccgcctggccctgggaaagcgtcccacggtgggggcgcgccggtctcccggagcgggaccgggtcggaggatggacgagaatcacgagcgatgtggccctggcgttgagtttgtggctgtggtcgcttcggggccccggtggcgggaccaggggctcgtgagaaatactaggctttagaatttcaccatatgaattttgggagagaggagcacagttcagcccataactaacacacgcaagacaaatctctcctctgccttctccttatcagactactcaacatgaaggcaataagaatgaagacctctatgtataataattgacttccacttaataaataaggttacttggtacactggtcgacaaaaccttgaaatgttgatgtttaagggctgttgattgctggcagcaaagaagtccaactgtgctggtacccgagatagcgtctccacattttcttccaggatcatcacctttgttctaaatagctcccacatagtgtgaacagaagtcatatgttttagattttctgccttggcacccaggaaaccagtatgattgagtaaacatattaaacttcctctgcatttccagcctgaacagatgttgagtacaagctgatccacctacgttcaacctgagagagtccacatccacagactgtttcatttccctttttcaatttacatagaagcatagattcttgctggcatatacaaatgcgccatttaaggcaatcaaaaatggttccacatctcatctgatttccacaattgttgctgtaacgatggactactgaggagagagacaatttctctggcacatcttcccacattttagcaacatgttcatggagagccaatattcagtaattacagcccaattcctcacaatttcacaattcgctaacaatatgcattttcacaatgtaaagctgattttcctttaaccaaatcaaacatgaaaagatagctgcatgcaatgggcaatctagatcattagaagattgatgtaaaattagaggacactgagactggaatagattgcaaacttcagggagctcagaaaacttgtaaactctacattttgaggaaatatgttgtcgatgcttttgcaactctatgcagtaacttaacaaataaagccttaaagtaacttatctacgagttactttgtcattatttgcaactatttcacatcatacagcttctctaggaagtcctcagcttattcaccaaaataaaatttctagttataa

SEQ ID NO: 2987 - DNA, 3826 bp, Homo sapiens
gtgaaatcatggctcactgcagcctcaacctcctgggctcaagcaatccttccacctccgcacccccaagcagctgggactacaggcaagggccaccatgcccaactaatttatttttgtttttcatagagatgaggtctcactatgttgcccaggctgctctcaaactcctgggccaagtgatccttctgcctcagcctttcaaagtgctgggattacagacatgagccacctcacccaaacttttctttttttttgagagattcttaaactagattgtacttacgataaatgttgactgattcattaccttcaacagtgctttcagcctctgatggttcagagaaatgattgtgtatactttatatttcacctgaatcaggtttcggttgagacaataattttctgagtatgtctccacttcacaaaattaatttattttcaacttttctctagttttaccactgttttgataaataatcttacagtggaggaagacttattgaaacaatttcatcacttttttttctcttgtttgcctcagagtatggttgattcattctctccctaggttggagccattgcagaatcaatattttacttttaactgactccaaaatatatacattctagctaagtactttcagcactatgagttgtccttcttttaaagagaaatttttttaaaatgatatcattaaaaacaagccattccatgatttattgtataagagaagataagtacggagttgtaaacctgcaatagaataataccctggatatccaccttcactgatgagtttaactgactcattcttacctgttaaccaaatgcttttgagagtcaaaggcagggtctgagaggaattatcaatgaatatttgtaatgaatcattgaggtcgcttgtgaatagttgaaacttccaatattaaggctgtgtaggccaagaatctagttatcctttcagaaatttttttttctgaccacctactctgtgccttaagcaaaagtacctgcccttctttctttcttttttttttttttttttgagagcatggtgtggtctcggctcactgcaacattcgcctcccgggttcaagcgattcacttgcctcagcctcctgagtagctgggattacaggcgcctgccaccaagctgggctaatttttgtatttttagtagagacaaggtttcaccatgttggccagactggtcttgaactcttgacctcatgatctgcatgcctgagcctcccaaagtgctgggattacaagcgtgagccaccatgcccggtcagtacctgcccttctctaaaggcacttgcttgcagtctttggaggagataagctttgatcaactcatcaacctaatggcaagtatcatttgacttgagaaaagataagaaacagggttctcaatagtgtgatctacaagatagacagcagtcagtagacgcttgcttctctgaggaagtgactcttggaagaattagtaagagctaggtgggcaaattcgggtaagacagaaggttgagaaagatgttttcagagaaggctccacaggaacatagttcctctcctgctgtattatggagagaacatggagccttcagagatataaaaatgtcattgtggctggaatgcaaagatgaagggaaagagtttgaattgaggaagggatcagagcatgcaaggatttaaagattactttaagaatttggtgcattatactcattaaatgatgtttgccacttgggtcaacaaacattctgtaaaggcttagatagtaagtattataaatattgcaggtgatatggtctctgttgcaattactcaactctgctgttgtaagggagaagcagatataaacaatatgtatgtgtgagtagatgtttccataaagctttatttacagaaacaagccatgacagtatctggcatatctcctgatcagataaatcctcatgttgctgccttatttcccaatgtctccgtttgaactagtgcagggatattttggagactttagcaatgcctagtcagcaagcatcagtgtactttagacattgaaaatcgggttaggaaaaaaaaaatatggactgctttgattttcctttgaagtaatgtcacaagaagaaaacagcaagctggttcatttgccaaggaaggaagagcatgaaagacaaaatgaaatgccagtaactaggtactagaggaaaggagtgctaagaaaatgttcaaaagggatcttgaaaagcaaagatcacttggtagatgaacttgttcaaagtgttcgctaactcacctcttgcaagaacaaactatcttgcaaggctctactgcaacatgtctgatacacagcacctgcagtcaacagactctgtagttgcaaagtattgagttttgtgctcaagctatagaagttaatggactgtcataacattgttcagatgaaacccagcaaagcttaacagactaaggtggattttgcctccccttttaatccagtgctaatttctttgagtaatctcagaaaacttttttatgctaaagtgattcatttataaagttcttgtcaaaacaaccagtgtatttaaaatattttggaattataatacaggacacaaatgaaagaagatatttatactaggcagatgggctaggttatgctgcaataatgaacaaccccaaaatcttagtggttgcaaacaacaaacttttttctcccactcacaatacaggttcatcatagtcagcagggggctccaggaatcataattgctgatatagccacctgacagatcagtaacctcagtgtagctggtggccatgagaaaaggcgataatcatctttcatatcaaatattagaacaatgcaagagaaatatgagaaagaaaatgagataaaactaacctgcatttctatcctacttttctgcctgtcttagaggcaaacaccaacacagtgatagaaatgtactgatggtccctgacatgggtaacagctgctttagagctgaatttcaagaatcagcttgtgaacaatgctttggagattaagacagtaggaaggagaagatttgaagcagtaaagtgatttagaaaactatttcaatggaccagacaagaaatggtaatggcctgaaatgagtggagggagtggaaatgaagtcacatggctgcagttgccatttattggagaaactgaatttcagggatttggatcaggtcaaggtatgttatgcacataaaccaaatattaatgatatttatttagtgtgcaccagtgatatttgttttttccttcgctaaactgaagattaaggcaatcagaacctagtaaacattgctgaattcaccattgtatcccccagtgctaatacacaaaaagtatacaatgaattctactacctacctttcgcagtgtggctatccttgcaaatttcaccctttcccttcctttcagtcattcttgtttccccatgctccatagatcatttagccaccacatctttttgtgttattttgttttctgcaatgatgctggtataattcagaactactagcaaaatctcatctctagcttcatgtgatattttcctgcttataaactacccatattcttgctgtgctatagtcaatatgtgtaactcttctgaggcctcctcattcattgcagatgtttgcaaacttacctctcttcttaagggcccattcgtatgtacttaaataggaagatcatcagagacaagtatccacatgtgaactcccttagctactgttcttttctctaaatttctctttttctctgttcaaaaaatttcc

SEQ ID NO: 2988 - DNA, 5351 bp, Homo sapiens
gatctttgtgttatttaacttatttatcattttcattattttaatctcttcatggaaattgtggctaaggatttctaatatgagctctaaaattttagtattatattctagctatttgaatacagtgaatcaatattgtaggcctttggaaacgtttttaaagtaaatattacctgaaaaaaactagtttgttgtaggattaaactctgtgttctgttcttataacttcatatatggcatttcttgaaatgactgaaggaattcttggatttaaaggtcatctcgatttccctaggaagtcatttagacattataaatgatggtttattcagaagaaggaagatgagagatggagatttcctgtcagtgcaaggatattggaggacagacttcaacatattatttatatatattagtatcttatccagttcagctcaaggcagataataggtgatgttttggtgctgtgtgtataggttctagtagattaacaagttattcagccttatggctgtgttttcagatttgaatcagttaatatttgtagaacatccgtgagataaaaagatcaagatgaaggcaaaaaaatgacacaagagctctgaattcttacctttgaggggcggcatacaatttattcaggaaaatgacaagtcaaagattctacaagtttgacaattagctactaaaataaatattttacacacacatgctaagtgtgtgtaattgaagaggggtaaggagggaagaatatagagtatttctcttaagtagactaggaagaaagataggacatttgagttagactttggaagtaggagaaacgagataattggcatagaaatgttggccatgaagtggtgaaagccattgccatggaaaaagaaggcataaaggagcctggcaagaaaagaaaagattcactggtgtggagggagagggaatgaggacgtggtcagccttttcttgggaatttgaattcgtattccaggtaaaagaatgccaatgcagtgcttctcagtagtttttaagcccatgcctcctttagataaacatatatctttaccactccatcctaaaactctgattacctttcctccccataatatgtaggtgattatatttcctacgtatctccagccaagatgattttgttaagcttcactctctatagtatatattgtagagaaaggattccccccaaatgtaaattagatgagaatgttgagttaagttaataactacatacatcctggggacattctaacatgcctgtgtgtgtatgtacttcttcatttcttctccatcctttgaaaatcaccaaggctaagtgccatagccaaaagaataaatgagaagggtgaggtttcctctccagtgcacttgatactaattgaaattagggtccacagactaggaaatttagtgaaatgggtgtattaaaagaacgagggtctggtcgaacagtctactctgagaggaagaggggtataaaatacaatatgaggaaaaaaatctgaaagtactgttcggaactacgctactaaaataggctgtatatacactttttccaggttttttggactttgtatagaaaatgaagtgttttgttttagccatttgaaggattatgtgtctgcatgacatttggtggaagtatttgataagtacaggaaataaaagatgagctaataagagaaaacaatcaggactggcaaattagatttggagatgattcatatagagatcattataatcgcaaaggcaaattatgtttaggaggctctgtatagagaacaactagccaaaccctgagggaatgttaatggtagtacgagagaagcaaatattaggtttctgtctgagtattcagatgaccagaaggcaaatcaccaggaaaatatattttaaaagttaaaattaggaatctttttggggaggaatttatttagatttaaaaacacatttattgaggacctactgtggtaagtgctggggttgtaagtataaataggatagagtcccctaaacctcaagaagctgacaaatatggtaaggaataaagaactgaagacaattggggtgtaatgtgatgggtgagtgcccagtaatttacaaaataattattttcaaacttaatttcacccaggcaagaaaaagtagtgcaaatatttagggtaggagggtgagaaagcaacgaagtcgcacaaatattgtggttttatagtaaatgttgtcaaggtggagacatatatggatgatagatcctcagggatgttttatgggtttaatatatacaatggaaattctttagaaaagtatttgaggagttgtgcagctgtattgctgatatgagacttgtggtttcttttccacattttataactatgaagtagtaggctgggtccttgaataagtgtgtgttctttggtttgcatgaatggtatgtactttgaattctcaaaacagaactccagtttattttctcagtagtcccagtgagaaaagctgtatttcttaaatatggtcagaaagcacttgacggaggagtgtttactgtagaaacctgtgattgtctgcaggtaccagcataaacatgttcccattcctcatcccgggggggtaatctcattattaaacctatgcaaccttcaagttagcttatttttaatgtttgtttcatattttaaaagcaagaagtgaacacggaaaaaagtttaacaatatgaaagaacatataataaatggtcagccccagatcctcagtgccccagatcctcagcaccccagaggcaaatactgttaacagtttctagtgggtctttcatacaatagatgtttttattttcatagagagaatggcttttatttgacctctggaatacaaaaaggtaactgtagtttccttgcaatgcagttggcaaattatttttaccttctttttccaagcagactctgaaacatgagttttgaggagcaggattaaatactctgacctaagagacccagatatttggatttttatgtggacatgtactcactgaaactgaaatttggaggaactggaattaataacattttccctcatgtaattcatggaatttattgctttggctctaattatgcatttatgttatattctgaataatgcaaaggagaatattgaaacattttaggccgtcagaacacttttcccgctctcaagctgtctccctattgtatttgtgctgaaatgcagcttcaaacacctttgtggtttgggttatattttgacagttgctaggtagcttgagtcagagagtgcagctgtgcaatttaagatgtgttttcctatcctttcctctaaagagagctaaaaaaataaaactataatcagatttctaaagtgttaaacgggataaaactatttagaacccatactatagaatgaagtagatgaattctgataaagcacatatatactaaagtataccagtgaatttatttcagatgaaactaggtaggctcattgtaaacagatgagcttctgaaatttctgaactgtttcattgaaaggtaaaacaatgggtttgggagcacccacacttcttggcacaggtgagtggttggcactcattaaccaccgaattctgacacgaacatgctgtttatgaagaaaaatcagggaaggagactaagatttctgataagaaagagtagaagaaaaggtagaaattcaacttacttggtaaaacgggagtacgtcaggattagaaatgggctcttacacaacgagaaataaagatagctttttcataggcttcctattctgagagtttttcttgttgatttgtagagtgtaaatgtacttcttcctgaagacaaggactaggccgaggtagtttgatgtaaatgtggggactcatttgttatgaacccatagtagactgctgtgggaaaacattgtgaacaaaagaaggagtcaaaaaataaacaaaacattttgtggcaagttatctaagacagatcctggagaagggctgattgagaaggtaaactagaacaaacggctttaaaaataatagacaaggtcaaaatatttctgggcaagaaggacaatcaaaccacttgcaggtgttgtgttgctgcctagagactggtttggcctgacccaagtgatggtgtctggagccaaaccttttatcaggagaaatataggaccacagagatgagacaagtactaccagtcctggggaagtaaagagacggaaaattcctttctttaactagagggaatggaccctgcagtcaacctgtgtacttgcagagctatatgtctttggtattctgatatacttcacaaagtatattttatgccctaggtgctaagtgaattgacaatgaagacttggtattgagggaattaaagggcaggtggggttctgttcccaaggctacagtccatagaatattggcaaggtggagacaaacatgacataccatcttccctgccttctttaatccctgggtggatggtagcaggcaagagagtaataaatgcaaggaacagtaggtttgcagtacccttggtattctgtcatatgtgtaattgaaagccacaacaaaatagcaatagaaaagaaaatattagtgaggcggctcatgcctgtaatctcagcactttgggaggctgaggtgggaggattgcttgaggccaggagtttgagaccagcctgggcaacgtagagagaccccatctctacaaaataacaaaaaattagcaaaagaaaaaaggcttttttgtgtgtgcgtgcatgtgtgtgtttgtgggaagtcttaatttttgccttgaattttaaaggaagatttaaatgattaaagtaatgattaaagtaattgtgagatgtgcagatgacatagaataatggaaattaaaaaataaatatttattgccttttctcccctgcttacaaaagcagtacagcttaatgcaagaaatttggagaaatgtaaaaggagaatggcatttaaaaataaccttaaaatgttttttttcttgaaatattcaatggtggtggtgggtagagagtgagaggaagaagctcctcatagactttgagaaaatcaagaggttttaaagagcaataaaaggaactgagcacatctcctttaggatctgtagaactggccttaaatcaatacagaaatgtctagcaagaggcaatctctctggggagattattaaagtgagagtagattatcatttgagtgactggttcaggttctctgaggtgctcttgaagtaccactgactgttgaagcatgtatctgaaatttccttttaacacaagttttcagtgattctcttagag

SEQ ID NO: 2989 - DNA, 3221 bp, Homo sapiens
agatcactcatgtgttcagtgattcaggttctgttgaagataccaaagatattcggttggtcaaaatgacgggcatataaaggcttctcaggtttctgagtgcaaaagatatgaaacatcggctaggtttcctgctgcaaaaatctgattcctgtgaacacaattcttcccacaacaagaaggacaaagtggttatttgccagaggtaagagaaaaggccttggtgaagatgtacttagtattaactatctgatgatggggatgttctgtgagaaggaacttgtgctcctagttaagccagatttggatcaagatagcctccattttcatggagatcataactacatttgaaatttctatacatttagtgaaaaactgccctcatcaataacatattttgtcataacgatggaaaataaaatctttgccttcattcaggatcttagatttcttgccccaatttttttaccatggcattccaattattctgtttctctctattttttctagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtgggaccccattccagtccaattttcctaagtttctttgagggttccatgggagcaaatatctaaataatggcctggtaggtctggattttcaaagattgttggcagtttcctcctcccaacagttttacctcgggatggttggttagtgcatgtcacatgacatccacatgcacatgtattctgttggccagcacgttctccagactctagatgtttagatgaggttgagctatgatatgtgcttgtgtgtatgtctatgtgtatatattatatatacattagacacacatatacattatttctgtatatagatgtctgtgtatacatatgtatgtgtgagtgtatgtatacacacacacacacacacacacacacacttttgcaagagtgatgggaaagaccctaggtgctcataactagagtatgtgtatgtacttacatgggtgttttgatctctgttctttcatactacatttgaacagggcaaaatgaactaactgccatgtaggctaagaaagaaatgctaacctgtggaaagttggttttgtaaaattccatggatcttgctggagaagcatccaaggaacttcatgcttgatttgaccactgacagcctccaccttgagcactattctaaggagcaaataccttagctcccttgagctggttttctctgatggcacttttgagctcctaagctgccagccttcccttcttttcctgggtgctcagggcatgcttattagcagctgggttggtatggagttggcagacaggatgttcaacttaatgaagaaatacagctaaggccttgccagcaacacctgccgtaagttactggctgagtgagggcatagaagttaaaggttactgtttttatcctctatccttttttcctttcctgatcaaggtgctcttctcattttttcctgagaaccttagccatcagatgaggctccttagtttattgtggttggttgttttttctttataatggctctgggctatatgcctatatttataaaccagcagcaggggaaagattatattttataagagggaacaaattttcacaatttgaaaagcccacataagttttctcttttaaggtagaatcttgttaatttcattccaaacatcggggctaacagagactggaggcatttctttttaggctctgagactaaatgagaggaaaagaaaagaaaaaaaaaatgattgtctaaccaattgtgagaattactgtttgaaacttttcaaggcacattgaaatacttgaaaacttctcatttatgttatttatgatgttattttgtacgtgttattattattatattgttttataaatggaggtacaggatatcacctgaattattaatgaatgcccaggaagtaattttcttctcattcttctaaaactactgcctttcaaagtgcacacacacgcgtccacatacactgcattcgttgctccagtataaattacatgcatgagcacctttctggcttttaagccaatataatgggctgcaaaatgaagacaccagagtgtatgcatacaaatctcactgtattaaagatgcaggttttctaattgtacccttcttgtctctctggcaatcttgcccttaatatccctggagttcctcatcagtgtcattttctgttatacacagttccacaattttgtctctagttgacttcaaatgtgtaactttattggtcttgccctattataattgtcatgactttcagattgtatctgaactcacagactgctgtcttactaataggtctggaaggtcacgctgaatgagaagtaaattattttatgtaatacatttttgagtgtgtttttcagttgtatttccctgttatttcatcactatttccaatggtgagcttgcctgctcatgctccctggacagaatactccttccttttgcatgcctgtttctatcatgtgcttgataggcctcaaagctaatgcttccagtgaaacacacgcatcttaataataagggtaaataaacgctccatatgaaacta

SEQ ID NO: 2990 - DNA, 1264 bp, Homo sapiens
tgttgttacatagattgcctgtgatttaaggaaacacgatagccactatttactatttaccctgtgtcaagaatgtgatcctcccagcaacgcaatgagtcatattgcatgaccctcatcttatgaatgaagaaacagaagctcccagaggtgccactcgcccgtggtcacagagctggtgggagaatcactgagtgagtctgaggacagagaatgacacactgtggtttccaagagagaacatcaatgtttttgaccaactcgtaatttcaaagactggaaaaaccatgcttatatgcgcagcctcttttctgaggaacagactagaggatgtttgtttatgccagcagaaagcaaagccacttctagatcagatcacctgctgctgacagtcagatcaaatcaacagcactgaatgagctcctcccagggacagtgcagctgcctggaatttgaatgtggtatctggagcttcagtagtcatccaggactgtaagtgtgaaagccatgcactgagagtggtggaacagaagccctgttttctttagacgctgactcctgctgtctgccagatcctcgtggtacaatgactggtgtagactggcttgttgaagtcactctctggatctgagcaacgctggctgagccgtgatgaagtattcctatccatccactatgcttcacagtgggaatctctcactgttcatcaccgctgccctagcagccgcagggattcttcacccatggttgcttaggtttataagcaaggaagctgaatgaagtccctttcctctctggatgagcccctgggtttctggaagagtcttaaaatcacccctaaatggcttccaagcactgaagcccgagatgttagctggcctgtgtgaggccttgagacagaatgccacagccacaccccaaggatgctgaaggggatttccctcctctgtggtttttctcctttcttcccgcagcactcctcctacgtgctaacatcttctagtcaaacaactctccttttcaaagggaccaggcacagtttctgcttatccctgagtagcagtgttcagtttcctgccagcctgtggagtttttcaaacaagccaatcacctcctcctgtgggaactgagaagcaccccaccctctcgatactacaaagcccctgcttgttccctagtgcaactcccatgtggtcctgtggagcatatggtatcttcctcttctgggcagtgagcatatgtgactaataaactatctatctca

SEQ ID NO: 2991 - DNA, 9067 bp, Homo sapiens
cagggtgtcactgagaggatgcactctgtgtgtctccaggtggtcatccccatgggctccacagatgaggacaccggccctcagctctgccccctctcagaagccttcctcacctgggggttctgggtgaagggagctccccgccagagactcatgtgggatcgtgtgtggaccgtagagccacagagcgtcatcttttagatccaggctttaacttcagtttcctgtgtgacctttgagaagccatccctccaagtgcttcctttgaagggtgagccctgggtgcctctctctgagggaggcccttgctccatctgggcttgactgtgccacgggggatcagaagcaacatacattctgtcagcagctgccggaaatgctggagcagcagtcctggaggcggggtgaagcagtccctggcttttggaggaggcgtgagaagaaattcatggggggctttaattcttttcagattcccaaccattttcttctagctgctactgcctgcatttgtgtaacttagtttgcaacacaggtgacaagctttctctcgttggatgctcattgcagcactgtggggcgatgcagccaggcaggtgctattgcctccatttcactgattgagagactgagactcagagcagctgggagctctcctgagataacacagctagttagaagtcaagccaggtccccagggtagagctttcagtagtgtgtgaggacagcataaaatgaagtctgtagactgtttttttctctgagaagttcaagtcttctgccttgctgcttcttccctccaagacaataagttggttcggtgccctctccggtgacaaacttaggaaacatctcttcagtatgaggtagcagcctcctttagctattgtcacagccaattcacagaggtctaaggcccccagcttaattgatggttaaggaccaattccaccctattcctccacctccatcaaaaaaagcaggcaaacaccacttcatgcctactagaatggctattaaaaacaaacaaacaaaaacagaaaataacaagtgttagttagaatgtagagaagatggagaccgcatgcattgctggtgggaatgtcaaatggtggaatcactgtggaaaacagtttggcagtttctcaaaaagttgcacacttaccatacgatcctgaaattccactcccaggtgtatagccaaaagaatggaaatcagggatttaagcagatttctatacactcacgttcatagcagtattagtcacaataaacgcaaagtagaaacaacccaagcatccataaaaagatgaatgaggcccggcgtggccgctcatgcctgtaatcccaagcacttcaggaggccgaggcgggcagatcacttgacaccaggagttcaagaccagcctggccaacatggtgaaaccccgtctctactaaaaatataaaaattagccgggcgtggcggtgcatgcctgtaattccagctactcaggaggctgaggcacgagaatcacttaagcccgggaggcggaggttgcagtgagctgagatcataccattgcactccagcctgggtgacagagggaaaatctgtctcaggaaaaaaaaaaaaaaaaaagaaaagaagagatgaatggataaacaaaatgtgagctatacacacagtggaataatattcagccataaaaataaatgaaattttgacatatgctacaacatggatggacctcacatacattgtgctaaatgagatatgccagatataaaaggagcaatattatatgattccacttccatgaggtacctatactgggtaaattcatagagacagaaaatggaatagagattactaagggattaatgaggggatggggaaggggagctactgtttaacgggtagggaatttatgctggggatgatgaaaaagtgttggaggtagacggtgggatgaggacacagcattgtgaacgtacttaatgccactgaagtgtatactcacaaatgattaaaatggtaaatggtacattatatatatatattaacacaattaaaacagactgttaaaagaaagcaaacaggccaggcgcagtgactcatgcctgtaatctcagcactttgggaggccaaggtcacttgaggacaggagttcaagaccagcctggccaacatggtgaaaccctatctctactgaaaataccaaaattaactgggacgtggcagcacatgcctgtaatcccagctacttgggaggctgaggcacgagaatcgcttgaacctgggaggcggaggttgcagtgagccgagattgcactactgcagtccagcctgggtgacaagagtgagactctgtctcaagaaaaaaaaaaaaaaaaaaaaaaggaagcaaacaaacccaaatagaaaacaacaaccgaacaaacaaaagcaaaaaaggaggcaaaggaagaagagagggcccaagggtaaaggacaggggctggtgtggaagacacaacagtacatcatgaaaaggaacaaggtgtctctgggagaggtccaggtggtgctctgcccaaggggtcgcataccttagtgctgggaagagaggcattctctggggcctgagactcctgcagggaaactgtcccagtatcagccagagaagagatggctttcttttactgcatggcagcagccctggagccccggggcaggatcatatccctagggtgggagaagtgcccatttccaatttatttatgtgttttatccccagagtgggataaatgactatgaaactgacctaatatttatgtctattttaaggccgggggttgatatgagtgctttcttgatgaactgcgcccttagagctatttactttagtggaaggtttcttttgaggaggagattgggaaaagtcatcaaattccgtggttgctgcttcctctaattatattctcacttttgaataatttttaagcctttcggaagtagaagaaataggggcttttaaaatgatgggagcattcccaacaaaggtaaaatgctccctaccttggggcccagctctttactgtgagtttgtgacatctacttttatcattctaaaagtttcatgttgtccatactgcctgttaggaaacatggaaaagctggctttcaaacttggacttggagccaggcatggtagcatgtgattgtaatcttagctacttgcttgagctgaagactttgaggctgcagtgagctatgattgattgtgccactatgctccagcttggatgacagagcgagacctcagtctcaaaaaaaaaaaaaaaaaaaaaaagggactaaggctggcagagacaagaagactaaactttgtattaatttgttgtatggtcattccttgttttttcagaatggactcctctcttttttccctttaagcaacaagatagtggagttacaacccagcccctgccggtagatttctctgttcggtcccgaaggttaaagtccttagatgaaaaaggctggaatgcaaggtgtgaacactgagataaagcagagcatgggcacatgttttgtttgttgccatgaggctctgttttattttatttttaagacagggtcttgctctgtcacccaggctggaatgcagtcgtatgatcgtggctcactgcagcctcatcctcctgggctcaagcaatcctcccacctcagcctccccagtagctggggatagccaccacacccggctaattttttgtagagatgggggtctcagtatgttgcccaggctggcctcgaactcttgggctcaagggatcctcatgcctcagcctcccaaactgtaggagtacaggtgtgaaccactgggctaaagtgtcatcaggctttagaaccagaagctcaagaactggcctcaaaagtaaagggacttcagaaatgaaattacattctgaaaccagtgcagaggagccaagtattcagcactgatttgctctcaggtagcactgagcatatatttgctggtgacagaggcagatgactggaatttattttttaccaaacggttttgtttcctgagtcctgagagatgacctggtcgaaacttcccctttaatcttattaaggaaaatcgatgggcacaagctgggattaactacaagggaatttgagcagcaagagaagctcattcttccaaggtgcttggtaaatttggggaattctctgaaaattctgagtaaatatctgggtggagggcaaggaagtgactatattattactagtaatgcaaggagatagtcatagctttgacaaatacttttaagtttgaagagtttttattttctcattttgtctctatgccacccaggtattgctattgccctaatttctcagagaagtaaactgaggctgagagcagtccgggggtttgttggaggccacagaaccggttagaagaggcgtggattaggatgcagggagtgaaacttccgtgcatggcagagcctcatgacagaaggagcctggctccttgaaagaccgggtggagagagctgctcacaggttggagcactgcccaagatgttacatgagcaagaaataaacttccgtggtgtttagtcactgcatttgggtctatttgttactgcaccttagcctatgctaacaattatagagtctgcctttgctaactcacacctaaaaggtcagatgtctattttgttgccaacactaaagactgtgcttgctcagctttgaggctgaacaaccatatttgagatggtgatgtctcaagtgatgtgtgtgtatgtggagcagggggagtgtgaggtgctggcttgatccgcattcccgtggcttgcagtaagattcccagatggcagctgccctctgcacttttacccttcctttccactcaccacccatcacttcccccactgttcccttcatccccctgtgtcccatcgatgaggaagcctccccatgaaaagctggaggagctctgccttggggtttctgctaagtcaccaggttgagaacttgccgcaactccttggacagtacgaatgcccattgcttctcttttggtggtctggggcttaacactccaggctatcactgcatcatctggtccaattgactgcatctaaatagtagaattctttctgtgctcctgaaaacaagagggctgcttggcgtgtgtgtgtgtgtgtgtatgcgtgcacacacgtgtgcatgctgtaggcctgatattagatacagacaagtaaaatgttatgcttttttttttttttttttttttttttagatagagtttcactcttgtctcccaggctggagtgcaatggcgtaatcttggctcactgcaacctctgcctgctgggttcaaatgattctcctgcctcagcctcccaagtagctggaattacaggtacgtgctacaacatctgactaatttttgtatttttagtagagatggggtttcaccatgtcagccaggctggtctcgaactcctgacctcaggtgatctgccagcctcagcctcccaaagtgttggaattacaggcgtgagccactgaatccggccaatgttatgcatttaagtgtggggagcagaagactggatatgcaagagcatacatctggataccttttacctcttggcttgtggggaaaatgacctgcaggattttacatggagcttcctgtgtgcatgctggtgactgttggcaacaaggtgtcaggaagaaagacattgctttccaaactccttttcccaaatgatcctttcttacccagtctgccttacctgcttctgtactgttcaacagaggagggggaacagggaaaagcaggggcagttgtgaaaaatagaagggaaacttgagtgtgcctttttcttctccttctctttctccaccctcagtcatcattaacagaaaaatatttttaaaagatcccttgatggcatccccaaatgttaagtctgacattttcttagctgatggcctcctttgtgaaggtactttgtgtccgcccagcatgcctgctggatccctggtttgccgcagttgctgaggtaaatactctttccattaagcaccacagcccaagagtggcctaaagctcaaataaatgaccaagaagcaacttaaacattccctggggcgattttaacctatgcaatggctttttgaaaaaattgcctattttttcatgttttggccgggggggtgtctcttattcccttcttttttattttcctttcagctgagtacaccttctctttcatttattcatgcactgcatgaaggatggaagcaggatgaataaatcacagagcattgcccctctccccactcagggtctgtgaagagagctggagcagaatacagtccaggcattatgtcaactttcaggggacctggggcaggtggccgattctcacagagaccccacttccctttcctgtgaaaaataccacagcccaacagccactggagaacagtgttcttctggaagcttcctctgggcaggaggagtcaaagatcctggtcctcagggacacttgagatgggtgtgcccaaagctgtgcaggatggtttggtttgttttgtttttctttgcctcaggaagaatgtgttcacaaacctcaggacaaatcgtttaaaaaagtgtcctgacagttgtcatgcttcatcacttgatttagaggcaataggacagccttattttcttctaatctctggtggttgaggagtctggttggcctggcagaaggctgagattggctgagggagtcatgagcgagcaggggcctctggtgcctgaagcgcccctcaggaagagcgggtctcaccggaaggccacactcatctccttcctggttacccagtgtggggatttgctactttgctgagtgtgttttgtctacattcatggtgctccagaactgtgtctgtgtttctcacattctctttcgtgtctgccagagcaacattctcagcaaaccatctgaatgcaactcctgtgatcacaaaagtcaatcactgatggaaatgaagaccacgaccctgattcctcaggcacaggttttcatctgtcactatgtgctaaaagcaaaccagcaagtgagggtgtcactgtcaactgctccttgtcgtgagattcccacctttccctcaagacatctcagatatcatatgtaaccttgaccctgtgtcccacagcaacagcggtcattgagtgtaaagccttttccttgaggattgtggtagacagaatgccccccaaaggtgactatgcttgaatccatggaaactgaacatgtcaccttctatggcaaaagggactttgcagacgtgattaaggttaaagaccttaaattagagggagtaccctggactatccaggtgtctaatctaatcccatgagacttcaaatgcagagagctttctctggctggagtcaaagagatgtgacaaaagaggtcgtcggagagattggaagtgtgagaaagacccgacctactgtttctggggagcccacctggaaagcacgagaagggacacaggcaacctttgggaacaaagactgccagccacaaggaaaagacagcagtcctctagccacaagaaaccgaattcagccagcaacctggacaagctagaagagcattcttccccagaacctttaggaggaagtgaggccttgcagataccctgattttggcttttgagacactaaacagaggatccaactgagttcaactggcccagaaactgagatatgtttggactgttttaagttgctacgtttgtggtaatttattttggtggcaactgaaaatgaatgtaattgtatattagaaaaattgaaggtagaagctctaatactttctccccacaccccagtggttcatcatgtgcagcactcagggtgtggaaattccattttgaagacaccgtcttccaggattctaacccccacctgggaaaggtcctggagagaacttctagcatgtatttctgagccattcacatttaacccagagagagaaggtgtcctgcccaaacgcaaagcagcatggcggtagttctggacataaccttaacaattgccaggaactctctggatgtccatccatcagccctatctagtctttttgtctgcatggcattgtgggggatgtggcgatgagggccaggatcgcagaagtcagagtacccgtggctggagcttccattttaaatgaagtgttcttgcttatggcttgatggtatcctttcagattttgcatctggctgtactccagatgtttatatagaaacttcacagtagacatgatggtggcgtaggtttgcaggaaggatcctttcctacttacagagtgacccaatgtggccgatcccttcaatatttacaacagctgggtgagtggaggcatgatcaactccatttacccgtcaaataaatgaaatttcagagcggttacacaatctgcttgaggtaacaaggccagcaagccacagagccaacatacccctggtgcctggctccacaggagtctgggaagagggagaggaagatggggacaggatgtatcaccaggatgctaggggaagagagaatattgacgtgtggggcagcctgcatccccaaatcaggagcactgggtgctgctgtgttacagtgagtgtaggagcatgccgttctgggcttcactctgcccaaatatgtcttgctcattttcaccgccatatggctgctcgtcccggtctgtttgaggttccttcctgttccctctctgcctctaagtccttcaaaaagccaactggaagtgcctcttccaggctttccttagcctttctttattcccttgaacttctattatgttaattgttcaaaagattagttctgacacttaccctatgctgctttgtattactattggaaaacaacagtagctctctcaacccattgggtggatggtacatgccatgctttatacattcccgtggccctgctgtacctggcacacacaaaaggggattaataaatatgcatatgttgaatgaaagaatgga

SEQ ID NO: 2992 - DNA, 9098 bp, Homo sapiens
aggatgggccctgcctgaggacgattttgaacactctcgctgatatttccaacatagctttggcaacatgatgagtaaagaaaagcgagattccatcagcaaggaagacctcgcccgggccacattggtcaccatcaccaacaacattggctccattgctcggatgtgcgcgttgaatgagaacatagacagagttgtgtttgttggaaattttctcagaatcaatatggtctccatgaagctgctggcatatgccatggatttttggtccaaaggacaactgaaagctctgtttttggaacatgagggttattttggagccgttggggcactgttggaactgttcaaaatgactgatgacaagtagagacgagcagtggaggaaacagcctcccaaaaggacagagaactaaaaaattgctgctggagaaggtgaaagtcgctttgggacggaagccaagccattatggcagatgaacctgctggatttgtaaataatttaaaatccttccagatgatcttttactcttaggttttgagctaatgattcaaaacgggggaatataaaaggttttttttctgtatactgtatttttttaaaaaaatggtgcagcgtggccaaacctaccaattgtatgcattaactttgaaaagttgtttgatgtttaagaaggacctgatatgtaagcgctggtcatttttcttctggggtttactgatcagtgtggtgattttaacttcatttagtaattactctaggagattttaccttgacttatatttttcatgacgtttcatgatttgctgttggtttcaaatgaaactacaaatctggcatgttttactgtgaacacttttgttatttgttttgtacccttttttgtcttgtttttctgttttagttgtcttctgaaaaaagagtcgttccctctgtttctgtcctcagatgatgtccctccccctacctgtaacctttctttgacataattgttcatatcaatgaaggtgctgaccagctcaatacaaagttaagcacaagatctaaagctcttgaaaatgcccgtgaagagaagactgaatgtgttaatgaatttaatgagtctggcaaaagttgcaaattatatgcaagtttgtcctatcgcttataaatgtagtgtttcattggatttattttatgctaggttatattaagttgaaatagtctgtgattaaatgtcctcatccatgcacagaatatgaatggcagcaaatctttgtgcaagaaatttgaaacttattgggaaaagcctcccagtagattaattgttcatatcaggagatttagggtaagtcatgggttgaggtgtcagatagtaatatctatttgttttgtacatgtatatatctaggaactttgtaacaacacatctttaataatgttaaaggttttttcatttttaatattttaaactaaaaactgtacttcaatctcagtttctaaaattaaaaataatttatactgatctatatattttttctttttgaaagatttcattaagactgatgggtaactttcaaatgagggtcatgtacaaatattgggatgcatgagatcccatgatcttgtgtattgagcttattgttgaaagggatttttgaaggacagaacaattactccatgatgaatcttcctttctctgccttctgagcaccgtctttaatttccatatcttcaagtcttgaagaagttgatgttaattgaagaattcacttgtctggttgaaataaagcctgtttctgttgtgatgtttttagtgtatatgttattttcatttcttaattctcatgtttatagtatctgctttgtaccatgaaatgactgtctgttgtgtttttgctactctacatttcaaaattggaggctttcccatgagtgtggtatggtccaaaacactgtcttcaggtgaagctgtagccctatgcatagatttttaaaatagagctttattgtttctatacaagtgactccttaatgccaactacctctgctatatttggtaattccaaaggagtttcaaaatttggtcatcacagatacattttaccaacttctatctggctttaaaaaaattcagacagctaaagtgttcttgaaaaggataagttaaaaatctacatattatttataattagtgccttttgatggcctcttctattcctattctcatctatcaggtaacagcagaccttgattccgcagatcatggttctacaaaggaaatcagggcaagttagtgtgactgtattttttttaattatctgaaatcacttgatctctcattacaaacatttaaaatattggtgtagctgagaaaatacattattccattatacaaatatcagttaaatgttgactacatatagccagcctgttttttacaaaagagatcttgtagcctgaggattttcacattcacttgaattacagaaacttttcttagaatcaacatcacaaagaaactgggaagactaaagaattttgaccttgtgcaatatgaagtaagagcatggctttttatcgtgaggcagcttcagtctgggtccagcttagtcagttaccagttcaaagatatgctaagcctctttctaaaccatagtttcctcacctataaaatgggacaaataattgttttacatacatatttaaagagctcagcacaggggttgacacaaagtaaatgcttcattaatgatagctacaatgaaaaaataaattatttaaactaatttattaaatcagtaattcttaactttctggattgtgggaaacccatgttagtatggagatgtttcaccaatctccgtatgctaatacatatccacagctccttgtccacacttccaaaatcccatacttaagaaatctatcttgacagctcacttggcagcaaaagctgacttgagcattatttctcacatgtagtagggctcttcacatgttttgttgcaaagctcgtcatgagttagataacaggatactgactctgacaggggtgttaagtaataaacgattttgaattggctgggtgtggtggctcacgcctgtaatcccagcactttgggaggccgaggcaggcggatcatgaggtcaggagatcgagaccatcctggctaatacggtgaaaccccgtctctactgaaaatacaaaaagctaggcatggtggtgggcacctgtagtcccagctacttgggaggctgaggcgggagaatggcgtgaacctgggaggcagagcttgcggtgagccgagatcacaccaatgcactccagcctgggagacagagtgagactgtctcaaaaaaataaaataaataaataaataaatgattctgaattttgaaacacatctgatcccgagttttagacaaagggattgtggaaatatagttgtgttcttcaccttatgcagtatacatggattcagagtctctttgttgggaacaattgttataggtaatgtatacttgatgtcgttcagtcatagaaggaatattaagaagttactctgtgccaggaaggaactggagactaagatgcataggatacagcccctgcagagaaagacagcaaaatctcaagccaacatcagtcatcaagtgccacaagtgccattcaatcatttattcattcacattcacagcagtaaacagaacaaagatccaccatcacagagcttatattctagaagggaagacaggtacattactaaatatataatgttagatcagtactacaaagaaaaagtaagctggtgtaaaggctaaataaggggtagttctattcagaaaaatgagaaggggaggaatatctcagggtggtctaagacagcctttcctaggaagtgacctttgagcagagagttgaatggaggtgagaacacattgtgtaaatgtctgagaaaatatttttcactcctggcaaatgaaaatagggatttgaggaactgcaaagaggccagtgtctggagttaaaaatagaaagtggtgggagatgcagtgttgggagtaaacttgagccaggtcctataagaaatctgtgagggtagtggcctctacccagaagagaggttggtcatttgtcttccagaaggtgctagagaaggttttgtgaagtcttaaccaaagaataggaatcactaagtggagaggaagggagggctttccaagcagagggagctgggtgagcagaagcgctgagggaagaaaccacttggcttattcagggactggaagctctttgctatagctggagcctggttcatgagacagaaaccaggtagtgagaaagaggaagctggcccaactgtggaaggacttgtcttccatgctaacattgcggacttttccgtagtcactgtggagccatcaaagagtttcaaggaaagtgaaactagaaataatcaggtttcaaagtggtaaagcaaaatgctctgttgaagtaaatgagtaaacaagttacgtacttttgaatacctaacattattccatttttttccctattgtgccagacctcatgcagtagctacagagtgaaccatgctttcgctgtaagtaggatggctataaaaattattgagaactttctcagaggacacaggctactaatagctacagccccactatgagtctattcattgagcaagaaggtttcaatactgggagcatcgtaaactatcactcacaagaattgttagaaagcagttttcctcccagtgatcagaagatgacgccacatttgtgaaaaagatttcattagtgtacatcgtttattaggtctaccagctgcccattcttttgctcatctgtttaatttttaataaatatcaatgatctgagaggcattgggtagcactgaggatgcaatccgatgtgaacaagacttcaggagctctgctttcattaggcttacatttggttaatggagataaacttgaagcatataaaccaataaataaacaagaaaatatcagggagtgacaattgctattaaggaaagaaacagggtgataggatagagagggaggagagagacttcttcagtcagatgatcataaaatgcaagtatgattaagtcatggcctcaacttttaaggaatgatgggctcaccttgctttcattcttgccacctcctcaatgaaaatgaaagatgtttttgggaaactgatagctaattttctttttcttagaatatttgatttagataatatgtatttaaaataaagttatcacgtaaaataatatattgatttagtaatgcaccttttttcccctgctcatttaatgaaaaaatattatttgaactgtttacttgaatctttattgttaatgattttgtcatgaccagagtcatttaatagtttccacagcacaagtttgaaatttaatactttttaaatttgtgatgtgttgaccactgggtttttaaaaaacccagccacaaacacctattcccatgatgagctcaattatttcacattccaaaaggtgtctcttcagtgtaaccatgtatgtcaagccttgcaaagtcaacttcaaaaggctagtttacaagtattcgtcacttgcaatacaaaaataaaaaggaattttgtataaaagtctttgcctgtttttttaaattatcaagtaaataaacattccaaactagaattaattgaggtgatttcagttaatgttttcactaaacagttttcaatcagtccataagaagagttcatctttttaaatttaagtattttttaaaaaaattcaacattttacatgcatatagttttaaaagtcaaatacttgcacaagactatggaaaacagcagcacacaagttttcttttttcttattttattttatcattgtgaacacggtggtttcccaagggtaaggtgatggagataaaaatttttgagtatttgcatatctaaaaatttttagaaaaatttttattctattgtcatgcctagttgatagtttggcagactacagaactttatgttagatgccatttttcttcagaattttgaaggcatggttctattattttggcaataatagagaaataggaaccttcatacattagtgttgggatttcaaaataatacactcactttgagaaacagtctgtcagttgttcaaaaagttaaatatagaattaccatatgatctagcaattccattctcagatatgtatatacgcaaaggaaatggagatatacatgcacatatgacttgttcgagcatattcttagtaatgttactcataataactaaaaaattaaaatttccctaacgtctatcaacagatgaatgtataaataaaatgtgtacttctatacaatgaaataatatttggccataaaaaggaattacaacacaaatgaaccttgaaagtattatgctaagtgaaagaaactagtcacaaaagactacgtattgtatgattccatttatatggggtctccaaaatagccaagtctacagagacagcaagtagattagtggtctcctagggctgagaatttggtagaaatgaggagtactgctaatatgtatgaggtttcttttgtggtgatgaaaatatactaaaattgattgtaatgatggttgcataattcaactaaaagtcattgaattgtacactttgaatggattaattgaatggtatgtgaattataggcatatgttgttttattgtgctttgctgatactgtgttttctacaaattgaaggttgtgacaactctgccttgagcaaatctattgatactgttttcccagattgtgcccatttcatgtctgtttgtcgcattttgataattcttacaatatttcagactttttctttattattataattgttatggtgatttgtgatcggtgatctgtgatcagtgattgttttctggtgccacaaatgtaagacactgaacttaatcggtatgtgttgcgttttgactgttccactgacctgcagttctcctatctctctccctctcctcaggcctccctattccctgagacacaaaaatgatgaaattagcccacttacaaaccctacaatggcctctaagtgtccaagtgaaaggaaaaaatcacacatctctcatttattagaaactagaaatgattaagcttagtgaggaaggcatgttgaaagctgaaataggctaaaatctaggcctcttgtgccagttagctaagttgtgaatacaaggaaaagttcctgaaggaaattaaaagtacactctagtgaacacacaaatcataagaaagcaaaacagccttgtggctgatattaagttttatgtctggataaaagatcaaaccaggcacaacattcccttaagccaaagcctaatccaaagccaagctctaattctcttcagttctttgaagtctgagagaggtgagaaagtggcagtagaaaagttggaagttagcagaggttggttcatgaagtttaagagcagaagttgtctccataacataaaagtacaaggtgaagcagtaagttatccagaaaatgtagcaaagatcattgatgaaggtggtaacactaaacaacagattctcaatgtacacaaaacagctttctattagaagaaaagacgacctcggactttcctaactagacatgagaagtcaatgtgtagtttcaaaatttcaaaagacaggccgactctctttttagaggcttatgcagctggtgacttgaaggtgaagccaatgcttattaaccattctgaaaatgctagggcccttaagacttatctcctctgcctgtgctctataaacggaacaacaaagcttggataacagcacatctatttatagcatggtttcctgaatattttaagctcattgttgagacctgcttctcagaaaaaagattcctttcaaaagatttctttcattgacaatgcacctagtcactcaggaactctgatgtaaatgtacaaagagattaatgttttcctacttgctaatccaatatccattctacagcccacagatcagggagtaatttcaatgttcaagttttattatttaagaaatacattttgtaaggctatggctgccatagatactgattcctcttatgggtctaggcaaaataagttgaaaactgtctggaaatgttttactattctggatgccgttaagaatatatgtgatccatggatggaggtcaaaatgccaacactaactggagtttggaagaagtggattccaaccctcacggatgaatttgaggggttcaagacttcagtggagaaagtcactgaagatgaggtagaaatagcaagagaactagaattagaagtggaacctgaagagatgactgaatttctgcagtctcatgatagaacttgaaaggatgaggagttgcttctcacggacaagcaaagaaagtggtttctcgagatggaatctacccctggtgaagacactgtaaacattgttgaaatgacaacaaaggatttagaatattgcataaattcaggtgataaagcatcggcagggttggaaaggattgacctcaattttgaaagtcctgttgtgggtaaaatgccatcacatgacatcacatgctgcagataaatcttttgtgaaagaaagagtcaacaaatgtggcaaacttcatttttgtcctattttaagaaattgccacaaccttcagcaaccaccaccttgatgtcagcagccaaatacattgagatgagaccctctaccagcaaataattagtactggctaaaggctcagatgattattagcattttttggcagtaaagtatttttgaaattaaggtatctatattttttaacacaatgctattgcaaacttaacagactatagtatattctaaacataacatgtacatctgctgggaaacaaattcatgtgacttgattgcctgggtctgaaaacaaagttgcaatttctccaacatatgcctatatattaatgaaatatataaaaagcaatgtaaattagaagactgaaaagaaccattggaatatagcacaaaactgaaattatatatgttaattggatgtttttttttt

SEQ ID NO: 2993 - DNA, 3207 bp, Homo sapiens
ctccacccctgggcccctgccctgggacctaggtgagaacaggccctcctgcctttgcacccaaatgttgtgtttcccaagaccaccctagcctgccctgcccccatcctgtgcctataaaaacccctgacaccctagcaagcagacacacaggcagatggacatggagaggaatgcaccgacaggcaccagcatgccagcaggccaccgaccaggagaactatcctatacggagtttagctggggcactgagtggccggactccagtggaaaaccttcccactccatccccttctggcttcctccatctgctgagagctacctccgctcaataaaaccttgcactcactctccaagcccaggtgtgatccgattcttccagtgcaccaagagtacataaatggaagtctcaccccctcaagtggattctctgtactgtagctggctcaagaaaggagaaggggctttgtcaagtaaaactggctgattggttccacatctataaaacagaaaatgcaaatattaaatatctatttggccttcctcatcatggatacaatgacggtaaaaggtaacttcacaggattaaatagcttgaaaacaaagtgtcgagaaaatgaagacacttttaatatcatcattgtgatcttcaatcaagaaacatttctcttttttcaatttgcaactggaatcttattctcacatgaaacttgcactattagtgcaaagttgtgcttcattgttaaaatgaacaaaagcaattacattgtgctgtaaggaaatatgcttggtccttgatcagaagtaattctgtcagtataacacgtgctgaaaggcagcaaaggttggcctctcaaggtcactactccagacacttacccagtactattgaggtaactctgtcccaagctgcaatcctttgacagagaggatggattgaaccaaaatgccggcaggcactggccattgctgtgtcgctcataaccatagtcgctgttaggaaagagccgagaaaaacctttcactaggtggcaaaattactgaaaacaattctacatcagtccacagccaagttccacactaatcaattagtcataacaaacaaaaataaaaacaaaaaaaaaaaacacaagcattccctgaatcaatgacttctcaaaaatagaacttttttcatagaatatctatcaattaattattcaggaaaatatcctacacaactggtcattccatttaaacactctcaagctgagagagtagattgtgctctcattagaacgatacacaatacaggtggctgggcccagagaaagctgtaatgagaaaacgggtgtggtggaactcaacccttggtgagaaattcatcgcagagtttaacacggccacatgtggcacagtcctcattactggtgatgtctttgggatgctcttccaagacatctggatctaccaagagaactgagccaggtctctctgtgtacactccatatgcttcaaagttacagccaaaaaggaaatgtccttcaggagtgtctcgagcattcccctaaggaaatgtttcacactaggcagttagcgctgccacttgggactaactgttttaaatcctctctctacttcggaaatagccaaagacttccctctcagcctcctctcattcatgcttccaggagcctctgagttgcctgatattcttggcaactggcagatgaacctgggcacagagaatgacaacaaattgcacctccacatgcacagacaaattgcaggcagcaatcggcaagcattagtatgaactggcccatctgtgtaatggaggtgagatgctggcacacaagggtcagtaagggagaaataggctcagctcaggggcctgtcaccaggcagctggtacttagaattttgcacataccagcaggatttggtgctggttcaatgcagcatgggtaggaagacttcagaattgctgcctataggacaaccagtgtttgcttcaggaagttactttacgaatgctggagagggacaggcaaggtcatttgggggactgtccaggagagggccaaaccaaggagaaacactcagtgacaatcacctttcattacactacagccaggtgtaatcaccgaaactccagctaccggtagaaccccaacaaggttgtgatgagccttcccaaatattttcagaaatcatgcagtgacagaaatcccactggaccagaaaaccttacaatgaactccttcatgattcatttcccacttctcagaatgcatttcagctggtgggatgagtagccgattccaatcacaaatgaatgcagggattgggccaagactaaggggcacgagagacacgggagaggagaaatctaattgccttccttatctggtattcctttcattctggactagcttacaattgaaaaagaaaaacaacaacaacaacaacaacaacaaaagactggcttactttgaagcctgtagaaaagattcccagagaagcaaatgtttcaaggagaaatcaggacattgggacatctcatctcatctcatttttttttttctctttggttttctaccagagaataaatttgcctcctgctaaagaatggctgtttcttaaggcaaaagctaaaccactaatgtaagatgctaacttcctttgcaaatcttccttgaatacagtaaacgaagaagcagcagtggcttcagaaagagggatgcaatgaatgacttaaaatctcatggtagttttccctgtgaatgcatttcaggatgttagtcccaaagggtagtacagagataaaatatttttgtcattgtaataatattgcactgactaaaacagaagtcacactggggaggcccctgaagatttcgatgatttgagctccctgaagatttgagctccaatgtaactgaagctctgttgccctctggctgagcccaaagagatacttcattcgctcttggcttggcgtcctcaccaacaaggggatacagctgtgggttactggtctgacggctggctgccactcttgtcagaccttcttagtactatttattcagagaatatctccagatgtctaccataagagaaggcttaacttttctaagatatgtgatgtgtatgtacacagtatctcagttcagtcactgatattttaatgattcaatatgtaacctgaggttgctatacagctag

SEQ ID NO: 2994 - DNA, 17794 bp, Homo sapiens
gtgcttttgctctaatggagggcacctcttcccagggtggggcatgtccgggttacctgcagtccctgggagccatttaacattttgcagagaagtgacagggccagtgggagggtcgctggaggtttgcagtgagcaagacctgagcatcgcctagggtaccagataaatagcagcagactccatcccgaggggtccagcgtgagtccttcttaatggcgtgatttttttcccaacacagaaggggatgattgaaatcagagactgccgtgcacgaggaaatggcatgttagtggggctcgtgtgagccagaaatatcaacatgtgtggggcgcagagagggacagggctggcgagatgggctgggaagaccgtgctggccccaggcctcctgccaggcactccctctgtggcttggtttctccgtgtctccgtgttcatgctctgtctctctctttccgtaaagcctgccaagcctgactcagtgacagtaatggatgagaacaaaaataattgggcatggggaggggaccaccgataatagctcttatgatgtcgatatgatgcccagtctagaaagaacagctcctgtcctccaaaagatagctttgaaggcacagatgagaggaaggaagaaagaaaaggagggaaagagagagaggaaatccacagcaacaaggcaacctcatgtctgagtctaggaagacccagacccaatgtccttctgctgcacggccgtaagtttccaggctgtcaggcagacattaccaaaaaaaaaaaaaaaaagtcagccaggcagtgggggaagcctgtgaagccacagtaaagtgcagatgtgaaaatcgggggaacccagctttcagagcaacttgccaactgccaggaagagggtagcaggaagaagcctccaggccgaagctcaagtccaccgggcaaaccgtccaaccgggaacggggctgggccaggccctcgtccccctccctccacgtctcccggctgggcacagagtaggaccacagacttcccctgcatgttggcaaaatttgcatctggttctctccttaatcaaagactaataaagagaaaaaggaatagattcatgggggaaaagaggacaaaccgaaaaatagaacagcatccagaaaacaggagatccaagaaaatctcagaaagtatgtgccatcctctatggagtacaagaagacatagcttgtgggattcatcgaaacagtactggttaagatgaaaactcaatagaatgacatgaaaaggaagatggaggagatagttacaccaagaaactaacagcacagtcagattgaagtatacactaaagaaggaaaaggcagagttgattcataaagaaagaatcaaatccgtgctgggccattggcccgtgtgccctcagaccctttcctgctgttcctgggtcctgctctgcatcctgggtgacagggggaaagggaaagccccctcaagctgcactcagagcccccatcagctggcttctagtcggactcagccaatgggagacaccatgggaaacgagtgtggaggaagaaagaaaccagggtatttctctcttttgtctctgtcttgtgtagcttcaccagcagcacctgcatcgtctctgtgacaccaacacccaccagacagtccctcccttcatggccccagtccccagtgggtagcccctgactcaacttgcttccagcggatggccctggtctctggactctgattagactacctcatcccactatcccaccaactcttaagagtaatgacagctttctatttcgctaatctctaggctacttcaccttccccttgttggaatctcagcagtttgattacctacgtaaccaattccatgtgtaaagttgtttctggttgaaatacctagagtggtttcctttgcctgattggactctgatacaggtggtttaaatcacaagtagcagaaaacccaattcaaacaggtttaaataaggaaatgcatctttttatctcatataacagtaagtgcagaagtagcaggcttcagaattggttgtttcagtgtctggatgatgtcctcaaagaacctggtgcttcccaactctctgctctgccaacctcagtgagtcagctttgtcctcagaatgcctccctcatggtcacaagatggcttccagcaacaatgggcccgtttccttgttcatatcctgttgttccttttttctagaaaccctgaggaggtgtcctcagttggcttaaacctacccttctctgaaccaataactggcaaaggagattggtttaccatgattggattaaactaatcatctgaattgttggaaagtcaacctcagtgttcactataatgaaatactaatgacaaaaactattcttaagtgcaaaaaaaaaaaaaacccaagaaactaaaagagaaagtgatggtaataaaggatagagagccaacccacagataagtgatgttactgcagaaggagcctaggacaaatggatcagaaataataaccaaagacataatagaagaaaacttagctgcactgaaagtcttaacttttggttggcaatcgaaaagggtgttctctgcaaatcaatgacaggaggcacatacctatatacattctaacaaaaatgttctaaaaagacatggaaaaatctggcaaagtatttaagcagaaaacaggctattcataaaggaataaaaaccaggctggactcagatgtttctgctgtaatagtaacataagacaatgaaatatcatccaccgattttgaaaggaaaatttggacactagaattttagactcagtgaagatactttcattttgatgatgaaagacacttttagatatcaagggttcataaaacatgcctttctaatgcattttctgaaaaagaaaaaatacttcaattatttatcaaaaagtatttgctgagcaccagtcatgtcccagcaatatactaggcacataggataagtgagtgaacagataaggggaaagaagtattcctgcctatgtggagcttacattctaatggggaagacaggcattaaatattgagcatgatcaacagaccaaaaaagtgataaggactatagagaaattaaaagggtggaaggcagttgcaattttaagtcaggcagttagggtcagtgactgctgaacaaagacttgagagatgtgagggacccactgtgtggatgtctggggaagagcagcccagcagaggaccagccatctgtagcctaaggctggagtgggccagccctgcgcacagaaccacaggggaccagtgtggccggagatggaaggagctagtgggatgggagtaggagatgagattaggggtggtaagggagagggcacaggttgtgtggggtcttacaggacattgtaatgactttgaccattggagggatttgagcagaggagtgacgcaatccaacaatattttgtaaagatcctcctcttaacatctgccatgttaagcagatgcttgagaaagaggagaacagatgtcgaaagatgagttaggagggtgttgctgtgattcacaggaggggtgatggtggtgtggacaagggaggcgatctgaccctggatatattttggaggtagagccaacaggattttttaacagatgggatgtggagtgtaggagaaacaggagcaatggacgactctgattctagcccaagagactgcaagaatgagtttgctatcacttgggaatggggcaggttatgggtggcacagcaggttgggacctggtgaacaagggagttcagtttttggtatgtggagtgtaggagaaacaggagcaatggatgactctgattccagcccaagagactacaagaatgagtttgctatcacttgggaatggggcaggttatgggtggcacagcaggttgggacctggtgaacaagggagttcagtttttggtatgttgagtgtgggatacagccaggtgtagctacaatgtaagcagctggatatcgaagcccaaagtttgagagggagagatttggccaacctggagatatacctttgagggtcagtgacaaaggatggtatttaaagccaggaaaccagataagatcaccagcaagtgagagtaaacggaaaagaggaacaggcctgaatgcagggatggtcgaacatctgaaggacggagatgagacagcagctaaggaaaccgaggaggggcaaccagtgaggtggaaggaatgagagcacaccttcctcaaagccaagtgaaggctgcattgaggtggaagacatcgtcaacatgtcaggcgtggctgacacagcaagtaaagtgaggcagagcatggaccactggcgaggcagagcctgggccaagagcagcattggtgccattggtaaggacagtatgggggagtggctggggctaatggcccattgaggtagatgtactccagctgacaaagagataacactaacgaagagctcaggaagggggaaatccatccccagattctccccactcttccccctaaatatatctcaaaatctcctaccctcctgactgccaccacctgaggtgaggccaccaccatctctcccctagatggacacatcttcttcactgggctctctgtctcctctaaactattccccagatccagccttggtgatatgtccttgtttggttggttggttggttggttggttggtttggtttggtttggtttttgagagggggtgtcactctgttgcctaggctggagtgcagcagtgcaatcatagctcactgcagcgtcgaccttccaggctcaagcaattcttccacctcagtctcctgggtagctgggattacagatgcacaccatcacacccagctaagtttttgtattttttgtagaaacagggtttctccatgttgcccaggctagtctcaaactcctagactcaagtcatctgcctgccttggcttcccaaagtgctgggattacaggcatgagccaccacacccagccttggtgatatttctaaaattaaaatcagacccagcctctcctccactcatacctggcaagtgctccctgtgccagcctccttctcaggcagataatggactccatggtcttccctgctttcctctcctgtttcatttccgagcactccccatgtcagactcatgccccagccaacattatttgctccttctcacctcccaaacctggcataatacgttttctctgcctagaacactcttgtccccagaactctccatgcctttttttccccctgctaactcctgctccagagccaggtctcggcttggatgtcacttcttccagaaatcttcccctgaactccccctcatatgaccacagcactgtattgttgttgttatatttgggactgtaaagctctgtgaaggtggagctggccatcataacatgcagacataacacaatccctgctttctagtaggagctcggcaaatacctacagaagggatggcttaaaggacaggtggtgagcatacaacccagctataacagggacaaataattgggaaacacattgtaaaactaaatgcaaataccaaaattgttactgaaggagatacgcaatataaatatgatcatataataatgacaacctggaactaaaactccagtattattaagaaaggaagggagaagaactggttaagagagaaatgtaagagaaaggatgatggcatatccggaacataaaagatactatttagatttttagagaactataggtgtgtgtatatatatatatatatatattttttttttttttttttgagacggagtctcactctgtcgccaggctggagtgcagtggcgtgatctcaactcactgcaacctctgcctcctgggttcaagtgatcctcctgcttcagcctcctgagtagctgggactacaggtgcatgccaccacactatgttggccaggatggtctccatctcttgacctcgtgatctacccgcctcagcctcccaaagtgttgggattacaggcgtgagccactgcatgaggcctaggttgatatttttttttattttgaaggtaactaatagcattttaaagacaatgcatacttccaaaatacggaagatgaatccaaagaaaatacaaacatgtacaacagaaccggaaaacaaaggaaacaagaagcagaaaacaaaaagaataaagtgagaccagagtgagaccaaacgcttgatttatgataataaatgaaaattgcttaaactaccctgttaccaacacagactctcaaatacatttaaaacaaagtgaaacaaaaggttaaaatttaaaaatgaggccaggtgtggtggcgcacacctgtaatcccagcgctttgggaggccgaggagggtggatgacctgagatcaggggtttaagaccagcctggccaacatggtgaaaccccatctctacaaaaatacaaaaaaattagccaggcatgatggcgggtccctgtaatcccagctactcgggaggctgaggcgggagaattgcttgaacccaggagatggaggttgcagtgagccaagatctcgtgattgcaccccagcctgggtgacagagtgaggctctgtctcaaaaaaaaaattaaagaatgagcagagataattctggcaaaaaaaaatgtacttttatatcaatatgcaaatagaattccaaggaaatacacaaaatgagaggggaaaaaatattcatttgatattgaccaaggatataacccatagtgaaaagataaccattataaactttatgtgccaaagaagattgtgttaaaacagagaaaatgactgaaaaataatttaggtgattcttaattcatatctatcacagaccaagtgagccaaaaaaaaaaaaaaatgaagtgcagtagctccaaatcataaatgtgacaaacatattttgaaccaaatgaaatgtgacttctgctagtgccaaaacagacattgtctacagccatattgcaatataccagaaaattaatagtaaaaagtctgttcattttaaaaaataaccatttgaaaatgttatagcacactctcaaataactactgcctcaacagttatttaactgcagactatttaagaaagatgagccgggtgtagtggctcacatctataatcccagcgctttgggagactgcagtgggaagatcgcgtgaacccaggagttcaaaaccagcctgggcagcatagtgagaccttgtctctacaaaaaaaatttttaaattagcctggcatagtggcatgcacctgtagtcccagctactcaggaggctgaggtgggaggttcgcttcagtccaggaggtcaaggctgtagtgagccatgatcacaccactgcactgcagcataggtgacagagcaagaccctgtctcaaaaaaggaaggaaagaaggaaggaaggaaggagggaaggaaggaaggagggaaggagggaagggaacactgcctcaaaactcttggctatgaccctaccaacgttcaaagggaaatttataccattttgaaagttgcctttattatgactctaggaaaaaaatgttatgaaattaactgagcagtcaatccaaggagcatgaaagacaaacaaaacatacctaaggagataggagaaaggagttaataatgataaaggcaaaaattaatgggttataatattttaaaagagaactgatcaacaaaatccaatagctgatttcttgaaaaaaggagtaaaatggaaaaaccttcagcaaaactaaacaggaaaaaaagcattgaaaatacaattacagtgaatttcaaatgagaaaagggtgcttattcatcgatagagtgaagatctcttccttccacctttatggatccgtatggacctcattctacagctctcggccctctgccttccagctgggtatagccagtggggtgtcccggcagcaggagggaggaaaggagagtgagggcagaacatgcattctctgggctggctctttgcctcaggctagctgtgtatccccaagcgaggactgctgcttctgctacgacagctcacctgactggcccttcagcccagggtggtaatacctctgccacgaccccacattgctgccctgacccttgtcagtttccttgtacccacatctggttaaatagttcctgtatcaataaacacttctggaatgatcccatatcgaactcgccatctcttttttttttagacggagtcttgctctgtcgcccaggctggagtgcagtggcatgatctcagctcactgcaacctccacctcctggattcaagcaattctcctacctctgcctcccgaggagctgggactacagatgtgcaccaccatgcctggctaattttgttgtatttttagtagagatggagcttcaccatgttggccaggctagtatcgaactcctgacctcaggtgatccacccacctcggcctcccaaaatgctggaattacaggagtgagccaccgtgcctggcttctccatctcttttctaatggaccttgactgttatctatgcaatgctaaatttctttaaaatgaagattattttccaggaaaatatagattaacaaaatggactcaagaagaaatcaaaataaaatgtgccaataaccatgaaagaaatgaaaactatcaaattactacctgcagctaaatgccaggcatagacaatgtcaaatgcaagatctactgtgccttcctgattccaataatggtctacttgttaaaatattcccaagtattaaaaaaaaaacaaattttatcagatagttttactaagttaacataaaatgatgttaaaacttgacaaaaatagctcaaaaaattataaaccaaatttattaagagatttaaaaatcttagtaaattgagtctggcactgtattatgtatactctactatttcaaatgagaaaagtgtgcttattaatagatacggtgaagatctagcctgatctagtatatataatagcatatatatccctctctgatatatagtgatattatcattttatatttttatatataatatgtatattaaatatagaagaatagccaaatagggcctgttttatgaaggcaaaaatggatcagtattggaaaatctttttctttttttttttttttttgaaacagagtctcaccctgtcacccaggctggagtgcagtggcatgatctcagctcactgcaaactccgcctcccgggttcaagcgattctcctgcctcagcctcccaagtagctgggattacacgcgtgcaccatcatgcctggctaatttttgtatttttagtagagaaggggtttcatcatgttggtcaggctggtcttgaactcctgacctcaggtaatccacttacctcagcctctcaaagggctgggattacaggcatgagccaccacttccgacctggaaaatctttttctatcaacttggttagaaaaaggcaaaaaatgaaattacatcttaaactttgtagtaacctaggaatagaaagatattttcttaacttagaacagggtatctatttgaaactaatgttcaaggttatatttatggtgaaacattagagacaatcctattaaagttaggaataagataattatgcatgctattaatgttgttatttagcattgaactgaaaagctctagccagtgtaataagacaagaaatattaatattgaggagaaaaaaatatcattatttgcaaaattattgtctacctgaaaataaccctaataaataaaatgtacttacaaatcagtgaagaaatgaacacaccaatagaaaaatgagcaaaagacataattgagcaattcacaaaggaagaaaaacaaatggtcaaacaaaacaaaagtaaatagtccatattgggctgggcacagtggctcacgcctgtaatcccagcactttgggaggctgaggtgggcggatcatgaggtcaggagttcaagaccagcctggccaacatggtgaaactctgtctctaataaaaatacaaaaatcagccgggtgtggtggcacctgcctgtagtcccagctacttgggaggctgaggcaggagaatagcttgaactgggaggcagaggttgcagtgagccaagatcataccactgcaccccagcctgggtgatagagcaagactccatccaaaaaaaaaagaaaaaaggataattgcttgtaaatagattcacaatctattctgcatggaaaaaaatcagatttcaaaatcatatgcaaagcattcacccattgttgtcatatatattaattttctgtctaaacacataaaacattagcatacacaaaatgttaatagtagttacctctagccagaggaatatgaattttttttagtttgtcatatttgtattttaaaggggttttaggtctggagctgtggagaagggaggcaagttgtgaagtgagcagcctccatgagtgacttcaatactttcttttgttggactctgtgtccatagagccccagtagacatgacgcagggcaggccccggtagtggttcaggtcattgctgcagatatatggtagctgggcttagaaaagttgcataacctctggtctctcaaccaagaaatagaaagaacgattatacaacacttggcaaatcttagacctcaaaaagagagagctatgaaattgccctgcccctctccaaaatcgaatctgaatttggtccagcttctttttttttttgagactgagtttcactcttgttgcccaggcttgagtgcaatggcacaatctcggctcaccgcaacctccgcctcccaggttcaagcgaatctcctgtgtcagcctcccgtgtagctgggattacaggcatgtgccaccacgcccagctaatttttgtattttaagtagagacggtgtttctccatgttggtcaggctgctcttgaactcccaacctcaggtgatccgcctgcctcagcctcccaaagtgctgagccactgcgcctggcaactgaatttggtccagcttctaaatccaactactaatttacagaaaacagaggaagagcagcatgtccacaaatcccacagggatgtaatcagcaaaagccccacagtgagaaatgctacaggacaaataacccagttcccaccacaagtaagtcacatgaaacaaaaaagacatctaaaaatacatcacagcaaccagtctcattatatcggccctaactggaatgattattcaaacaaacaaattattttgttaatataatggcatttaagagaaatctgtgaatttaaacactgattgtatatgacgtgatattatgaaacttgttaatttctcaggtgctataatattatctttgtttcttcaaagggtcatataaaagatgcactgaaatacagataaaattataggatacatggaatttgctttaatcttaggagaagtggatgggcaggatcaaccatgggttgatggggggggcggggatacatgggagtttatcatactattggcactacttttttgtatgaaggttcaaacttctccataacaaaaaaaagtttattttttaaaagcaaatagtgttcccatctttatggtgaagctaatggacttgaattataaatttgtgaataaggcaataggaatctttgccagtggggactgtgaaaataaaacggaaatgccaagtcaagaggaaattcaacagcaaaacaattcctcttccccaattctcaatttcctgacacatctgaaaattgaggtgctgaagacctgtgcatctgtccccgcagtcatcgaggtgcttttcaactcctaccctcagctctgcttgtcagagtcctggaaggaagtgattcctgaggaagtattccaggcaagagggctgcctttctgcccatctttagtacaaaacttttgtctgtttttgcttctttgcatggggagttttgcactgatattcggctaagtattatacatctgaaaaaggaagaatgggaaatgagggtgtatttgcacgtttctggttttttctggaggctccataatcacacagccaggagcttgttatagtagttgcggtgccatggcctcaaggagctcagagccccgtgctggcctgaaaagcgcgagggttccttaaccagtgtccaaagaaaggccagagccgcctgaatccacgggcctagctccacgtcaggacatactaatccggccctgtgagtcagcttcatgctccagcagctcaagatacgaccaaggaagctatggggattacatctatccacgacaaagtccacaggtgactgtccattaaaagagagtgagaacaggccaggtgcggtggctcatgcctgtaatcctagcactttgagaggccaaggcaggcagatcgcttgaggtcaggagttcaagaccagactggccaacatggtgaaagcttgtctttactgaaaatacagaaattacccaagcatggtggcaagcgcctgtaatgccagttactcaggaggctaaggcaggagaatcgcttgagcccaggaggcagagagtgcaataagctgggatcacgccactgcactccagcctgggtgacagagctagactccatctcaaaaaaaaaaaaagagagtgagaagagttgtgtgtgttttttctgtttcactgacttgagtcatgtgtgcatgactgaccaccagaccaatgccatgcactcgctcctgagcccctccctggcagaagggaagagctggtcatgacttggggagatgaacagggccaccccggagctgtagggctgctgtgcaaagaggatggagcaaaacggaattcggggagaccacctggagcatctgaagtcaccccagtcagaatcccctctcactcggcaggaactgtgctttgggagagcacacaagcccctggggtagagggtggttcccacaagatggtgcgtctccctccagtgcgcttatctgggatcagttagccatagaaaagcccgcttgtaccatcagtggtctggctaagaagaaaacgtatgttggttccacgtgcccagatttctaatccacctgccttcccttccagatgcacaagccgttctaccagtccctctttgccttggccctcaccccacgctgcctgcagcatctttgccgctgtgctcttcgcagactgtttggcaaaaggtgctttgacctcatccccctgttacccttgccaaagcccctgcagaattacctacttttggagccacagggtgttttgcactgaaacgcagaacgctgcaaccaatactgttgttctcctcgctgaccttccatggaggccgtgtgttggagagtgccctgatgcagatggaggtgatgggagttcccttcccacttgctctccgtgggaccgggtgaagcacagaccttgccaagcttcaggttcacctcgaaatggaattggcaacaaaagccctttctgcctctcagggtcgcttgtgaaaatccagtgaaatcgtgactatcacagcacttggtctgggaaagtacctttcaacaacagttaagccaaaaggtacagtgagtcctcacttaaggtcttcgataggttctagggaaccagctttaagctaaatgaggtataacaatgccagttttcccaaggttaattgatataaacaagaatgatgttcctacagcatatttctggtcacaaaaagatcaccacacttctaaataaagaccaatacaattctaatagtaaagattgaaataaaggcaagctacacatacctttaaaagagattaataacaagtaagataattatttacccaatttttggtgaatcagtatgtgatggtggttgtcctgctggtgggttagatcaaggaataaatgtttgcaaaacgaaccttgtcaggagcacctcctaccaccacgaagttcagaacagtcaccaatgtggcaggcttgctaggccctctcataccgcatcatttattgtcatgcatttggatgattattgtatgccttatgaatttttactttacaataatttgtattcattcattcattcattcattcatattctaatgtgcttattctagttcagggtcgtgcgtggccagagtccaccccagcaactcagtgtgcagggcaggaaccaggcctggacggggtgctattccatcgcagggtgctcacacacccccacacccacccacccacacacaacactgggacaattcagacacgacagctcacctcacttgctcagctttgggatgtgggtgggaactggagcacccagagaaaacccatacagacagtggccttgcccaggaatcagtcttgtttcttttttgtttttttgtttgtttgtttgtttgttttgagactggcgcaatcttggctcaccgcaacctccgcctcccaggttcaagcaattctcctgcttcagccttcctggtagctgggataacaggcatgtgccagcacgcccggctaattttttatttttagtagagacggggtttctccatgttcgtcaggctggtctcaaactcccgatctcaggtgatctgcccgcctcggcctcccaaagtgctgggattacaggcatgagtcaccatgccctgccgaatcagttttgtttcttatcggtgttataataaaatgacattaaacaaaacattatttaaggacctactgtatatgtatttttccagtgtgttagcagccctcatgctgcccctgagccttgggaccgtcccctcacagagaggcctctcaccccgctggggcccgaccacccggggaaactctgtaccctagatcacaacggacctgcatgttgagaaaggacacttgcaaccaaggcacgtgcacctgcccagggcctgtcggtgctctcagtgctcccaagcatattacagcccagagctcccccggaggacaccggcaggatggtgaatggaagtttccatcctgtgtgagtcttcatgtgacaccctcaccaaaagccactgctccagctccaggaacagtctgggaagtcagatgccaggaacagacacaggttgatcaaaggggccttcagctcagcctgagcgtcacatgccaacagagatgctctagacaacaaggactatatcaaccttgtcttattttctctattccatatatatatacaccttggggtagagggtggttcccacaaaatggtgcatctctctccagtgcacttatctgggatcagttagccatagaaaagcctgcttgtcccatcagtgtctggctaggaagaaaacgtatgttggttccacgtgcccagatatatatatgccagaatctcactctgtcacccaggctggagtgcagtggtgcaatcatagctcactgcagcctcgaccttcttggctcaagtgatctcctgcctcagcctcccatgtagctgggactacaggtgcacaccactgcactgggatcattttttctattttatatagatgatgggatctcgcatgttgcccaggctctaattcctggcctcacgtaatcctcctgcctctgcctcctgagtagctggaattgcaggagtgagccccctcccccagcttactttctctattcagatgctttgacatctggggccttgctgacccaggaggaactgactgccccccacccaccaggcttagctggttcttagcaacagtaaacaattccacacaaagcatgcttttccaatgttagccaaccaatctggagcccagagcccacacctcaaccacctcttatatcccactctttctcacatgccagaccactgtctactccagagcaagtgccacacaacttgggaaagtcctatgccccagagtctgctgaaattatccaaactagacaaacttcagccttgccctctcttgcccattcctcccctgcctcctgaaagaccctggggcttcctcatgggctgcccccatgtcatagcataccctctcctcttaggaacaatgatcaataaaacaccttttcaatagcagtcatctcctgatctgttggccctatgagacatcaaattttctatgaatacactgtattttaaagcaaagactcttcatgttcatcctccaaggacaagcagtggctctcttttttccattacagccagcgcaaggtgctgccccaatgaacctcagaggagacactccctctgtattggtctgttttgcatcactctaaaggaacagctgaggccgggcaatttataaagaaaagaggtttattcagctcacagttctgcaggctgtacaagaagcattgtgccagcatgtgcttttggtgaggcctttcaagaagcttttactcatggcagaaaatgaaagggagccagtgtgtcacatggcaagagagggacaagggagagcgaaggaggtgctgggctttttaacaatcagttcccaagtgtactaatccagcaagaactgactcaatactgcagggaggtcaccaaggccctgtgacccaaacgcctctcatgaggccctacctgcaatgctggggatcaaacttcaacatgggattaggagggaacaaatatacaaaccataccaccctcccattggtagaatctggaaagggaattcagaccccagcaaataactgcagggtgaggtgggatgttatatgcaccataagtaaagcccatcatggagtgaaaggggggcccaggcagagcccaggaagtgaggatggacatcatgaaggagttagccagggtgcaccttggtggacaatcaagttttaacacagtggacctgcccagggagtgataagacagcatcccccagctccatcagctgacccaccttcacccaccctttgagatggacaattgatctgtcctacaaaagggctacgtaaacccagcttcaagacccctcagatccccatcccaggcagatgactctccccaagcctctcctacatagactttcaggagttaccactgcctccaaaggaaaacttgaatgaaggcaggtgtgcagggaagtacagggttccatggagggatagtgatttatcctcctggctaggaggatccccatgctttggcagctggaaggaggcaaggctagagaaggtgggggcagatcaggaggtacttggcttccagaccaagtattctgaacttcactggacaggctgtgaggaaccacgaagcaagtgagcaggtttggtctcagtgggactctaggaagattgctttgtcctggaaagggaagcaatacactggaagatgagtagcagcccaaggtaacaccttagagataggttcagagcttctccactgaccaagaacaatgacttaactgaaattggttcaatttgcttacctgggaagtgaacatatctgcgcctctctcacttacttaggaattagtaagatgtctggtgtaaggcaggtcttcaccaaatttgaagggatcttgttgaaatgcagattcagactctagaggtttggagtggggcccagattctgtggctccaagcatttggatgtttctgttaaccttggatcctgatctgcaggccccactgagcagagaaactgcaaaaacccaggcccagagcccaacccagagaaagaacttgataaatggttccttctgttattaggattgttttatcattagaaaaagaaaacagcccaatattaagatagagactgtaaaaaatggg

SEQ ID NO: 2995 - DNA, 1187 bp, Homo sapiens
atatttattataacaatgtaagactttggttataataatgaaaggagaaccagttgatttcattgagcaactcaatcaaataattcctgatgtggaagagggaagtttattaggatcctgagctagcatggagcatggccatttagagcatgagaaaaatgcttaagttcccccagttagtttgatagatagaccatatttttacttttaacaatacaccaaaaatcctttcctgctttggaaagatcttccttaataacttggagaaggaaggtaatatgatctacaatttaaattaagctttaactagtgaaaacacagttttcttcaatgaattaataattaagcccatgaaataatttcaatgagcatgaagatcttataactataattgtcttagtaatttatttttctgatgcatctaggattttcttcttcccctgtgactggtgaatgattataaattgactgatcattgtgatagcttcttctaatatgaacaatctaaatatcatgctttgcaccctatgtttaaaagtaacaatatattcaaacttaaaattctccatgaatcacctgaccataaatttagttagaaatcaaggaagaagagtaaccatgtgttatgcctatttcttattaaaaacaatttttagatattgctggggaccaaaagttttgaatcaaatgttttagctggtttccctgtgatcatagactccgtgtgtatcacacaacacggaacttagccctggaagcttactgagttgtaaggacatgaattctctggcaccatggtctcaggcatcttccagccacccagtcttgtagaagagataagccatttcaggcagacacgtctctatccaggcttggaatgcatccaaaggaaacacaaaaaactctgacatcagaacacacctgttgactttggagcatccgtatcaatcacagccaagaccagggcagctgtgctggggccagccctctgtgtggggcagaaggaatgtcagctatgaacaaagtcaggaggaaacagagatagaggcttccacattcttctgcctctttgtctacataccattaataaggttgactttttttttaacttggccccaaaaacaattctaggatggcatcttcagttcttcattcacttaaacaatgatttttagatattttaaata

SEQ ID NO: 2996 - DNA, 1166 bp, Homo sapiens
gttccacatctaaaggctggaagccatttgggcagaggcagaatctgggctcagagtctagccctgcaggacccagtgtggcagctgcgtgtctctggagcactggagagggggctactgcaaattaagatctgctgtaaagagcatcttcctggttattctctgggacgcaaaaccatggtggtatctgatctcatcacacttctgccaggaggtgaaatcgaagaggctacattcttgatgctcagtgtcttcttcaggtcatttgcctgaggacacctggggatactgagctatgaaaagaaaacatttggaagatcactgattccttcatggagaggctggcttgggaatagatgacgtgtcaaagattgacatcaaccttgagtgcttatttgtggacttgagatacagataaaaaaaaaaaaaaaaaaacctccctagagtgagggctacttgggatacatgctatatcccaaggagttctcagtttgaggtcagccccagctctacaactcaccaggagagtgcgcgaggatgagggagagacagcctgctctggttctcttcaaggtgacaatgacacctgttgacagatgagaattccagccaggaatacagatttaggaatcatgtttctcactctcatgatgacatagaagagatgcgtctgaatctttctgccagtgtgttaaagttattctgatattgactgtagttctgagctttgtctctatcccaccaaaccactaacttctggaaattacttgtagaccaagatgggaggactccgtgtgtggctccatatgaatgacttatcgtgcctgtccagagtcagggaaaggagaaacaatcttatttgagaagggaggatatcactgcagtggttgtgaaatcgtgtttggaagctagattgctctagaccactaagctctcttcatgtgacaaagaaacttcctaaaatactaaaagctaaaggagattgttatctaagcttgagatggaaggttgccagcggaaacttggaggatcacagccagtcgcctgggattgaccacagggagtggcagaggcagaaagcaaaagaccagttgcaattatccaggtaaaagatggaggctgttgcaataatccaggtaaagaatgtttggtggcttgaaccaggg

SEQ ID NO: 2997 - DNA, 17573 bp, Homo sapiens
gcatcacctcatcaatgtaatggaccagtgtggtgtcctatggcatggaaatgtggtggtgtccctatgggctagattatggcatggagctggagagtttccctagccttgaggtagaacagtgaaggtatattgctggcattgccaactgaaagaaaagagcttctgatggtcttattaataggcatttgttggatcaatagctacataaaaggtgacatacaagccgcatgcatacagtggatgtattgctttgttccaacaacagctgcatctggaagagcagctgcctttgaagtcagcacctacttaacttcaggataatccactgtcattctacaagctccctctgtcttctacacaggccaactattataggccagttatatggggatggggtggtaatcaccatccctcaatctttcaagttctcgctggtgacactaatctttacgggaatgtggttttgcctttggtttactatttttccaggtagagaacagtactagtgatttccacttggtctttcctaccatgatagctcatgctcctctgcaggttagggaaccaatgtggggattctgctcagaatgtccatgctaacgaatgcaccccagaacttgggaaatgaccataggatgatttcaggccccactgggcctactgtgagatggaaccaaacccaaactgcattaatcatttgaccttcataaatgcctactctgattggtggattgcagtaacattttacgcattcgggaattagtgctagttcagggccagcatcccataattcctgagaaagtctaatagttactccttccccaaggtacaaccaccctagcaaatggccatggatcttttgggaaagattgggagggagatacacacttatacatttttcacggtatggcagggtccttcttcaaggattcacaaactctatgttggtgaatcagttcaagtctgggaactgattgagaggctatgactctgtcatttggtgacttaatccagaacttctgatcactagacttagagcttttccattcacacagatacagaagacttaatagactacctatctactttatttctagggacagtatgatcaacttagtcaatgccaacaatttctgtgaatcagactatttttattattgctttggttctgatgtcacttggtccctgccaccctagagtcctatcaccttcattgcattcaggaatcttaattcaatcatagtcgatgccctgatatctgatctacagagatgaacgagcactgagctcttcaaggatgctgagggaggggtcacctcatgaatttatcacagccttggcaaaggatgtgtcctctggacccttccagaatggatgagcaggtcttgcatgatcaatacattctagcattttaatctccttaggtctttgaatacttgcctttatagtacactaagaagttgtggcattttgatttcatttactgtagaccacctttggatacatatttcagttaaccaaccaaacaagtgttagagctcttcctgtctccttgaaataaagcatggaatacatactctctgctcaatgcaccctcattagtaaatctgtgctgatccagtttgtactccttcctcctgaactcaggcaagagtggagagggagtggctgagaaagctagactaaagaatcaagaagatttaatgaacttactggtcaccatttacatcatgatatacattctggaagggacctaggagactggtcaggaatacctcctaattagcaagggagctaactttctccctaattcgctttaccttgcattgttagctcattcttggttttcttgaggtgagcagatgacagagttgggaaaggatgccattgtcacttggattctttcccgataattccttcctcttggtaggaagagtagatagctcttcagcttcctcctcttcgaatagggtagtgctttatgtaaattgtgaggattagagagactataaagagcttggcacattgcagacatgtaatacatagttggcatctattcttatcattagacctaactatgggagtaaaatcgattttcatcctttttgtttgaatacgtttgagagctttcttgcttttagtttgttaatttcattctatatatcctgaatttttgcagtcagcagattatagccatttgccatttcttcagataactatctgaaagatctgaaattttagaatcagacagcgctgtggctgaaatatccaagcatagccatgactgctttattccagtgtaaacctcagtgcaaatgctgcttgactagtgactgatttgcaccattcgtggaaattagaaaactagaaaattagttcgttttctagtgcttttcgatagtcatccactgaatggaggcatgagtacaagggaagaacaatccactgaatatgggaccctgtaggtggtactttattcctaatttagaaaaaaaatattcaaaacaacttaatttttgtaagtaaacagaagatggtacaagtaacttagccaaggtcgcatagaaaaaacccaggtagtgtagtgcttcaaagcataggtttcagggccaggtagtctgggttgaattttggccaagggcaatttatctaatctctttgtgccttggtttcctcagctgtaaaatggaggttactatgtctatcccaaaggcttgctgtgaggattaaaggagttatcactttaaagcccatagaacagttcctgcacattgtctatgtgctcagtaagtgtttgctagtgaaagcaggtctgttgatatcctgtgtttatgctttgccattgggggaagctgagtgaagggtacatgggaactctgtacagtttttgcaacttcttgtgagtcttaaattatttcagaataaaatgttacataaaacaaaggcaggtctcctggctccaaagcctgtacctgtgcctgtccttggatatccttctgtccatcattaggaaaaggcattccttaaaagtcccagtgcaggagctgctccagcctaagggctgcaaggttaatcaaaagatgagtgtttcaggatccaactgtacatttagagaacagcaccactacttagagtaactaattaaacctgcaaggaactgcaaacctgtggtttaaaatccccagaattgaaagctgtgagaaacaccattctgtcccatttaatgatgaatggaggatctaaacaaaaactcctcagtagcctgtgtgagttcaggattacacatgtatgcacacaccacacatttgccttagaaacctcaaaggttaactacttgttatgtgcttatggcctaagtgtcagataaaatcctatataagcactgggaacataccctataattttgttcatcaaagtaaaagaaacatgaggccggatgcagtggctcccgcttgtaatctcagcactttgggaggccaaggcaggcagatcgcgtgagtctaggagtttgagaccagcctgggcaacaaaggaagaccccttctctacaaaaaattgaaaaattagccaggtgtggtgggagtgcctgtagtcccagcccctcatgggattgaagtgggaggcttgcttgagcccaggaggttgaagctgcaatgagccatgattgcaccagtgcactacagcctgagcaacagaatgataccttgtctcaaaaaaaaaaaaaaaaaaaaaaaaaatggaaaagaaaaagaaaaaagaggctgggtgcagtggctcatgcctataatcccagcactttgggaggctgaggtgggcagatcatgaggtcaagagatccagcccatcctggccaacatggtgaaatcccatctctactaaaaatacaaaaattagctgggcatggcggcacgctcctgtagtccgagctactcaggaggctgaggcaagacaatcacttgaacctgggaggcggaggtttcagtgagctaagaccatgccactgcactccagtctggtgacagagcgagactctgtctcaaaaaaaaaaaaaaaaaaaaaaaaagacagaaagaaaagaaacataaggaaaatatctgggaatatcatttttaagacattgaaaggaattgatgtgtccaaatttgtgcagatcaggtgattttgctgatccagtgaggtatatgagaatttgtaaaacccagggctgaggcagaaaccagttttctgacctcttgaatttgctcttgaactctagtcagcatttcagaaaaaaatatgttcagaaggaagttcctagtagcactcagggaccctcaaaggtgttgggagggtggggtctctcagagtgggcatgggtagatttaaaactcgatttaaattgtaacaaaatgaatatttggaaaacaagccgaaaaaggctttttgtaatttctaactggataaaataatgaagaataaaatcttcctgactgtgaggaatatgtcaaagaaaacagattcttgcacatcaataattcttagggtgatggacaaaaaattcctcaaaaggcatgggttaaaaaacggttttgaagaattcaggactagatggtatgactctgttaccccaagaatgacatctcatcgatcccatctctaccttccctactcttcaccgttagccaagacaaatcaggacaactgctaaattattagcagaaattttactttgacttcactgaggactcagtgtttgaaagggaaattggaaaaatatttctttccagggagtctactttttcactggttcaaaagaactgagttcactgggcttcagagaataaccaaaggctggttgttaaagacatgggctccatgaactagagtccacatccactcttgcctgccccgtgtggccttgcttcaccagcctgactgctgggcttgcttcctgcctcaacagcttaggaagtgaactgttctgggtgagacatgtaatctctctgagcctcaatctcctcatctgcacaatgaagatgatgatagaatgctcctaaggtggtggatgaaatgcttaaatgagataatgcatttaaggcacccagcaccttaaaagttgtcagtaaaacgagctgtactcgttactatcctggagtggaatcaggtgatcttctgcccacctccacctgacaccccaccaccctccatacagtgccagtgctttcagtcctatcacggggtcttatataaatgcctggccatgctccaagtataaattgttgtatgtatgggaagacagccttaattaaatagaaacaggatttggaagatctagacatctaatctgtaattcagttcctggtcagatggaagctgagtataaaaggcacctgaattccaggtgactcaacctgggacctctctctaggaaggaggggaggtaataataagacttagtaatactctaccttccctgcgaactccttaagttccaagtgctgtcctgtccaggccctcccttggggatccttccataactcaaattttacaaaatgggacccttgtcatccacctccctttcaggtaaggttgcttccatccggtgagaacttaagtcagaagtcttcgtcctggtgacaaatggtcagcttctccagcggatgttccagtgcctggagctcatgctccctgaacgcctggcttggtgtctcttctcagtgagcacagcctttcttgaattcacaccagctgaacttcgtgaaagtgcacttagggctactagcatttgaatttccaactttttttttcctctttggcattttgtttctattttttatgcttcttttttgtattttatgtatccttgtgagccatctgccatcctttctggaatgagatggcatataaatgcatacatatatgcatacataaaatacatactgatatttgagaaagacttatcaaacacaggcatccctcaaggtcattggtattcaagagagtaagggggagggatgggggagatagtggtatttttcaaaacatatatgccagtaatcttctggtctcctctttacctttatttcagagacccaggtaattttagagtcactctggagggaagattcgtatcttgaaaaattcttccaggtgatttggacatacctttctgcctcccagccacccccccccgccatggctcatagccacgtctccgggattcctcagctctatttctggatttggtcagaaaacagcctgctctgctggattagctcatctctccatggaaatgccaccctggagttatgagagcacggcctctttctaaggctttctggtgcaatgcaaccctcctcgatggccacagctgattgactggagtgaacctgtgacctgaactgggccagtcagatttttcatactggaaatttggcgtcggagccctgagaaacaagtcaggtggtctcgggggctgaagctacccctgtggggtgactagtggaactcctggtagtgagaaaaagtgagatgagactgatgatcttcagaaggaaaagtttggactaaacacccagaggaaagctgaaatgagagaccacatggaatgaaggagaacgtgagtatgagcaagcgaagaaagccaatcactgagacaagtattgccagggaagaaggcttttttgggtgctacagctgaggagctgggaggtcaaaacagtgtgggaaaagaaatttaaaaaaatgttattaaagaagctactgtcaacctaaaggaagaaactgaggcaaaattaatgtaagtaaagagtttatttgggccaagatgaggacagctgctcagaagattcaggcccaagtgatcttggataggagctctgtttggcctttgttaccagcaggtttttaaaggcaaaagcaaggggatacgtagggggatgatacaaagttgcttgtcaggaattctctttggtttacagaaatgtcattcattagttattgcctatacattgttgacatatagattatgacctaatgatatctatcatgtggtgtcattaggttaattttgagctacttgtgagaaaaggcctagagtccacatagcaagcaaattcaagagatgattatttagctcaggaggggaagtgggatgtgactgtagcctcattctcatgcctcactgggcctgataatttaaaggaggttcacattcctcagatagaaagtttcttttctttctcgctataagcctctgtctttcttgtctctctattgctaagtggtttggcataaaatcatgtgctctggtagaaacctaagggctttttattcagctgttgaaattcatacccactggagattctagagccatcagtggccatggttcctgccactggaggaaactgtctttagagagtgaaggtgaagctgacatttataaacagccacggtgagaggcagggctggaaagcaggcctggctctgttccagttcctgtgtccattttggagacgagtttccgtttcctatggtttgattacgtgatcccatgaatctccatctcctgcttaagctgttttgagtgtcttgtccatacatgaagtgtcagggtgtcctaagaagacagtggaaagtgatggggtccagcatctgggatgttgggcatcttagtactgggggagtgtgtcagtctatagcaaaatcttcacttctgggctgggcttcaggatggaactcaagtcttttggagggaggaggagttcctagaggaactggggtcgcaaatgagttccaagtcaaggactcaagaccatgagtcaaatatagatgcctgagtgctgtcctcagcaagcagtcaagggtgttggacccagacgcccagatggagtccagggtaggcatcacttacaggtcgtctttgatgcatagaaataaaaaaggcaatctaaagggcagaatttgggttgaagccccataataaaaatcaagcagcttgttctaagtagcagttgtcatttggaagaggctaggcagaaagggtgacatggtaacatttacagatagaaagaaggataagcagatgagagaggaaaacttcaaagaaaaatgaaggaggtagaatctgaaaaaaaaaagtcctggactgaagagaacatggtgttgctgcttttgtaagttatctgtgggctaggttgtggatatagagaaagctgctaaaggtgatagttcactgaagatggcaaaagcaccatgagcagaactgggacacaggatcagggccagatgagactacaagatgacaaattttgggggtcaggaggggaagtgagatgtgactatggcctcattggtagacttttccattcatggcccccaagggaccgtgtctctcagtattcatgctcttgtgcattgtctcccatattggactctgggcttggcaaggtgacttgctttggccaataatatgaacaaattaaatagggataaattagaggcctgataggcatttgcatattggacctatgctctttgaattctgagattgccagaggatggattgactagctgtcattaccttactacaagcctatggatgaagccagcacaggaggtaatggaaggaattgcagagctacgaagctgtgactgtaatgcagcatgcctagtccccttcctacctctagtcttcttgttatatgaactgataacttatagtttaaacttctcagtaagttcactttcttgcaactgaaagtgtcctaatgacacagtgtattagtccattttcatactactctaaagaacttcctgagcctgggtaatttataaatgaaagaggtttaattgactcacagcttagcatggctggggaggcctcaggaaacttacaattatggtggaaagcaaagaggaagcaagagaccttcttcataggcagcaggaaggagaagtgctgagcgaagcagggaagagccccttataaaaccatcagaccttgtgagaactcactcactatcacaagaacagcgtgagggaaactgccctctgattcaattacctccacctggtctctcccttgacatgtggggattatggggattacaaatcaagatgagatttgggtggggacacaaagcctaaccacatcacacagccttttgtttttaattttttgaggcaaattcccataatgacatggttttttttttgaagctgggaattctataagtaaaaatatttgcaaggcacttaacagcttcgatggggaaactctatccctgtgtccatgctttctacttacctgatcccctaagtaccattttctgaaatgctgtccactgggatgcagcaaggagtccagttggtgattttagagcatcacagccatgaagagttactgagttgtgcgtactcatctgaaactaagacagcctttttggttccagttgtcagcttgtgatctatttatctttgctcccagggggctatataaaggataccagaaacaggtacttctcatgtcccttctagctcaatgagtaatagacttgatggtttttccctctgatgtctgaaactttaaaaagacaataaaaacacacagatcaatatactgaataagtatatcttccaaacctcatactctgtttctcattataaacatataaattagcctcatgcaaagaaaagaagcatagcttgtaacatcttttctatctgacatgtgctgctgcctagaagactccttaacatgctccctttattacatctcccatcatattctccacttgagtatccagcaactggaatacagtgttatagaaatgagtagttatatatctgtaattatttccagcttcaaccgtgtctataataagccaatgtacttaggtcactaagctctaaataggccagagggtatggaagacatatctatccccaccactggaagaaagctcaaagcttgtccttgttgctcacgctgtgatgttttcccaaagggagggcagcagggctgttatttggggacagctgagacctgcgaatgcataagagcagaaatgatcaatggagcatccccattgtccatcacagggaaaacccagagagggaaaatagggcatattttccctcactgccctgaatgcaatacaaatctcatcactccatctccctttttagcctgtgctggagcaaatagttttagaacatgcacaatttgaagcaaccccattaagtcaggatggcaaatgctataatttatccatgctccctccttggagaagttgaacaaatattgcagatgagctttataggtaaagactgtagcagagccttattaactaggtttagaacagtaggttgaagccctttctcagacaagaaccacagactctgtttcctcttgatgtgatagatctgttaggggtgcttgtgtctgcactaagattacagctctaggcagggtagttcttgagacacttagaccacagctctgctctttgaggaatgaggcaattcaagtgttaaatgggctccatgttttaatctttagcacttgaacttattctatttctgtccccttctttgcaatgttaggctcagctgtctgtggtgacaggacttcttctgcagccaaccagcatacagctggtcactacagccctaggtgctgccaaaggctgagaggaatgggaaatgctagtactttccttcgtgcaagagtgggagatggtgcaagggcatttctgtctagttcaagtaagcatatattgagttctccctactggctaggccattagagacatagaaatgaataaagcatggcccctgcctcaaaagctttcattgtctacagtaaggtttggcaaactatacctgtgagggtgaagatgctgcctgttgtaaataaagttttatttaaacacaaccatgcacactcatttacatatcgtctatggctgcttttgtttctacaatggcagagtaggtctaacaagatcatatgggcccaacagcctaaaatatctactaactgatccttcacagaaaatgtttgctcacctctgcacaacttagtaatttttggtatatttacagaattatgcagccactaccactaccaaatttcagcattttcatcaccccaggcgacatctcatatccattagcagtcagccccagcccttgataaccactaatctattctctatctttatgaatttgtctattcctgacattgcataaaagtgtagtaaggcaaaatgtggccttttgtgactggcttctttcacttgcaatactgttttaaaggttcattaatgttttagcatgcatcagtgcttcatttctttttattgcctaatagcagtccattatatgtatataccatatttggtttatcttttcctcagttgatgaatgtttcggttatttccactttttgactattatagttaatgatattatgaagatttgtgtatgagttttgcgaggatatgtgcttttgcttgggtacatacctcagcatgaaatttctgggtcataggataactgcatttaacattttgaaggactggcaaactgctttccaaagcagctatgctgtttgcaatcctaccagcaatgtatgaaggtttccatttctcgacattcttgctaacacttgttattgtctgtctttttgattctggttgtcctagtgagtataaggtggtccttcattgtggttttgatttgcatttccttcaacgctaatgatgttgactattttttcttgtactcattagctatctgtacaatgtcttctctgaagaaatgtctatcaaatcctttgcccatttaaaaattaggttatttgctttttgggttaagttgtaagtgttctttatatattctgaattctagtttcctatcagacagtatatattatgcaaatatgtcctctcattctgtgggttgttttttcacctttttgatggtgtttttggaagtgaaaacagtttgtaaccttgatgatatcccatttgcctattttttcttttgttgcttgtgcttttgatgaccaatctaagaaaccattgcctaatccaaggctacaaagatgtacttctatgtttttttctaagagttttacagttttagcttttatgtttaggtatattatccattttgacttcatttttatatatagtgtgaggtaggggtccaaaaatcctcttgcatgtgaatagacagttgtcccagtaccatttgttgaaaagactattctttccccattcttcacacccttcgtaaaaatcaattgactgtaaatgtgaagatttatttctggattctcagttctattccactgatctatatgtctatccttatgccagtaccacacaatcttaatcactgaaactttgtagtaggttttgaaattgggaagtgtgagtcctccaactttgctcttccttttcaagattgttttggctattttggattccttgcatttctgtatgaattttaggataactttgtcagtttatgcaaaaaaaaaaaaaagccagctgggattttgacaaggaatgcattgatttgtagatcagcttggggaatattccaagatcagttttaatctttttgtttccaagatgttttgagcatggatcatctgggtaacttgcatcaatgattcccagcatttctgagggttaagtttcttttataatgtaaaccattattactgtcttctcaaaggataaaacttttacttttctattaaaagcatcattttattgcccaagtacataagaccaaacactattatgaactagagaatgcttttaagtgaatttgtattttattaattcataatagtgtctatatatacttcagaaattatagagcaaaacatggagaaatggtaaatattctgtcttcagccactgcttggtatatttatggagtcattgtccggtttgcaaaaaaaaaaaaatcagctcccacttagggaacctctagttagcaagaaaatccttcttctaaagcaggtctatctttctgtccagagtgcctcagccatagaacagggcagtgtgagcaggactggccttcgtaaactgaataaagatgccaaatagctcacgatcaacctggtgcttttaaagagttgactttcttgtgagggaaggaaattgtatcccaagctgcttcccctgttgtctaaagctgactttgcctcacctggcctgggaaactttgctccctggatgctctaccaattgagttaattggcagtatgctcagatgaacaaattcagccacagaaatacctctaagattttctttggcaccttcaattaccagtttttattaaaaagaaaaaagaaagcaagcaaacagaaatctcatgtgaacattctaatctttcctgctggcatcacctttctttatatttggaacaaaatggagaagtaaaaaatcgtccttttttttttttctctcagtcaagacgctctattgaagaaaagaataaagtaaattgattgcttataccagtccagaaaatcgttcagatttgtattctcttctacttagacacatccactttgccatattgtagtggaaaggtcactgatactagaatcagaatatcttaactcaaataccaaatccctgtcttgctgatctcaatttctttacagttaaatagaattagtaatagctaacttttgaatgtgagaattaaggagaaacttgaagagagtaaagcagttaaataattcaagtcttgtgttgtttttttttattactagcgtgctatttttgcacgaaagataatgcacccgccacttcctgagattcccaacctccttctagagggccacgtttttcagtgtggcatgggtccccgcaggcttcccttcctgctggagcaagtggagactatgcacctccccaggtgtgtgcccaaatcatgcagagagggctcaggagctcccagggcccagcagcttcttcctgatggcaggagtgggccaaggcagcatgccagggcccaggtaaagtgagacccagacagtggggagagagggcgaggaagtcaccagacagagagatgaacatagcccttcttttcctcccttcccatttcccacctgtccatgtaactagcatgacttacatcttcgtatgtgttctttgaccccatgtggtgtcctttcttttttagtgttaaacattttctaggcttctggcttggtgcaaatgatttgcctttggaaaaaattatatttattgaaagcttcaccatttaaataaaacccctctaataattcccacttccctccttattacccctccttcctctgctggctagattcccatctgtgttcattgccttggggaggagcttgaaaaggcggggtaacctgctagtcactggcttcctgtttctggagcctggcccatgatgggaagcagtgaggtgccctgggtggggtgaggtgtaataggaaagcatgaagatggtggaagtgggagtgcctctgaggggaatgctccaggtcaacacagaagagcttctgtccctactttcctgctcttggactacagaaacgtcctctgggccgagggcaggctcagagtaaggaggagagagagagagagagacagagaagcagcaagaagagcagaaaagtcaacaggcctgagagggccatggtgcaaactgcttcaaaggcaggtccttggagcccatgtcactgcagaggagttggagggctagagaacagagaagtttggcagccatcatccttggccatagttccggaaggctgcaagaggctaggtgggcaatgtatgagcaggacatctagcaaatgggccatggagagcctgactgagactcttatgtcctattctggcccagaaacttcacaatgggtcttaaatagcacagagaagtgcagccctgaaaggttcacatggacaggagtctcagcatgtggacaggtgatagaggagcaaatggggtgaggcacattttagccaacacctgtaactgaggcttaggagatgccctcccctttttcccccatgacctggtactaagtactctctcttgaactggtgaactaccctggacaaaggactgaattcccagggactgagattacatttttgtcaccctagcaagaagagggctcaaataacaattctaaggcgttatagaaaattttgtatttcttgcacacttgagttggtggaatgaaattcatacccaccacactgttctttgtctattccttgtatgtgttccactctagttgatgtgacttggtgagtcttttggactggattaaatatggcacaacaagtctttgtcaagcttaccatttgcctgttcctctattaggtaccaggaacaggtgtgtgaatgagaagtggttggtagtaggcagcctcaaaggccctcatgagctgcacctcctggtattcttgaccttgtgaatgctctccatttgaatatgggctggctctagtgatggagcaaacagaatatggcaaacagaatatggcaaaagtgatgggatgtcacctccaatatcagattacaattagactgtggctttccttttgctcattctatctctggctggttcggagggaagccagctgccatactgcaagctgcctgaagaatagatccagagaaaacgaactgatatctccagaactgaagacctagttcctactaatagccctgctggggagcttggtttcttcaagtgttgaaccttgagatgactgtagtcctgtttgacactttgcagccttgggagagactcagccagaggcacccagctaaacctccaggattcctgaccctcagaatctatgagaaaataaatgtttctgttttaagttgctgtgttttggagttactcattatgcagcaagagataaccagtacccagtccttgccctccaggaactcttgctctaggatgagaatttctttggaaagagcattcatgataataaagatcagagagctaggcataatggcacggattctgttaattaggcttcaggcagtgagaagaggagatgagacgcaggatgctgaacaggcaataatgcctgtgaggtctgggatcggtttcctctggccaacacattctctttaattacaaagcttagttcctgaaatgacaattttctatttttactcagtggattggtggaagtaagagaagtagcatcccgtggtagaaatgagagagcagggctgtttagggaatttagctcaaatcaacaactgtttttggggcggccactctgtacctatgagcccttctctcacatactcatagatgctgtgccccagcctctactgaatcaccctttatcgagggcattttgctaggatagactgtgcttgtgactgatgttcttagtcatcacctcttctgtgaggtggagccactgaaaaatggtaactctcatctgtcattgttatagttgcaacagatttaaagacaacttcattgaaaatagaaaagggtggtggtggaggcggctgcgaaggagaattggtttttcttctaaaaagccctgactcaggccacacattgagagtgctgcaatctttttggttctacaacttatatcccagaatccccaacccactatgaagatacactcccttctcatctgaaacattgtgtgctaacaatagcaacactgggaacttcggatatttccttgcaaatggatttttcctttggatatgactatattaaaatattgctcctggttctggttcttaattttaggtgagttcagaaaaaaagatgcatcagattgaaggaggacattgaaatcaattatatactgattagctcggaggaaaggtttccttgttctttttcttttttttccctctttctgtattggctaatccccatgcacactgcaattgggtgcagtcaagctgttccaggcttttgataactgcctcaactgtcagaagtcactgggagtgccagcagtcagccacagaactaccactgagctttatggaactttgcaaatcttactggaatccatcgcatttcatcttgtcagtccaaccagctcactgtttgttgtatgtgatgttttagagataatctctctctgggcacagcacagtgtttgttttgtctgctgagcattgactgccttatcttctgttaccagtattctgattctgtggggaagaaaataccactctcagtctacatgattggggtgggactgatcccaatcctgcttccagaagggggcaggtaacccatggatgggcgattacagtgctttatcccctggtcccaaggcttggtttaggatggacatatgacccaatccaggccagacatagccattgagacttggttctaggacttctatttgaggagtgagaaaaggcctgttatgctccattggggttggtgctacaggtagctttcttatgatcacaggggagtgcctgtccatgaatggagaccacatagaggataggaggagagagagagagagagagagagacagtg

SEQ ID NO: 2998 - DNA, 2258 bp, Homo sapiens
atttgccttgaaacgcaggaggcagagcgggcctgggagaaggaggttgtttccacgccttcctgggggagaggctggtgcagtcgtgagagtcaaccgggagctcggaggaggagcagacaggacgtgggagagctcgggagagacccaggctgggcgtcttgcagctcagacccttggccacccaagcagcgtagccggcatcacagcccacggcgtgaggccaccaagacagacagaggaggtgagggggacccggactgggccagccacacgtggaggtcgtggaggaagcaggcatctatgcggaatctcggccgcccagtctgccttgtccacagagaggtgcctgtccgctgcttcgagcgtgtgccgacgtctcccgaatgtgtcccctttctcttcttccttgggatttcctaacgtctgacgatcccagcttgcgttggccccctgtgctgtggccccacgacgttttgtccagcttgatcagagcagaaaggggacctggtgggcagcccaaggggcaggaaacttccgggtggattccagcacagccccagccctgccggggtcttcatgccaaacccctggtcggccaggcttgaagctgggctgtggagccacagtcctggcctacaggcaggtgcttaagtcactcaggccactatgacacagttccacagcctgggcagcctacataacagacatgtacctctcacagttccagaggctggacgtccacagtgagacactgtctctaaaaaataaataaataaaaaataaacaaaaggccaggaaaaacgtaaggtagtatcaaaaatgtaatgtgtcaatctcttttcatgacaggctacaactgaaaacaccagtcatattaccaaggctgtgaccgaaatcgtgtctctgagaatgtgcctcaagcgttccaagcctggccggccgcgctggctcacgcctatcatcccagcactttgggaggctgaggtgggaagatcacctggtgtcaggagtttgagaccagcctggccaacatggtgaaaccccatctctactaaaaatactaaaattagctgggcgtggtgacagccgcctgtaatcccagctacctgggaggctgagacaggagaaccgcttgaacccgggaggcagaggttgaagtgagccaacatcgcgccattgcgctccagcctgggcaacaagatcaaaactccatcccccctccaaataaaaagaaagttcccagccttacagcgagagtaaataaaaactgtcaccatctggcaggcccaggaacctcagggctatcggtcaaatctaaagcctgccttggtttggcttcttagcctcaagaggccattaaatctgagattcccatctgatcaacatagggagaaaagcttatgtttctaaagaaaagctgtaggcctgggtgcagtgcctcacgcctgtaatcccaacactttgggaggctgaggtaggaggatcacttgagcccaggagttcgagaccagcctgggcaaaatagagagacccttatctctatactttttgaaaaaggaaaagaaaagctataatacatctgttaggagattgtagctctgggcattgtatttgagctcttatatctacctacagactagactagatcctaaattcttctagattccttcagtcaaaatttcttccatggaattactaaaaataaaaactgctctgttcctaaatccctataaactgaaactagatgaattttaaggaacaagtctcatatctgacatatgggccccacaggagttcaccaaaccatccaatgccataaccacagacatttcacctgcaaaccaggcagagaagctggcgttttcacactgtagccagggcttccagttcatcgggacgagattctgtatcagagacgccctccctcttaccgtctacctgctcgtgccacaggatcatggtcatttagttcattcaactggtgatcttaagcctagatgtacacctcctaactgaacaatgctggaccggctctttgagatgatagcaaagactatgaaacaaataaaactgaaattaataatggactccaggtagactcagcctgagagacattcctttcaaatctctcttgttcaaatgtggctaaaggttttgccactgacttctagctgctaatcacttccctccactgtgggacaagaccagcaaccgcaggacaccacatcccagcaccaacaagggacaatcaaaac

SEQ ID NO: 2999 - DNA, 715 bp, Homo sapiens
tcgagcgcggccattcgccgcgttctgccctctcccccctttcctcacgctggtggtggccctttcctcagtcctgctgatgtcctccagctgattccaggctgttcccggccacccctgaggccgtcctttcgcttcttgtaaaagcctccccgcctcctgagctccctcggtcgcctcccgagaagccaacgggcctctctggtggagcgttaggttgacagcgttttagcaggaccgcgagaaaccggggagatcctcttacgaggaaaaactccaagattacatccctgttatctttcctccaagtagtttctgatcataagttatttgtttaaaaatgatgttttaattagaatttatttgatggcttttaaaaaacttttactgacactcaacatgtttgtttttgtaggagctgactaaggctttggaacagaaaccagatgatgcacatatattatcgtcaaagagcttattgtcacattcttcttgggaattactgtgttgctgttgctgatgcaaagaagtctcgcgaattcaatccaaataattccactgctgtgctgagaaaagggatatgtgaataccatttaaaaaactatgctgctgctctagaaacttttataggaggacaaaaattagtgcagatgctaatttcagtgactggattaaaaggtgtcaagaagctcagaatggctcagaatctgaggtg

SEQ ID NO: 3000 - DNA, 2671 bp, Homo sapiens
cacaaggtgggtgggggttggggggaggtgtttgtcatggctcaggaggtcaactttgaagcggggcattccctacaggtagggatctgcccggaacgcatcccatcccaaactgcaaaaccacaagcatcaacagcaggagccgagcaaagtgctcggcggaggaagaggaagggcgagggagagaaatggtcgagtacagaagcctgcgtgtgggtaagaaaataccctaaccactcgcccaccggacgcagggcggctgggactgcgaatccagcagcagccacagcgtagcagcgggcggcagccgccgaggcagcaatgtcaggagggcacagctggaggaggcggccgccaaagccactaccccacccccaggaagatttggaaaagaggcactggctactggaggaagggagaaatcaccgagagagcgaaagatgtaacagatgcagtgactcatgcctataatcccagtactttggaaggtcaaggcacaaggatccattgaggccaggagtccaagaccagcctgcacaatgtagcaagactccttctctacaaaaaaataaataaaaattagccaggcatggtggtgcactcctgtagtcccagctactcaagaggctgatgtagagaatcgcattatcccagaggtcaaggctgcagtgagccgtgatcatgcctctgcactccagcctggacgatagagcaagactttatctcaaaaaacaaaaatttaaaaagatatcaggtagctcatagaattgttgagagggctgtaaaaccaggcttgaacttaaacagcaacgataaaccacccacagaacggacatgatgaagaagttggcaaatgttaccaactgtcctggtttttttggtgactgtagtttccaaggattcagatccttccatgccaaaatctgaaaaatgctgggcaaagtatgactgacaatgtggtaatcttacagctagcactagagacatcaagcactagacaacacaatttgccctttggccacttatacaatgggaactcacgcttgcagtaacctctattgccactaggagagagaaacacagaaggaggaagggagaagggagagagaggaaaaaaactgttgcttgtctccttagctgtgagtcaaaggtctaacacagatgtctggctgaaaagcctaggtcacatgcctgcaccccagagaaagtatgtgacatcttctgcttccattatgggaaacagcctttgcttgtcacgaagatttacatggtgagacatatcctaaatatagggaagctgttgaagtggcccaaataatgaccaatttctactaatttgtactaatatccaaattacttttaattatctaatattacttagatacagtgaggcaaccattcgttggatatataatggtttctttgatttcaaaaatctttttttatgtaatatatgtctgaagaccatcaaaataaattcttaaagtcagattaataggatgttacttataatattattgtaattatttgaccacataatagtttatgcccattatatactatgtaattgtatgatggaaataatgctgtactttgtttgtaaaagtttaattatcctgacctttgttcatcataaagaattgctccatttctattatttatcgaggaaaaaagtttctctctttttgtttttaatatgtcattaggagaagagtagttacacgtaggctagagtgtttgccaagaagaaattgattttaatgggaaccttttatctaagacaaactttaagaagagcagtaatggacaatgtgttctgtgcaactcttcagccttcagtctcacattcattgtggtcaagtattttcagcaaagaataacaagtcagagtttgtgtatatttttcatagctgttcattctcttacagagtaaccttgaacaaacctcttaagatttgtgttttatcttcatatactgaaatacaaaatgggaatgcctatatttaatcaaagatataatttttactgatagatagtaaagaacaaaacactggaacaagaattcctgtcctgcctttcacaatgtggttttgaggccttggccatgtcacttaaattctcatatctgttttctcaatctataaatgatcataatacctgcactatctgtctcaaattgcatatgtgaaagcatcttaaaggtacaaaacaataaatacaaagcattattattaaattattacaccttccagcatttaatgctaaaaatgccaaatgcgtcctttggttatatgtaggaaatatgtctcagaaaaatcaatttaaaattatagaagctaacaggtaagtcattttaagtgtgtggttatcttctgcatggcagatttttaaatggtaattattaatgaagttttcctatacttactgtttccaagactccattctttccaaagttttctgagttatgcttatcatcccttaagtcttagggatgctcttctgagcttttggggtttgtttaattgatatgtcatagttgtacatattttaggagttcttgtgatattttgatacatgtatataatgagtaatgataaaatcagagtaattgggatatccatcacttccaacatttgtctttgtgttgggaacattaaaattcttctcttct

SEQ ID NO: 3001 - DNA, 13956 bp, Homo sapiens
aacataagtggacatgcacaacaaaaaggccctttcgggcgttaattttgtatcacctgcctgtatttctattcaaacatgaaaaatttttgaaacaaatttgaagggggagtggtccttcaccaataaggcaccaataaggcaggttattttctcctttgtactggcaaccatcttttctgtagtttatgctctgctcacaccctatgtgcttgtttcccatctgagataaccctgccccttttctgttttcatgaccattattcaatggaaaattggaataaagtaaaacaggacaagcctgaattactttgggctctttgttatatctcatcattttttttggtctcttttctccactacatttaaaacaaaaaataacctttgcctgtgcttttccctcacttctaaatatgttttttttaaccttttctttcttctcttttgtgcttgctttcttagttaacattacaaattttctgttttttctaaagctaattttaaaaggaggcctataatatttgtgtaaagtttttcattcctccagtcatcccattttctatatgactttaatgtgttatctgccagaacaactagaatagatatctccattatttctgcacagatggcagagtgaacaagactttgtccttagaatttccatcaacaaaacaaaaccaaaccacttactatatatgtattgccattcatgtttaagtgctgaaaatggacttggagacttatctcagcactatcacttatgtactctaactcttctttatttgagtagggaatccttcttgtgacttccttcagggtgtggacacattgaaagattaattattcacatatcagctggaaaaaagtgaggtgacaagtgttgacatttgcgtttctgaaagaggcacattgttacatcaaaaaaaggataatgccaattaggatttcatatgtgttgttttattttcacaattacaatgttagaggaaagctcaaaagtaaaggcttttgtgaaaatgatcagatgataaatcttgatacctgtgtaagaagtgaaagcaccagagtttttttagaagatgaaaaatgaaaaaaaaaaaaaaaagaaaaagaaacaatttggcattgttagaaattctttattgggagtggaaaaacatgaaataaagggaaaatagctttaatcaactccaaattccttctttggaagtgctgtgtgtaatctccaataatggtggtgtacatttcccccaactctattaaaaccatcattatcattgtcatcttcatcaacatggtcatcatcattgaacacacactccatacaaagtaagatgttatgtgtttgtattataagcagagattagacaataactctaatcacaaggatgctgtaactagtagtgtagatggtagatgtgcacaacaatgaagggatgtttgatggtatctaagttgtgtaatcattaggcttacttgaagagtttcccctaatttttctatttttctttttccttttttttttttttttcaaacagggtcttagtctgtacccaagctggagtgcagtggcacattcctcatggctcactggaggtgcctcagcctcctgggctcaagcaatcccccaacctcagcctccctagtagctaggactataggcatgccccacaccagctcattatttatttttttatttttttgcagaaacatagtctcactctttttcccaggctggtctcaaactccagggctcaagcagtcctctgtcctcaacctcccaaagtgctgggactacagtagggtataaccacatgactaatgtcacatataaaaatggagaacgggtgcacattaaagagtaggtaagtggttaatatactttttctctctcaatcctcccaacctgccctctttacctttatctctccaaaataacatgtttgttgtttaatagagatgacatcgtcctaatctaaggcttaagattcctgtaactcttaagtcacactttgccaaatttttattcaatcactgaaggctcacattgcctctgaaagaaaaaaaaaaagcaagtgaaatatttctgactgtgagtgttcttatattggcatcttagtgtgaacttaggggatatgttagcgttgactgttttctgtatcacctcaggtgtattttgtctttcccctcttgacttcacttacccactcactctgactaatgtcctagcagtggcaagcatgtagatgtctaaaaatgtagaaattgtaagaaagaggctgtttcagggcagcatttggaagtggctattgtgtagggctaaccatatctctctcctgccagaggtcatggccttgttgatggtctctagtcaagagcaatcccattagtgaaaaaaaaaaaaaaaaagaaaaccagcactgacagtgactgcttccaaatattctcctgtctgctactatagaatttcctagtgtttcccatcttgtcaattcctttccctcaccttttttacactgagtgaacaacttttatttgaagtgttaggtactaacccagttctctcaccctttactctgcttccttcctttcttaaatgcttcctgctttgtaaccctctgcagctagtgatacattagtttatgtttgtgttttctcaagaagtgaaactgttgtaggttgacctattatatagaagtacatactcctcagtagaaggcaacttatgattgtagaaactgggtgtttcgtgagaagttgctacttaactgaccaattaggaaaaggggtacagaaatgattgagacctccaaggagatacagattcatttaagttgagtgtactgctgcagacatcattttgaatatctgtattacgagtaaatggtggaaatttgaagacaagtccatactttatgaaagtaagagaacaagaaatttgtttccctaaatctgtgagcataccctataattcatcagaaacagcaaattcacaaacacaaaattgacagaaatatgtaaaacttttccagcagtttacttctgaatacattagaaaatgtgacagaacatagtaaatttcttgtcattttacttcccaagggaagtgctaggtttgtaaatcctagaatatcatcaaattatattttgaaatttatttctttttgagctagaattttaaaagattacatgttttttcacagaatacgttcatccagttactaataatgatgctgaaggaatggaaatgtaatttctagaaatcatcacttttcaaagttttatagtttgtgaactggaatactgaagatggaagtatgatttaatatttggtagaaacaggagagtttgttatttgtagctctgatattagaaattacttgaggtttctgttaccaaacttcacaaaatatatttcataaaaagcattcttaactcaggttatacattttttaaaaattattctgaaaggaattagatatttaacattgtagctgacctaaataaattggagaaaattcttaaacaattatctttcattttcccatcaataaatggagcaataataatacctaattatttattgcacaggagtcttgcaataattaattaaagctttaaagtactttgaagatgaaaacaattttataggcctcattattaaaggtaatttgttatggtaaccagtcaaagtcattcatttggtcttttaaacttgtttttaaatgctctattcggatccaggtgttaattaaaaaattttaaaacaacacttaggaaacatatgaaattctgctttctatcttgatgcttaacttgtgaaataataggtaagttttttttccgaattttgtttttttcatgtttatacgcctctctcaaatcccattgagtgagcgagtattgctcccagctcattattacaaaaagaggtttgccatgttaaagccactaagatttttctttttctgaagctctttacttaatgcaaagacaaagtgtcatctatgataacaattctgcatatggaaaacacaaggttattcatccatttaaacatttattgagcaaatgctatagtttaaaaaagataagccactcggtaaattggaaaatatagtaatatgtcacttgcatgaaatttttatccaatgaaataatcaagtaattaaatttaaggtgaaagtgattgatgtaatataggttaaaagccagtatggcaaaggctgaaacattacaaagagaggcatcaaatgtggttttgggaagcactcaatttttgtgtagataatatcctagatgtacctgtatttcataggaaagaaggcagtagtggtattctagaacagtggttctcaacaagggcaatagtcccctgtcccccattcctgggacatttatcaatttctggaaatatttttggttgtcacaactagggaagtgctacttgcatctagtgggaagctactaaacatcctacaaaacacaggacggcccaccacaacagagaattatccagccctaaatatcaacaaaactgagcttgaggaagtctgctcttgttggaaaacacagaactatcaaggcaccagatggagaaagtataagatgtatatcaggaatagcttggcaggagtagacgttgaaggtaacattgaaaatgctttaggatagccttgattattagattagactacaaagctgactcattgaatcactcacgcactgtgagtcattcaataaacatttatatctcaggcaatacggacagagagatagaagatatagatgctgctgtaaagtttacaatttagttggagacagtcagataaaccacccactgtgtgaacaaagtgatatctgtcaaacaccaattctactgtgtctttaaaaaaagttcaattaaaaataaattttggaaagagtatgcactacatacttctccacaacttgggactatatacaatcttgttttgtgtatcagtttgcctttatttcagccagcatttcttttggcagtgtacttttaattcccttttatataacaactattagcaacccatgacgtattggatagcttcccttccagactcactctggacccttctctgtgctattccaggctcaagatactgatcttcgggaacttcatgctgagtgtccctgtgttcggttcttgattgtgtttggcccaagagggacatttataggagatgagagggtgagaggagacaggggttggggcatttggtccctcaactccctcctccaaatagccaggtcaccacagacttgctgcatccctccactgaaggccacactcctttcagatgccctttcttatagagctaccctgtctgggtccttataactgtttcctctccttatcccttctatctaaagctggcaatgttcctcatctgttgtgagctgtatgctgcttcactatccctctttaggaaactgcctacacatttgtaaaaatcctttattaagcactcctcaaagtgccagtctaggattctcattgttatatatggggaacatgacttgggaactgcttgtatggtagttgcttttaaaaagagttctgcataggaaggagtccgaaaagtttaaatttcatattatgacttatgcacatctattgaagaatgtatctgttagcttatttattcctgcatgtatgtatgtatctgtatgtatgtatttatttattttgagatggagtctagctgtcgcccaggctggagtgcagtggtgtgatctcagctcagtgcaacctccacctcccggcttcaagcaattctcctgcctcagcctcccgagtagctgggattataggaacctgccaccacacccagctaatttgtgtgtggtgtgtgtatttagtagagacagggtttcgtcatgttgtccaggctggtctcgaactcctgacttcaagtgatccacctgcctcggcctcccaaagtgctgggattacaggagtgagccaccatgctcagcctcttttatttatttttaaatgtggtttagctgttccgcaggaccattctgatgttctccatataattccatttttgctatatttggtttcagtgaaaatgtaaggttttgaaaaagtgaagtggctcaagagtcatgctttattctggtagatggatttcaaagacgggaagaaggcatgaggcaaggagacaaacccagatgtacatttaataatgagtaattaatactttattgattatgttttcctttattttataattctaatgaactgacgccaatatttttaaaaagcaagataatgatttgaagagagttagccatggcagggaaagcatgaatggaaaagagattgtgctgttatagtgacagtgcctggaaactcattgaacctgacagtgtagaaagatgatgtgagataggcagggaaagacagtagtaaaaatccaaaatttaacgtacggaaacaaccatgtctgtggccattccactctgaacacgccgatactgtctgatctcagaggctaagcaccgtccagcttggttagtatttggatgggaagaaacatcttcttccccaattcctttttagttaccaattatatctattacttttatgaatgttaagagtctacattgagattagattagcatgcaggggtatgacaatcttttaatggagaaggtaacttctggtatctataaactggagaaaaagtgattcttcttacaagaaataaactgcagatgcaggcactaatagactgaagcaataactctatttccctcttttgatctttgaagtatctatatcaaaaaaatcttcttggtggtggggatatactacatggagatgggccaaagactacaaagagagacttaggtaaaatcttgtctttgtatgaggattctacttgaattcaataggcctgtgtccctaaagaaaaaaaaatgtatttattgcaaaccaatttagcttaagtaaaggtacacattttggggttttattggttgtggttgttcagttaaattatacttactgtactggacaccatatacgccaatcactgttatcaattctaggaatgcacaaatgaataaaatatggtccctgtcttttctattttctgtgaactttctacttacgtcacaatggtgcaatgggaaaagaagaaatggatcatttattcaacccttgataaaagaaagacccctcctagttagcatggtggtagcagggataatctgtaaggaaacctaaatccaatgtgaacctctgaagaaagtgaggatggttagagtaatctagtcttgcctccacatcaggacatacttgccatgaccagcctgggagtgtctattttttttccccattaaagagggtagcatttccttttagttaatactgagattcccccctagaaaggttctaataattgtagtgtaacaaagttagtatcaggttaatatccactttaatgggagaatttccaaaactaatattatcagttttaatgatacctttttgatttacgaaatgtctgttattcacatagtttttgttagcagtcaaaaccaacaaaaatatttgatgaacccagataaatatttgagaaacttgtatgctataacacttcattttaaaagatatgtattttgtcatctccaagttttctttttaaaattgttattccaacccttcttcccctcaatttaccagcatcactaaatgcccaccttatttcccagtagtttatgtgttctctcatattttaaaaaggtttcttgaggtataatttacatattataaaattatttatttatttatttaattcatttttaaatgtggtttagctgttccgcaggaccattctgatgttctctatgtaattccatttttgctatatttggtttcagtgaaaatttaaggttttgaaaaagtgaagtggctcataaagagtcatgctttattctggtagtgtattcaggtgtacacccattttaagtgtacagttcaatgaaatttagtaaatttttataattgtgcaaccatcaccacaatccagttatataacatttcagttaccaagaagtttccctcatgcccctttgcagttaattcttgctcccgctgcagccctaacaacagccactaatttttctgtctctataattttgccttttctagaaattttgtataaaaggaaccatacaatatgtagtcttttgtgtctaattatatttgtatgtttttgaactattaacttgccacatgtattagtactttgttccttttattgatgagtagcattccacatttggatatattttgtttattcagtcatcagttgatagatgtttggattatttctagcatttgcctattatgaattgttctgaacaagcgattatgaataatgatttctcacacacaagtgttatgtaaacatatgtttttatttctcttgggtagatacctaggactaaaatttctgggttatatgataagtatattcttaacttttaaagaaactaccaagctaccacttttccaatgtgtacgtatcattgtgcattgccaccagcaatgtaaaatggtttttctacactcttaccaacacttgatattgttagttgttttgattataatcactctagttggtgtgttgtggtatcatcttgttcaatatccattttcccaatggttacttatgttgaacatatttttatacgcttttgcatatctttttcaatgaaatatccacatcttttgctcatttttatattgggttattgtcctcttggattgtaaaagttctttttttattccaaatacaagccctttcctagatatgattggcatatattttttcccagcctgaggcttgtctttgctttatcttaatggtgtccttaaaagccatgcttgtgtaaacatatgtatccacaaacataaacactgtaggagttttattttgtttttttatcttattaaaatggaactgactctatatacttttcagcatcttgattttctcattcaacattacctcatagaaattcacccattagtttcaatttattatttttaatgactgcatactatttcatggtatgcattcccccactgatgagcattcaatttgtttctaggtttattccacacccccaacagccagtaaaacaataaccacatttgtacccatttatagatccttaagtacgggtgctttttatttctgtagtttcaagtccaggagtaaaatttttggctcaaaggcttatatggttttattttgatttatgttgccagatggctttctgaaacgtatgtgataattcacttttctcccaaatgtgtgggcatcctttctcccatatccacttaagtcagggagctgtccattttcaaaggttgttcagttaaattgttcagttaaatgtgactgggcatttgcattcctatcatgactagcaaatttgggcattttcacgtgtttgctagttgactgaatttgctcaattgttaacttcagtttaaccctttataaatttttcctttgggtgttttgtcttttttttttagaatataaatatatttggaattgtagatattgggttttgtcatttgaattgcaaatatttcttccagttgtattgtttgactattggttttgcttttgatctcccttgctacaagaatttttaaattttattattcctagtcttgaaatatttgtaatatcattactatatattttctaattctttaaggtgggtactagattcctttatttttgtctttctcctttaataaaggagtagtgtcctggaagtgataacatcccagtatcaaacacctagagtccagatcttggtttctgaaggtcatttacttctaaaaagaaccaagagtgcttggagaaatggctgattacaggttgtggccaagaaaaaacaatcagatctgaattattttgtggcgttagaaacaaggaagtactcagagactaatggagggagtcatgttaaaaggactcagaaatcacattcaaggagccactgctggtctactctggaaaaaatttgaataccaaaaatagagaataaataacaatgatggtaaaggatcacaaaacatttgaataaacaaaaaaaaatcttgagtcagcagagatattccaaaaaaatgagagactaataaatgtagggaaaacatgtatatttaagaatcactattgcagctccagtataacatttgattaggcaagaacatggacagaggctaaaattttggccattagattgttggggaacacggtagtctcacaaggatacaatgtttgataaggtttggctgtgtgcccacccaaatctcatcttgaattgtaattccaaatgttgtgggagggactggatgggggtaattgaatcatgggggcggtttctcctatgctgttcttgtgatagtgagtgagttcttatgagatctgatggttttataaatatcttgcatttctcctgctatcatttattctctctcctgctgccctgtgaagaggtgccttccaccatgactgtaagtttcctgaggcctctccagccatgtggaactgtgagtcaattaaacctctattattgataaatcatccagtctcaggtatttcatcatagcagcatgagaacagactaatgcagtaaattggcaccacagagagtgatgtgctgctataagggtactcgaaaatgtggaagtggctttggaactgagtagcaggcagaggttgaaacagttgggaggactcagaaaaagaaaggaaaatatgggaaagtttggaacttcctggagacttggagggctcagaagacaggaatatgtgggaaaatttggaacttcctagagacttgttgaatggctttgaccaaaatgctgatagtgatatggacaatgaagaccaggctgaagtggtctcagatggagatgaggaacttattgggaattggagtaaaggtcactcttgctatgctttagcaaagagactggcgacattttgccctagaaatctgtggaacattgaacttgagagatggtttagggtatctgacagaaggaatttctaagcagcaaaccattcaagaagaagcagagcttaaatgtttggaaaatttgcagacttatgatgcaatagaaaagaaaaacccattttctgggaattcaagcctgctgcagaaattttcataaataacaaggagccaaatgttaatcaccaagacaatgaggaaaatgtcagagaccttcacagcagcccctcgcttcacagacccagaggcctaggagagaaaaagtgttttgtgggccaggcccaagcgccccccagccctgccccccggcagccttgggacatggtgcccagtatcccagctgcgtcagctccagccttggttaaaaggagccaaggtacagcttgggccatttcttcaggggtactagccccgtgacttggcagcttacatgtggtgttgggcctacgggtgcacagaagtcaagaattgaggtttaggaacctccacctagatttcagaggatgtacagaaacccctggatgtgcaggcagaagtgtgctgcagcggtagagccctcatggagaacctctgttggacaatacgaaagggaaatgtggggttggagcctccacacagagtccccagtggggcactgcctagtggagctatgagaattgggacacaattctccagaccctagaatggtagatctactggcagcttgcaccatgtgcctggaaaagtcacagacactcaatgccagcctgtgaaagcagccaggagggggcggtaccctgcaaagccacaggggcagagctgcctaaggctgtgggaactcatctcttgcatcagcgtgacctggatatgagacatggagtcaaaggaaatcattttggaactttaaggtttaatgactgtcctattggatttgacttgcatggggcctctagctctttggctttggccaatttctcatttggaatggatgtatttacccaatggctctaccccattgcatctaggaagtaactaactttctttttattttgcaggctcataggtggaagggatttgccttgtctcagatgagactttgaacttggacttttgggttaatgctagaatgagttaaaactttggggaacctttaggaaggcatggttgtgttttaaaacatgaggacatgtgatttgggaggggccagaagtggaatgatatggtttgggtgtgtcctcacccaaatctaatcttgaattgtaatcccacgtgtcatgggagggacccagtgggaggtaattgaatcatgggggtggtttcctccatgctgttcttgtaagagtgagttctcatgagatctaatggttttatgtgtctggcatttcccttgctggcattctctctctcctgccaccctgtgaagaggtgccttcctccatgattgtaagtttcctgaggcctctccagccatacagaagtacgagtcaattaaaccatttttctttataaattacgcagtttcaggtatttcttcatagcagtgtgagaacagactaatacagtgttacttcataaattgcttactaatcgaaaaggggaaaatgtattaatacctttaagatagaaagatctggcaagtagacaaacttaacgttgcaagtaatagaacataatattttgtttctcctctgctatgcagtataaagtacctaaatcattaccaacaaactatgcttaccaaaaatgtttattctaaataaagcatctactgtggttctcatttatatagtaagtataggaattagagaaacaaatgaagtagcaccattatgcatcaatcagacaaatccatgatttgggacattctctaagtcaactaatttggctcttttagaaagtgaaagtcaagagaaaataaaaatgtaggaggcatggcatggtggctcacacctgtaatcccagcacttagggaggcagaggtgggtggatcacttaaggccgggagtttcagatcaacctgggcaacatagtgagaactcgttctcttaaacaacaacaacaataaactcttgccagcagaggtgtgctattaaaaaaaaaaaagtaagagaactatcttgattaaaaatgatttcagagaaataatctttattgcaatatgagaatttttctttgaatactgaagttgtttttaaagatataaaatttattttgatgaaaattgaggaaactttaatatggactgaattagatgacatgaaattattattaatttttaacaattgtgataatggtattgtacttatgtagaagcatgcccttattaggatatgtgtgctgaatgtaggctttaattgctgcaaaagtcttcctcatgtaaagtcaaaattttttaggtactaactattggtcttcgttccgccaactggagttaaaagcatcagttgatactgtcacaagaaaattatcttctttgtattagtaaaataattaaaattaaaatgtatatatacaaggcagagaattacaaaatttgggtatcaatactactatattaattttatgctactatagtatatgcccttttagatgtttaatatctgctaacagatatgtttaggtagaaatgatgtatatcaggtatttctcaccatttagatgccatgaagttgctgtgaattaaataaacatttgtttggtaaactgcagtaacctattttaaagtgttctttaaaaggtatgtataggccaggcgtgatggctcacacctataatcccagcactttgggaggctgaggtgggcagatgacgaggtcaggagattgagaccatcctggctaacacagtgaaactgcgtctctattaaaaatacaaaaaattagctgg

SEQ ID NO: 3002 - DNA, 5061 bp, Homo sapiens
cagggaattaatgcaaaaaggctcaagcttctgtgcccctgggaaatggcagaggaagacagcttcagcctcagagcacacagcactgagttgtaagaaacaggtctcatcatccccttggccagcagattttcaccctgggcccactaagaagcctgccagggggtcctctgttgtctggaccctgaggcttcatcctcaatgtgttggagcctaggagagaggattagagttatgcgagtttcccaacggtgcagtctctactcaccgcaacctctgcctcccgggttcaagcaattctcctgcctcattctcttgggtagctgggattacaagcatgcgccaccactcccagctaattttgtatttttagtagagatggggtttctccatgttggtcaggctggtctcgaactcctgacctcaggtgatccgcccagctcagcttcccaaagtcctgggattccaggcataagccactgcgcctggcctgtttctattttcttttgccaggcaggttatgttatactggggtttcttgctgaggtctgtcctgggactgtctgaggtgtcacaaagagcccacaggtacagacgagaaatttgaaagtgaatccagacgcagcagatgacagcaagatgggactccaagttctctttctagaaattacaagctgctccgctacccacacatgtagctcattctccctgtggccaagacactcctgtgcctgagggaaaggcaatgcctgcggcagaaacggagcggtcccccagccaggggagagagtggcacctagtatggtacccaatgctctaaggcatggagctgattgactgctgactgtagaccagccactcaccacagtgtaggttggaagccttctaaggccgtgcgttctgcagagtcagcccatgatggggccaggagtgtgggctccagtgtcacccccttgggatttaatcctggctgcacctctgggggccttgggagagtataagggaaagaaatagtcccttcctttctttggagagaaggaatccacaagctggaaggagggaccctggcacgaagaaaggcacaggcccctccataacttgtttctaccactcccctttgagggcccctggggaaggttggttagtcttgaatctgtgcccaggagaaaccaaaaatccttagtggggtttctccctgtcctaggcctcctgtcagagctagcggagatctgctggaaggaggccgggaggaggggatgtacggatgccatcatgcctggatggaggaccagaaggtctttataacaagtatttgtggagctcctaatatgtgccaaactgtggtagacctggatacccagaaacacggccactcccctaaaggaggttgcaggctataccaattaaaataattatctcagtcccttcttatcaacagagtcgtccatggagactatttctccccctgccccaggcacacagaagccttgaggctttcattgtggccccacggtgacagcacacccaggtggcactctcagcttatcactgatttgcagagctgctgtcttgcagctaaaagcaatgtgctggtggatttttaaaaagaagttctgagaggcttcttagaaggtctttctccacatcactaactattcggattccggagcacggtgccaagcccctccatttactgcagccttgcccttcctctcaagatccagccgctaatgctatgggatggctggtggccccacttgggctcccccaacccccacctcgacccctagcttccgcctgtttggagctgttatcagaggaaacagacttgaacatgacggagttgctgtctcttgggcctgaccagagagttgtgttttcttggcctatatcacctcagatttatcctcggcctgaccgcagtcattatcagctaaattcaccatctctagatgcccagaagatttcaaaagtggactataggctgccagttggtgttagagttcagagaatccctggacttcagcactagaaaggagcagctgctatgtcgggggtgtcaggggctggatgcaggggctgttgcactgatcccagcttgctccattcacaagcccctcatccatctctgaagactgggaccaaagccagggctggggcaggcctctctgggcacaggggcctgttagcattggtttcattccttcaccaagaggcctaaagacattggaatgatgaggcaattaatgtgaaacagaaacaagtggctttagttccaggcatttgaaactgaaaggaagctgttgacattctttgagacccactctaggctatgatttttgctgtgctagccagaactctgctacttacttgaagtaggaccttgggaaagtcccttctctaggtctcaatttcctcatatgtaaaagtgcatctgggattagtcaagacccttccaagcctgacatgctatggtctaagtgtcccagtaatctctctgtcacccagggatcaaagatttacagatgtgtaggagagatggggaggaacacactaagatatgtccttgtgagtttagttaactaaaagactgggggaaagaaagggaagtaagaaaataaagtgaaaaggtggaagaaggcagagtgtaaaagagggagataaggaaagtacaaaagatagagatgtctgctgcaatttctcagtactcttcagatacatcctggccaggtttactttcttaggggcagggtagattgtgagggtgtggaaaatggtattttttcaaagagagtcacaatagtattgccatctcacatgctgttatacaatgtgatcttgccatttctctaccaagataaatgcagtctagtttctctccctttaaatctgagctggccgtaagacttgcatgaacaataaaatgtggtggaagttattccaagtgacttctgaggcttggtcagaagcagctttcccttagttactttgagacatttgttctgagggaagccaatctgactacctgaggccattgtgctggagaagccacacattggcattcctgttgacaatcctagctgaaccctgccttctaatcatttccctcaaggcttatcaaataagtgaatgaagctatcttggactctccagaccagcccatgctgcagctaagtattactgatcaatttcactttataccacagggagcggaagaatcacctagctgagccctacccaaattcctgctgtgtttgtgcctagattttttttataaaacaaaacacactggaacaggatggcaggagatttttttgtttttgttttttaaacgcttgtttcaaacagcaatgaaaaatccttaaaaatgtataaataagacttcaagattttagaggtgtgaaatttcaaaagaaatctggaggctgggcgtggtggctcacgcctgtaatcccagcactttgggaggctgaggcaggtggatcacaaggtcaggagatcgagaccatcctggctaacacagtgaaaccccgtctctactaaaaaatacaaaaaattaactgggcgtggtggcaggcgcctatagtcccaggtactcaggaggctgaggcaggagaatggcatgaacctgggaggtggagcttgcagtgagccaagatcgtgccactgcactccagcctgggtgacagagtaagattccgtctcaaaaaaaaaaaaaaaagaaatctggaagccaactttcaatttgcccattaaggactttagtacaaaactaccatcttctataggtcattatatcgtttttgtttttgagacagagtctcactctgccacacacattgcagtgcagtggcgcagtcttggttcactgcaccctccctgtcccaggctcaaatcgtcctcccacctcagccttccaagtagccaggaatacaggtatgcactaccatgcccaactaatttttaatttttttttagtagagatgaggtctcaatgaagcagtgttgttgcctggggtaaatacccgggttcatcatctcgagccaagaagattaaggacatgaacacacatgaagagtaagtttaggagcagaggtttaataggcaaaagaaagagaaaggagaacagctctctcccttgcaaaagagaggggctcccaaaggggaaaacccagcctgcggtggactacacccgattttataggcaagcttgagaaggcagtgtctgatttatgtagggttcacagattggtttgaccagtatgatgtttacatagtattcacggaaggctgcatgccccaccctaatcttattatgtaaatggagtctttgcctggctggcgccatattgtcttctccttactgtacatgtggtttgacaaagggaagggaagatgaagctgccattttgaacatgcctagtcccaggtagccttttcctgttggcacaactgctggcattcacctgtacaagcttccagcttgcttacctatgtctgcagctcgattttacaggctgctctttgtagaaaaaaaaacaaaaaactattttgagactgcttttcatgaaaagaaaaaccttaccaaggactcccagaccctcactatctgcctaagtaatttcttcttaactcctgtatcattactatattgcccaggctggtctcaaattcctgggctcaagtgatcctcccaccttagcctcccaaagtgctaggattacaggcatgagccactgtgcccagccatgttgtattttttaaagtacagtttatcatgaaaaagggagaaaaggtactacatccaaccagaatggctaaaatgaaagagataaacactatcaaattttgacaaagatatgaaacaaccagaactctcatatatgcctggtggcagtgtaaaatggcatagccactttaggaaatagcttggtagtatccactaaagctgaaaatatgcatatattcaattgtattcttaagtatatatcctacaaaaatttatgagcgttttaaccaaaagatctgtgtacaaatgtccatagcagtaatcttttctt

SEQ ID NO: 3003 - DNA, 5231 bp, Homo sapiens
gcctaattccactgtgtaacttccatgcataacactcagaagccagttaagtacagtgctgaagcaggacaaaaaataatatccaaagatattttggcactaacggcgctatctgtagcaagaaagttgagcagtgtgaactgttgagacttccaaggagacttcagacaaccaagacagtgtaaaggaaaacagagaaaaagacttgttagacattattaagggcacgaaagttgaattgagcacagtaaatgtacaaacaacaaagccacccaacagaagttcacttaaaagctacaactggcgggcctcaaagagctttaggacatgctccaaagaagagaaatgagcccctgagtcctgagttggtggcagctgcatctgctgctctgttttgacaagcaaacaagccagaactgctcaggcagctccgtagcatgaggaagagtcaggggcacagagagatggagagagacctagttaggtaagtgaatcaaaccattaggttagtaatgtttatatctcaaaataggccattttcatgtggctagtaagtaatacacataatatataccacataagtggaatttacatatagaatataccatataagtagaattttagcaattcaagtttttaaaaaacttatgtcttaagtaagattatagttttaagagaccaattgaatagttactgtccttttaggaagttacagtttcttgtccatgaaacaaggaatgataaattcagtaatgttattaaaaataacagaataagatagcttttctgagaaaagtaatttttttttcagttaaatagcttgctggttttatgcatggtatagcaatcttcaggtctgtttccttctctttttcctcctattcttatgtttaagctgacatctttccacttactctcttcatctctcattattttatgctacgttagactccttgctgcctacattgtagtaagtggtaacactgcttcattttggagagtgatctaaatctgttattcccaatgagcgtgtgtaccagatgtatttcgggaagttaaaagaaatggccatgtgtggtggctcatgcccgtaatcccagcactttgtgaggctgaggtgagaggatcacttgaggccaggaatttgagaccagtctgggcagcaaaacaagaccccatctttacaaaccataaaaaaattagctgggcattgtggcatgtgccggcagttctagctactttgggggctaaggctggaggatggcttaagtccagagtttgaggctgcattgagttaagataggcaccactgccctccagtctgggcgacagcgagagaccctgtctctgaaagaaattatatttaaaaaaaaagaaaaccataaatatctgtactgtcagttcagtgactcattttgtttgtgtttgaacaaatacaagggcaataaataaatacatctatcttggttttaatttagttattgaatataggtgataggcatacagatactgattgtactttctgttcattttcttggaataatttttcatgtgacacttttatgtttgaaatgaatatttctgaagaacatctttaaaagacaagtaaacaaaaattgtaatgttctgttatgtgaatgttaatagatgactttttaaaatttaatttaaacataactttgtatgctgtataattagtggataaaaatgaaataagaattaaatgttatcactgtcctgtttcagaaagtttattactgttctgtagctaaggtttctttatttttttatttttttggagacaaagtttcactcttgtctcctcggctggactgcaatggtgcgatttcggcttactgcaacctccacctcctgggttcaagcgattctcctgcctcagcctcccaagtagctgggattactggtgcctgccactgtgcccagctaattttgtacttttagtagagaggggggtttctccatgttggcctggctggtcttgaactcctgacctcaggtcatccacccgccttggcctcccaaaatgctgggattacaggtgtgagccaccgatcctggctgtagctgagatttctaatgcacttgacctttttattatttcagtttcaataacaaaatatcagatatgaaaattgccagatgtgctacagctagaattaatataaggccagagcatcagattcagtttgaccaaggctatgacaattatcctggcctggagaagactgctgatcttagaaacaggtatcaggctttgtagtctgctgggttttgtttgtatagtttggttttaccttgactgtagatttaccttattgtgggtgtgtatgattgctgttggatatgtgagcattatgaatgcatttacatctgtgttcttactctctgtataccacttcctagagagggaaccatgtgctggagttagccagtcctgcatttttctataccttaaatcaaaataggccatgcttcatatctacccatgatgaatagggttcctttgatttagaataaatagagctgactgaattctgaacaagtgagtattttgtaagaaacattatttttcattttaaatatcaatgcctaatactgtgtattcatttaccctttatatctctatacatgcttatcttttgttacaccttagagaaatgacccaccatcaacgaaaagaaagaaaggcgtaggctgggcatggtggctcacgcctgtaatcccagcaatttagagggccgaggcaggcggatcacgaggtcgggagttcaagaccaacctggctaacatggtgaaaccccatctctactaaaaatacaaaaattagccggacgtggtggtgagctcctgcaatcccagctactcaggaggctgaggcaggagaattgcttgaatctgggaggtggaggttgcagtgagccaagatcgtgccactgtaccctatagcttaaaatggtagattatttgtggctatttgaaattactgaagttcttaaagatggtgagccatgtcttacatagttattttagaatctaaagttgttctgtatttacataaagtttctattctttctctcctttaaaccctgaaagtggtagttgagaaggaggagccagatatttggcatggtctgacaaaagttaacgtgtcttttatttatttatttgtttatttttttgagacggagtctcactctgtcgcccaggctggagtgaagtggcaccatcttggcccactgcaacctctgcctcctgggttctagcgattctcctgacagcctccccagtagctgggattacaggtgtgcaccaccatgcccagctcatttttgtatttttagtagagacagggtttcaccatgttggccaggctggtaactcctgacctcaagtgatctgcccacctcggcctcccaaagtgctgggattacaggtgtgagccaccacgcccggcctaacctgtctttatagcaggatatgctcacagttggagtgttttcaatacattgtgtattccgtggatttgttttaagtaaaatcaggcacttgagttaactccttctgggtgttaaattagtgatttatacaggaaagttggaaaaggtggttagcagttaacacaggaagttcaagagtttatggtgactttggaatattatttgaattactaatttaaagtgatttagtatctgttacatattattgaataaagtagaaagtgttcttggagttttacttaagaatgtttaactgagtcagttaataccggagaaaatttaactgaatcattcagcttgcatataatactgtgcagctacatcgggatggcatatttgatttttaatattagatttgatatttaatattttaaaaattaggtggcaaaggagaaactaaaaaagtaggaaaggggttcctgtgccttcagtgtgttaaaaagccagctaaaggggagtaaggggaagcaatggtgagatgccaagttgttcaccctgatatgacttgggcagggtctggggtatcaaccccagacaacccaggcctggacttattgcttctgttggaaattgacagttcacactggcctttctcagaatgttggcactgccactgactaattctgtgaccggggcaccttttatagcctccatcagcctgtttccccagctgtaaaatgctgaaagtgaaacctagcttaaatggctttcttgaggaatagaaaagaaaccacgtataaactctctggtacatagtaggtgctcagcaaatgtccattccctttctctgttgtgcattcctcttttgaagttcagtgctttaccaaggcatttcctctctgccgtgacttgctttaatccaccatcctgttcaccggacgttcggttgagaaagaagaatgcaaggcactgaggaaagttctggagcagaaaagcctttgtttacaaataacttgggaacctgctagaggaaaacttgtatgacttgaaatcacattacttaatgttcatatgatattttcattttttccggttctatttagtagagaaaagtagtttagtccataaaaaaagaatttagaattatttttaaaattagccctccagtttataaactggattttaatctgccagtaagtttattcaagtaaatatgtaaattgatgcataaaacagttgattatcaagtttgcaagaaaatgttacctgttaactctgatattaatttcaatggttaaaaagtcatgtaaagaaagttaattattttacagaatgattgctttatgaaagggaatgttgtgatttacctatataatcttttgtaattataatttgtaattaaacattgcagtgtttcctgcccttaaaaacaagtgttgactctttttaacagcttcttttaattataatttgtaattaaacattgcagtgtttcctgcccttaaaaacaagtgttgactctttttaacagcttctttttagcatagttttataatttttcacaacatggagtttttaaaacttaatataaaagggaacaaataaaaattaatgctaattgagctaatcttttcagttggatattttggaaattaagttgctgtaactgatttgttgtattatgaagcaaaacttcaagtgcacatttctgtttttagtctatcagtcctaaaaatgtggcaatttagctaagatgtttgatgtacgtcagtg

SEQ ID NO: 3004 - DNA, 4875 bp, Homo sapiens
ctctacccgagaagactctagttgtgagatctaacaagtataaatagtcccttatcattgacattttgtgaaaatgggcaactcttcaactttgagaaggtatacttgaggccaacaacaaggaacacataatctggtctcaggaaacattttgcatcatctggtaaagggatttctgcctcatcagattacagactacatgtgaagccttgaaggatagctccaaggagatgcgtgagcacaaggcagtgtcctcacagtgagctaggaagaggcttgcactgtcactgccagtccgtttgtgcatcagagaaggcctaagcgtaattgagcagtcattgctgtctcctccagggagaggaaccatcctcctcacagatggctgaagatcttatgaagctgaacctcccaacaaatcctcatatttcgatacaaataagaatatgattgtcaatattcatacaatgttttaaaccttatgtagcaattttgcacattcttatactctttcagaaatagtgtgggttgtgatgatagatttgggtttgaattctggttaacctgttggctatgtgatcctgggtgagttacgtaacctctcagaacatattttctcctctataaaatggtgatggtgatggtgctagggtcaaaatgataccaccttatgggataaggattggatgagagaaatacctagcttgacccataagaggcactccatttccttcccttttataaaggtggttatttgcatcagtagacctcagatttccacaatagttacatgtttatataggtgatgtgttctcttcaaacatgtctcatgttacatggtgaatttttttttaagagatagggtctcaccctgtcacctaggctggagtgcagcagcatgatcctagctcactgcagccttgaactcctgggtttaaaatatcctgccgccttagcctcctgagtagctgggactacaggtgcatgccaccacacttggttaattaaaaaaaattttttttgtaaggacagggtcttgttatgttgcccagtctggtcttgaactcctggcctcaagtgatcctcctggcttggcatcccaaagcactgggattacaggcataagccaccacacctggcctcccagtgattcttaactcagcaatggggcatggaggcgttaatatctgtattgctataaagcacccctgagcctccagactgagaattgtcagtctacagtatgataccccaagtatctctcatgagtttgatatttttgtgataccttattcttcactcttagtaggtttatttcaataaagtaaggctttgcttatatgggagggcagtgcattaagctaatgcaaattatagttgataaactaccttctcatgtatcgctgaatgccagggagcatttttgttgggggcagtgctggcgggagttttgatggaagtaatagtagagagatggagagtacacaagacctagaggagggttgattgaaccataaggaaaaacagataaaagggaaggtgagaggaattgaagacaattatcatttttctcatacagcctcatttagcaggctgagacttggctgtttcgggagtacctgctgcctctcactagaaactgccatctttatgctatcaccctgtctctcatccagtcttacctacctgaggtataagacctggactcaccacttgagttatacatggctacctgatccatctcttcaaagtcatattaaatactataagattctcagatttaatctgtcaaaacctaaatagttctccctataatgatacacgaatggttacaaataaagtttggaaactgcaaattagaaaactagagagaaaggaagtggttccagtctaccatgagcagctcataggctagatgaactgaacatagcttttggtttgttctaaggaaaggatataagaccaaagtgtccataaagttcttatttaaagtaacttttagagtttggggtaagagatctttcaattgaaactactaagaatacttcttaggccaggcaatttgaattgatgagataagataaagctgaaggtcaaagttatgactttgagaagagtcaaggcaatgccatcatcaagggagccaatcttccagtagacaggggctcctggagtgagaactacagacctgctgtttccaggctgcaaattaattgcattggcccagcagacaccatcagtaaacaagcctgccagggaatatctacttgatcctctttcacagagcaaacttccaagggctgcctgggtcccatccttattttgttatcatcttcaagtgagtccaagtgcacagcaatgaaaaaaatgcatgtgtagactaaagaaaagagtaacataacggtgcgttggaccatgaagtgatagatagcttcatgaggaaagaagaattttggagggaccttgattatgggcaaaatttaaagaaagatgggagacagcaaatgtatccatacttctggaatgttttagcttttggcacttaggtttgagcatccccagatgtctgtggtgtacctcataatctggtccttgcagttgggctgatgtgataacatctgttatctaaggtatctactgtgtgctcatggacaaggcatctgtttctgtgactctgtttattttcattgatgactcccatattgaaactcctgggaatgattccatgaaagatgaaataagccaaggttcgaaggagcaaacagttcaaacacatagtaatatagtgggaattagagcagcctgatggatgtgtggagacttcaccagctggaagcagactgggaattacaagtttcatcaacagaaccaaagcacatgacatacgccacagggcagaatccttattatgtaataataacccctgcacacttctctcccccagttaacaatgcacagattgaggtcattgtgtatttacaacctggagatagctgacagcccatacttcaccttgaagtttgacttgtctgttccctcaaatgtgtcgacacttctgaaatgttttctcctttggcacatcggtttgaacatccccagatgtctatggtgtacctcaaaatctggtccttgcagtcggggtgatatgacacatctgttgtctaatgtacctactgtgtgctcacggacaaagccaaataattaatctgggccgggattgttcatgctttcacagttcggttcggcattgatctcttcttgcagaaggcctatattgggaccaaactgggaatgcaacagggcaaagttggtctaaaaatcctctgggaattttccatttggcaattaaattttctgtagattacatctctctatcaattaccagtgtggcttttataatgttataaaatctgagcatagccagttacatttcttttaccctgagtctctgggtctttatctgaaaaattaaaggactagaaaagatgactttgagttttttacagctctaatgtttgagaatttaataatttctcagtagtgaaagtcagatttcttgacaatatagcaattagtttgtccacctgtatgtactctcctacatgtatctgcctgaagcccattgctactggtatctcccaagatggaaatgtgccaagctggtataagcccagtggaatttcactaagaaactagacccagccactcagcccatactcacagtcttatctttcctcccattcatttacccattcactcaacaaacatttattgaaggcctgttaagtgttaggtactaatctttagaacctgctctatggctttttagtccatcttcccttcactcactttttttgacaaaccaggcagacaatggtgtaggaaatgtatatttaatcattctcttgaacgatcagaactctaaaatcagttttctataacaacatgtaatacagtcaccgtggctccaaggtccaggaaggcagtggttaacacatgaagagtgtgggaagggggctggaaacaaagtattcttttccttcaaagcttcattcctcaaggcctcaattcaagcagtcattgtccttgctttcaaaagtctgtgtgtgcttcatggaaggtatatgtttgttgccttaatttgaattgtggccaggcagggtctggagatctaaattcagagtaagaaaacctgagctagaactcaggcatttctcttacagaacttggcttgcagggtagaatgaagggaaagaaacttagaagctcaacaagctgaagataatcccatcaggcatttcccataggccttgtcaactctgttcactgagagatgttatcctggtgcccgatagagttctggctctctgtgctgaggcagcagccaaagagacagaatgcttatttgccaatgactaatgtgaggaagcagacagatttgttggctcccctctttccaggcccttttctactcaaaaccagggtttcttagccctgacacagttgacacttcggattgggtagttgtaatggggagacgtcctgtacatggtaggaggttgagcagcatccctggcctctatccactagttggtagtagcactgtatcctcctccactccctcattgaggtaaccaaaattgtcttcagacattcccccggagatggggggcgaaatcaccccagctgagtcccactgctctagatgctattgaaaactgaggtcttagctgtccacgcaggatggaaaggagaagcctcagagcttgtgatgacataatgccatatagacaaggtgaaaggtccttccctggaccattcacggatgaacatcatctgagaaataaacccgcatttgtttgtttaaaaagaaggtgc

SEQ ID NO: 3005 - DNA, 18701 bp, Homo sapiens
gccacccgcggccgcctccgccctgcgctttgtggagccggagcccagtgacaggcgacggcctcttgccgccccggaccccgggcgcttacctgtggctgctggggtcggccgcccgggaccaggctgggagccccgagaaacgcttcgttaagggactcaggcagtacgggaagaacttcttcagaattagaaaggagctgcttcccaataaggaaacagtgagtacaattggactttatgtaacttgattttttcctctttgctcctgctgcctctccacatttgatcttatgaaatggtttcctttaaccctgcgctgtgctcagactcgggctggcctccagaattctctccgttttactcccttgacttttaatttgagttcataatttttagatagtaaagtgacagattatgcttatccgcctggagaacatagacttctgttgtaactctgagaacagaaaggtctttgggaacagagggttagttgtgggggaaggattgttggagagttaacatcaaattttaaacatagtggctggaataggaaatagcattttatcactagtttgaatttggtaattggcagaaatcatcaaccaaaccagaggtttgtggcttattatactttgagttctgggggattttttccatttttcaatgttgctctgttttgaagaggagttttaactctttaatattctatccctgagagtttgcactttccactggacagatgtacaaggggatcttataaattgcttaaatggagctttacaaaaaactacttagtatttcacaaagctgggggtcagagctgacaaatgtgcccgataaacgtgaggtagaaggatttgctgaggaaaatacagagtgaaattatatgaagagaatgcggggaagggattcattctcatttccctgtggttgcctccctcctcatctccttccctggtggtgtagaggcagatggggagagagtcttccctctggctaggccacgggatagggcagatgggatggagttggagcagccactccactgtctgaaggcgaagggaggactcattaaccagaaacactcttcaggactttgggaggagtgatccatgtttaatctgcctagacattgagctgcttttttagggagtggaggtgggagatggatgcaagaatatctactataaaagtatgcggataatttgggttttttggcttaattttttaattggatgttgtttactgatttcctcttgtttaattctgtctttttaaaaatgagctgtttttctggacacttactgtatagtacctcaaggacagtgataactcatggggaagaagggttttgtgatttcaagtatagtcttgtatatataaatggatgatttgcatcagtcaatgacaattaaatttaagtattacgcatctcatatgctaggatggatcatattgagaatggtaaaaaacagagagagagaaacctgtttatgaacattaaactaagatgtattatgatgccaatctatataatcaacttatttcttacccttcccagaacagggtagagttatttaatatggaatattgagatacatattttaagttttctggggatttcagtgacttgaagtttgatatgattaaaaattaaaatgcctttgcccgagtgtaggaagtttggtttggctgagtaaaaaagagatcagtgagtagatttctcctgatcgctcagattgtagcctctcaagttctctgtctctgctctgctaaaagttgcaaaccatgaagaatttgatacagaactatcttgacaattattttatctttcagttttaaaaaataaattcataattggaagattaagcattaaatctaaattctaccatctggcatttggaaatgctcggtaattttacttagtgttttatctccgtagtggaagcagatgtgagtaacctttaacctagttaagttcttctactatgtttttctttttgctcttgattttcccttcttattgatgatgtgtgactccgtaaataaatagccttttttctccttcagaggcattctcagtacaccaaccttttgagctagttctctggttgtcttttccactagcctctttgctgagacctttccccatcactcctccgccttcacagtttcccacgctgtagctcttctcccttctctagcacccagcagttttcctatttccaaagtcttcatcagtcaccatcattggaactaatgagagagttgtttgcagcaatggaggatttattatgcctgacatttgctaaatattcatagtgtccttgctgtcttttgcattgcactggaggagtttggtagtagggtaaatctgtaagtattataatgagctgggagaggcactcatcttgtgttttcttattttctctagttatcaacatagccaagctaatcattcacagcccacagggaggggagggcagaggtcattttttactttttgctgcagaagatgagatttgcatgtaccagtgttgttgattcagaacttgctgggtagaattcttatagtcatgccccttttgatagcaaatccctctaatatagatacttttcacattctctctctctttctctctctctcttttttaatgagacaagatctaactctgttgccctggctggtctcaaactcctgggctcaagtgatcctcccctgaatagctgggattacaggtgcacgctaccatgcctggcttacattttcttctgtctaccagaattattaactcatttctttgttattcgcaagtgacttggaacttgagaagggtgtcagcatccaaaagaacatgcctgattgggcattggtgcaagggtcagcagacctgtgttctattcttggccttactggtaactatagtacttgatgatctctttttaattgtgcagtctgccttgagctgttcattggaaagctcaggtcaaatcttgacaacactgggaagttattttctgtaaaatggtgtttctctgcatgagaattgtgtaggtgctgtggtcgttataaaatgcctgtacgtcgttacttgctgcagtgcctgagaacgaagtgatgattcttgccttctctgctacttacttgctctggaaccttaggcagattattcatcccctctgtcctttaatttctgcgtttgtaaaatggggtgataattcctacccttttgattattttgagaatttaaatgagataatgtttgtaaagagtgcatagaaatacttggaaatgattgttcttcctgtctaccttaaatactacataaggtggtagctaaatgctttgaaaagtacagaattcctttctgcttgtaaatatactgagcctgtataaaaataagttacctgtttttcattaatctgtcttgccaaaaacttggagggcagcaactagttaacaacgtccgtcttgaagctttgttgagacctcattcttaccagttcattcatgcggttatagcagagaagggttcctggtgggcatagacgtaaacagctttcctagctcttttggtttctggtgtttattgcacaagagctaaatctggcttttctctgaacactgctgcccactgaagtgggaatagtggctgtgattgcggaaaacccaactgtttatagaggcttagttgaatgggtattacgtgttaacctcagggtacccaagagaataactacaagtcaaatcttttagtgtcatggttgtgcaaatatcctgtagtttattatactttttcccattctctgtttctctataaccatttacctcccctcaatatgcttataaagtatataattagtaggtgaaatgtagtcaggaatacgggtggagcattttagattcaccttggctgtatacctcttctctgtcaagccactgtttgtcataaaccacatcagagtcttaagtgttagtatatttgtataagtcacagagcgcccggtgtctgaacttttgggaggacagtggagaactaggcctcttgattctgctttgagccctgccacttattgttgggtagatggatggtacatgagctttgatgttaaggtaatgcctgaaaaagtaggaggcctaatagagaatcttaattacctaaaggtgaatccatgttaggaataacacaaaatcgtggatgatccaaaaataattttttgtttgatttgtctatacattgcagttttcttcaaaatcatgagataattattcaagcagtggtgacatatctcttctctgaggacatatcagttatttgaaccaaagactttttgtgtctggcacctggatgattgtcccttgaatcctggcctttgtttatagctgtgtctcctattacttagacaaattcagctggcactgggtcgtagtccaggagcgcttcctcagtgacctgccgttgcttgtctctggtgcaactaagattggtgagaagacaatgtgatctaccccagcttggtagccaagaggtgttcccaaagtgttagcccctggagggagatggaaggtgaaaggggacatgctttggctgtctttctcgtctctttctttttatttttgagcacctagcccagtgaagattaagcttgtgtcatttgtaatcccagttggtggtgcattgacacttactacactggaaactcattttcattcacttcccattatcagaactaaattttgtgtatagttcaattttttaaagttctgggtgcccactgagcactgcaatgggtagggtatctataaagagaagcaaggtgccatccctgccctgcagggagccagcacgacatttacatacctgccatacttggtagaatgtgctgagggccctggtgggtggaggttcaggccccacaaagtgagcacagaggctcctggaaagctaattggaggggcggtgtttgaactgggctttgaaggaaggattcatttttgacaggcccaggttgggagggtagaggaaaagcaactttccagccataggaaatactatgaacaaaggcacggagacaggaaattgtaaaacgtgcccagcaagtacatgagcatggttggaaaggaggttgcataagcggatgcagtagaacttgggcccaaattatagctgcagggtagattttgggggaccttgaattccctccaaagaatgtgtatgggtgagtgtggggatgggacccatttaaggcttttaagaagagaagtgagggctgtgctaccgaagtatgtataggatgggaccaaagaggaggctcttcttataatttagtcttgtaggaagacagatagggacttgaaagttcaaagttaatgggaagggaagcctgccttctatcttcattttctctattggaaatgtgtcactgtttggcaccaagggcccagtgaaagggcagccagttttgacgtttttaactttaagtaatgggatgaaaggtattagagatttaaatttttaatttaataaataacatgaaaatcaaccacctttcttagccacatttctgggaatgaattctattaaatacgtacgtaactactggccattaactgtacttttttcttcaggcaaaatgtcatttgcatagaccatattcctgcagcagagaataaatgctattgagaaagggctttaagactgagtaatcaggtttctgttaatattaagaggttaaaaatgattctagtattcaatatgagcttccagcctgaagttttatttaatttcaggttataaccttaaataaacaattttcctagcctcattaatgcttaatctaatgttgcataacaaagtatggacttccttagtcggttgatgctactgagaatgtgcaaatgtgtcacggccacataccagtacattagaagatctctgtttttaaaccttgtccctcttctacaaacgttgtctatcctcactgctcacagtgtgctcctcaggccagcactctcatcactggttaaaatggaagattctcaggccctgtccttgtctcttgagccagaatctgcattttaacggaccccccagaggattccaaagtactgtaaagtttaggaagcaccgctatttacagtaatgcagacttgcagaattctgagcctgcatagtatatcattcttaaaatgatactgtctttattctgttaaaattgtaaagtttcactattagggcttgattttgtttttctaattattgcaaaatatttcaaacagaaaagtatcagggcttatttccattgtcaataataggatttcttttcttttcttttcttttcttttttttttttttttggagatggagtctcgctctgtcgcccaggctggagtgcagttatgcagtctcggctcactgcaagctccgcctcccaggttcacgccattctcctgcctcagcctcccgagtagctgggactacaggcgcccgccaccacgcctggctaattttttgtgtttttagtagagacggggttttcaccatgttaaccaggatggtctcgatctcctgaccttgtgatccgcccgccttggcctcccaaagtgctgggattacaggtgtgagccaccgcgcctgaccgtgagccaggacttctcaatatagttttcttctcaattcccactcccatgtttttctagaaacatgattgtaactcctgtcttacttgatacaaaagctcttgttctctttaccttgtggcatgcagtctagttagaccttgccagattctatttcagtttttaataagcctttttatgtggaaggatggccttctcttgttaactgaagtttacatagtcataaaggtttaataccacagtgttttcgggcattgctttcttttattggcattccttatgtatgaaaaagaaatataagttatttgaggggctggcaagatgggtaagaggaaagacatttatgtgccatactgtttttcttaataatttgtgctcacatagatataaacagttggaattttccatttgaggccaaagtgattgccagtagaaacaggcactgcattttggcagtaagtactgtgatcctatagctattcctgtgctgagagtttgttcccattaaaatggagccgaggctcgaatctattaattgtgatagtctgaactatagggatatttgcctgggcagtggtccagttttcgtgagggtaatctatgagagactggctgatattcccttgtgtaagtgaagtacgtaagagacttttggtgctggtgttggaaagaaaaggaggtattaaaaaattgggtgactttttaaaccaagggccttggacagttgccgttctcagtgtaaacagcctgaccttggcgttatcctacatatgaaaactagtggggatggcatgagaatgctttaattatttgaaatgtattacttatagaaactgcactcaaatgaagtatgcttggggcttttaaagtgttattgaacaaaatgttgcttgcagggatttatttgctgttggtatttgctaacctatatttcttatgatttggctgtgtcttggttacctggatgacttttagatggagacatttatgactttgaagcctaaatagtctgcaccattttattagctagtaaaacaaatggaaggtttgaattggtctttagaaagacttacaagttgtggttgctgtggttaacagtcaatggatttatccacttggagcttatattttatatcatagattcttttttagccttgtaagatctattctgactttgaaaactagtttgctgatattttaaaaatatatctatctagtctgttaggaaaccgacattaaaactaagtttcaaaatgtatctgaaattataatccttgaataactagttcatttttaatcttatttgaaactatacccttgagtaatacttaggaaaatagagtaaaaattaatagtattgttttgaaaagtaaagcaaagcattaacctcagtctcagtcccagctgctcagcatgggaaaggcatccccctactcccagtaagattttttttttcctgtcatgtataatttgaaaaccattaattgtgttaggtaaataggaaaagcaaacaggagcaaccttcctttgggataccagaattccattaagctaagttttccgagatgttgaattttttaattaagtttcagtattaatggcccatgtttcttccccccaccgacccccccactttggaaatataattctttgttctgctcaagtgtcttaaatccttcttctgaatcctctcaattgtggtatcataatccccaggatttgactattgaaatgttatttatttatttagagacggaatctccctctgttgcccaggctggagtgcagtggcgcgatctcagctcaccgcaacctccacctcccgggttcaagtgattctcctgcctcagcctcccaagtagctaggactacaggcatgcgccaccatgcccagctgagttttgtatttttagtagagttttagtagagatggggtttcaccatgttggccagcatgctcttgatctcttgacctcatgattcgcccgcctctgcctcccaaagtgctgggattacaggtgtgagccaccacgcccggccgactattgaaatatctaaactatcccagttgacaaagttgggattttgggggagcttttggtaaccccaggcctgtgctgtctaggatgggatgtctgaggtgaataagggtgcttaccttcatggcccctagtgaaggggccaggtgggccaggggtcttctctgaaaggtatctgagtcccctcatttcttttttttttttttttttgagatggagtttcactcttgttgcccaggctggagtgcaatggcacaatctcagctcaccacagcctccgtctcccgggttcaagcaattctcctccctcttcctcccgaatggctgggattataggcatgcgccaccatgcctggctaattttgtatttttagtagagatgaggtttcactgtgttggccaggctggtcttgaactcccgacctcagatgatacacccaccttggcctcccaaagtgctgggatcacaggcatgagccatggtgccctgctaaagttccctcatttctaacggtcttgctggggctgcctctgctcctccccaggctggttgctgttacacaaagggcccatttcatctcagcagagttgggttttgttccaccctcttcaaattaagattgggcaggtacagtggctcatgtctgtaatcccagcactttgggaggttgaggtgggaggatcacttgagcccaggagttcaagtctagcctaggcaacatggtgaaaccccatctctacaaaaaatacaaaaaattagctgggtatggtgacacgcacctgtagttacagctactcgggaggctgaggtgggaggatcacttgagcccaggaggtcgaggctgcagtgagccaagatcacgctgctatgctccagcctgggcaacagagtagtctcaaaaacaacaacaacaacaaaaaacaaaattaaaatttattttattttattcttggacttgactctgattcctcttttccatgcatttttactctgcacacatgtgtgcatgaatgcatatatgtatttatatagaatataaagccttctgggcagggacctcattttaatacctctttatggcacccttagagtcctgtaacagcccttactttttatttgcttaaaatgaagtatgtgtgtgtgtgttcacgcatgtataaataataggttcgaaatacattgtaatcatgggtagataattaatggtcctaagacgtgaaaactcttcattgtttttaaacgaacattttcctcatcttttgctcttcagtgtgagcaaaatctaacagaccaaaggaaaaaaaaatccatcaacagtcataggaagcttacaaagcttcggagatctggcaccaccaaagcttctccacctgatctgctttgaaatgctctttttaagaccagtttgaaacctggatatcccaggccttagactttgtgtaatagacagaaaacccctgtgaactctactgtcccaggacaatgggtctaggacttggggttcactctgccacactggtccttcctgttctgtttattgtgcgcagtaaatcaactctcctgtttgcgcagcggttctgtgttctagattatttataagattgaaatccattgtttatttttctcagcaggtttattgagccagtcaagaataaaatactgtcttaagcagtagagtaagccattagccaattgcaacttggcttcaaattaatccctaaagggtgtgcacatgaacacacacactttgtatgtcccacatacatgtgtgtactggaggtgagagccaggggaggtggaggagctttagtggtgccagatctctgcagctttgtaagcttcctatgactgttgacggatattttttccttttagtctgttagtgagtcatcatcatatgccattttattatcttgaaaacagtctgtggaattttttatcccgtgtctttgctgtatgagtgaaccaccacagagggtgtcgggagcaatattaagctggagactttcttcagtgatgcttcgcttatgtatttgcagctgctgccattgtcgctttgttcccatgtgcaggagttggatttttttgattgttgtttggcaagaaatattaatagtaacttttgtgtgtttgattattttcggggccggagcagcatctgtccagcacctttgggatttggtggttattgacttaggcacagggcttctaagatcagaacttggttcttcttcccacaagtgctctgttttggaaatgtgctaatgacacacattgaattatgtcagaggtttgtggccttaagttgtcgagggaggtgttttcatttggcgagaatctgtaatttgtggaacaataggattaagttctaaaggaaataggcccgatgaatctgtatagatggctagtttcgcaaagtaaagcacagagccagtgaactgggggcaaactacacgttttggataatgtgagcctaaaaagaaaaaccctaaaacttttaaataaatttctaaaaaccaaaaccttttagtatatgtaatttactggcttaaaactataaatattatagttttaataattttgtagatcaggaatttaggtgggactcagctggccatttgtttccatgtcatgtatccaaagctcactctgtagtatcacctggtagatgggttgacctgaaaggtccaaggtggcttcccttatgtgtctgccaccttacgggagatgggtgggaagctggctcatctggggctattaaccagaatactggcatttgtcctgtcctctggggtggatttgcccatcaaaacttgaagttctagcagggcagggtagatactcctactatagttccaactacctgggaggctgaggcaggaggatatctttagttcagcccgagcaagctagcaagaccccatctctttaaaaaaaaaaaaaaaaagacttgaagcccttatttcttttgatcttgtaaatctatcaggtgactcaggagaaaagtccatgtgcctctctccattttatggccaccagatgagttgaaggatgtaatgcttctttatgtagtaattttgtatttttattaagatgtccatgtttaccaataggaatacccatttgtccaatatatcttagactcatacaaaagtgtaccattttcttttgtacagtactctgttctagttattatttctccaaatgctacataccttaccaggcatgtctataaatacttacatttgttgcaacatttttctggaaatctgtcatttggaatgtttaactagatagtgtgaatgtaaaatgctcctagtttattcctgatgctagtcaatcatcaagcacttactgaacttattgagcatggggagaaaaatagtgagctgcggttgtgctccctgggggtgtcttactggctgccacggtgcatactggagggaaaccaagtgccgaacaatgtagtgtggatattaaatagtaatgggaggatgaaggcttggggagtcttgtgcatcctggaagatggacacttggggcttcaagctctttgaaggatgggtgttttcaatgttaaaacttgtttgaaaggccttgccgaaggaagtccttgaagtagctttcttgtctgttgaggtatttctcactacctgaatcttctacagcattcctgcagactggggacatcgaacccattaaatgaagccattgtggttttgaacagttccatttttcgggccgccttccttttattaagctgaaatctgtatcacttcaccttccatacattgttctgatctcgtcccttggagacttagaggattcttgccataacgtcttcctcatggaggctcttcatgtgggcctgtgtagttggcacaccccctgcctgggcttctggctataggctgctcaggcctctgcttcctgcaacagccgttctgggtgaggtcttgtggacctttatcattcggccctttgtaaaaattgatgtctacaaagaggagaaagtggcaacaatggccccagccgtgtcccccagccagggcggcccccctcccctgcccagccctccttacccagcaggcaggcaggtatgcatgcatgtgtgttaacttagtgcctcctgggtgtgcatcagtgcacagttcctagactaacataaagtcacatataggttgtgtttgttctgttgagttgagcatgtctttatcccagctctcatttcccacaatgagaaagcattaatgttcggatttagtaaaaaaaaaaaaaaaaaaaaaaaaaaaattgcctgattgaatagtgcatacccaggctaaccattaattacaccatttcgacacttagaatggacctgagcaaagatttccagtgccagagcccaacatcatcatgcatgaaatagtaggctctttgctcctgggagagggaccattagctttgatcatgtcgccaggccctccccaggaacttgtccatgctgataatcttagcaccagttaatttctcaacccattcctacatgttttgataaactgtggctaaagattaagatagcaaccatttagcagacatacgccttcatgagtgtgctgcttttgtttcaaatcatctgttgaaagaaaagcttgaaagacagagttctccattttgccctctcataaacaaaaattctggaaatgagctgttcacagactggcctaggagccctggattttaaggtaaaatcattgctttgggatttgctgtcagtccaaattggactttctgcttttcattgagccttccccctgcttctattcctctccccaaaacagtgctgctcacaggaactgtgtcccgacagaagtgtggacagttctccttttctctctgctgcctcatgcggttgttagaacaagctaattccatctgagtaggtagtatagcttttctttctgtttactattgctgggtgacaggagagcaagggcagaagttatggtagatagctcagctttacaaccattgtcggggctaaacatgaatcctcagcaatcgggttggccattcctcttctcaaacgttgtactccctctgctggttttgagacaactgatatttccttaagaagtgtgaggctctgccttcaaaacggcacagtctcttttccccagatctgcaactgtgtgtgttgcacacccacaaagaagacagttctttctggctgtggggaaatgatttcagttcttgggcaaggatggcaaggaataaatgtagaagaaattcctttctgataccattctcctacctcacatcctacccccaaatcattgcgggacatttagacttgtttgggggacccccaaacacagcattctcaggcgttgtattcacttctacttgttttctttgaccaccaccacctcctgccccaagcccagcctccacctccccgcagcactcacggcaggagtcattttttatagcacacataacctttacaccaaaaggaaaaagtgcattgcttgtaacaaaatgaatctcttttctgcttttattttgaaaagtcctccctgttgtttaatgtggaggatattcatgctgaaagcctgttccaagtaggcatttgtgcgtcccagaggaacttttgatttatttccttaactctgccctcctttctctgtggttcagaaacctttaatgatctgtgaagctcagagacttcagtgcgaaacagtagtcgttttaagaacccctcccactatataaaaggcctgccagtttccacatgctgggtttttgactccctgaaaggctgacctcttacaaattttggttgtacagcagggcatcctgggttggggccttgataatgcttttgtgaaatctttttccctcctcctcttgctctctttgaaagttgtaatgaaaattccgggctcttggccagcctgtgggatgtgatacagtagaaatgtttctggtgccctttgttactactcggctttgattaggtttatttcccgtaagcttgattttgctagcccttcccccaccctccctttttttaatggctgaggaggttaacttagccaaggttaagcgttttattatgcaggctgcttcaacctagtagagtcactttggccaggcttttgtggcagagagagacaaggggaagctatgttctccctctgtgtttgcatttcttcctcccaaggctgccttttacttttaatgccagcgttcatagaaggtaacaagctaggtaagctgtattggtttcccatttctttactcagaatgttccaggaaaccattgtacaacttgtcttgagattttgttagtcaaggtaaaaatcatggtagacctctctagggtttctgccaggtggagggcaaggccttgagagccgcagttaacagcagcacgcctttgatcctccctgtggttctctgtttcaaaagaaagaagtggctgcagctttaaaaaggttttaaatgctgctttgaccttgtatttatagctctttcgcccttgccattaagaacattttatagacatcagctcagcagtcatccccataagtctacgggggctgccagtatcattccacatgcacaggtggagaaactgaggcacggtgatactaaaaatggcaccctcacaggtcttgtccaggtcatggggtggggatgagccaagaactagggccttgagaggtaggcttcccccacagagcttctgttgcaagtgcttgcatctgggacaagatttgctttttatagaaaaaaaaagtggaattttattatcttagacattctttgttcacagtaggattccttggccaccttataaagtataaatgtatgtgcttcctttgtatcctagagctgttgagatgcgaactgtctcataaggtagcagaaagcactgtgatggaagcttctgtttcatcggtgtcctggaatctgctccatccccttctctaggcagcaatatggtcctgcttccttctgggtttaggtcctgggagcctgtcacaattctgtcacacaaaaagagaattccgtaatgaccagcacagctgtatcatttcaaggttctatgctaaaaatgtgcagatcaccaaatagttggccactgagagagcctgtaccacagagggtttcctaatgcgaatgcctgccccaaacactgcagacagcactttctggacttcatcctccatgttcattaactttccactgatttaacagttctaaccagagttattcttgatctttgatgaagtagatttttgaacctcgggtgtcgggtgttttgttgtggagatgatgcgggctctgtagcacatttgtggcagggttcttttcaccctccacaaagttgtatgagctctgactcttgcctgggctgaaaatgcggtctaaaattatatatgtacgtagtacttcttaggttttttaagatcctcactggactaaatggaagagaattctaaattctcaacgtgttctaattattctgaactattctccctctcccaaaaacacatacagatacacacaaatttattttgtgtgtaacccttgactttcagaaagtttgggttattctatgcataattttttaaaaaaccatttggtttaaaataatttcaaacttaaagaatttgcaagaagagtataaagcattcccatatattctttacccagattctccaaatattaacatcttatcacattatttaaccctccttttgtgtgtgtgcgtgtgtggttttccccccacatgaaccatttgagagtaagttgcggacctgttgcccctttattcctaaaaatgcaccttaaaaagtaaaaaagttgcattactgctttcttctcttgaaaatattaatctgactggggacagcatcatgcctataatcttagcacttctggaggccaaggagggaggatcggttgagcccaggagttcgagaccagtctgggcaacatcgtgagaccctgtctctacaaaaaaataaaaataaaaaaattagccaggtgtagtgccacacacctgtagtcatttgaacccaggaggttgaggccgtagtgatccgggatcacaccactgcgctccagcctgggaaacagagtgagaccctgtctcgatttaaaaaaatattaatctggtggattgactcactcagaatcctactgctgcagttaaaaatcatagtacatttaagtttggctttgtagttgttagggggaaagggaaggggtctgtttttagtaatttttttcccccttgaaaacacagaaaaatttacagtagaaaattaaaatcaggccggctgcggtggctcacacctgtaatcccagcactttgggaggctgaggcgggtagatcatgaggtcaggagatcaagaccatcctggccaacatggtgaaactctctctactaaaaatacaaaaattagctgggcgtggtggcgtgtgcatgtagtcccagctactcaggaaaatgaggcaggagaatcgcttgaaccaggaagttggaggttgcagtgagccgagatcgcaccactgcactccagcctggcaacagagtgagactccgtctcgaaaataaaaagaaaaatcagtaattccatcactaagagatggccactaattaacgttttggcccatattcttccgactgtttctaggcatatatcaataaatattttaaacagaaatggcctcattcagttctataacctaatttttaattttatttttattttatgactatttaaaacttatctgtattgatcttttgcttaacgcatgtatctatggagtcatttttgatggttgcatttttaaaagatatcatgttattaaccaacttctagttttgatcatttattttcagtttctggggtatttttcgggggtggttactgctgcaaaaaaatttcttaatgagtgactttgtcttatctgggggcagttatttccttaagattcattcctagaaatatttatttcaagtagtgtgtgcatttttaaggcctttggtagccagtgccttgcatcctcctgagagattatattggcataccgctaccagcagagccatgctcccttctcactcttgaccatcacttactattctttcagtgttttaacttagcctgcagtctcctttttcttcgaaaactttatgatacttcaaacaacacctctgccactccctcaccctcccccacgccccaaaaagcaaactcagaaaaccgacatatagtcagttggtttatccagagtcagagaagtggcacagggaccaggggcttcatctctccagctttggcaatattttggtgactgtctagggctaattgtcattctcaaggagggtggggtgaggagccaagctttcaggactgtgctctgggtcctccatatcacctcacccagagcagccttccacctcgccctgacacggttggcaccagtctgctgccacctagcccacccttgtaaggagctgtatgggttgtcgaccctgctgtgattttactatggtttttgattgcccaaggactcttcttctctgtctcactgttaatcaggaagtagtttagtcaacaattactgtgggagagtaatctcagattagaatctgtgggacactctgcttttaaaaacgtagggtgatttgaaatttaaaagctaagattttggccaggctcacgaacctgtagtctcagcactttgggaggctgaggcaagaggatcatttgaggccaggagtttgagaccagtctgaacatagtgagactccatctcttttttttgtttgtttgttttttttttgagacagagtctcactatgtcgccgaggcaggagtgtagtggtgcgatctcggctcactgcaagctccgcctcctgggttcatgccattctcctgcctcagcctctccgagtacctgggactacaggcgcccgccaccacgcctggctaattttttatatttttaatagag

SEQ ID NO: 3006 - DNA, 2973 bp, Homo sapiens
actcacctggcggctgccacgcgcccccgcccaggatccgaggcctggggcatctgaatgaggaccctccacccacatttccacttgggagcgagctccagtcggggaaagggcctgcagcccgcctcgtccccaccctgggaccccgcgccccccagtcccccactcccgcgccgaaggcagggccgcgccctgagccgggaagtcgaggggatggaagggaaaggagccaccggtgagggtcccccgggttctgagcctcccgcgtcgggatccgtggggcgcacagagcgccacctccggccgaggcgcagctcagagcgcgatgcgggggaggaacgcgcgcggaggccgaggtctgagcgtggctagacggctcccacgccgagaaagggcgggtgcgcctgggctggatggatttcgcctccctagaccaggagggattggaccctgactacaggtccaggtgctcgtcagtgccctgccagggggtctacgcgtcctggtaccgggtccagcggggtggcgtgctgtgcagaccccgaggctagacggcctaggcccctggagcccaggagacgcttccttggggggaacttgcggcttgggaggggacacccactgcatggcttctggaaagagccggactcgcagggccaggacgcaggccggaccccggcctcattcttcggccagttatcccggagtggcgcgcatcctgtcttcctgggcctcggactgctcgcgcgcagagggggcccgaggacacctctgtggggttagaggactcggtaagacggtgtggaaggcaaggaggaaggtcgcgttgtattggggatggggtacccgtccctcccagcttgagggatcctgggggtcctcgccgcctctgagggcctagatggctgcttccctcggctcccctgcccggcctggagctacgggtgcgcccagctagagtttagggccacctggggacgtgcaaggggcgctggagcgaggcgggggctggggcggggcgtgggtgcttcacccgcgggggacgcagagcttaggcgaaagcggtgcaggcatctctctaatcgccggccgctattaaaaataaaaccgcgacccgtcgccatggcgaccacaacaacagcggccgcgcgagggaggcgaaaacttgtgcagccgcgcgacagccgccttctggggagactcggggcacgacgcacccggcgtgggactgggacccccctgcccggccccgccacattctccgccggatccccggaagacacaaggagacgtggacccccacaggcttttttggggggattgggcgttgaaaccgcagggctgacttaaccaagaggtcaccgacttggataaaaaacccacgcccgcgcggacccccctccccggccttcgtttccattcaaactcccagcgtcctcattgcagcccctggggagggggacggagggacgaggtgggtttcaggtgctcggcccaggaggggacggtgcgacccgggccccgccggcgggttttgcgcgcggaggctgcggcacctgccccgcccgccctgccgcgatccttgcagacgggggcggtcacatgcttctttctggccaggaatcgagtttcacttccagccgctattagtcggttcacacagttcactgcaaacatttgataatgaggctaaatatactcccgcgtcggaggaggcgtgggcgtccccgcccaggcccgggagacagaggcgctgaccccgggacagagcctggctttgtgcgggaggcagacgcgccccgcgcgccgcccccgaaacattcgcaccccatgctgaggcgcgcgtctgggagtccgtgggcgccccgagaaatgaagttgaaaatagcacaggagcccactatcactgtgtgaacattttgtgaatgaagacatgtatgaaaggatgtttggaggcttcaagaaacgaaagccgagagtctagctagaccagagccatccagcccaggagcgatggccacgtgtggccgctggacacgagagacgtggccagtccaaactgtgcagtgcggttgaaaaaaacattttggatatatggtgttaaataaacatgattacaatgactttcgctgtcagcctcccggaggctcattttgctcctctgggccacagccagctcagagggttgctctaggaaatatctacacgttcttgaagcacaggtttatgtgccaggcactgtactaagtgctggggacacggcgttaagaccaggccctcacggagccctcactctctgaggaggaacaataagtcagagagcgcgcgagtgcagcccttcaggcaaaggatttcaggcccaggtcaggaaggccttgtctgaggagtctgagaagaagtcaattgacaacagctagaacatctaggtcaggcactccaggccgacacgacaaagcaggtgcaaaggccccagggcgggaaccagcgtggcttgttcacagaacaaggaggtagatcgcttgcccttgggaccaaaggaaggctctggattttattctaggggcagtggaagccgttggagggcctcaggcaggaacacaaggtgtcgtggcagaaaggaagaaggggccgggcacggtggcccacacccgtcatcccagcactttgggagggaggccaaggcaggaggatcgcttcaatccaggagttcaagatcagcctgggcaacacagcaagaccccgtctctactaaaaccctaaaacttagccaggcttggtggcatgtgcctaaggtcccaggtcctcgggagactaaggcaggaggattgcttaagcccaagagtttgaggctgcagtgaactattatcacaccactgcactcagcctgggtgacagagtgactctgtctcaaaactaaataaataaacaataattgtgttattctgtctccatttctcgcatactgaatttaag

SEQ ID NO: 3007 - DNA, 663 bp, Homo sapiens
cgcttaagggtttcaaaatgaagggcatagattttttcattctatcaacccacaaagagtatagccagcatactgaaatgcacattggttgaaggttaaggacttctacaactatctctgctcagctgaaagcggataatgaacaagaacatcaatttgtgcaataagcttttgactaggagataaagtcttggaatcagctttgtgggggcagggcctgatcataaatataacaggaatcagaagtggaactgtttttaaacgtctctgagagctgtgaaagagagattctccatttggtgaaggaaaaatcttccattagaggcagataatggcgttctttataaagcatttcacattaaccagctctacaaaacaagctcctgtggatgcagtcacattatctgagccactaagtctcctgtgaagctggttttatatactcggggaagcaccaagcccaagcagttttgaataccagtggaaaaacaagactctcagcagttccaggaaaaataaattattaaagccgaaagagatggtggaacaattcatcccccaaatgtacaaaggattcttgggaaggaggaaggcaaaatgctttttttctttcaaccaatgccattaaaaataaaatttacattttactttagaaaactggct

SEQ ID NO: 3008 - DNA, 1722 bp, Homo sapiens
gtaacatgacataaagaaccttttattaacacaacaatgatattttaaaaaggaagaataataatttccaagaaaaagtacaggaatttattttatgtctttttgaatttagacagagaattatttcatagacatcatttagacaaagttagactggcctgaatttaactgcaggtcctgagacttattattaaggtcatatttgccaatgtctggtgagaaatagactgggaagatgaaaagcatcaaaagatttctaagggctaccaagattattgaggggatactgaagaacatgttttttatttaaatatttcctaggactgaccttcactcttttttcagtgaatctaccattaaaaagggtacctcatctattacactcaggagcagctacagctagagtcaccaagaagggtcgctgacatggtagttgatgctagcaggtcagctgggaggtcagctgcggctttctggcagagtatctacatgtggtctctctctcaaggtgacttggacttcaaacaggatggtacccatgtcccactggagaacaactcaagcatcaatattccaaaatttgtgatgcttcaagattgattgaggatcaatcacagtttcccagaactggaaaggtcctacttttcccctgctctacttgttaagctgcctccacagcctgctcatgttcaagggcctggagaaataaaatgtttcttcatgaaagcatggcaatgtcacattgcagaagtgcatgtgggaataaacatattgttgtggccaactttggaaaatataaattctcaaaatcactttggaaagggtttctcttttgacagaaatcaaaaggtaaccatctaaaagcacttctcctttcattctgggcacagagctggataatatttctaatttctgtaactcttaggaatggctatatcacttacatttagccaatggaatgcacacacaaatgtgtattccaccccctggtctgagccatagttctccgcagtgatatccctcatattatttctcttttcactttactattgtgacaatgcctagggaaacctagggaggcatatgttaaagttggcagaatttctgtgaccctgagtctaatttgatcctcaatgactttcatccctgtgttgagtgtgagcaaaatctatcaataggatgagatagtacttccatgagtacgttatagtttatagcaaatgagatttttacagtgtaattagagttggaaatcactgctttttaactgtgtcaaatgagtcattaaacttgtcctctgtgtaatttttgttgttttttcttttatttcgttgccttgttactaatgttatatcttatggttaacttggccctgtacatatctttaattttaattttattttttcagaaatagtaaatgaatttgttttaaattttgtatccagtaattccagtctcctaacacatgatgcctctctttttgttttttcaaccttcagtttcttatttccaattatggcatgttttcttcaaatacttgtgggatatctctgaagcctggagtgcagatttttcaaactgtccattcacactttttagttgtttcagtggaggtttcgtctaaatattctggtgcattgtattattggaattgtatatctcaaataatatgtcttgctttcacttaacctggaacaagagctgatgtgaggtcaacatata

SEQ ID NO: 3009 - DNA, 5596 bp, Homo sapiens
gttatttttcctgtctttctaaaaaggctaaaaggcaaatgttctgcagtatggaactgagtctccgagttaagaggtttgccaggtaattgctagcaatgacaaaggtgagatttgactgtcaattttctacctttctgaacattagacagacttccaatattcacatatcatctctatgtggcattttccaggactttcttaggtcttcaaaaaccaaatgagggacatatctctacttcacaatgaggaaaccaggacttaaaggggcttgcccaaattccctgaggtcagcaaccttctcttctctttgtatcccaagaacctaaaggcaatggtagcaagatggttaggagactgggccctgtagtcagacatgcctgcctttcaaatcttagctctaccactgacttgcagtaggaccatgattatcttttttctccttttgtaaaatagtgcctgcctcagggttatttattcattcagcaaacatttactgatcacctatcatgtgtgaaaatgttctaggaatatagtagtgaaccagggagtaaaaaaaatcctgccctcctggagcttatgttctagttggttgttgttaaaattaaatgagacaatgcattgaaaatgtcctgtatagtgcctggaatagagggggtatgcattttgacagaattaagacaaagtctacaaactcctggaagtaatagcttttgcctttccttgaatctataaagatagcaaatgtaatattaataagtcctttacttttccaagaaccatttcattccacggaaagccatagtagtatttagccatagtagttgtttttataatttagccatagtagttgtttttataatttagagttctttggttgcaaacaatggaatagaaaacaaagaatcaactctagcttcctcaagcagaaaggcagaaggatatgtatggctgatggaattgatgagagggtgttgaactaggcttagtacctaaaagacctggagcctgggaactaaactgcaagaggagtctcatcacgattcaaatgtcaataggttttccctattctgtgctagccctggagtggtgagaatagtgtgaggcttttgcttactggctctcggtgtgtatccagtcaaggagggataattctgtgaaaggaaagtgtggtgcatttacaaatctactgggcagtcaagaaacaaccagtgacagttctgaggtcttaaagctggatgagttatactgtcagcacaaagtgtttgacattaagtaaaagaatggggttcttgttcccaactaaacagtgggaattctaccacccagtggctatcctctgaaattccatgaattgaaactagtgcttatgatttagttaatatacatttatctgtatgcatatgcagataaatgtatatttatctatttagtactaaatagattttatgaaacttcatccctggctttatttgccaaaggcgagtcctccatcttgtggtttctgcatctctttggcatttgtcactatgcacttgttgccttttatattgtcacaggaatcccagaaacacctatagaacatcagtgatgagcatcttctgtgagtccagtggtgcactggctctgggaatatggagagacctgttacattaccttctataattacatgtatttgctattcctgagaaatcatttgtgtgtctctgccaggaaacattagcctttccattttttaagttttcaaataatatatgtagaaataatataaggaaagtacatagttcaatgcttgcacttaattgatagtcaataaatggcaatttgttgacattccaataccttgaacttcctggatagctctgtaaaacggaaagtgtccttgggaacaaaactgcacaagcatgctggtcaagattcaaattccagggagaaggtgttcaacagcctgcccctgggctctgtgccagcctctcggtgatgaagggagagtccggcttctgttattggctccccagtatgtattcaatgtgtacctttaatcaaaggtaaattccatgagggaggggccatgcctgttttataggccactgtatcttgcatgtagcagtttctagcacatgatatgcacccaagaaacatttgttggagaaatgaccaaattgggattctctctacagaggctaaagggaaatgactaagctacttgctgagtggctatcattagtgcataattttcaaaagcaatcatagaatgggcaagacgtttaatctctgtcatgaaatgtaacctttagagggaagacaagcaatcacaatgtgacttctccgagtgtcctgcagctttgagcatggcccgggcctctctctgatggggctgatgaaagccaacgaacaaaggcattttgtatgttaaaacaaaccacatttagtcaacagtgtttgcaatgactaatccctggtaagaaaacaccaagaagtggcctacacctcaaaaaatataagcacagagaattctttcttggaatactggctgcaaaagttcagcgtttggcatttgcaatgattgctgtttgattttctttatggttgtgttggcacattctggaaagtcaggaagctcaagtatatactgtgggagctctatggggtgggaataggagatatacaagctttgttttgtattataactattgcaacacatttccaaatgtcactttttgtccatggtgggagaacctggggatagttcaatgtcagatggtttcaagtgacataacactagtgcagtaatttatttattcaattattgtttattaagtgtctactatatgttgagtctggtgacactttggtttttctgtgtttaaattttattgtttcattctgatgtagcacatcccttcctgcatctctttgccagcctaattccttataacaatccagacttcccctcctacatcacttctcccaaaccaccaacacctggcaccctaccacagcttaggtgcctctgatgtgggccctgtagaagctttacattctcccaggatttctcaatctgcctgtttcttatttgtcctgtctctcccatgggatgagaagctatttaagggtctgggctgtggttgtcactaacccagtatcattacttaactcagtgtctgaaatatagtcggtgcttattaagcatatattaaatgcatgcagaatatggaattaaataaacctgaaattattttttggagtacattatacaatgcacaagagtaggcatttttagaagcatcgagcatagtaggtccttgcttgtcccaagagagcgttcagttagctaagtaatcctcatatatttgacaaatgctttctgaatgccaattatgttccagtttaccatctatttggaagtaaagataagtattttaaaatataactaacattaaaagtcttgagtggtaaaagccagattcaaataagacagtgaagggtcaggggttgcatgggtatattagtccagtctcactctgctgctaaagacatacctgagactgggtgatttacaaagaaaaagaggtttaatggactcacagctccatatggctggggaggcctcacaattgtggcaggaggtgaaaggcacatcctacatggcagcagacaagatagaaaatgagagccaagtgaaaggggtttccccttataaaaccatcgatctcatgagacttactcactaccatgagaacagtatcggggagtgcgcccccacgattcagttatgtcccactgggttcctcctacacacgtgggaattataggagctacaattcaagatgagatttggatggagacacagccaaatcatatcagtgggtgaggatatcacttaggctggtaaagtatttcaacctagtttatattggaaacaggcctttctttcccttccttcccctttttttctttatagcttctcattcatccatctgggatttacccggtgtctaccatattccaagcatcgtattagatacttggaatataaaaatgaatgacacactccaacctcaggaaatacacagcagtaaaaaaaaattttaaaggtgaatcttgcctttgaaccaaacagtttagtacagtgtttattttcagtataaaaactcatatttgtgggacaaggccatcttcatttatatagttcttattccttctctcaaattatgtttcttggccaagtctgtggaactgttggactgtatggcctctcagtcaagccagacacagctgagaggccatcggaaacttgtaggaatttccggtaattggataggaccataatcaaattttatatgaagtctggatgtgctgatgatgtgccttcatttcccaggtcagagggaaaatctggatgccttaatacacccaaaggttaggagaggccttttctgaaattgttttcaaagggatttccatgaccaaaataacataactatgctaaaaattctgtgacctgataagaaatcccttgcctggattcctggcaacattacttaaaactaaaaatgattctctcttctcagaactaacactcagtatcggactgacttatctgacacttgtcatgtacacatggccttgtgtcattagttgtattttcactgctcctgtctcactcccttgactagattataaactctttgaggctaataaaaataatacagacaatagctaatatttattgagggtttctatgtgccaggcagtattctaagcactttatacgtttcatttaatttttacaacaacctgtgaggcaggtattttatcattatcttccctgtgtatggggaactggtcccagacaagttcagtagcttgccctaggtccccaatcctagtaattgacagagctaggattcatgcccaggcagtctgactgtagaacctgtacccttgtttactttattgtttgtcttctctagatgtcttgtgctttactacatgctgacttgcatgtggaagatactccagaaattaaatcgttgttttatcagatagttttctaaatgtctcataatcctatcaagtttctgtctatccttctgggtaggagatataaggcagttgttattgtcttaatattcttggtgagagtataaaggataagggtttatttcaggtacagcaaagaattttctacagaaatccctcctcattatcaccactgaaaattcacagtgcctaagtgcttatcaggttcaaatatgatggaaacctgtcccatctccaaatttgagattcctcttgtacacatctaggacatttgagtacctcctcaaaatgtgtctcattgatctgaggtaacatagcagatgtaacttaggaagtctttattttcatttctttaacaagtaatagtcctttggaccattgtaatagaacacataaagtataatgaccctaagttaatgttgttttatgctttattttctgtaccatgtttctatcttacatgtctctcacttttccccctttaaaagatgttctagggagtgcctgccactaaaaactaacccctttctgtactttcctttaatcgaac

SEQ ID NO: 3010 - DNA, 4804 bp, Homo sapiens
agacagttgaaattttaaaattgtagttgtactctttggtgtttaaaagtgttatgttgacattttaaatattgtcctgtaatgtttacttcaaggtccatagttatactaatatttcttctttgatattaatgtttgagattgtttatttgcctctttttgcttgtgtatcactacagtgttgtcactcatagtatgacccctttattctttcaggaaaatggtgtatatacaatagcaaaattaattttaccaaataagcaaaagaatgcagcaaaaagtaatctattacagtgttatgctttcagagccttgagatttctcttcagtatggaaagaaacagaccactctttaaaagacttttccccacagacttgtttgagatcttcattgacatagggcattatgtacgtgatatcagtgcttatgaagaattggtatccaagctgaatttattagtggtaagtcctgagttttcaatattttggcaggctgctatgtagtcaggatgtaatttatcacagaaacccatttcctttttatattttgattaggaggatgaactgaagcaaattgctgaaaatattgaaagcattaatcagaacaaagctcctttgaaatatataggcaactatgcaattttggatcatcttggaagtggagcttttggctgtgtttacaaggttagaaagcatagtggtcaaaatcttttagcaatgaaagaggtcaatttacataacccagcatttggaaaggataagaaagatcgagacagcagcgtaaggaatattgtttctgaattaacaataattaaagagcaggtaaatgttttccttgtttctgaagatgtttttcttaaatacatgtcattgcaagaaagtagagttgtggtgctcttgtccatgctgcttatgaactagttccatgtgaaataattgacactgaagcagtgatatttttgccagcttttttcctaaggcttgacattgaagcataaaacactgtctggagtttatatcagggtcatggatgcaaaacaatcggatttacagtacagaatgcatcatatatgagaaatccttttcttttcattgtgagcatatctattcttttctccttatattttaggatatttggttacttagttacatacatagaaatatgactaagagtttcttgacttttgccaaatggaaccaagctgttaacattcctcaaatatgactttattagatctaaaatgtagattttcaagttgggttattatgtattggcatgagcagaatactctgatataatgtaacagctcaattaactctcattatgaaagtttgtttgaggaggaagaataaacatttcaaagagaaatggaatttctttgtgtgatccaagaacacattggtttctttttcagccttccttatttgcacattcatcacgaatactgttcatttataattcctgtggtgcactatcagctttgctgcttttgtcctccactggtcacatttgcatagcatctgtgttgggatgtaacaaattccataaacaaggagacctttgttcataaaaatcgatagttctactccagtgtgtacattatagtaaatattatcattaattgtttattttatagttgattttatatactaatagactagactttaaaaagtttgttcatgtgtagtttgttcatgtgtttgtatggtcatctagccttccacagtgtgctctttcattgtagcacaaggctagaacagggcttttgacctaagccagtccagtgttttcatctggacccaaatttggttttagtccttgtgggtgagccaggtccagaatatggttctggttggttacctggtcacatattgcttacgatctgctggccacttgctagttgatgcagtagattatttgttttagcacatttcctaagaaaagaaactgtcaaactagggtcagataggaagcatatgcttgggctttgaggtaactcaaaattgccctctcactagaggatcaaactgatggaaaggatgataacattgagtccttaaaggaggaggtagtggcaggcagaagcaaaacaaatggggctagaatggagagtacattaagattaacctgcattaacaaagaggatcccaaatgcaggtgcttagaaagaggactcacagtacagtgggttatttctctttcacggaacaatcccaaagtgagtaaaccaggttgaaggtgttctctgctccatgcgatcatttggggatgcaggcttttttctctcttcttgtgctgttaccttctagtgcactgtcttcatctgtgtggttgaaactgccatagccatgctcacatccaaggtgagatgaggaggatcatggagggctattcccaaggtttagagttcacacaggaagcacacatgcttcctctcatattccacaggtcagaactgagtggtagcctcacccccagcttcaagggaggctgagaaatcttctctaactgggaagccatgtccagcttcaactgtattgcaatgggacagcaggtttttggtggacagctagcaatctcccttcaaaaagacgtgcagaaagaccaaaaagagatgcaagcaagccatttgttgatgtgatggtgactgttctaagacaaattttatctagaaactcaaattataagcaaaaactacaaaattattagcattcttctagaaaatgatcttttttaattaaaaaattagaaattccactaacattcttaacttatatcaaagagaaattgcaccattttttaaaaacggtgaggaagactttattcaatactattgcaatagaagtcaaactattgtaatagaggagagagattgaacccaactctgaattcgaggactggacagctggggactcagagccaatggtcagggtgagggagggtcagtggatggaagtttactaagaggaacttggttagatatcaagggtgagtggatgagaaacttaattggatgtcaagggtgggaaatttttccataaactgacttagcaggatataagttgctaaaactgacagaccaaggatgaggcctagtcacgaagaggactcagaggagcctgactaaagcttggttaagtaggaagtccttgtcaactgttattatgacttaaactgagtcgactcttagattatgttattttctactaatcattttggagagcatagaaagacagaaatagtgtaaataggcacaaactttccataaatatttagatggtagagagaggtaaagaacaatgaatatttgtagtcaacagaagttaccgcatttcacttttctcctttatacagtctgtgtgtcgggttgtgacaaggtgtgctaaaggaattcttaaggttccttctacctctatagttctcttggttaagttcgatagtaaagttaggtgatagaacgtttttaattttatttaataaagctatagaggattgctattttcagatcagtttataagcaacaagtttttaaaaatcacaacaatctcagttcgatgatatcttgaaatgcttagttttgtaaataaatataatttctttgtagttttcaaatatgaagtccaactaagtagtcagtgaaaaaacttgtattttgaagcagtgcaatacatgtttgttatttattttcttatagctttatcatcccaacattgtacgttattacaaaacatttctggaaaatgataggttgtacatagttatggagctgatagaaggagccccgcttggagagcatttcagttctttgaaggaaaaacatcaccattttactgaagaaagactatggaaaatatttatacagctgtgcttagctcttcgatacttacacaaggagaagaggattgtccatagagatctgacaccaaacaacattatgttgggggataaggacaaagtaaccgttagtcttgttctccatttatttgcagcctttgaaaccatccaaggaaacagaccccgattcagtggtacatggggtgagacacagtcaacatttgccctaaatactgtcacttgccaaataaggtccatattgtgccatcacattacaaaatgactcttgagggaatttggtaaaactgaacttacccttgaacccaccattccagatttcttgaccttttcaaaaacccttattttaatgtaaaccttccatgtccgcttgcctcctctgctttcaaataaaaaaggaaaagaaaaaacaaaactcatttaattatagttaatagatttcaggcatggactttagtacatgacacagaaggtcacatgttcatcttgcaaacaaacaggctatgtgaatttctgtttctcaagtgatatttggcacctgctctgatgataacaacaagaaaaaacctgattcagtgtaaagtttatcaaaggctccaaggctcttcaaatgttatcacaggtcaggcattgctgggatagatataagatgaaaagccatggtttctgctccctgagctcacagtcctatggggaaaacgtctgttattcactcagcaattaccttcctagctgacacatcctacaagtgagcacagcaagcatgaaggacataacccctgtcttaatgaagcttataattctgttacagagtgatgaaggctagaatgtatatgcaaaatactgtaacatgtaataagtaacctgaaattctcaacagcttaaaacagtggcaaaatacagcctaaaacagtggcaaaatacagcctgtgggacaaatcaagttgtgac

SEQ ID NO: 3011 - DNA, 10229 bp, Homo sapiens
gtattaggagttcatagatagcacttaagactgactactaaaatgtagtaggtatttagtcatgtagaatttgtatttaagttgataaggtaacagtctttatcttgctgtgttatatatggtaatgtgtatcatctcctaaggattttgcttaaatatttatatgtattttatggagttttctttttaatggctaatgtttggggctgataatgtgattcactacttaagataaactgctgcttttgacatttctttacatttctaacctttttattaatccttaaacactgtcaaggtttttcagtgttttttaaatttaacacaaattcattggaattttattaaaatatatattatactacaaattcttttaattagtgcttgctttttttctgtggtagacatctgatgcaaccctgtttatgcaatgcccaaaattttgcactgttgacactgttgatagaattgatgttttaatggtacttgtaatcaataaactattttttatataaagagatgaggccaaagactacaattcccttgtcaaccttgatagtgttttagtatagatgttctttcattagatactggaaatacaagggattttaggtagttagtgaatgtacatgtgaactaaaatgctctctgtgtattttctgttgtgtaagtacttgttctaatccagtgttattgcattatgtaattgttctccctgggaaaaacagaatggcatgcattttccacaatacgtaagtgaccaaaaacgagcctttttgcaataaattggcatgctattaaccactgctgtagcagaatctcataacctttcagctattacttgttttcacattcagattttcaatgtgccagaaattcttcctagcatctactgatttcatgggtgtgttgcagaattgattctgatggtggcatgggaaataccgattttttttcttgcttaatattccgccatttgctgccagatggctgggtgtctgtgtgtgtatctgtgctgccactatgcacttgatgacttctgaatgaagggaaatgttgattgtggtaatgtttaaaataacaactgcatgaaatcttacaggcttctgctcttcttggcagtttgtctactgctcttgcagatcttggttttaagtagggagagaccaataagtcctacacgctcacccgaatactaaacttataactattcactttagtgttatttttttaaagttatatttcatttaatttctccatgcatatgttcaaattgccatataatttcagttattttatgttttagcagtgttattggtctttcacctttattcaatttcagttttcattatgagaaacacacacaggaaatgttgttaagacagcaactatatctaaaatgattctgttctcaaattgtatgtttacagataatcaaagtagtaggaagaggggaacttaaacatcatagtgatagatggttcttttaaacatgaaagcataaactgacctaattgattgttcctcttaaataatttttggaataaattagaaagctaacgtacatactctatataagaactatggctcatagaaatagtcatactcaatagtagtttgaaacctttggagttttttgaaaagagtgagtaagatccttagaaactaactttttggaagatcaggttattgattgatttgagatctttacatttttttctttgaatgctaaagcaatcaggtacctaagtaagaaaacattcaataatactttttctgggtagacattttttaatgatagtgataggctttaaattttagaactatttagaactatttaagatacttttttaaatctaaagatttttaaagctgtaaaaagcatgatgaaatcttagatcactgctgtatctaagtttaagtggtatagttatccttctaataagtctgcttttctgctaatttcaaaacactttttttcactgaccattaatcgacagttcttaatgatcacaagtgtcacttactcacagctgtcttagcaattctttttagtggaactacagctactaattccttgaactcagttgacacacatgagttatactttcttgttcatttttcctttcactatgttaggcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagctgtcggcagcatccagcccctccagtcacagtcctcacagagcttcaggaaaggacccctttgcagagctctctttggaggatttcttataaatcactttagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaagttttgttatggtattctggtctgagatgcattttcatttttcctttctctttttattatcaatattgtcatttttccctaataaaatatacccaggtgattatatttgttgatctaataacatggaaggtttgttttatatgaattttcaaaaagatgtctctttacactttttgttaccttgtagactcttattgataaatgcaactacttattaaaattgttcactttttgtcttttgatcagatgcctttagtcaggtaagtttaagggaaaatacgcagtttaatgttttggtacatataattatgtctgccaaagaaacctttgattgtatcatattgcctatttagtagtgcatagggttcagagtacatgataaaggatcaaaagctttgcattgataagtgtctcataatatttgctgtgattggagaaaaaatgtagtcgtagccaataaattttatcagcttttaagtttcagtattattaaaccattttcatataaactgggaagttgtacttttataagttaccctccttaactttacaaatttttgtctcttgtggtgtttgaggaggtgtttatatttaaggtctgtggcttgttttctttcatattgcctttttttttttaagtatgtttcagtatgtgacgtgcttcatagccatttttatttcattgtttaaacaacttttgggctatgtttgataagtgttatccatattttacccattttatatgtaggaatcagaaatcagaaaaggagctgggtgcagtggctcacacctgttattccagtaatttgggaggctgaggtacatgatcacttgagcccaggagttcaagaccagcctgggcaacatggtgaaacgctatctgtaccaaaaatacaaaaattagccaggtatatgcctatagtcccagctacttgggagactgaagtggtaggatcacccgagtccaggatgttgaggctgcagtgagctgggatcatgccactgcatactccaccctgggtgacagagtgagaccctgtttaaaaaaaaaaggaacttgcccagatgagtaagttaacagatggaaatcaaatctttgctttcatggtccattgttctctctgtgacctgctgtcacgtaattcatatatatatactgacatggagattgtttccctctgcaatctagactgatggccactctttattcccagtggtctttagtgaagtacatttcctgcctcctcctctgatgcccagacatcgttgacaaggaagaatgcaaacatgcgacaagagcaactttaaccaaaatataatgagtgaagtaaatcagctattgattacataattacatcaggctgtaaactcatacatgctcatgtcattttactatccagttagcaagtagctattggctgagataagagagaagattgtaagcagaggacaactgtacctgtcccaaatcgttttcaaaattatttgcctttgatttaacatctatcagcattcagcattttttaaaaggtatccctttcttaacaagtgactatgagaatacatatttaggaagaggacttccttatgttagcctaggaatcttctgcttttccagaagccaacaaaatgtgacttatgagaaataggccttaatgggatgtttttcttgaactaaaaataatttcaaggttcttctcatttatcgtaactcacaaacacgcttccaaactctgtttgcttattctacaaaattccacagagaaaaaaaatctctcttaagagtgagtgtggctcctgtgtgctagcagtgactaggtcacaatgtatggagacaccacagtagtaagccagatgaatttattcttgccttccaggaaagatatttcacagctttcatcagtggcctctgcagtcagcttagatctttgttctgccacacttgctgccttccatgggtgtgactagcccttctggaattctgctgtctgaagtttcggaaaagaaaggctgcattatcatccatgctgtctcttgctgaaaacattaagctgatttcttgctgttactaagaagtaatgtcctatttgaagtatcaccaatccaaaaggttttctgtgtttctagctagtattcctaatgttagcataagcactcattgtgtcccatttgttgttgatgtagtatgcagacgtagttgcatgaaagctgtatgaaactgacaacactgttaatgaaagttccttctatggtatttgttctggggcagatgtaacttgaagcgaatattaaactgattttaggcagacaactaggagagaaaggtgaggttagaaaaagttttgttttctgataagccctggttcaaaatagctttttatctaataaaaaagctaattttaggccagtgcagtggctcatgtctgtaatcccaacactttgggaggacaaagtgggcggatcacttgagcccaggagcttgagaccagcctggccaacatggtgaaaccccgtctctacaacagtgaaaaaaaaaaaaaaaattaagtcccagccactccaaaggctgagatgggaggatcacttgaacccggtatggttgaggctgctgtgagccgaggtcacaccattgcactccagcctgggcaacagagtgaggtgagaccctgcttcaaaaaaaaaaaaaattaaagttttgttttgtttttgttttgaggtggagtctcactctgttgctcaggctgtagtgcagtggcgtgattttggctcactgcaacctccacctcccaggttcaagcgattctcctgcctcatgtgcctgccaccatgcctggctaatttttgtattttaatagagatgggatttcactatgttggccaggctggctcaaactcctgaccttgagtgatcccgcctccatctcccaaagtgctgagattacaggcgtgagccaccacacccagcctaaagttggttttgaaataaaaattgtgtgtgattgaccttgtgagctaaaccttgctctgtcggagccttccccaattaggtaccctgtctgtcttccttgagccttggtcccttggcagctgtcctgtcctctggataaacaagtattgagttaccgtgcctctgactgggaccctagggaaggaaatatcaagtagccccccactgcccaccacttaggctatctaggaagtcagatttctttaaacttttaagaacactacatggaagcattaagcacaccacactggcactgccagctagcttagtgcctgtgtaaggcacaaaatattaaatctgcatctctgatcatttttgtcctaagaagggtagtagtgttagtctgttcttggggttgctataaatacctgaggttaggtaatttacaaagaaaagaggtttaattggctcatggcaggctgcatggcactggcttctggtgaggcttcaggaagcttttactcatagccaaagacaaagtagagagcaggcctgtttacaaacaggaattcatacttaagaataagaggtcagattaatgggatgtatcaccccttgagaccaaacctgcagcacaaaagagccttggtctcacaggtcacaaatagacattcagtgcagatttttattgctatcatcccaggttagagcccagtctacactacctgatagctggctctgctgatactcaggccaacccaagggaaaaagatggattttctttttgggggaaggctggtctttggtgcagacaggaggaatactggtccaatgggcttaggagaacaatatttatcagtcacccaatagagaagcgtgctttccattcatcaatgtttattttactgtcttataggaaacttgggaagtaagcaggacttcccaggcctcttgtcttgtgttatgggaaaccacaggacccatcaggcatttttagtttcatttaccaggcagtttattgattgcaacacttagcatacatgattcacaaagttctcattcttgataattttctgcccaaatgtagcttcctgagaagggcaggagtgatccatcacgtggtgggtgttcatgtttctggttggctccagccccttcccttgaatcctgtgctttaacagctggaatccttcagtgtgtttgggtggctcactgcttatcaaatattcaaggcctacaaccattgcagcctttctcatacctccactcttgaagcttctgctcaggctaactgtctcttccctgcctcttaattgaaactctggaattctctgtgcctttgtttttacctatttgcctgttcaaagtctgtaattattgggatggaaagtgagcaactctgatcatttttaggagcactgtaaattggccagcccttccagaaagtcataaaaatgtttgtctcctttgctcagtaattccacttctagacatttaaagaagtccagaagtattaaaagagctgaaactggatcccttccttacaccttatacaaaaattaattcaagatggattaaagacttacatgttagacctaaaaccataaaaaccctagaagaaaacctaggcaataccattcaggacatgggcatgggcaaggacttcatatctaaaacaccaaaagaaatggcaacaaaagccaaaattgacaaatgggatctaattaaactaaagagcttctgcacagcaaaagaaattaccatgagagtgaacaggcaacctacaaaatgggagaaaattttcgcaacctactcatctgacaaagggctaatatccagaatctacaatgaactcaaacaaatttacaagaaaaaaacaaccccatcaaaaagtgggcgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggctatcattaaaaagtcaggaaacaacaggtgctggagaggatgtggagaaataggaacacttttacactgttggtgggaccgtaaactaattcaaccattgtggaagtcagtgtggcgattcctcagggatctagaactagaaataccatttgacccagccatcccattactgggtatatacccaaaggattataaatcatgctgctataaagacacatgcacacgtatgtttattgcggcaatattcacaatagcaaagacttggaaccaacccaaatgcccaacaacaatagactggattaagaaaatgtggcacgtaatacaccatggaatactatgcagccataaaaaatgaagagttcatgtcctttgtagggacgtggatgaaactggaaaccatcattctcagcaaactatcgcaaggacaaaaaaacaaacaccacatgttctcactcataggtgggaattgaacaatgagagcacatggacacaggaaggggaacatcacactctggggactgtcatgaggtggggggagcggggagggatagcattaggagatctacctaatgctaaatgacgagttaatgggtgcagcacaccaacatggcacatgtatacatatgtaacaaacctgcacattgtgcacatgtaccctaaaacttcaagtataataataataaaataaagaaaaaaaaagtacctatgacagcggttgagattaccaaaggaaccactgtgtgccagagtaagggccaaggatgagtcccagggaacacacccttattaaggggtgaaggccaggaaagaacaatcaaagctggaggcggagaaccaggaaagataattatgtcaaggatataactgaagaagtagggaatggccaacacaagtaaaataaagaccaaaacctgcccattggttctagcaattaggaacttgaaccttacccctagatatacctgggaattgtcagggacagaaggcagatcacatggcattgagaaaatgcagagatatcaaaaagctatgaactaaaagagatactaagcaaaagactgaccaaggaagatttttagaaagcagattgagttcttcgttcatccattcaatacactgagtgccttcaatgtgccagtagttctaggtgcaagaatcaataaacaaaacatagattcttctttcattgagcttattttcttgtgagagtaggcaattagcaaatattttatgacaaatgatgatgagtgttgtgagaaaaaaatagtagagagagtgatgtgagcagagtgtggtgctgtttgggatagggtcaaggaagaccttgaagtcatctttgaacagagatactaagtaaggaagcaggatggtaagatttggagagtggctctcctccccacatatgggggcagagggcagaacaaaggccctgtttccctagtcagaaacagcactgtcg

SEQ ID NO: 3012 - DNA, 45917 bp, Homo sapiens
ctttaatttctggtatcagatttttaatttccaagaggcttatttgtctgttttctttaattgttcagttttatattatgccgtcttatttcacagatgcgatattttctaatactttgctgagaataattatgatttacattttttttttttttttttttttgatcgttcttgggtgtttctcgcagagggggatttggcagggtcataggacaatagtggagggaaggtcagcagataaacaagtgaacaaaggtctctggttttcctaggcagaggaccctgggaacttccgcagtgtttgtgtccctgggtacttgagattagggagtggtgatgactcttaaggagcatgctgccttcaagcatctgtttaacaaagcacatcttgcacagcccttaatccatttaaccctgagtggacacggtacatgtttcagagagcaccgggttggggggtaaggtcatagatcaacagcatcccaaggcagaagaatttttcttagtacagaacaaaatggagtctcctatgtctacttctttctacacagacacagcaacaatctgatttctctatcttttccccacatttcccccttttctattcgacaaaaccgccatcttcatcatggcccgttctcaatgagctgttgggtacacctcccagacggggtggcggccgggcagaggggctcctcacttcccagaaggggcggccgggcagaggcgccccccacctcccggacgggacggcggctgggcggagatgccccccacctcccggatggggcggctggctgggtgggggctgccccccacctccctcccggacggggcggctggccgggcaggggctggcccccacctccctcccggacgggatttacatttttaaagaagttttaatctccctctataacctctgtttccagtaagctttttgtttgttttcatttctatctttcatgttagagatttcccgaagatatttttatatttggttacctgttcatatttaaaagtgggtgtagggggctaaaaaggtgactggaagctctgtgttcatgggtggggcttgttgtcaatgatcttagttgtagagtgatgttggtgggcttttcactgtggagctcctgaggtccgtatctttaggtcttacctcttacgtttccaagattcctcaaagaagactcttccattctcttgcctgaatgggaaagacctggctgtgagggtcctgtgggttttggaaatccgtagaaatgttcacttaatctcctgattttcagtgtggtattcactctgtccactatgcagagagtttctgctctatccactacaaagaataaatatctagtcttctcctgggattgtggagagcagttggctagatgcttgatgtttgggagaggatttgaggttataataccgtcctaaaaacaacctttccaccatttttgcataatttacccttttctccttcagctcacttctagacaaatctggtgctaccactgtctaaacttttgaagattgtgcaatccaagttagttgcctgttggctttctccactgctgacttaggacctcagctttctcagatctgaaaaatatatcttcaccagctggttttccagttctaaaattttgttgttgttgttttcttctctctcttttgttccatctttaaagaattatgcaaaacatataaacacacctgcatccatttattgtacttttaattatgtttcaagtaggaatgaaagtaaaagccagtgttcaatattttatccttacttgaaaggataaaatacaaaatactaaataatattaaatactaaatacttacatccaaaaatactaaataaccccatggaaagatactctcaactcagaagtgcttgatgtagcattttggggagttctcagcagtgccctggccagctccctcagtttatccaatatactgtaggctgtcagacgtaagggtcattaaggtattcttcccttgagaaaacaccatgcaaatagctttaaaaagttactggcttaagaaaattaccaaggtcatctccagacaggtttttaaagttacctttgacattctcatttgtctgttcttccacttttcaagcatacattggacacatagcctgagccatgcatattgccatgagttggcaaaacaggataatgaataagagactgacctcatgaaccttccatgctatcacggaagacagacaccagtgttcaagatgcaatatggtaaatgccatcataaagatattaacaagtgctggaggctctagggggtggaagtgattaagtcggtcttcaaaactcatgattggaaatgtgtcttaactctcactattcaagcaataattttccagaacaatcccctggccaatttataactggaaaacttaataatttcccagcaccataatagagtcttaacttggtcagaagagaatttgaaagtgattttcagcttcttcattttatctgggaaaacctggctcaatcctggtgaagtcaagactgaaacttaggtttcttgagtctcatagtaatatactttccactaaattatattgagcccccacccaaaagcccaattattttttgatatgactgaaattttaatcagtagctctgagtctcagagatctggacatactgattttaaagacctctaagaagttctttcaaaacagtaacttaaatgaaggagctgtactttggatacagatacaggactccaaactcgttcatgtaatgccataaagagagaatggcttggagttttcattgcttcttttgaaagcagggctaccattcttaagctagaagaacagggctcttcttatttgtacaggttagtattgattgaacttcaaatcagccagcaaattcaggggatagttgtctggatgaagcttcggtgtgtcattttgcaatatatttttgagacatttctgtgtttacattgccttgaaagtacacaacagatgtataaacatataatttaaacattttggagaggcagacaatgttgtcttcagtgaacacttaagaatgtaatgtattctgttaaatgtatggtttcatgacttaattaatgattagcaaatggtatattatgggaaagctaagaactataaaaatatattgttcaattgtcagttctttatcagtaatataatattaacaataattacattactcattcaaagcacaatacatcttgcaagtgatattataatatcttcccaaagtatattaactttttatttccacaaatgcttagattgtaattttctcaataaagcttttgcttgatcctcttctggtaagaagtccttctttccctggtccttcaaatctctcctgtagtgttgatttctttctgtgctatactatagttccttgggtcctagcttgttttctaggctgtgaatttcatgaaggcaagggctgtcttcttctttgtaatttcagtggcttggcacatgttaagcatataatagaaggtaaattgagttaattctatagggactatgtcattctgctttgtaatttcagtgacttggcacatgttaagtatacaatagaaggtaaattgagtgagtactataaagccctcaatatattaacataaaatctttgtttatttaatttttatagcacttttcattatatctgaggcataaagtagctaaagtctcagggatgatgtacatgtaacacacatgcttcaagatttccttctttcacttttgaaacgcctttcatctctcaccctaggctgttagagccctctaaataacggatcctattggctggacaaggcagttcacacctgtaatcccagcactttgggaggccgaggtgggtggatcacgaggtcaggagatcgagaccaacctggctaacacggtgaaatcccgtctctactaaaaatacaaaaaattggccgggtgtggtggcaggcgcctgtagtcccagctacttgggaggctgaggcagaagaatggagtgaacccaggaggcggagcttgcagtgagccgagatcgcgccacagcactccagcctgggtgacagagcgagactccgtctcaaaaataaataaataaataaataataataataatggatgctattccatatgactgaacttcctgttgtccatggaagagaatcatcaatcctcatccctgggaaatctggctcggcataaaaactttctcctgcaccttggtggaagaaattcctgtgctgtttctaaaaatgagaaagaaaaagaaaagaaaacattctctgttgttctcattcttttttttttttttttttgagaaggagtctcgctttgttgtcaggctagtgtgcagtggcacaatcttggcttattgcaatctccacctcccaagttcaagcgattctcctgcctcagcctccagagtagctgggattacaggcacctgccaccacacccagctaatttttgtgtttttagtagagacggggtttcaccatgttggccaggatggtctcgatctcctgacctcgtgattcatttgcctcagcctcccaaagtgctgggattacaggcgtgagccaccgcacccagctattgttctcattcttgaacaatggggaacagcatgattctttattattatttgtgtatctgtgttgtgacctgtcttctggttctcttccttcttgacaaagactggatgtgccattctcggtcagctcccatgaagccagctctgaacacctccttgcattctaagtacagccttgtcattagttacacccctggcattagtgactgagattgcacttctcaggaccttttgtgagtcccaaaaaagagacttctgcatcagttcaaagggtggcatttctggagctacaactattacaacctttgttgttgaagataacctgggatttctgcttcttgaggcctgaggttagagatgtttcagtttcctcaactcaaaagcggaaactgaaataaatgggtaatgaaggcctttcttgtccttgatgtgtgaatccattttctggacattcatttctgtgactgtcttgtccttttcctcaacaattcatctgttacttttgcatgggttattcatctggttagtattaacattcttttgaaatcatcttctatattaataaacacttcacaaatctattggtgaagtcgccttagaatcttggcttaatgggattatagtgaataattctttttctttgattctatctctgtaacaaaaattgctgtggatttatgtatagaaaactagatatgttgtaaaaaggtcagggttcaagtttagctctgtgaccttggacatttcattttatctttctaggccttagtgtgttgtaagcggaggtaaatatcttgcatctggggttcttgcggcggggattcaaggagagaaagtatttgggaagtgctttgtaaacgatattgtactatatgacaagcaagttgttattaatagaggcctgactactcccaattgtttctgcttggtcagttagttctagatgagtaaattggagaggacagaaaggaaggaagtggcactgggcggggagccgggtgatctggaattcatccgggtgctgttcggcggtcagtcggtgacttaacgtgaccttggcaaagtcgctttgcctcatgtgcttctgttacgtcattggtaatatgaggtgggcgaaagaaaagatgatccagagacttttttccagtttataaaagcatgtgattattagagtttaaattatgagattattatttatttaaggatatcattgagtttagattattaaatcataagtcttaccaatagtgggcccaaataatatacatattttgaatatataatttcaatgaattattttaaagaaaatgccaaaacttcatcttttaaccactgaaaaggaactaatgaagtctcctattcactacatttttgtattgtatttggaaggaatgtgtgtatttaaagggaggctaaggattaacagatgaaattctgtatgagaaaccaattgtgtctacagcacctaaagcacattctgttgtgatatattctctagttactttaaatttgtttgttttccttcatttaaccaaaaaatgaataattgtaaagaatcaggcactatgttaatcactgtagttaagataattcctattataagacatggttgatctagtgtagaaagcaacatggcttaaaaattatacagggatgcctcgtgtcattgtactttgcagatgttgcatgcgtcgcatattgaagctctgtggaaaccgagagttgagcaagtctattggcaccatttttctaaagcacgtgctcacttcaggtctttgtgtcacattttggtaattcttacagtcttttaagttattctattattataactttcatggtgatctgtaatatttgatgctattattgtaattgttttgggagtgccacaagccatgcccacataagacaacaacttaatccataaatgttgtatgtgttctgactgctgaaggaagagaaacaaatttaaagttactagagaatatatcacaccaaaatctgtttccagtgttgtagacataattgacttctcaaacagaatttcacctgttaattcttgtgtgtgttctgactgactgtctgttccccatctttctccctcttctcaggcctatttcctgagacacgaagatattaaaattaagccaattagtcaccctaaaatggcccttaaatgttcaagtgaaaggaagagtcacatgtctctcacttaaaatcaaaagctagtaatgattaaacttagtgaggaaggcatattgaaggctgaaatacgctgaaagctgggccacttgccctaaacagttagccaagtggtgtatgtaaaggaaaaattattgaaagaaattgaaagtgctactccagtgaacacaggaaggataaggaaatgaaacagccttattgctgatgagaaagttgtagtgatctggatagaagatcaaatcagtcacaacatttccttaagccaaagcctaatacagagcaaggctctctcttcaattctgtgaaggctgagagagatgaggaagctgcacaataaaagttagaaactagcagagggtggttcatgaggtttaaggaaagaagccatctttgtaacatagtgcacaaggaaaagctgcaagtgctaatgtagaagctgcagcaagttatacaaaaatatctagctgagataattgacaaaggtggctacactaaacagcagattttcaatggagacttcatagtcttctattgaagaaaataccaactacaactttcatagtgagaaagaagtcaatgtctggcttcaaagcttcaaaggacaggctcacttttttgttaggggctaatgcagctggtgactttaaatggaagccaatgctcatgcaccattctgaaaatagtagggcccttgagaattatgttaaatatactctgcctgtgttctataaatggaacaacaaatccttgatgaaaggccatttgtttaaaggatggcttactgaatattttaagcccactattgagacttactgcccagaaaaagaaagatttcttttaaaatattactgcacatttacaatgcacctggtcatccaagacttctcatggagaaatacaaggagattaatgttgtttttatgcctgctaacacaacagccattctgcagccatggatcaaacagttatgatccatgaatgatcaacagccatcctatagctatggatcaaatagctatggatcaaagagtaattatgactttcaagtctttttatttaagaaatatatttcataaggcttacttgctgtagataatgattcctctgatggatctgggcaaagtaaattgaacatcttctggaaaggagtcatcatttgagatgatattaagaatatttatgattcgtaagagtaggccaaagtatcaacattaacagtagtttggaaggagttgatttcaatcctcatgaataactttgaaggtttcaagactttggcttatgtctataatcccagtgctttgggaggcaaagacaagaggattgcttcagtccaggagtttgagaccagcctgggcaacacagtgagaccttgtctctacaaaaaaatttttaaaaattagctgggcacagtcatgcaatcctgtaggaggaactgtcaaacacttataaaaccatcagatctcctgagaactctctcactataatgagaacagcatggaggaaaaactgtccctacaatccaatcacctcccactaggtttctcccttgacatgtgaagattatggggattaaaattactgatgagatttgggtggggacacagaaccaaaccatatcacagggtttgagaggatttactccagttttgaaagaagttctactgtgggtaaaatgctatcaaacagtatcatattctataaaaaacttttgtgaaagggagagtcaatcgatgtgacaaacttgagtgttgtctcattttgaggaactgctaaagccatcccaatcttcagcaactaccatcatgatcaatcagcagccatgagcatcaaggccagattcttcaccagcaaaaagattacgaattgctgaaggctcagatgattgttagcaattttttagcaatgatgtgttttcaaattaaggtgtgtacattattttttagacataatgctcttatacacttaatagactgtagtatcatgtaaatataacttttctatgcactagtagccaaaaaatttgtgtcacttgctttattgcaatattcactttattgtggttgtccggaacccaacccactatatctgtaaggtatgcctgtataaggaagataaaacacaattccaaaattataggataagggattaactttgctgaaaagatagagggaatataaaaacagcatatttaaaatgctttatagattataagtgtttcttatgtaccgttttatttaaatattaaacagactttgtcaggtatagaacgaaataccatcttttggtaatcagtttggaatctcctgcaactctcaaagcctgagcaatgtagagaaaatactaataacatatattgttatttaaataattaaggtggatagttatatgtaatcaactctttaaaatttctgaaagttttgcctaaaatgacttagactagttttttttaaatttaaatttttattttttaacagagtcttgccctgtttcccttgctcaggctggagtgcagtggtgcagtctcagctcactgcaatctcctcctcccgggttctagtgatcctgccacctcagcctcccgagtagctaggaccacaggtgcatgccaccatacctggctaatttttgtatttttgcaaagctagggtttcgccatgttgcccaggctgatcttaaactcctggactcaagcaatctacctccctcattctcccaaaatgctgggattacaggcgtgatccactgtgcctggcctttttacatttgggcatgaatattaccctattagtcattctctttttaaataagaaggctataagaaagttttcaacttacataatgtaggtatttagttctatgtatattttcaaggtgaatttctctaacacttatagcacatttgtttgtgatcacaaagctaggagaaaccttagttccattacctaactttagaattatccacaatagccaagatatggaaacaacctaagtgtccatagaaaggtaaatggatgaagaaactgtggtatatatataataaactacaattcagcctttaagaaaggagagcctgacatttgtgacaacatggatgaacttggagatcatcccattaagggaaataagccagacacagaaaggaaagtatgcatgatctcacttatacgtggaatattttttaaaaagtcgaatacatagaaatagacagtagaatggtggttaccaggttattagagttgtggtgggaggtgctaagggagggagggtaaaaagtttcagttatgtaggatgaataagtttgaagatctaatgtacagaatgagggctattgttaataacattgtattgtattatatactgggaatttgctaagagcagattttaggtgctcttacaaaaaaatgctatctgagatgatggaaatggtaattggcttgactgtagtaatcatttcactatatatgaaaacatcatgttgtatactttaaatatataatttaaaaaataatctaactttacagataatgaatataatatgccttttttcataaaataaaattattttcataaaagatgtgtcttgctcaatcacaaaatcaggactataattatggtctctgagaccagttttcttgccgctataccacagtcagagtaaagatcgcagcaagtagaacttcatttgatatgggaggtgcctaaaattctcttggttgctgtttttctgtcagcacaatatttttacatgaattctttgaaaaataattaatgtggtgtttaaagttactactgcttgttgatgaaaagagtttcactgtgtaaaatatttgattaaatttattctgagccaaatatgaggaccataacccatgacatagccagaggagataccaagaacatgtgcccagagtggtcgggctacggcttggttttatacgttttagggagacatgtcatcagtcaatacctgtaagatgtatgttggttccatctggaaagacaggacaactcaaaggggcagggctcccaggtcataggtagattcaaagattttctgattgacaattgcttgaaacagttattatctgaacacctggaatcaatagcaaggagtgtctgggttaagataaagggttgtggaaaccaaggggttttatcatgcaaatgaaacctccaggtaccaggcatctgagcttttatcagacttaaaaaggtgccagactcctcttagtgaattatctcctggactagggaaaagatcagaaaagggaagaggattctctacataatgtagatttccttacaagagacagctttacagggccatttcaaaatatgtcaaaaaaatatattttggagtaacatacttcaatttctttcagggcctgctaccagtcatgttggaattttattgctacaaagagtctattttgtcaatcttaagatctctgtttgaatgttaatgctggtcagttgtgcctgaattccaaaggagcaatgtataatgaggcatgtccgacccccctcttcccatcatggcctaaactagagttccaggtttatttggaatgcttttagccaagaagggttctataagttgttggaggccttagaattttatttctggttttcatattgtacagtactaacatttcaaggaagtttgactcttttgtggcctcaaatgcctttaataatgtatctgctcaaacatgttaagtagttaaacataaaacaaggagatatggtggtcagagttattgcttccatccttgcctcagtttcagtgacaaatctttaaaaatgaaatgtatctttttattatgatgtgacaggactttatttggatttgttttattgctaagtaaaattctaattttactttatatgaacacattaaatatagtgagccttaaatttcaataactgtggctacaatttaattttttctaagaaaagcccaattttctggttttatgaatgtgatctttgtttatatgttatattacttggatattgttaaagcattgtgtccatttttggactgcagtttagaagaagctcataaaaatagacagagtatgtatataaaatgagcactttaatggcaggttaagagaactgacgttgcttaacctgaaaaagagagagctctggaaacgtgctaattaccaccctcaggcatctgaagtgattttgtaagaagtactgtagtttttctttccacttagaaaggagagatttgggttctatcttgtgttagaggtgatgggagcatctcagggattcagcaagggtaattgcagttttcatctgttaatatctcttaagagaaggatacaatgaaatgattaggtatgatgaaataacttactccagcatgggacattgtctctcaggccttcctcctaaagatgaggaactagaagctcagagagtgctggagagagaacttacatcaagatcttgcatcaagccttacatcagggcttttgcatgtctctgcactacttctgaatacttactgagtgatctaatatttcattagagttgactacacaaaattaattggaatgggaggtcaagctcaggataaattgagaaatgcacctctttccaagtactgcaggtgatggcttattttgttagagtggtgactttctgctagtgtggctgaagaggaacagatgtgttgattttgattgatttgcatttagaaattatgcaatatttgtaacgtgtcctagatcattgtgctcttcttttataaaatagaaataagcgtgtaggcgtggatatattgcaccccaccatgaccgaatagttattacttggaatttttcacacctagcagtggtgctgatgtttcaagtatagctttttgagagccatgattaccactgactcattccttttctatgacttgaaatcgtgtaggaaagggaagagtagataagtttaaagagatttccttgttgcagaaaacactaaggtataacaaaatgaaagagttgcaaatggcatggatgatgtgttgcccaaaccctcctctgagagatgtaaaacttgaagccaggaaaaagacatggctggtatttggagataggtgaggactagaaaccaggaataagaaggaaaaacaaaactgaaagctgcaaatgggttataaggatttatcgggaaacactgatggcaggtttttagtggctaagacaaagttatcacccatatctttatacagaaagagggaagacaactctttcatgacatataactctctttaaagcattaacatacggaacttttctgaaagggtcaaaggggactaatactgaaaatggaagtgaacaatgtgatgagcactctgaaagggtgaggtgtattgacaactaaggtcttctcactggtattttgtggtttctttttgaaaaatggaggtgattctcaccttttgggggaagatctgttgctatttgaccatcattggcaagtatctaactgtttcacatctccagagaaccaaaggtaaattataaagctgacaggaatataaaaattcatcatttctgctcagtgtatgaatttggattaatatttaatgattcattaaatttttgtattttgtcttcttcccactgtcagtgagtaaggtttaatggaattgaatgaagtctatgtttactcacttttatggcttctgtgtcctcaggataatgtctgacgcatattaacactcagtaaatatttttattattgttgttgtgtatacagccattgctattcttatttttggtattatatgatattggtgtttagaagggacttagaacctggtgtaattcctgtattttgtgataaaagactgaggctaggaaagggcctgtataaacttatacagctacataaacaaaacttggttatactgacttcatttatctcctagtccagaacaatacatttttgagtaaacaactttgttagaggaggtcatatatagtatatagttttgatgagcatgcacattatctgagattcaatactttaataaccctcttattaattgattagttaattcattaaaatattgatttgttaattcaccaatatttcttgagacttattgtgtgctaagcactgctttatatagagcagtgaacaaaagccaatagagttgtctgagtttatgaagtttaccttctgtgatgggagagagactatcaaataaatagaacattttatgtcagatgttggcaagtatcatgaaaaaaaaaagatcaggcaaggggacaggggattttaggagacattagcggattaatttagaattttacttaggtaggtcatgaaagacctcactgaagaggcaacatttgcacaagcacttgaattaggcaagggagcagcaatgagcaaacaatggtctatttgggagagcagcatttcagatggagggaacagcaaatgcaagtcctctaaggagtcgtgtgcttggcatatttgcaaagcatcaaggaagccagtgaagtcagtgaaagtgagaatgttggagatgaactttggtgaggccacagtacatctccatcttcatggcccatgtctcctgaccagtggcttctgtcacagtcaaatctcagatatgcaaggcaacactcctgggactagtcagtccaccttctccctattatagggtgctttctgccataaccagctccttcaggcaagtaacatttgagccttctgccaggttgaaataataagtgcctcctgaatactaaactggggatgggagttgaccttcagtgagtgcccttgtatatcagaaatttgggacagtatcaataatttccccttagagaatgtgcatttctcttctgatgcaagagcctcagattgctgatgggagagacaagaaatgcaaagtagtttgcaagaagtgaaattctttctattctgtttccaaaagcaatgcaagtctaatgtataccttcgaagagttgttgtagactcagaccatctttcatttaagagagctgtgtgtttttctacaaggttcctcagagcccctctagtaacctttggggaatcattgcattgctaaatcaccacattagcctgctgccttctggaaaatgctgatcccattgcttctgtcagcaggagaagtcagcccttgggctggaaccaaccatattgagaactaactgagaggcgggggagggtggggaagcccttaaaaagaagttcagatcttcagggtagtgtggggggcaaacaatcctaggaaatgctgtactaaatagaaagcacctgtttttattattgctaatcataaaatcacttttaaaaaaaatgcattacagtttataaagcttttccctatcccttacctcatttagtctcctcttcaatctagtgtggccttgttatataaaatgatacaaaccagcacatctgtatcacccgaatcttgttagaaatgccccacacagacctactgagctagaattcacatttaacaagaccgctagcccctttaagtttaagaacattgctataaagcctacagaacaataatttcttctgattacggtaaggaaatagagaattagcctcattgggtgactaagccaaggtcacccatttagtaagtagtgaagtcaggcttcatacccaagctttgtgcctcttgttccagcagtctcttggctgcagtcacttcccactccacaatcccttcatagcatgcctgcaatgtactagcttttgaaagaaaaacaaccctttttctctgaacccacctgctcttattttctccaccagctgttctgggctcctccctcatctgtttgctgattctagaagtgcaaacacactgaaaagctctgcagccattgcccacatggtgccctcaatgagtgaatctgataagaattgctagcatcagtcacttgctcagagcttctctgcaaaaaccttctggcctcacttataggaaagggtaagaattcagaacaagacaacagagatcatgcagctggaacatactggtgggtacaaatggggttttccactattgcttactgttaggaaatgattaaaaaaaaaaaaaaagctgagcttagcatcacagaaaaacacatgtgcagagagcttcatagcccaccattaaacagaatctttctccgtcacccaggttggagtgcagtagtgagatctcagctcagtgcaaccgctgcctcctggattcaagtgattctcctgccttagcctcccaagtagctgggattactggtgcatgccaccatgactggctaatttttgtatttttagtagagatggggtttcaccatgttggccaggctggtcttgaacttctgaccttaagtgatccaccctccatggcctcctaaagtactagtatcactggcattagccactggcacccagcccttaaggatataaaacgtgcagaaagtgagtgcctcatcctcgccaactaattgacccaataagtaggcaaaacttagtctgctgggtaaacaacccctcatccataggaatcatactttgagtgagggaaaattctaatagaattttaaatatttgattgataaatcctgaactagaattccttaagtaagtaaagctcactgatctcaggttgaattctcacattttattagttagtttgttaactgaaaaaactgacataagacatttcctgtgaacctactacatacatgaaggtcatcagagtaggtgataggaaagtttctggtatgagtgatatcttccctaagagcctgcagtttaacagaattcacgtatatgtacatgcaaaatgataatggaacacaaagggacatttctcccttaccttccacctcaaagaatgaagtcttaatctaggaggtggcatttgaattatttatggacagaaggtaagtttgggacattcagagtctgcagagtagagaaagtcatgggcaaggtgaaaggaacaatgtgaataagacacaacgaaaaatgctaggtttgtatttggaatagcaaataatgtgttgaatatgacttgtaatctatcaactcagagataaatatgcttttgttttctttttttctgattgtatatatttaaggttacatgatgttttgatacacatagacacagtgaaatgattactactgtcaagccagttgacacatctgtcgtctcacatagttatctttttttttgttaagaacacctaaaatctactcccctagcaaatttttagtatatgtacaaatattattcacagtagtccttatgctgtacactagatctctacttatcctacacaactgcaactctttaccctttgaccttcacctccccatttctccccaccttccaactttggtaaccagcattcctctctctgtttctatgtatttgactgttttttagtttccacatataagagtgatacagtgtatgcctctctgtgcctggcttatttcacttagcataatgttctccaggttcatccatgttgttgcaaatagcagggtctccttttttgaaggctgtatactattttactgtatactattttactgtgtacatatatatgtatatatatgtacgtatacgtatataccccatctctacgtacatatatatgtatatatgtacgtatatgtatatatatgtatgtgtatatatgtacacacacatatatgtatatacaccacaatttcttttccattcatctgttgatgaacacgtagattgtttccattatcttggctattgtgaataatgctgaagtgaacatgggaatgcaggtatcttgataaagtactgatttcatttcctttgggtgtatacccagaagagggattgctgggacatgtgatagttgtatttttaattttttgaggaactttcatactgttcgtcataatagctacaccaatttacattcccactaacaacgtataactgttctcctttctcaccacccttgccaacattttttatgtcttgtccttttaataataaccatcctaacaggtgtgaggtgatatctcatcgtagttttgatttgcatatcgtaatgacgttgagcaccttttcacatacctgttttatatttttatgtcctccttggagaaatgtctattcaggtctctcacctattttaaaagtgagttatttgatttttgttattgagttgtgagttccttatattttggatattaactccttatcagatacatggttcacaaatattttctcccaatctttagtctgcttttccattctgtttattgttttctttgctgggcagaaatttttttgtttaatgtagtgacacttgtttattttttcttttgttgcccatgcttgatgtctcagccaaaaaacaataataaaaatcactgcaaaggaaaatattagtaagtctttttcacatgtattcttctaggagttttacggctctgtgtttagatctttaattcatattgagttgagtattttgtagtgtaagataaggttctgattttattgttttgatgtggatatatagatttcccaacatcatttattgaagagactctcctttcttcattgtattttcttcccctttcagaaattagttgactatatatgcctgggtttatttctggcctccctattctattccattagtctatgtgtcggttttcatggtagtactatattgtttttatcttggtaatataatttgaaatcgggaagtgtgatgcctccaactttgtttttcttttacaggactgctttggctattcagggacttttgttgttccataaaaattttagaattaattttccaatttccatgaaaagtgaaattataagagggattgtgttgaatctgtatattgctttgagtataaaaattttaacattattaatatttcaatatatgaacaagacatatcttttatttgtatcttcttcaatttatttcaccttatggttttcagtatacagatctttcacctctttggttgaatttatttctaaccattgtatttttttaatgctattataaatgggcttattttcttgatttcttttttggacaggtaatatttagtgtaaagatatacaattgatttttgtatttttttaatcctgcaactttactaaaaccattctaagagtttgttgtgaagtctttagggttttctacataaaggatcatgtcacctgcaaataggatagtttatatttggataccttttatttttttttttcttttctggttattcttgctggtacttccaatactgtgttgaatagaagtggtgagagtaggcatccttgccttaagccagaccctagagaaaagcttctggttttctcccattgattgtcatgtagactattcataaatggcttataatatgttgagtaaattttctttgatgcctattttttgtgagtttttatcatgaaacgatgtcaaactttgtcaaatgctttttctgcatttattaaaatgatttttttttttttttttagacagggtctgctgactctgtcacccaggctgctggattatagtggtgtgatcttagctcactgcaacttccactctgcaggctcaagtgatcctcccagctcagcctcccaggtagccaggaccacaggaaccacaccaccacacctggctaatttttgtatttttagtagagacagggtttcaccacattgtccaggctggtcttgaatgcctgagctctagcgatctgcctgccttggcttccaaagtgctgggaatacaggtgtgagccaccgcatctggcctgatcatgtggtttttaatcttttatattgttaaagtggtgtatcacattggttaatttacctatgttaaaccaaccttgctccccagggataatctcacatagtcacaatgtataactttttagatgagttgtaaaacttggtttactagtattttattgaagatttttgcatcgatgttcatcagaggtattggcctgttgttttcctttcctgtgctatatttttccggccttcatatcaggataatagtggcctcataaaatgggtttgtatgtattttctctacttctattttttaaaatagatgaataggatggatattaattattccttaaatgtctggtagaattcaaccatcaaggcatctggtcctgggctttactttgttgagaggtttttaattactacattaatctctttatgtgttatttgtatgttcatgatttctctttctttgtgattcaatcttagaaggttgtatgtttctaggaattttccatttctcttaggctatcaaatttgtttacagataatttttcatgatagtccttcatgtcctttttatttctgaggcatttattgtaatgtttccactttcgttttttatctcgtgtctttttttaaattcttagtgattcaagctaaaagtttgttaattttattttttcaaaaactcaactcttagttttgatttttaaatagttctagtttctatttgatttatttctgctgtgagctttattactttttttcttctgctaactttggacttagtttctttttctttttctagttttttgaggtagaatgttaagttgtttatttaaggtctttcttctttttaatgtaggcattcactgctgccaacatcctacttaggagtgcttttacagtatccatagtttttagtgtgttgtatttccatttttgtttgatttaagagagtttaaaatttcacttttgatttttttctttgactcatcggttgtttagaagtatttactttaatttccacatatttatgaattttctagatttttctccttttattggtttctagtttcataccattgtggttggaaaagatacttaatatgatttcaatattcttgcatttacacagccttgttttgtgaccccacatttaatctatactcgacaatgttccgtgtgccattaagaagaatgtgttttctgttgctgatggatagaatgttctgtaaatggctgttaggctcatttgtactgaagagtaattcaagtctaatagtttatgattgatattttgtctagataatctatccattgttgaaagtgggtattgacacccacttctattattgtattcctgtttatttcccccttcggatctgttaatatttgctttatatgttttggtgttcttatgttggatacctatatatttatcattgtggtagactcttgatgcattgaccccttcatcattatataatgaccttatttgtcccttataacagtttttggcttaacgtctagcttttccaatataaaagctacctctgctctctttaagtttccatttgcactaaatatcttcagtctgtgtatgttcttaaaggtgaaatgagtctcatgtcagcagcatatatttgggtcttgtcttttttaaataatttatccactctatgtcttttgattgacaaatgtagtccacttacatttaaagtaattattgatagataaggatttactattgatatttcattaatcattttctggatattttgtagatccttccttcctctcttgctgtcttactttgtgattgggtgatttttttttttttttttttgtagtgttgtggtttgatttctttcttatcttttctgcatctactataagtttttgctttgtagttaccatgaagcttatgtaaaacattttatagttatacctgtatgtctactttaagctgatacccactttgatcacaggcaaagctttatggttttaccatttccccacattttatgttgttgatgtcacagtttatttctttttatattgtatatcaccattaacaagttaatgtagctgtagttatttcaaatactttttttcctttcaatctttatagtggcactataagcaacttacacacaaccatttcagtattatggtattctgattttgactatatatttacattttcagtgagttttatgctttcatatgtttttatgttactaattagtaagccttttgtttcatcccaaataagtctctttagcatttcttataaagcaattccagtggtgatgaactccctcagcttttatttgtctgtgaatgtcttttttctccctcttttctgaaagacagctttgctatgtaatgtatttttggctggcagttttatttctttccacattttgagtacatcatcactctcacttggcttgcaaggtttctactaagaaatctataatggccttattggtattcacttgtatgtgatttgctttttttttcttcctgcttttaaagttctttcttagttcttaattttttattgtaatgtatcttggtgaactcttctttgggttgaatttggttgaattcctttgagcttcatgtacctgcatgttcatttctttccccaggtgggaagtttttagccattatttttctaaataatggttttctgtccctttctctctctgttcttctgaaaatcctattatgcaaaaaatagctctcttgatggtgttttatatatcacataaaattttcattcctttttttcttttttctactcttactatatgatataaaacaatctgtcttctagtttgcttattatttcttctgcatgatctattcttcttcaagctctctattccattctgttgttcagtcattgtattatttagctccaaaatttctgtttggttattttctaatgttttctatcattttgttgagcttataattttgttcttttattgtttcctaattttttaaactgttttttgtgctctcttgtttgctgaacttcttttaaaacgatacatatttgtacatattcatgaggtgcatgtgatactttgttacatacatagaatgtgtaatgatcaagtcaggatatttagggtatacatcactttaagtatttatcatttctatgtgttgggaacatttcaaattctcccttccagctattttgaaatatataatacattgttgttacctgtagtcaccttactctggtatcaaacattagaatgtattccttctatctatctatgtgtttgtacctattaaccaaccttactttatcgccaacatccatataccccttccatcttctgatatctatcattgtactctctacatcctggacattgacttgtttagctcccacatatgagtgagaacatatgtctttctgtgattggcttatttcacttaacatcacctccaaccaattcagtccacgttgctgcaaatgacataattttatttttttatggctagatagtatttcattatatatatatcccacattttatttatccgtttgtccactgatgaatttttaggttgattccatgtttttgctattgtgaatactgctgcaatacacacgggggtgcatgtatccttttgacatactgatttccttttctttgaataaatatccattggtgaaaatgctggattatatagtaatagtatttttagtttttcagaaatctctatactgttttattttttactgagcttctttagagaattattttgaattctttgttataaaattcatgaatctccaattcttctgagatcagacaggattgggcatattcagagtggtatggccatagacaatgtccaattctttaaggtcacttattagaagtttattgtgttcctttggtttcatattcctctgattcttcataattcttgtagccttacaaagccttacaaatgtagcatttgatgcgtgcattctttttccaaactttatagactggttttggtaagagaagaccctcacctgtggcagaggttggggggtggttatagagggatgcatgctggggcgtgccatggcaccaggtgtagtggtgtggggcaccatgaatggaagtatacagtagctccaggtcaaggggtggatgtggtgtctcattggctcagaaagctgggggtccatgacattggcaattaggtcgttcttggtggcaagagctgtgtgaggtctgctatggctgtgagggtcctcagtagtgtctctgagtttggtggcaaggggctggggcagaaagtgatggggaccatagtcagtggtgtgcgtgtgctcagctgtggcggctggctgaaggcatgtgtgtggcagcaaaggtcagttgctggctgaaggcatgtgtgtggcagccaaggtcagttgctggctgaaggcatgtgtgtggcagccaaggtcagtggcaagcttgtgcatcgtggcaagggctggcagcaaaggaaggggctaggactgactgcatgtgcacatgttgtggcagaggttggcagtgtacacatgcatgatggcaggtgtcagctgcgggttgggacaggggtcaggctgactacatgtgtgtaggcagtagtgggcctgagctggagatatgcacacctaggcagctgcaagggccagttctgggtacaagaatagtggtggaggcaggagctggggggtggggcctgctacttacacatgcacaggtacaggggcagggttgggtgcatgccctagcctgctgcaggggacaaccttgggtgtggacatggtggtgatggctgggcccctgggccggagctcctttagagacagcagctgttctttgtttcctttaaattaggccaacccaattctgactttgactacctctccttggtggtgaattatttgtcagtcactattggaccttatcccacctaccaggcagagtcaaagttctgcctgggtcttatgagccttaacccatttgtggtcattggccactgttatggaatatgtgccatgtgtggggcgtgagagtcttcactgccaccaagaactgccctttgcctggggttcagatccccaggcaagtcacatggccatcactccccagaatgctactgactgtctccaccctgcttcctcttaatacccctgtgtatatgtttttagtcccaaggcaaatatttgtctcatctagagattcttttttttttttttttgatgtgagagactattttattaaaaataaatcagagggctgggcacggtgactcacacctgtaatcccagcactttgggaggccaaggcgggcagatcacgaggtcaggagatggagaccatcctggctaagatggtgaaaccccgtctctactaaaaatacaaaaaaattatccagttgtggtggcgggtgcctgtagtcccagctactcgggaggctgaggcaggagaatggcatgaacccagaagccggagcttgcagtgagccgagatggcaccactgcactccagcctgtgtgacagagggacactccgtctcaaaaaaaaaaaaaaaaaaaaaaaaaaaaaaattagagaaaaaagtcattgtcttttttttgtactttaagttctcgattacatgtgcagaacgtgcagttttgttacatatagatattcttaagaaatctctttccctcatatacctccatccctgagccttacacatctccttgctgagtatagtcttttctaagacctgtgatctccaaataacttctgtttttcttattgaaaaaatacctgagtcaaggaaatactaccttaagtaacccacttcaaatagcacaggaaaaagagaagaacaaatgtaagttaatatcttaataaacaatggcactacattcagaacaaccggggcatgaggtcggtgagatagaatggtgggtgcccaaactggacactttttggggttgtggtgatggggagtggtgtgggatgtcttccattgacttcagtgactctcctcgctaagatcatacaagcctacatttcagtctcggttccaactttctgaccctttttatcatttataaacttgcctctgtgcctgtctttctctcttctttgttcagagcaagagttggctctcctttcattttaagccagtcaaggtttcccctagatgctgtcacctcctgtgtcttgtgggatgctgcatcagcacctacttctaagacgctgatattttcatcctctctactgacttctcagctaatcgacatgctcacatctatcctatatgaatacgaaatcagcacatgaaaagcccttcttttcaccttccaactctttctagctccttccttctccattcttcacaacatccctgattgcgccacgctttgcctccagggctcaggagtgcctgagagacagcctgttcagtgtcagtcatggagacagatgggctctgccacttacagtatattctcctggagaaatatactgtaagcttttctaagtcccatgttcttaatttaaaaaatgataacagtgaggacaaccttaaaatactattgtcaggattcaaaaacaaagtaagtaaatctttttatcacagtccttatatataatagataggaaagatttggaagtattattatttttctcaaatattgcacccttagcctgaagtccgattctctccctcttccatccttccggttttcctgggaaatttctgctatctatttatactctcctccgtgctggtacctgctgtcacctccttccctacctttccccttgtctgatgtgcccccactactctctcacgatacctaagaaactgttttacagttatttgaatttttgtctccctctcagttctgctttgcgagctcttggagaacaggaactggggtgtaaatcttttatccctgtgcctttgttatttggttgtgagcactcaaatgcttgttgagtataattttatttcacaaacttttatagtgcttactgtgttctaaacactttagagatattaactttgtaggccaggcacagtggctcacgcctgtaatcccagcactttgggaggccgaggcgggcggatcacgaggtcaagagatcaaaaccatcctgactaacacggtgaaaccccatctctactaaaaatacaaaaaaattagccgggcgtggtggcgggcccctgtaatcccagctacttgggaggctgaggctggagaatggcgtgaactgggaggcagaggttgcagtgagctgaggtcgtgtcactgcactccagcctgggtgacagaacgagactctgtctcaaaaaaaaaagatactaactttgtaatctttacaacaacactatgatgtggatactattatcttcattctacagatgaagaaactgaggcacaaggaggtaaatatgcccaaggccacataacacaagtaaataggggagttgacatttgaacaacaaggtcagtctccctcatccacgttgtgtttattactatctgccctgggttaatattattatagattccttgcctgcttgaaggattgtaatgaagactatgatatgaatgaactttgtagactgaaaaatattgaatggataaagaaaaagtgttatctaaatataagtcatgacaactaaaaagagagcattataaacataacactttatagaaatttgatgatgatcatcaaaatacgcttttaaaccctgattttgaatcactgaaaagagagactgctattcttatatgcttttcaaaggtaagctgaaactgaaaaatagtttaacatatgtcacctctggagtgtggtcccacagtcatttttctgcagggatcaattctacttgagaacagctgtttagagcagatgaacttcctaaaatggccctggagagaaaaaagcaaacgggcagctgcttgacctttttccaaatgaaaaaaaaacaaaccctgatcagttggtcttgattggcatgttcagagtcaaggagctttagatctgtttttataacaaatcactcgtgatgattactcactgctcactaacattgtatcacagatcttctggtgggtctgatgcgtatttccgttttaaccccgttaacacaggcagcttggacagcatgtgccctctcagtggtgacctttggggaaaagcaacagagagtgtttctgcagatcgcctgtgtcagaattacctggaagggttgaaccatgcaggttaatgggatcaaacttaaaactaccgattcataacctttgggagaggattctaagatgttgcatcgagagcaggcactcccaagatgactcttaggaatacagggactgggtatcatggaagggagatgctggtctcttacagcatcatacaggatgagaacgactctggaacttaagttgacctttcacaaaagaattccagatattctttcttctgctggttatgatcagttaattgatgcttcctattgcgcagggaatggaggttgagttgcagccgaacagaaagatattcctaagtctgttttggctcagtttacatcagtgatttcaattctgttgcctgtgcctttaggaaggaaagaaagaaatgaattttctggatgaccaacatttgaattgcttgagagtgataaaaataagccccgcagagtagcatttaaagagatgatatattaggcagggctttattcaacacctgaataatgatggctgccccctagaaaaaaatttttttttaaactttgtaacagctgcttaatagagcggggaaatgtttctgttttaagccctgttaggaggtgctggtgcagacaagtgtgtcctctttgacatcttgaaacaattttttatgtcattcatcacaccaacataaccatgatttgaaaacactatcagtagctagtctcttataatcacataacaccgatgctgccaccacagcacaccagtaactgtaagccaaggagcacttgtagaaggtgtttagagtccatttacttgtctgagaacacatataaattataattattgtctagtaggtatattgtacgtaatgctgcaagtcaaatctgacactaaccgctcagagttagcactgactccacaggttaaggacgcaatccccaacaagattgcactgatttcagacgctggctgccagttcgggttccttgggctgctttcactgctcaccaactgaatacaaatttggaaggggatttcccatgaccctctcaggttagataattcattaaaacaattcacaaaacccagtaaagtattaggattatagttctattattagggatacgattcagaagcagccaaacgaagagacacatagagtgaggtttctaagagtttcaaatattgagcttttatgccctctccccatgacagcatgtcacccttctggcacattgatacattccccaacaaggaagctcaccagagcctcaaggtccagagtttttattagggttttattacttaggcatgaccgattgagtcattggccacatgaacgaagtcaacctacaacttccctctccttctgacccatggctcaaagttgcaaccctctaattacatgtttggtctttctggcaggactagcccgcatccagagacacctccttaactcaaactcaggtgtggttcatgggcccagcatgaatcacagacactctgatgatttgggaaatttcaaaggtttcgagtctccatcccagaagcccaggacaaagaccaaattctttgttgtataacactgtaattctcagaggatgatatttcatattaaataagttatctattgggacctcatacaatgttgaggaggaatgaatcttagaaatcatttagtctaaacctctcacttgacaggtgaggaaactgagatccagaggtgaagagaatctcccaagctagttattagtaaacagcagaggtggagctggagtcagggttagatttaggttttcttatctcaagacctcagatttgggacccggacggaaattttcatgcaaaatttacatgggaaacaatggggattggaaaaaacatgcatgactgtgtgtgcaccagctgtgtgcgttcaggggcttatagcagataatattgggtgtctgctgtttaccttgcttgtaccagggctgccatatggttaatgagggttctttagaccactgctgggagaattactgaaacataaaacttgagatgtgtgtcaccatttctcccggtctaaggaaacttattataaaagagaaatcaagagcccagattctgactgtctgactcagtcaactcatgagaaaatgatgggcaaaccattctacctgtcactgtcttaacatctccatttttataaaaagggtgggcagagaagaatggcttcccaatctgacactatggaatgtctatgaaacattgtatgtgtgtttttttcttggggcacaaatttttaaaaaatgcagtcattctatggtgaccctcagcatgttgcctttcctcctcttctgcatgtaggtgttggctgactagatgatttttatgacctcagccagcttctggagtaaatatctgggtgatgagcatacatcattgctccctgtatgcccatctgtaaagcaagaataaagatatttccttgaaaaaaggaggatctgggtgatatttgggaaaggaaaaaatagaaaactttaaaaaatgacttccagttaactgactttttctctttcatgctctttctttattcatttctaaatccctctggtcacagggatttttagagattggtagaggcaaggcagaggcctcaatctagccactatcatctacttcttgtcttcacctgccgcctagaatctcacgacttgtattcttccagtctagaactttctcctggacttcagaaccaaagcacctcgaactctactgactccagctgagctctttgtcttctcctcagtcactcccttctgcttttctcaccttgccaaatgacaccacaatctacataggcactcagagtggaaacttagtcattcctaaggcagccctttcctcacctagtctgactttatgtcaccccttttatcgtctctagtttacattgttatatccctttggttctgctgtctcagttcacattcctcacctcttatcttctgcagtggaggcctaactggcctcccttattctgaccctttatcatttttaagaagacattaattctgtgctctatattatattgagccaggtggcttatagacagaaacagtattgaataaataaaatgtttacaagtatattcccaagctgcctatattattgaacaaccaaataacctgaagacttgttcagctgagcccagcacaggcccttactaaatgtctttatgtaaatacattatttagtctcatttagagtagcttccaactattcctattctttgatcctggaagctcatgagcctgggctttataggtagggacacttttgtttattattatgagtctagcatctaatgacctggcaaatagtaagtgcttaagttcttgtggactgaatgaatgcaagaatatacttcctaatggatttgggagctaggaggaccctcagagaaaacttaatagaatgtattcatttataaatgtagatgctatggttaaaagagaggaagcaagtcacattgtgaaccacagcttgtctggctgggctgttcttatgcctctcacgtttcctattgggtttcctgctgtgcaatcactggtctttttcattgcggaaagttttcttctgtccgctccagtcctcacaacacagtctgacctctttggctttcaccatgtgatgacctgaataacccctgcaaaaactcctttcttcataacctccccccactaccacctcccaaccgaaggccaccaccacctgctttcctgctggagtccgttgggtttatagctcttccagctccttggacctctttccccttgtgtcctgggcatagtcccttgtgccctttgcaccatttccttcggcagcagtcatcttgtttttcacctggttatggcattaatcttctaatcattccccactttttctagctctttgttcaaaataaggtttggaacagtggtgtccacttccagacttttctgaggacccaacaaaattcctcccttgacagtatctatttctgactccctacggtatctgtttctgacttttacaaactgctttcttcacactgaggcaatgcgaaacatcgataagctattttttccagtaaaggaaaaaaaagcccttagtatagaaatctttcaccaacatgggagccagataaaatgtttgtttttgttatttccacttttaaaatgtgatgttttactatcaggcatacacctggtgtcagggagtagaagagaggattttatgctgccccagctcaggaagaattactctctccttccctgccactgaaacataaagtcctcggctcccaagtctgaagccccatggcctggttagctggctcccttgataatgtgcagctgtatggagaagccacaaaaagcagccatcgtgatttagaagctttagaataataaggtgtttggcctttgggtgtgatccctggttggcagtggtggacgggatctggggcctccctgtatgagaagatgaatctagatgtctatctatgatttttttttttggttggcaggctggggtgggggacggtgaggagaaagggtcctgctctgtcacccaggttggagtgcggtggcacaatcacagctcactgcagcctcaaactccagggctcaaaccatcctcccacctctgacctcccacctcctgagtagctgggattacaggcatgcaccaccacacctgactaatttttgtattctttgtagagatgggcttttgccatcttgtccaggctggtcttgaactcctgacctcaagtgatccacctgtcttgccctgccaaagtgctgagattacaggattgaaccaccatgcctggctagatctctttgtgatctgaagttggagcagaactgcttatctttcgtgtcaactccacattttctgcctatcttcctgtgcctcactttgtacattcttgcatcccagacttaccctgctgcttctatttcccatctaaatatgaccttccgtgcctcctctatttgctgcatacccttactccaccaaggagcttctcactatctactcatttctttttcgcttaaaatacttcctattctccaaagctgggatccagagcggagattctcaaaagtgtggcccccaaatctgcactgttaacctcaccagggaactacttaagaatgaaaattcttgggcctcacccgcataacccctgagtcagaaactctggagtaggcccagcaaggtcttcaggggactctgaagcatattaaagattgagaaccactgctctggagtgaattccaggtcttccacattacccagtgagcactgtctaagggcccattgaaatggaccttacgaaagataagctgggcctgggctggctctcaggaaggccctggattctttaccgccatgcactgaccctgtttttctttatcccgtaaatgtttatggagaacttcttactaaatgcaagggaatatggtgggcttcggggaaattgcagaaataacttagctatgaattttgcacatatataagctgtggggaaaggagggaggtttaaggtatgtaaacaactaccaggcaaaaattgtcatcgatgagaaactgagaaagttgagtggagggagaaattgtttcctggttagagcataaggacatgaacgagtttgagtctttcaacaacagtcattaaatgcaggtggaagagctgagaaggggatcctcactgacttcaaaaaagttcagagttggagagaaaaaagtgacagtaatggtggccctcagtgcaagaagcagaccaggatagtggtttctaagcatgagctctgcagtcagcttggcttcacattctgtatctgccatttattagctgggtgaatttgagtaatttactcaaccatgtctttacctgtgttcctcacctgtgaggtgggaatagtaagagtacctacctcacaagggttttgtaaagatgagcacacaataataagtgaaaagcatttggaacatttagcctgtcacatagtcaaggctcatagtaactagaggttagtcattttgtcattgagtgttgtgatagcaacttgtataattgaaaacccaaaagtgaggactatattgtataactgttcttatgatgttttacttatgatagagtagctttagaaagcatttagacagtaagcccggctaggcttactcactaccaatacaattactttctatttgtagagaatatagtgccaggacttaatctggaaatgactccagtgtttcctcttctgatgaatggattctcagtcagcctgccccagacgtatggattaggactgccaaattcagaacttctaatgcctgggagtccgcttagggtaccagctctgtgtgagacggaagacaggccaggatctgtcttttgcatcatcatatgtctctgggtggggcagcttgcattgaaaaatataataaaaggttgaggtcacattgcgtccattggtgccaaagcattctgctcaggcatagaacatatggctattttgttttttcagtttccaattttagagtttctattctttggagccttttgtatctttctgttagaagaagaaaaaccaatatattgaactagctagtaaaatgattagaaaatattcatattgaaacaactggaaattctgttcaaagtgaaaaaaattctctccctgtgtatgtataaaacgctctgggccagaactctgacagcatcacggtatgtcctcaagtttgcctgacacaacctcaggagtttttctttggcctactcatctgtataggtgagatcaggaatagggggaaggctacggtcatctcaaccctgaagttcaccagttattatcaatgtggggcttacttttgcctatagaactaggcccagttaactctcagtgtgggagttgggggaggtaatagtttggaaggtgaggaaggaggaaggtcactgtttgacaggccgtctttattgtatgtgttgaggtgtggacttttcatgctacgtaaagtcaagcaatctttgtggcacatgtttaggctggggttaggacaacagtcactacagggtgagcaaatccatatggcagatgagtgacttactagacactggaggaacactgcgcctctatctcaaactcaccgaattcgttttctagggctgctgtaacaaagtaccacaaactgagcggcttcaataacagaaatgtattttctccccattctggaggctggaagtctgaggctgaggtatcagcaaggatggatccttcttagaaatattagggatagtctgttccattccatgcctcttccttagcttcaagttgtttgttggcaatttttgccattccttgccctcactgctgccttcatctttccatagtgttctccctgtgtgtatatttgcatgtaaatatccattttctgaggatgccaatcatactggattaaagcccaccctaatgacctcattttaacttgattacctgtgtaagggccctatctcaaaatatggttacattttgagttactgtaggtgaggaattcaacatatgaattttggggagacacagtacaacccacaaactcacatataatgaatccattctaattcacttgcgtacattattacatggaaagagttagaaagcactgtggaccacaaaacaggaagcttgaggtctacctctaatttgccagctctaccactaatttgcaatgtgactcagacacgattttaaggcctctttccatttcataaagagaggagttggtgttgttctcttagatttcattcaactctatgctcctaggactctgcagctctttctctgaagttctcctgttctgtctaggaagtgtgatgttgggtgataccatcttacttacttttttgtcttgtagtgatgtgagctgggccaggggttgctccaacagattccaagcactcatcgcaagaggggaggaagaactgagtcatgcttttattttaacttaatgctaaatgaaactgagaatactcatatggtcttctggtttggtggctgtgtgatgggttcccagtagaggcttctttctcctctacattctccatttggacaggctttgtcaaaagcgtgtctctccagtttcagttgacctaggatatgtcaacctgagtgagtctgaccacctggtgtggtgtattgggtttaagaccctattaggggagtataggcaccagtggattttgctaagtattcacagccaatgcaaatggtgagccatgctgtgcagacctcggttgtttccactgatctgcctagctattcttgagtgcctcgtgaagcacatcagggaattgttgacttgaaaacattttaataatgtgttttgattcctagtttgttctttaatgtttcctatctttaagaatcctttgagcattattcttcaaatattgtaaggtgaccttttgtgtatcttggacaaggcacttcagctctctgagcaacagattcctcatctataagacaggcataaaaacctgtattctgctcccttcttaggctacaaaaatggagcagatgaaatggtggataatgaacacagggttttaaggatgagagccatatgtctctgtttatattgttttggggtgataattaatgatatccccttgtactctcaaaaatgtctgagtgtgcataataaattatataatcctcttatatcataaaataatgaatgtaaggattcttggttttatcatttatgtcactatgtaaattatcttaaattttgttttcttagcctcacttgaaaaaaaaagtaggacttttttttttttgcttactttgaaggacagaataagagttttatacccacactctttcacgtaattgctgtcattggccacagtgcatcccaggcaggccctgttgccgcagtgtactgggaccatccaggtctagccagtgctcaggccatctacaggctttagtcactcaactgatttgctcctaccacttactctatccctaagactgtctccaaagtgatactggtttctgcatttgcccattttctttctgcacctaaagacaagtactgaagcccagtctatttataggattaaaaaccatgatcacacaggtagatagatgatggtaaaaagaataaaaacatggaaaggctgcaaagcttaggaaagggtatgatgttcttgcaaagggtttggcctaaaacctatccttctctacacccttgctgtgacagaaactgtaaaccccagtgggcttctgtcttctgcatttatggctaaacctgggacacacacagttctctcctagtttagagtacattttctcttttgggaaaaagcatttctccattaaagtcttgttcctcaactaaggctgagtaacaggttatattctttccttgaatgagcagttttcacctttgagaatttttagattggagagtaatcatttgacagaaacttttattcatctaactgcatgtatcttattaatattataattaaaaacttttttttacagtggaaagcaacttagggatcacaaaatctactgctctcatctcccttatgcagtagaagaaaatgagtactcagaagttcgaaaccgtcctttaattacagagtatgggccttatgcaggtctctaggcctagggtttctttctaacatactattcatagtcatttgtttatcattttgttttagcccagtttactgaatataataagtgtttagcaatgaacaatgcaattgtggatggactgtatagtttctaaatatgtgtcacaagaattgagtcagtggatagcatgccttttgctgcttttgtggattacagtggccagactttggcatcagtacttttaacattcatggtgttttgattagatacaaagcagctgacccaagtctatggtacataataatttgtcacaaggttaataactaccccatgggttgttctagggattacatgagatagggcacaaaaaaatcctgagtatgaatgtaaattccttgagttgcaacattggatgtaggaggaatcactcaataagagagtctagtcataaaacacttagcaataacttttgaatgagttagagtcaagaattagatgatttgaaaagctgtctgagtgtggtgattcctcaaggatctagaaacagaaatactatttgactcaacaatcccattactgggtatatacccaaaggaaatatagatcattctattataaagatacatgcacatgtatgcttaatgcagcactattcacaataataaagtcttggaacaaacccaaatgcccattaatgatagactggatataggaaatgtggtacatatacaccatggaatactatgcagccatagaaaaggaatgagatcatgtcctttgcaggggcatggatgaagttggaagccataatgatcagcagactatcacaggaacagaaagccaaacatcacatgttctcactcataggtgggagctgaacagcgagaacacatggacacagggaggggagcaacacacactggagcctgtcaggggggcaggaggagggagagcatcaggactaatggctaatgcatggggggcttaatacctaggtgatgggttgacaggtacagcaaaccaccatggcatacgtttacctatgtaaccaacctgcacgttctacacatgtatcccagaacctaaaataaaatacaattttttaaaaaaggaaaaggtttctggatgtagtttttatggatgtgggcaatttattataatacttaactgatttgtctctgtattacagtgttctttacgtttttcttgccagcaccacaggcctctttgtggttgcccctttctaatgctcctcaagacaacctgctaatataagcaaagagtaaatgagtgaggagagcaccttctcatgtcaggaagcctatggagttagatcacctggatttgctcatttcctggacaaaaactgcccttttaatcctcaatttcctattaaggactggttcaacattatcatttcccagggagagtcttcaacttgaagtgatcactcaatcactaaaagcctccaacttgaagtgattgcaaaaccactacagctgcacctttcttatgcatttcttttattgccttttggattggactttatgccttatttttttctccatttccaagtgtgtcttgcctagaatgtagcacacagtaggagctcataaaatatccactgaaattgagttgaacaggagagataaggcaaggaaactcagtggatcaaggccagctcttgccaagagttccaaacttcatctttgtacctgagctgcatatttctatggccttgatgaattccttggcagcagaatgttcaacaactgaaacatttatgaaaatttaagcaaatgggtcaataaagggaacaaaacgaagcccacacagtctactcttgtgctcttttgcttttaaagaagcttgtttgtgttatcacttcaacggtttgataaacaactgtgccttctcacggatctgtcccctgtgtttgaagtggtaaaatgtgatgattagtcatgggtaaaagctgtatgcatctttccaagctgcacggcaatacgtgtgcaggaatttgagtttattacacaatgtcatcatctgtcatggagcctctggaaaacacattatcataagaaaatgataatgaaaaagataaaccatggtcctgattttgctggattttcaggattaatgcactaaaaatcttactgaacgccagatgaggtttctggataatttgtttttcttctttgcgcttttctgtgttttctagttcttctctactggattcatttggttgacacaaaatgaaatattaaggtatattacaacgaggaccacattgcttaacttcataattccaaccacttcctcttccacgtatcttgagaaaggtaggagcatttttactcttcacatccatacactcacaatcagctttatcacttactagtggtaggattggagaagcttatgtgtactatgtccttcaggggcttcttatctaacatggggatactattacctgcctgtctgtctaatgggattatataatgcatgtgaaaatgctagactaattgcaaacacagaacaaacggatgttgtcaccattattgtcagatctctatgtatgtgcaaaagtgaaatccttggagacaagctgggagattttttttttttctttagcatctcttctgccaaaaatatatattgattgcagctggaaggaaaccgttctgagagagaaaataatgttgaatagaaatcagagcctgtttgatatttgacagcttggacatgtttcttcatgtttaatgataataataatttgacttttaagtgacttctctgacatgagagccccctaaatcaggaaagctataaactgatgcaaagctacccccagagagatgacatggaagggtaaatgggattgaccagtgtgtttggctgagggtactcatctgcctaagattttatgggcttcacaggaggcctgttctgtggcatgtgaatgacctgagaacaagtcacccaccagccttggaccccatttattgagattctactatgtgctaccctctggagtaggtgctttgacaaagttattacatttgaccttcagaacaattctgcgaagagagtactattgtaccattaatgtctgtaggaaaattgatactcaaatattccctagactacaattatcatcagatcttctaattctaaatctggtactcttttcattttatagacaactgcctgacaaccacataaaactgtattagtaactacgcatttacaaagcacttctacacaaattaccttacttgattgttactttttctgtctgcaagttttccaagtcatgctagtgtgttatttctgtctcagttctggtggcctacctaaaaagaacattgcatgatcatgaaccagaattctggtattgtctccttcaccagttagctttgttacttaaagccctaaaagagaagggaattgcctctactgtagctatttggtagaagaatccagaggagaacccaggcttcttgagaaccaggtctcccaacgatctttggagataaacagtactaaacatacaagtatttgtgcatttgttgcgatcattatttaattatttaaaaagtataattatgatctattccttctggtaatcaataagactctgactcaaaatgaaataagggaaaatgttggtagaaaaagacttagcataaaggctgggtccttattgatagtgaaaatgatacttagaggagaagaagctgtttaaagcttgcattagttgtagaaaccccagcttgaggcactgaatctgtaaaaactggagacagagtttgggctgtatttaaaagagtctatcaagggctcctctttgtagaggatccaagtcagacctcctagcctatggaaatcagcttgtcagagcaaatgaatgtattggagactgaccctgacctaggtagctttcaagtcatccctgagaaagagcattttagaggttgaattgatgagatggctaatatggttattgaagttattggaggctatttatttggattttgcaatgattcagatttatgaaaatgaatctgtaatgaaaatgaatggtggaaataagctaatacaggaagtgttcagctaccaaagcaaacctgccttttcaataagacaaggatattacctctggaggatgaataacatatcatttgagatattttattaaaagttaactgtgactctcttttgaaggcagtcgctattactccagggagaatgaccttgaggctacttccttctttctcttacctttccttttcttttctttcaccatttcttttggacatacgctggtgaatgaagactgtggaatatggagtgaggaataaggaagcccactcaggctgagtcagatgcagtaggagatcagtgaaagggatttttcattagggagtgggatgtgttgatgtgataaagcttcttgaagtagaattttatggcaagcgtgatattgtaacttgcccatatttatgcagcttttaagtagtaaagctacgatttgaactgggtctgtttgtcttgaatgcagaggccccagggaatttaccaggtctggctctcattggttttggatagcagaaggttgaaccttaacatgtcagtcattttatttgctagattgattacattttgtctggaacatggtaatctcagactctagtcagtcttcagcttaggaaatattttcttgattattatttctattccactacttaagatttgttcttaaggataaaaattacttgtaaagataaatctccagtatttactatttttattatcttccctttcatatctttcaccttttctgattcttgggagaatttcctctttacatcaatgatttaatttttactgagaccgagtctcactctgtcacccaggctggagtgcagtggtgagatctcagctcactgcaacctctgccacccagttcaagcaattctcctgcctcagtctcccaagtagctgggattatttttaatcccatgccaccatgcccagctaagttttgtatttttagtagagatggggtttcaccctgttggtcaggctggtctcaaactcctgacctcaagtgatccgcccgccttggcctcccaaagtgctggaattgcaggcgtgagccacagcgcccagcctatttaatttttttatagtgccagttttgttcttttccaattccagggtaggattaatttggctattttgttaccttgcttttctcagccaggtcccttaataattttagactatattgccataaattgtctttttatctcatcacttatcatcatccctaaccttaacaagcgtaccatttcatgtatttacttgagaacccagaacagacgttcccagtttttttcttaatattaaattattattttttttttaaagaactagggttttcttctgcactttcagaacaacttttccttatttcaattttatagcatgtgtccagcctgtgctttttttttgccccacccccacccccaaatgtttacttttccttgagcatgaatccaaccctggaatttccaaaagtgaggcttctctgttttcccttattccccaataatttccatgagagtgtaatagatttgtacaaagctcttcactaatttttaggaggtctattagtatggttctgcctaaataaggaagtatctcctgcttccaatgtagaagatacttctttggctctgaagaagataatttttcatcccttgtaagttgaaaattttctagttcttacttttccaaaaacagagtatacaatggtcagagctcttcctatcttcactagtgcccactcaacaactttacattacgtcctacttggaatttctttctttttttttttttttatactttaagttctagggtacatgtgcacaacgtgcaggtttgttacatatgtatacatgtgccgtgttggtgtgctgcacccattaactcatcatttaacatgaggtatatctcctaatgctatccctcccccctccccccaccccacaacaggccctggtgtgtgatgttccccttcttgtgtccgtgtgttctcattgttcaattcccacctatgagtgagaacatgaggtgtttggttttttgtccttgcgatagtttgctgagaatgatggtttccagcttcatccatgtccctacaaaggacatgaactcatccttttttatggctgcatagtattccatggtgtatatgtgccacattttcttaatccagtctatcattgttggacatttgggttggttccaagtctttgctattgtgaatagtgccacaataaacatacgtgtgtgtgtgtctttatagcagcatgatttataatcctttgggtatatacccagtaatggatatatacccaaaggattataaatcatgaaggatatgaacagatatttctcaagaggagacatttatgcagccaaaagacacatgaaaaaatgctcgtcatcactggccatcagagaaatgcaaatcaaaaccacaatgagataccatctcacaccagttagaatggcatcattaaaaagtcaggaaacaacaggtactggagaggatgtggagaaataggaacacttttacactgttggtgggactgtaaactagttcaaccattgtggaagtcagtgtggcgattcctcaacgatctagaactagaaataccatttgaccctacttggaatttctgtaccactgggaattacagtcttcaactttttctataagggtaatccactaatgctgctttagggaaaaagcaaatgtcatgggagagagaaaatcatcctagatggcttagttaaccatttccttattgtattttcttattgtaatatatgtgggaagggggatgtaagatttctgatttctgcaggttggagagggagctacacagtgggagcgactgatggtttctgctacttttctagccctgtatatacacatcagctggggatgaggccacatgctcatcttatacagatgagtactgatttctcctgggtgctgaaaaactgttgttagatattatcagtttagttttcattgctatagttctgtcaggtcatattttttgtttttgtgtattttaatgggatgtagggagaagaaatgccataagatgtatcaacactttatttttatgatgtcacactaatgtattgctacaaacttaccctcagtagttataattttctgggatcattttagaatagatgatgtccattgttgagctcatgttttcctatccgtggaaatctagcatcagcagctgaaaccatcagttttgggatgactttcaagcctgatttgtcctgtcccatgatccactcaaggcacatagggaagcagcttggcgtcctggccggaccactaaccctggaaggcaggggccatgtatgacttacctttgaatcctgtgtactttgcaaagggcctggcacctgggtttctagaatatatcaaattatggttttttgtttgtttgtttgttttttagaacaaatggaaagcctataaaatttccagagaaaaactcagtcaccttttcaggcactctgtcttcagcttctaatgggataactattttgatatgtagcaaatgaggttttttaaaaatcttaagtgcagtggtaatttcatactaattattgcactggacaaataaattattttcattgaaaacctaagttatgcaaaactatgatttaaaagaaaagcagaatttttatttattctcaagctaacctattatttcaaaataagccaagtgccctgctttctagggtaaagctaatgcaccctaaaactttgtttactggttagcacgctccaaactctgcgttgctctgctctccatgaggatcttcgtgcagaggctgcagcttgctcagcttcagaaagtcatggcagaagtaataaaactgctggtagcagcatttaggtacccaagggaacgttctcacaagccagcagctgatcttgagttgaaagaggcaagtgatgagctacagaagcaatgcagcagtctgatatgccaagttctgggtacctgaccactggcaggttcagtatcagctttcagcctgctaaggcatgggtccggtttaccacctattttgtttgtataaaactatatagaaaatctatttcaatgtaattttttaaacagtggactgattgattatgtagcacatttaccatggtttttctgtgatttttcaagaatcac

SEQ ID NO: 3013 - DNA, 2830 bp, Homo sapiens
cagaaacctggaagtggaaatctcgggcattcaccgtttgggtgaagacggaggcgggttctggacagacgtaggctgtcagggagtgtttacttcgcctccacttctgttcctccctgccctggtgctgctccaggtcacatactcgtcctgagccggcttcagcctgtccgcgcagaagtctcccggagccatggcctagtactcttatgtgaagtctagcaagctcgtgctcaagggaaccgaggtgaagagctgggtcctgcagctctggtgggagcctcctcagttcttttcggatgcactccacccccgcgaatccggtggaagccgtggtgcagagagccggctttgtggcctcccaggcttcgctctgaccctgtctgggctggacggaggccggaccgcggttcctggcgcctgtgcagagaggggcagcctcccgtgctgacgaccctggaaacaggatagacgggcgggtgacccgtggccccgtacccacgagtttgggtcccctgaggcatctctccaggcctctgcctggtaagaagaaaaagagcaaagataagaagagaaaaagagaagatgaagaaacccagcttgatacgttggaatctggtgaacagtaacaaactttggtgaaatttcaggaaccatagccattgaaatggatgagggaacctatatacatgcactcgacaatggtctttttaccctgggagctccacacaaagaaggggaaaatggctttgttggcctcaaatagctgctttattagatgcaatgaagcaggggacatagaagcaaaaagtaaaacagcaggagaagaagaaatgatcaagattagatcctgtgctgaaaaagaaaccaagaaaaaagatgacattccagaagaagacaaaggaaatgtaaaacaatgtgaaatcaattatgtaaagaaatttcagagcttccaagaccacaaacttaaaataagtaaagaagagagtaaaattcttaaaaaggctcagaaagatggatttttgcatgagacgcttctggacagagtctcagtcatagcctgccttcatctctgaagggaccaggcgacccatggagtgcctcggcagcctcgtcattgcatgcaatcttcacagacaagatctcactgcaaccacgtttctacaggagcacaggtgtgacattatactgatgacatcattctcagagaaaattcattttacatactaaggacacacagatacaaggaggcttacacaaagggagtggacctctcctcaacacagtagtgcaaggccctgccactttgcttcaattcctgaaaattccttggtaaacttggggctgctctattcctgacactttcaaaaaacagttattcatcctctcagcatccacaatgttaatacaaacccaacattcttcaatttgtgttttgttttttggaggcacagtcttgctctgtcacccaggctggtatgaagtggcacaatttcagctcactgcagcctcgacctcctgagctcaagcaattctcccatctcggccttccaagtagctcggactgcaagtgtgtgccacgacactcagctaattttgtttaattttttgtagagaaaaggtctcgctatgttacccaggctggtctcaaactcctgggctgaagggatcctcttgcttcagcctcccaaagttctggggttacagttgtgagccactgtgcccagccctttaattctttacttggggttcaggtgacaacatatttcttgtttacaaatcttacttaatctcactgatgctgtcattggcaaactgacccacctcgaatgaagcctcctccaacaagtctggaatctgtccaaatttaaattaacaggtacttctatgaattccctcagagaacacactgtggatgctttagagacctcttcccatgcatcctgaattatctgggttgcatatggtggccataagtagtccatgggcttctgatgtaaaaacaaacctgccccttttgaccctgctctgtacagcatcagggcagtgattgctgaccatatcctggaccctctggaaacagagggctctgcatccatgtccatgagccttcatgcccatctggccatcaggccttgggaagcagcaccccacagccttggcacagctgcagagacctccttgcctcaggatggagtcaaacctggaccccctgccattctcatctgcaggaaacactgccctccttcattctcaggctgtgttgctggaagtcacccgtctccgaggacccttgggatcgactgagtgaccagcagtgaagttcatccaccttctgaatggatgccatcatctgacatgatggagcgcagtgggatgctgctgccttccctcccttagctaggatgtccctgataaaggatgacacccaagcctcagcacaactggccaaacttgaggtggtcatctcagcactgatgctgggccaacaattagccccatttgtacatttttacaaatttttggcaattgtcaagaattgtccaccttccctccccattgaattaaagaaacttcttgcctcatggatactcagaatacaatcaaggtaacagatgcctttttttttaaccaaggacacagtacagatctcacagggacactccttatctcctgcagagttccagacactactgatggtgaccaaggcaacattcatcggaaaacacagtgctaggcttgtgaaagtgtccagtagggcttccactgcccctataggctgcaggcagctgctttagttgagagagagactgagctcctcaaagaattc

SEQ ID NO: 3014 - DNA, 864 bp, Homo sapiens
acggataagaggcattaattaggtaatgcagggagaaaagagcattaaggcagaggaaacactgtgtgtaaaggtcttgcaatggaaagagaaatggccttagaagcaaagactgaagatttctgaagaagaagcaatcatgcctcaataaagcaacctaagaaaccctgcctgagtttccagcctgctggcccatcctgcagatttagaactgaaaactacatcaactaatttgcctgcattcccactttaccagccagccctacagctttcaaacttgccagcccctacagtcatgctttattcccgaaggacacggtggatattttgtgtggcccaagaaaagcaaatgctggaaaaaagcactagaaactgccctttgaagtttgctaccaagatctaatatcttgacagaccaaatgggtacttggtgcctactgagaagcctttactccctttactcttcctcagatcaatgaaggacaaattgacttctctgaaaaaggttcggctttttgggaattttccctactttgtgtaatttttttattctgtagagctggcccagacagccctacaaatgtctcacttccaccacatttgggaacgcaggcctctgtaggtgacataattcatccactacacaaatcatgatccattcagcatttccatattatcttcatttgtcatattttaaaaataaatatacacacaagttttactatttgatttcaaaatatctggagaaaagcacactgatgaaaacattgttcctcttttaaaaaattactctattaaacttatcaccaaggcatggtcagaacattggagatggagaagcttgagagatggtctttattcttg

SEQ ID NO: 3015 - DNA, 1535 bp, Homo sapiens
cagaccttgaagatttcctgctgcagggatcaggaaactgagatgcttatccatcacttgtcatgtggcattacctaaagactgctttcaggatcatccactaccttgtatctctggcctgccccatgctcagcagagaaaatctgagcagagaatgtcaggtgcttttggcagaaggcattggcatacatggggtggtaagtataatatcaatgggatattggcagagcacaagaaaagagtccagtgcagtgaggtaaggaaaaagagaagcaaattcttcttaacactaattatttcttctccagcctatctaagattcacaagatttgggagcagtcaagtagcattttctttctgtttatgatttccctctgagactatcattgctttaggcaaatgcattcatgtgaagaatcatttttctccatgtctgagcctataataaatgtcaacccttttttggcaactgcaactaatgctgcagacctaccattactaaaaatgaaattacacatgttaggaccccagatcaatgtatttcaagggacatttaagatcactctggacaggcaatggaatctctccacctctgtagctatgagcctccttctggaaaaaaagataaaatttttacttgattttttttctctttctcttagtgcttggatcaagcaaaaaaaatgcaaatgaaatttctagccttgttaattcccctgaaatctagcatcctctctaaaatacttggtaaaactaagcacccaggaaacaaagtttaaagtctttaaggtgtgctcagtgtagcctgtaaggtgtttaataaatagcccttaaatttgcatagaaatcataggccattggagcaaaaagtaagctcaggcaatgtcacagaaaatgcttcattttacaggtgagagaaatgaatcccagagagaattggtttgcacaaaactacacgtccgtttagtggcacagcaaaaaccagaattaaggtggtctgacactcattccaataattttcatggttttttatgttttaagctttgatagaaagacttttgtgcattatctcatttaaagaaactaatgagatggtaagtcatttacaagtcagtcatctgggtaagagcaggggatcctctgggatctgaatgcttgggttcaaattccagctccaacatgtgtcacctgcatgaccctgaacgatctttctgtgcttcccttttctccacggtaagcaatggcatctatctcagtacccttaaaacgattgcatgaaatactggtaagcaatgacaactatctcagtacccttgaaatgagtgcttgaaatgctacaagcaagtgtctagagagtgcctggaccacagttagtactccataaatctgaagcgacatgatgtcatcttcacaacagctctcaaagatactcatgcagtgatgatacgtgtcaatcatttgacgtcaaatgtatttttcattccatctggcaaatcatatccctcttcttgaatggaattcctctgtcactctgg

SEQ ID NO: 3016 - DNA, 5088 bp, Homo sapiens
ttcccccttggaaatgccctggcttcacctgggtgctccagctcccagacaagacttagtggagacagggtgttcagagttagaacccacagagtctgggttctaactcacatggctttgggcaaagagcatgttccttccttacctccctctccaggaacatcagagggggtaatttaagagcctccctcctgtctttccacagtgtggtaggcaatgaccccgatatctgctaaaagctgcaagatggtcctgataaatttcattctgggttggccctcaggccacctaacagagtgcttcagcacacatcctggaggccctgaccttcctgtatccagacccagccttgactctggatccacaaagaatctctgagagtggatgattcggcccttaagcctgagaggctgagagtgggtagggctcagtgcctggagcagggaagagtggaggaggaagctcaggaggaagtttgcctgggaacctggcacaaatgttactcaggatgcacagtggggatattttcgtgtgttcagagggcagatatgcggatgactcaacgttttgcccacgtagtgcctcttgttgcttggctgccttagctgattgaagtcatcagtggataatgtagcaggtgcaaatgaattggctactgatggtttatacaaccctggaggacgcccctactctcggcctaatatggacagaaaatacagttattggactacagcatcaaaatactacagccctgtggacgatgaatcagagcatctccctcacccacagagaccacagtgttccacaagaagggaagatctgcagtagcaattcctgcggcggggggaggcttcgtgtctccccgtcctaattgctgtcagttgccctgcactgagtgctcacgaacaaggaaggaggcactgcgtgtggtcatcccaactcctcacagctgctgaagagaaaactctcatccatatatggtgttcaatgggtttatatgttgatgactcccatcatgtatttgcagcccaaattctgactcttctgtcctctgtctagaagatatatctatctatgtgtcctttacactccctggattcaccatggccaaacctcctttgagatgaagtctcaatctgttgcccaggctgtagtgcagtggcgggatctcggctcattgcaatctctgcttcccaggttcaagtgattcttgtgcctcagccttctgagtagctgggattgcaggcatgcgccaccatgctgggctaattttttttttttttttttttttttgacgtggagtctcactcctgtcacccaggctggagtgcaatggtatgatctcggctcacagcaacctccacctcctgggttcaagcgattctcctgccttagcctcccaagtagctgggattacaggcgcctgccaccatgcctggctaatttttgtatttttagtagagatggggtttcaccatgttggccaggatgggagaactaacctcaggcaatctgcccacctcggcctctcaaagtgctgggattataggtgtgagcaaccgtgccctgcctaatttttgtatttttagtagagatgaagtttcgccatgttggccaggctggtcttgaactgagctcctgacctcaagtgatccgccccctctcagcctcccaaagtgttaggattacaggtgtgagccaccacacctggcccaatgttccctttactatcctcttccctcaaactttgctctttctctgtccccactgtctcacttggtggtagcagccactaagtacccaatccagaggctctgagaagacgctaggtgtaccttttttttttttttgagacagcttctcactttgtcacccaggctggagtgcagtggtgaagtcatggctcactgcagcctcaatctcccgagctctggtgatcttcccaccttagtctcctgagtagctgggactacaagtgcacaccaccacgcccagctagtttgttgcatttttttgtagagacagggtctcactgtattgcccaggctggtcttgaactcttgtgctcaagtgatctgtccacctcagcctcccaaagtgctgggatttcagttgtaagccacctggcctgagatttactttttaattttaattaatagactatttttcaagagcagttttaggtttatgaaaaattgagaagatgctgggcgtggtggctcacgcctgtaatcccagcactttgggaggctgaggcgggtggatcacctgaggtcaggagttcgagaccagcctgaccgatatggttaaaccccgtctctactaaaaatacaaaaactagctgggagtggggacaggtgcctgtagtcccagctactggggaggctgagacaggagaattgcttgaacccgggaggcagaggttgcagtgagccgagatcatgccactgcactccagcctgggcgatagagcaagactccatctcaaaaaaaaaacaaacaaacaaaaattgagaagaaagtatcaatagccatatccctcctccccactagtttcccttattattaaccccttggatgagtatggttcatttgagtttgttacaattgataaaccaatatggacacatttttattaactgaagtctgtatttacattagggctcactctttgtgttgtactgtttgtttgtttgtttgtttgtttgtttgtttgttgagatggagtctcgctctgtctcccaggctggagtgcagtggcacgatcttggctcactgcaaagtccacctcccaggttcaagcaattcccctacctcagcctcccaagtaacttggattagaggcacccaccaccacacctagctaatttttgtatttttagtagaaacagggttttgccatattggccaggctagtctcgaactcctgacctcaggtgatctgcccacttcggcctcccaaagtgctgggattacaggtgtgagccaacatgcctggccttgtgttgtacattctacatataggttttgagagacattctgtatgttattgtaatggtgggtatatttaatgccaagtttgttcctaaagcagatagtggccttgtagtggggtacacatagtgtgtcccccgagaagaggagcactcagaacatatttgtcagtcccttccatcctttctccctctgcctcaaggaacacctactaccccaggtttggttcctggttggccctgaccccggcttgcctgtgtcagatgggagctgcctgtggtttgtagattagcccttatcttaaatgccaagctccaggtctgacctcacacagagctttgggctgatctgatgatatttggtgaggaacagatgcacttcttgactataagacctgtggttcagtctcaggtctcaccctttgtcaattttatgcacttattcattgacttagtttttacagctggggctccacgaccagccccagatgatcacaacagctgggaggcagaagtgacttggaacagctgaagtcctaaaaaagagccttaggtctgatttccattcagtcgtgttggcctcccttgctagttagctgagaggaaggaggactttctttctacccactccaactctcataaggcccccagtgatatctgtgttgctggagtgggatggggtgagagagggagagggagtagaaagagaaacacaagaaattcagggattgagccatattcctggtcctcacattggcactactgaaggcctctgttagcctttcaactcttggatgcctcgatggttcactttagaaggaaaagggaatgatttggaatgcctgcacttgttgcagggtgatttatccagggaaaaggaatgcactgttcacatttcttagcctttttttcttttaattgaagtgatgtgagcaattaaaatgtttccttccaaaaaaagccctttaaaaattctatgaaggtagccagatttcaattatgttcattatgactagatttagatgtgtattttgtataatgtagaggcataggacatctatgtcatgaacattctagaaccatccccagaaaaatgcagtttcattaggcacacacataacatttgcatgtatggatgggggtgagtcttggatcttttgcagcccacctagtgatggccactaggatcacaaactttaagaacagctcagtgaccctaactttcatattctgatcctacattgtgctaaggtgtgtgtgaagtgaccaaatttaatagataataaaattactaggctgtgtgctgctatctggccaacgcttgctttggacatccttgacaataccctctaccttgcctcttcaagggttttaacctctccatgacattgtcctctatgggagggctcatgcaccccaccccgcccaagaacttccccttaacattttacaaatgctgtagaaaaaattttgtgtggctgggcgccgtggctcatgcctgtaatcccagcactttgggaggccgaggcaggtggatcacttgaggtcaggagttcgagatcagcctggccaacatggtgaatcccgtctctactaaaagtacaaacattagctgggcgtacttagctgggtgtggtggtgcacacctgtagtcccagctacttgggaggctgaggcaggagaatcgcctgaacccgggaggcagagttgcagtgagctgagatggtgccaccgcactccagcctgggcgacagagcgagactctgactcaaaaaaaagaaaaatggtgtttcagtgtaaacctatgcattgtctacagcaaagctgtcagggctatcagattctactatgcattgtctttgagctattttgcaaggctctgtaaattggaagtaaccgatagatatgtaaattatgtcttgtctgatagtgatttaattgacttcctccccttttgggaaaaaaagcaatttaatctccatttgcaattcatctctacattccttcactcagtaagaatttgtgtgtttttgacttttcctttgaactattgcctggtttcttggtatcaggagtaaataaattcttcaacgtg

SEQ ID NO: 3017 - DNA, 2029 bp, Homo sapiens
gaggctcagccgctcgcggtggagaaagcaggccgcggaggaggcgggcgcccaggcctgcccggacaggaagtgggcccagctttcccactcctcgctccgctccttcctccgcgggaagggcaggccccggaggcagcgagcgccccgggggtggccgggcagccggatgctcccggggttgcgggctgtggccccgggggctgagggcggcgcgggtgcggcggaagcagggaagccgcgaaccggccttctggctggccacagcgccctgcacggacgatcagtgaatggagattactcaagtatttatcgagaacttgcagtgggctaggcacagttcaggctgacctttctcaaagttgaaccttcgtcttgtgaggaacagaaagatcaagaactctgaagcacctcgactttccacctgtgaagatgtgttcaaatttgcaacgtgcggccacacctatgaggttgaactttatacaattggtttctttataggtttagatggttgaatttaagttacccccactgctattattattattttgagacagagtcttaactctgttgcccaggcaggagtgcagtggcgagatctggactcactgcaacctctgcctcctggcttcaagcaattctcatgcttcagcctgtagctggaactacaggtcactccctctggaggaaaccagctgccactttgtgaggatactcatagtcctgtggaggcatatcctccatatggctgagacctcctgcgaacaaccatcactgacttgccagacatgagtgtgccaccttggaagcagattttccagccccagttaagccttcagatgacatcagcccctgctaatctcttgactacaacctcatgagagaccctgagccagaactagccaggcttacccctcatggttacaaagtggctgcaacagctccaggtgttctatcctttaacacagaataactcaaacaacaagacccaatattcagacaagaaggaaagggacttttggagagtgaagaaaactttcctagaaacctcaaacttctccccatgccttattggccagattgtatcccatgcccatttctaaaccaatcattggcaaagtgagtggaattgacgtgattagattaactttaccaagaatgcatcctcagagaggctgagaaaaagtccagcctcctttgaagagcctggctacctttcacctgaacaaaacaagaattctgatgaaaaatggagaatgtatgtggagcaggcacccggagtgtctatgccaggattttttttcagtgcgtttcaccggttatatttttgtctctttaccttacaagatatgtggcacgtttgcctaaaacaagccttgctttctgatttctgtgcactaggcacttaaaccttgcaaatgtcgcttacctaacagtcactgtcaaggagtacctggctaaagaatctccagctagacaaagtagaagtgtctgtgctctggcagttgaatatattgtatcaggctcaacagcacctttcaccaaaggatgagacttcacaaccattagatcttcttttattttgtttttattaaaaaaaaaaattttaacacaccattgctaacttgaagccattagatcttcttacccccaataccacaaaagtttagtggaatcaggggtataccaaggcaggtggagtaggggagctgggagtggtcagcccccagggcaggcaatgagggattgtgaatctgtgaagaattttaaagcaatgatacagctctaaatgcaatgtactatcctggacttagccctggaaaagaaaaaagatattagtggaaaaactggtaaaattcaaataatgtctgtagtttggttaatagtattataccaatgttaatttctgtgttttgataaatgtaccatggttatgtaagctggatgaaagatatgtgggaaatctctctactatttctgcaactctcctgtaaacctaaaaatgtttcaaaataaaagatttaatgct

SEQ ID NO: 3018 - DNA, 1375 bp, Homo sapiens
gggaaatagccagaaggggcatttggctggtctcttcctactcaggtattggctgctctccgtgtgtgtggagggggagttcctggcagctgctgatgcactgggagccaggatcagtctagggacagactctcatgcatgcactatcccagtgctcactcattctttcctctcttcctggggctccctctgggcccaccacaaccacgaactctttccagccttcctccacccagaagaggatcttttgggcagttatttttccatttgcacctgtgtcagctttggctatggggaaggaccaaactcttaaggaatcaaccatgcaggcaaggagacacttttgaacaaggtaagatttcaggcagaaattatagtaggtatgcagctgcccatcccctcatccatttatctccccgatctttcaaccagcaaatatctattgagcatctactctgtgctttgccaggcactaaattctgtgatgaatggggatgcaatggtgggcaagacacaatttttccttcaaggatcttataagcctaacggcaagaatcctcctaagagagacattcgacaatccaggtttctggaagtggccactaagctgaaatggaatggttagccaatgggtaaggaaccatgtgtgcagaggtctaagtgagagagagcagagctttggagaaatccttccccactggccaccaggccaggctgcgagcatcacagctgcagttttcatttgcaaagcctgaggggctggttgctcagtctcctgggctccaagcgcatgatgcataaaaatgagctattctctttccaactgcacagtgccatcctgccacagggctgcagaactgttacctctgaatctggatgctgagcctgagatgttcaccacagtagtgaatggtgggttgattgtaaggaagaaaaccttctaagccatttttgtctggtctcaccccggctcccacaggacttcactatgaccctgtacctgcggcattactggaaggatgagaggctagctttctccagcgccagcaacaagagcatgaccttcgatggccggctggtgaagaagatctgggtccctgatgtcttctttgttcactccaaaagatcgttcactcatgacaccaccactgacaacatcatgctgagggtgttcccagatggacacgtgctgtacagcatgaggattacggtcactgccatgtgcaacatggacttcagccactttcccctggactcccagacctgttctttggagctggagagctgtaagtatcagcattcctaattccttcactttctttcctctctgatctttgtgccattttagtaatcatgagactgagcactgcccgcc

SEQ ID NO: 3019 - DNA, 3096 bp, Homo sapiens
acacgatctaatcctttacttctggtgttgttccacttgatgacaggcctacccttgtagcagtgataaggagtgtgaagttgggaggtattgccacagtccccaccaaggatcatcggcctgcatggtgtgtcggagaaaaaagaagcgctgccaccgagatggcatgtgctgccccagtacccgctgcaataatggcatctgtatcccagttactgaaagcatcttaacccctcacatcccggctctggatggtactcggcacagagatcgaaaccacggtcattactcaaaccatgacttgggatggcagaatctaggaagaccacacactaagatgtcacatataaaaggtagggatatctgtagttctggggtttttttaaaataaagaaatagaagaaaaatatagataattaattccattggttttagaaaaaattacaaggaagtttctttaatcctagctagtcattaaacttgttatttaggtggcaaataatggaaacagaccataatagatttatgtgataagaggcagagccaattggtatcaaccaagacttttcattataaatggtaacaacatagaagatagtataagtaaaaatattttatgtgcttctgattgcaaaatagaattttttttttctgaagtgtcagggtaacatctattggtcatcatctctgcagggcatgaaggagacccctgcctacgatcatcagactgcattgaagggttttgctgtgctcgtcatttctggaccaaaatctgcaaaccagtgctccatcagggggaagtctgtaccaaacaacgcaagaagggttctcatgggctggaaattttccagcgttgcgactgtgcgaagggcctgtcttgcaaagtatggaaagatgccacctactcctccaaagccagactccatgtgtgtcagaaaatttgatcaccattgaggaacatcatcaattgcagactgtgaagttgtgtatttaatgcattatagcatggtggaaaataaggttcagatgcagaagaatggctaaaataagaaacgtgataagaatatagatgatcacaaaaagggagaaagaaaacatgaactgaatagattagaatgggtgacaaatgcagtgcagccagtgtttccattatgcaacttgtctatgtaaataatgtacacatttgtggaaaatgctattattaagagaacaagcacacagtggaaattactgatgagtagcatgtgactttccaagagtttaggttgtgctggaggagaggtttccttcagattgctgattgcttatacaaataacctacatgccagatttctattcaacgttagagtttaacaaaatactcctagaataacttgttatacaataggttctaaaaataaaattgctaaacaagaaatgaaaacatggagcattgttaatttacaacagaaaattaccttttgatttgtaacactacttctgctgttcaatcaagagtcttggtagataagaaaaaaatcagtcaatatttccaaataattgcaaaataatggccagttgtttaggaaggcctttaggaagacaaataaataacaaacaaacagccacaaatacttttttttcaaaattttagttttacctgtaattaataagaactgatacaagacaaaaacagttccttcagattctacggaatgacagtatatctctctttatcctatgtgattcctgctctgaatgcattatattttccaaactatacccataaattgtgactagtaaaatacttacacagagcagaattttcacagatggcaaaaaaatttaaagatgtccaatatatgtgggaaaagagctaacagagagatcattatttcttaaagattggccataacctgtattttgatagaattagattggtaaatacatgtattcatacatactctgtggtaatagagacttgagctggatctgtactgcactggagtaagcaagaaaattgggaaaactttttcgtttgttcaggttttggcaacacatagatcatatgtctgaggcacaagttggctgttcatctttgaaaccaggggatgcacagtctaaatgaatatctgcatgggatttgctatcataatatttactatgcagatgaattcagtgtgaggtcctgtgtccgtactatcctcaaattatttattttatagtgctgagatcctcaaataatctcaatttcaggaggtttcacaaaatggactcctgaagtagacagagtagtgaggtttcattgccctctataagcttctgactagccaatggcatcatccaattttcttcccaaacctctgcagcatctgctttattgccaaagggctagtttcggttttctgcagccattgcggttaaaaaatataagtaggataacttgtaaaacctgcatattgctaatctatagacaccacagtttctaaattctttgaaaccactttactactttttttaaacttaactcagttctaaatactttgtctggagcacaaaacaataaaaggttatcttatagtcgtgactttaaacttttgtagaccacaattcactttttagttttcttttacttaaatcccatctgcagtctcaaatttaagttctcccagtagagattgagtttgagcctgtatatctattaaaaatttcaacttcccacatatatttactaagatgattaagacttacattttctgcacaggtctgcaaaaacaaaaattataaactagtccatccaagaaccaaagtttgtataaacaggttgctataagcttggtgaaatgaaaatggaacatttcaatcaaacatttcctatataacaattattatatttacaatttggtttctgcaatatttttcttatgtccacccttttaaaaattattatttgaagtaatttatttacaggaaatgttaatgagatgtattttcttatagagatatttcttacagaaagctttgtagcagaatatatttgcagctattgactttgtaatttaggaaaaatgtataataagataaaatctattaaatttttctcctctaaaaactgaa

SEQ ID NO: 3020 - DNA, 1667 bp, Homo sapiens
gagtgacagagaagactggcagctgcagagcaggacagaccagattggccagtacaacagcagagggccatgttgggctttgactcaggaatcctggtggaggcaatgatgagagagaagagataaaacacactaggtaagccaaggtagttgtcaggatagaaggagacaggcaggccagatggctgttaaccgtgtggtgtgtcccaactttccagcatcaatttaatggccaaattaaaatcagcagagccaagtgttagagttattgctgcctgagttataacagctgccctgggaatcttgtctgaacaacaagttaactgctgttcccagttatatctggtctttcccacccccaaacatacacaaaagatttttgtcattcttggcactggacaacagaagtgataagacatgccagcagaactctaaaggcagaatgtccttccacctgttttatgctgtaagacaaacttccaagtgcgaggcagtgtggagggctgttgccttgaatggcagctgaatgcaccagcgggatccttggcagcaatgcccaggcactgaagtcgggcattcaggagagctaaatggagaaaagaaacttgagcaaactgcttcctggaacactgagaacctgaatgggaaattaagaagaaccagattctttctattcttccaccagccaaggtgatgagcacaaaaggatccatcttatacagtgcttgccagcttccataatactactcaccacgatgttgaaatcacctgttccagaaccagtcctgtcctttgacaagaaggatttaattatcagtagtggtggggactggctggagagaggaaaaacacttcaaggactctgccacctttcgtagatggagagtgcaaagtttgtaccatggaactccttctctaacagttactctgtggcagtgcctatttcaaacctcccttaacttctgattgtatagatgtttgtttcatttgttcatctgtttgttcacttagtcagagatgttttaagccttaagagaaatagtggactagaaaatgccttggaaaagtacaaagttcaatccaagtaaactgtttttaaactaggaatttatgaagcctaaaatataaaatgtatatacatggatatgctctgaagtgaggtagaggggtagaaatcaacattgtgatattgtactatagttttgcaagatgttaccattgggggaaaatgtttgaagggtatacgggatatctctgccttatttcttacaactgcatgtgaatctacagttatctcaaaataaaaatttaattaacaattgattacaattaacagcattaatttcttatcctgtcattttccttctcctgaaattgcagaatagccaaacagaaacctacccatgaccaccatctgagattctttggtgcccgtattagtggacataggcaggtgtatcaggaggcatccagtcacgcatactggaagatactgactcaactgatttaagcaaaggaaaatacagtgtattatataatgagacatcttgagtagggtagtcctagggtcagttgattcagcagcttgattgataatcaagggcccaaattctttcccactttctaccctgccatcctcagcctatcagtttcgtcctccagctggc

SEQ ID NO: 3021 - DNA, 996 bp, Homo sapiens
gtttgaggtatttttcaatgaagacattttctttgcagaaagaaatttcagagcttccaagaccacaaacttaaaataagtaaagaagagagtaaaattcttaaaaaggctcagaaagatggatttttgcatgagacgcttctggacagcttggtatctgagaccatctgcctgctgactggcttttctggcacaaacattctgcatgtaggcccagtgtgttcctcgactccatatcaacccgttcaccctcatgttcccttggttcctgtccccagtccagcgagcagaactgattacagatcttgacaacagaaggtacagatttaaaataacttgcctgttcccgtggaatttatccactagtgaaggaggacaagtggacaaggggagagggtaggtgggcgctccttcccttttcctcccattccactttatacaaaccccagctagaccactgggagagcaacggaggttaagaatgactgcctctaaatattgtcatttggtccactcttcttccatcttgtatacaaggatatcatgactttggtttaaagcactactgaaaccaagataaactgtggcttagcattcccccgatggatcagtctagtaatcttatcaaaaccaagattacctaaaagcactaaccaaaggaaaagctccctcaccccaacctatgactgctcacatttttcagattgaatcatttcaattgtattttaagatccattgactctttaccacctccaagctgctcctgaacacaactgattattttaattttgaaaactttctcacttctagaatttccacttgagcctttgttattattgtagtttcttcttctctgctgtgatttcctatccatttattttaagggtttttggggttttgattttagtaagaattacaataactactttaaaaatccgcactaattccaacatctgggtcatctcgaagtcagtctctattgattgcctttttctt

SEQ ID NO: 3022 - DNA, 1110 bp, Homo sapiens
cgcgcagaagtccggggctggcaagcgcttcctgcgcagcgcctaggcgacctggagtttgtgacgctgtgatggtctagaggctggagattcaagatctgggtgccatcattttctggttctgttgatgaccctcttccagtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaaggtctcatcgtgttgtccaggctggagtacagtggcacaatcatggctcattgcagccccgatctcccgggttcaagtgatcctcctacctcagcctcctgagtagctaggactacaagtgtgtgccaccatgcttgcaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaaggtaagttttagagaagacatttatgtaaattatcatatttgaaattattttaggtgggtttagaagcatattttcttatttagttcaaaggtatgcacatgtatggaaatatgccattatcacattatacttattgaaagactagaagcaacctaattattcaataaaatgggattaagtatatgtatatttttg

SEQ ID NO: 3023 - DNA, 1715 bp, Homo sapiens
atcacctagtggggttcatgtctaaagttgtagcctggtctcaattgatggtaggatattgagataaaaccttgggataccctcatggaaatctgcaatgaagccattgatgtcttttgtggttgcagcttgaataagacactttggcacattgtttggacataggaagcacacataaatgttagttgcctttatctttctttgtcctatatcatgaaaggcaaatacttatgatttccatgatcacaaacatttgcctttcactgctctttatcagtatctgaatttagtgtctgatcttttttttttatgtagacaacttttaatctccttcctctgcttaaaatgcttacctactttctctccaacaagtcatgttaatcaagtcgattaaaacctgaatattatctctataaggatacctaatatcaacctaatcttgtgtatttatttcctgtgcttgctattggtttttctttattctcaccagatcttaaccaacacttaaggcctctaagttcccatctagtgcaaaaagataccttcagccctactgtgtttgtttgaattcaaattactattgcttttagatcagtaccactcgttaggttttaatgattttgtgtgttagtgatgatgtcaccaataggttgtaaactcctgaccatcgggccttctgtgtatttgtatccctcacaatgctaaatccaaagctcagcgtatactcattaagtgcttgctacttaaagagtccacgtgtgggtggaaaaatgattctgaagtctctctacagccctaactcctgcacctttttgattaatcagagttgggaggtgcctctctcaccactcttctcttccagacatctttatgacctttcttttgacattccactattttctctctgccatcaacgatttgctcagctctgcatcaatgagatctttgtgattataaaataacatgaggtatgcatggaaagaatttgttgcatatcactataaatgagatgttgctcatatgaggtaatgtgatatggcaagccccaatcactggaatgttcttggtgtattattgaacacaacaaaaatggaacagttacaccatgcacatatgactttgcaaatttattctcagaaatggtgaagtagaaaccctaaatagctgcttataatttgctgtgttatatataaatacaactaagtgtagacttatctccagcaactggtttagtaaactggttatcagctatctaaggatctttgctattatatgaatacaaaatttgaaaatgcttggttgaacttttcttttgtgctccttaaaggtagaaatagtaagcaagaatattggaacatttatgaagaaaataaatgtttcacaaaaaatctgtatagaaaattggactgttgatataaaattgctatcactctgaatattttcatatcattatctcagagtttttgaatatatcattttctaagttattctaaacagcaaatgggaatcatgtacccagttaattgacaatttaattagctgaactatgatagtatttttctgatgagtaacttggaatattagttaaggcaagctgatgtattgtctgcatttattctgcaggcagaactgtgtttttacttctactgacgataaaaatttttttaaccccgatttgtgacaaagaagagaactgttagcttcggggcggttcc

SEQ ID NO: 3024 - DNA, 2189 bp, Homo sapiens
ggcaggcgccaggccaggtcctgggtggcctctgtagtgaaatgcagccctggttacctccagcctccatctctcctggggagattaacattattgaatctctacaacatcctagaacaccctagacaggaggtcttttttttttttttttttttttttgagacagggtctcactctgtcatccaggctggaatgcagtggcaaaatcatggctcactgcggccttgaacccccgggatcaagcaatcctccagcctcagcctcccaggtagctggatcagcagatgcgcaccaccgtgatcagctaattttcttcattttttttgtagagttgaggtctcactaagttgcccaggctggtctggaactcctggactcgagcaatccccccgccttggcctcccaaagtgctgggcttacagacatgagccaccgtgtccagctgacaggaggtcttaacatccttgtttttcggacgaggaaactgaggcgtggagaggtggagacttacacaagatcatagagcgaatagagggcagagctggagtctgaagtcagtctgaccgaccatgaaactcacatgtcatcctgacaccattccaatcctgtgaggtccccctgcttctggtaggcagctgcagaaggtgaagatgcagcactgaggaggcaggaggagggctgaccaccagctcccggcatgtccccagcaccaagtggcccagagagagcccaggatgcgcacgcaggtggatgctccgcgtgctgccctagcgggtgcctcaggaccctttgacatttcagtaccagaaatcaaatgtcgcttcagaagcccggccctccaaagatgtcacaatccaacctcccacacgcacagataggtctggaaacttgaatctctggaatatgcaaaatgcccccttcaccaccaagaaaggaccatcctggtccctgatccccgggggcacaacactgctgtgtgacaggggcatgacagctcccatgaaggagtccagaaccgagacctgtggagagaacatgagatgcccaaggtcacgaggtgagaggctcaaggtcacagagtccatcataagactcagatcttatattttctggggctttgccagggctgcctgtcaagacattctggctgtgttcctccagcagatctgaaacctgacccaatgcatgtatgctctcagccaagagccagcccaggtaacaggtgctgggcatgtacgtctcgctggctcaagtcataagaaaaccaacaagaatgctctcgtgtgctttctgctggaagcccagaggctgagaggaggagctggaagacaggtggtaggctggtttaatgagctctgtcctgccccacactgcccagaaaactggctcttcctgagaggtccccaggtgccactcagtggtagctcctgagaaggtttaggaagcatctacattgcacagcataatactgaacatcatctatgaatcccctagccccaaacttaagaagcaggataattaccaagtagttgaatttcccctgggagacacagccttatgtatgtggatgaggaataagcaggaggaaatttgggagagtgagaaatgtggtcaaggtgttgaaatggtgaccaagacgctgtctaaggttcaggctgaggagcctgcagctttgagttcttgcttggttgtgggcatctgcctaccttgaggcagctttattcagacccctgacacatcaggttaacagcatcaccattgccaggcagttaacatttaccaatgccctctcagagcctggccaagaatgcagaggatgtagaggtgaaatgtccagagggtgtttttcaaggaacccagcctagaggggagaactgagagtaaacagatcccacagcacacaataccccaaacaatagaagaggggtacgtatgaaggacccaaacataagactcagcctggagcagttgaagtttaacagaggaggggatttttgtgctggactttgaaggatgaataggagtgtgcttagaggacaaagggagggtgggcccatcccaagtagtagatagaaaaggcatgaagttacaaagtttgaagaactgggcatgtttgcaaacagttcgtatgctagatactggggaggaagccaaaaatgaataatacatgtttctgctttgtaggcgat

SEQ ID NO: 3025 - DNA, 1348 bp, Homo sapiens
cccagtgccatacgcccgcactcctcagcccttgggtggtggatgggactgggcgccgtggagcagggggcggcgctcatcagggaggctcaggctgcacaggaacccacggagtgggtgggaggctcaggcatggggggctgcaggtcccaagccctgcccggcgggaaggcagctaagcctccgtgagaaattgagcgcagcgccggtgggctggcactgctgggggacccagtacaccctccgcagctgctggcccgggtgctaagtccctcattgcccggggccagcagggctggccgactgctccgagtgcggggccgccaagcccacgcccacccggaactccagctggcccgcaagcgcctcacgcagccccggttcccgctcgcgcctctccctccacacctccctgcaagctgagggagtgggctccagccttggccagcccagaaaggggctcccacagtgcagtggtgggctgaagggctcctcaagtgccgccaaactgggagcccaggcagaggaggtgccgagagcaagcgagggctctgaggactgccagcacgctgtcacctctcaatacaatttcatctctctctctgctatggacacagatggcttcactccatcctgtattcttcggaccatgataaaattccagactctcggtagtttttgcgttccaagaagtagagcctagagtggtggcctataattacagttactcaggaggctgaggcaggaggatcctttgagtccagcagtttgaggccagcctggacaccacagcaagaccaccaataaataaataaataaatggaacatgtttccctgtcatggtcattttcatccattcctctggtagaagcatcagattccttcaagcaagggtttatgttggggtctctcaatctctgcgttagcacaggcatccagtcttcttatggagggggacggggaggtggaatggagaaacgagagaggcgaatcagagacctcactgccttctgcccattggtgctgcccgtggacggctggcacaggggagcaccccatgcttctgccttcaatggtgcggggaggggcagaggacaaggaaacgcaggaaactaggagtggggcaggcagacatgcttcaaaggctggagccaaggagggtgcagggagagttgggagttcctggaccaggcaggggtcacctcctcaccacagccagaatagctctaccagtgcccatgccatctccagctccaaacaccgttttttctgtttcctaattcattaatttctttctttttttttggagatggagtctcactctgttgcccagcctgtagtacagtgg

SEQ ID NO: 3026 - DNA, 1604 bp, Homo sapiens
gtgtgtgtggaagggagagagctgtgcgagcgtgggggagagtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgt

SEQ ID NO: 3027 - DNA, 4313 bp, Homo sapiens
taggctacagtgtagtggcgtgatctcggctcactgcagcctctgcctccgagcggggtccagcgattctcctgcatcagcctcctgggtagttgggattacaggtgcatgccaccacacccaactgatttttgtatttttagtagagacagggtttcaccatcttggcctgactggtcccgaactgatctcaggtgatctgcccacctcggcctcccaaagtgctgggattacaagcgtgagccactgcgtggcctgagcactagggcgcaagagaagccgtactggaatattacactactcagcacaagacaggtttaatctttttcttgggggacaagattggaaaattgaggtctgagcagacctgaagagaggcatccagcaactctgagattaaattcatcattgatcaattcgttattgtttggaattgacgtttagctgtgttcctcactcagatacgtgcatgatagctgcttgctaatttggtcttagctcacatttcacctagaatgtatggtctccctctcccctgcaaaatatcccactgttgctaatctgtctgcctcataatttccatgagattgagcatcttgtttgttttgtcaccactatataacagcatgttggaaacaaagcagtaataaagctagaaaaaccaagcgaatacactggattaaaaaaaatactgtttcctagaattaaagaaataaatgaggccgggcgcagtggtgcctgtaatcccagcagtttgggaggctgaggctagtggatcatgtggccgagatcgcgtcactgcactccagtctagcaacagagcgataccttgtttcttacttaaaaaaaaaaaaagacctcatttgttaactgttaaacagaaaacaagaaattccctatacctgtatgcattatagagcaaataagagcatcaaaaacaatcttagaaatctttcagagaaaggtcacctacaaaggaacattgatcagataatagatttttttttttttctcagatggagttctgctcttgtcgcccagactggagtgcaatggcacgatgttggctcactgcaatctccgcttcccaggttcaagcagttctccagccttagcctcccaagtagctgggattacaggctcccactaccattcccagaatttttgtattttaattagtagagacggggtttcgccatgttggccaggctagcctcgaactcctgaactcaggtgatctgcctgcctcggcctcacaaagtgctgtgattacagggtgtgagccactgcacctggccgataacagatgttttaatagtaagataaaaagtaaaatttccagtgtgtcgaaggaagaaaattacagcctagaattttatcttcatgtacattatttaagtgtgagggaatagtttcagtgacattatgtcattgaagaccttagaagatttccctcgctaaaggagataaagcgactggcacaacatgtatttctctgagtaattagaagtgttcttttctggctgtactgaagggactttcatgatttcttcgtttttgtactcttagttttataatattgcatagtagctaaggcctggctgtagcagttataaactgttctgcaagtgcgggaagtaatagttattcctatctcaaggatgtggggtttaaatgggttagtgcacaaaaggacatttattaaatttagtcataatcatctcaaggacatggtaagtgaaagagtgtacataaagtacttaatgtaatgtttgctacttaatgttcaataactcaaagagaccaccaccactactacattttacttttattagtaattaataataattaataattagtaattcagtggtaattagtatactaccaaagaaagtacttgagcagaagagccaaaattcaaaccatagaatcattttactgtgcttttattctacctcaaacactaatctccaggccttggataaagggattatttctctgaaggggaaagttatcctctttttgcccaagtcacacttgtgtcatttcttatactgtaaacatgtggttccaattctgaggtattttcccggtttgtaggacccaaaaagaagttaggcttgagaaattttaagtgaagagaacaattctagttcagagtgattggctcttcctaaaagctgacatttgactgaaaattttgaggggagggaaagaaacaataccttttacggcatgtaataggaagaagacctggattttagttgctgctctgatgtcccaacttgggtaaggcaacataacataaatgtcagtttcttcagatttgtgatgaagctgataatccatgctcagcttcctttatgggtctcttgcctatcaaataaggtacagtatgtgaagatacattgcagattatcttatgcattgcttcaggggatgattaaaccatcctttattatagccagagtctagtctaagggaagaaggtcattctctataccagtgaaggctccatccaaaccagtgtttgggggcatagtcataattgaaaaatgattgttttccttatctgtaagacaggtaaatggtattaatcctcaggtggttgtgaggattaagtgatacatgtaaaaaaaagaaagctttggatagtacctattataagaaactcagtgttgctgcaatgtatgtattataatggatttgaaatttgccctaaccaagagtcacagacagaaaaaaggaagttaatgtatctcttgatcactatcaagatgtggtattgaaccttcaagatccttttcagggaatatgtgagatcaaaatttttatactggcactatgatgttatttgccttttcctcatattcacaagtgaacagtggagttttacagaagctatataatgtcatgacatcactgatgggtaatagaatgtgtgcttgtatattccgaaactttcagttccaatttcttcgatcaatgtaatcctcataagtaaaagttatttgaggacctcagacatttttaaaaatgtaaagggggtggggtcaggctcagtggctcatgcctgtaatcccagcattttggaaggccgaggcgaacggatcacttgaggccaggagtttgaaactagtctggtcaacatggtgaaaccccgtctccactaaaacaaaaagttttctggatgtggtggcacacatacctgtaatcccagctactttggtggctgaggcatgagaatcacttgaacccagaagacaggttgcagtgagccaagattgtgcccctgcattctagcctgggtgacagtgagactgtctcaaaaaataaaggtgtacagggattgtatatttgacaacttggtatgtaggatgtgctacctctaatgttccatgctgttacttagttttcactcactactatattttggagatttgttcatattgctctgtgtacatttaattcttcagtgtgtatccaccacatttaacttattcacttacagaactatgcaagaatttctctggtaaatttcactaagtacttatgtacttttcagaacgattgtgagtttacacccctaccagcaggactgagttgagtacccatttcctcacatccttgccagtacttcatttgcctaatttttgccattctcataatgtggcaattgttcaattttgcatttcttccattttatttttttgcatctctgcttttcttttggttagctttgccagttctgcctattatattaatctcccagaatcagcttttagttttgttaaatctctgacatgtttcgttgattcctgctttcatcttaaacatttcttcgttgttaatttgtgtttgctataaaataagcaacatcttaaatgcttgatttgctttcgatgtttattctgtaataagatatttaaagatataattttttccctaaatgctttattagacttttctcataagttttgactggtactgttttcattgttatttaattttgtgttttttaacttctttcatgatttccttttaactgaaggttttcttagatatttagtttgctggtatattcttttaaaattgtatcattgctttctttctatattggattattgtcagagaacatgatttgcatgatattaactttttggagtatattgttgcatctttgtggcctagtacatagttaatttagtgaatgcttccagttgtacttgaaaagaatgtatattttctgattattgagggtaaatttctctatatatgttttcctgtttaataaatatgtagctatgtgctta

SEQ ID NO: 3028 - DNA, 625 bp, Homo sapiens
agctaatccacacaaatgctcctcctcctcagccttaccaaatacaaaactttaggcattaatactgcctggattatggaatcacactttgaaagtgctttaagtagatttctgtttttcctacaggagaactgcttatctgtgcagcaatctatccgagggcctttgggccattatgctgtgaatgtgacatctgcagccaagctctgcagtcagagtctatgtaacaatcatggaagagtattcgaaaaacacctgagtcctccttctatctgcatatgcctgaaagcagtgtcaggtccctcagctgcaggtctgttggagtttgctggaggtccattccagaccttgtttacctgggtatcaccagcggaggctgcagaaccgcaagtattgcagaagagcaaatattgctgaacaacaaatattgctgcctgatcctttctctggaagcttcgtcccagagggcagccgcctatatgagttgtctgtccacctctactgggaggtgtctcccagataggctacacgggcatcagggactcacttgaggaggcaatctgtcctttctcagagctcaaacgcggtgctgggagaaccactgctctcttcagagctgtcagac

SEQ ID NO: 3029 - DNA, 4356 bp, Homo sapiens
aagaaatgttaatgtatataggaataggactagcgcttcctggttcattttcattgcttaggggtaatcatgatttgaccagatctttctgattgatgagtctatctgatgattagtgaaccagctattcttaaggaaatacgttgttaccatatttccttgtatgttgagaagtatacctgaaagttataatagcttcagaattagtgtaattagggccttccttactaaaaatacctttgcaaacaaaagaaaatggtaacacagatactcccatcttgacttagcagtgacactgcaggaattttttttcataaaatattctttatagttattgtcttatataaaaggaatgctcttatgatgaaactttgagtaaattacagtgctgacttatgagtatttcttactgtgtccttagctaaaatcaatgaaactgatacatttggtcctggagatgatgatgaaattcagtttgatgacattggagatgatgatgaagatattgatgacatctaaattgaactcaacattttacattccatcttttctgaagattgtcctacaatttggattttgatcatgacaaagaagattaaaatttcattagcatgaatgcaatttgttaaagcagactgatttgtttctaagatatttttggtttttttaaaactgataataatgctgaattatcttaagtgagatgttaagcccactttgttcttttaatgtaatggagcttatgggtagaagaccatgtctactaattacaaaaaaaaaaaaaaaccatgcattgctgcttttcctaccacttccagtaagaaaatgggtgttttgaagaaatcatttgccttgtcctcacggaatctgattaagccctggcctcttgattgtatagagtcattgtgtatattccagttacctagatattcccttgagattttgatacaatttgagggaggcagaagtctgcagttgaagaaaaaaaataagtctgtttgtcatatttaagtagcctgtggctatttttatactgattttgatatcatgttcttttcatagtcgtattttgccaccgtaaacataaaaaaaaaaaaaaagatttccaaaatgccgttttcagaacctgggttttaatagcagtattgaatttgtaagcttagtagttgcagaaattgaacactaggtggcactcagttatcttaacaggggaagtactgatacaattgttgacttttcttttactatgtgtaagaaataccccaaacatgaaaagattgttttgatcatatgcatgtatgtagaatatttttgcagagcagaaagattatgttagaagtgtgatttttattttcagaagtcatatacatgtaagctacaattttgagtgctttataaacacttaagatatatatataaattttaatttcatagcaacttgtaaaaaataaaatacttgttgaaaagcctttttcaacatatccctaagctaagggaagaggaaggaataacaactcagtgaaaagatggtctccagtttctgaatgaaaaagctacagctgagaaataaaataaaatgtcatgctgcagaatatgttatacccttattttgtgttaaggatatattttattatgtgaatggttttgtttttgttttttgtttttgttttttgcttgtattgggaattagctttactggtaacttccttatttagtttttagtggtcaactctaataaaatgaaactagggctgagctagttagccctcactagccaaactgaaactctatgcaacattaaaagaagagatccatcatgtagcttgtgacacttttattttattagtcaccggggaacttttcagtgatgaaaatacacagggtaataaaccttcacatggcttcaaaaggaaaacaagcaaatcttctctaatctactcttactataatttcctaagtgtacaccaaactctggatttaaaaatctgaagtactatagaacattaagttgaagaatggaaattaagagtacgtattcatggtttatatttcttattctatggagttcgtgaacacatctaggtggaatgcatctgagactaagggctggtttttaatcctcataagaaaccagccttgaagaattaacaattctcttcattggtattctaaacctcctaagatatttaggcttctgtacataaaagtgtttttgctaaatttacagtatatatagatcctttcatattattttactaagaatgtttgaactttgcatatttgatatagttcctggtaggaatagcacagctcaaacattagtttttctacttacctcctctaacacgtggtttgtctggagagtttctaaaaattcagctataaccccagttcatgtatttactggtgattgttcttgctgaggtagtaacagcccaatcttgggctgttaaatcctaggaaatctcgaatcatagtgattaaaatagttggggtaaagttgtagcttatatgcaatactacttggaggaattcttctactaatttgtatttaatgtggaaattgtatagtttcattgatttaatcataaataatggaaatggtctccaagaagttttatttttcatttttttgcttatacactctgattcctataatacagtgctataagctatgcacagaaaataaaatgtttgaaatccaagaataatggttcttactgctaagagggagtaatagttattactaatgattttgattgggttgcatttttgttgcaatgtttattccacttgcagttagaatatgaatatgttttatcactagtgtggctaaataaccaaacatttgtgtaaaaaaaaaaaaaagccaagatttcattgtttgttgaatatttcttaagcatctggcccctaaagagaccgcttcttaccaagcctgtaaactatgcatgatggaaattcttgtattttatttaggaatggctgttggtttactcaccacatctgtggaatcatggctataaatgtttgcttacaaactctttgtgacttgtaatttaacttaatctcatctaatgtaaatattagattatgatgttcagtaacatcttccataggtataaactgctgtcattattgatttcagagtaactctgagtaatcaaataggtaaaagcatgttttgagtaaaatagctagatttatactttacttgtatacagacttaacaacaaccggtattgactggattgacagctaaagtatcagaatgaaagcaaggtttttttgatgttacctgactgtcataaagatgaaaatgatttgtattggtatgaaatgcttatctttattctacttcgtaagggtaagttttatttatactctttggactcccatgaacttttgcacactgctttgtgtttttggtttaccctaaactaccatcctttttatctttgctttttttcttcctattcagaaaagagcaaaatgtgaaaagacacaagactctcaggtatagaatgaactgagcaatttggagaatgtattggactttgtcctctcttattcccccctcctagccctgcaagttgctaggtacttgtgaggcagtgtactggagaggggagagcatggatcctggggtcaaagggcctttgcccccacccttacttggccctctacctgcaggtgaccactggcacattctcctgcttgtctcagcttcaggttcttcacctctaagatggggatgatgaaaacagtacctgtcatgcagaattgttgggaggattgataatttagatgtttatacatgtaatgtacttagatcagtgtctgctcttttcacttgatatccagtactatgtaagatagaaggtgcatgtcttctgtattctgtatttcccatttcttttgcgtgcagtctttgattcgtacaatagaaggaacacgtagaatgtatatttgtacattcatgtcaacatagtatttgaaattgctaccaaactcatttaatttggcataagactaacagatgaagtctctcatttgcttgaagatattttacaaaataccaactgttctatatttctttagaaaaagattatagttattaatattgatacctctgataatattttattcttaaatcttcagtgattccttttactatagattcatgacagctaattagtactaactgatttagaggtttcctttcccatcatatggaatgatgtaaagaaatcagatacaaactactgcaattagaaaataaaatatgaacaactttcaacaatgtatacaattgattcttttctaactttataacattttaaactatttattcat

SEQ ID NO: 3030 - DNA, 1294 bp, Homo sapiens
tgtacttcctgagggcttggctctgagatttgttcctacatactctctgtggggccaactgtaaaccttcaaggaagaatgggagttttgccacaaatcaggtaggagaaaggggacgggaactttacaacagagaagagtaggagttaatggccagaggttttacagtacagagtgagttaaaaaatataataaaataccactttgtacccactgggatggttaaaacaaaaaagacagataataacaagcgctggtgagggtgtggaggaacttgaagcttcataccttgctagcaggattgtaaaatgatgtagctacttttgaaaacagtgggaattttttcaaagtctcaaacatggaattaccacatgacccagaaattctggtcctaggcatatactcaaaaaaatatgtgcatacaaatacctatgcaaaaactcgtgcatgagaatttatagcaatattattcatagtagttaaacatggaaacaatgcaaatgttcactaggtgaatgtataaaatattagttgaccataaaaaatcatgtactacccaaacatgctacaacatgaatgaaccttaaaaacactatgccaagggaaagatgtcaggcaaagaaggcaacatcttacatgatgtcatttacatgaaatgtccagaacaggcaaatctggaaggtatattagtgagtgccacgggctgtgtatgcatgtgtgtgtgtgtgtgtgtgtgtatgtgtgtgtggcagctggggctggggaagtagagaatttggaatcgagtgagtgctaacagatgtgaagattctttacagaatgataaaacatgttctaaaagaacctttttagatggtggtgattgttacacaaatttgtgactatactacaaacagcaaaattgtgtactttaaaagaattgattttatgttattcaaaatatatctcaatataggcatatggaattatatctcaatatactaaaatatatctcaatatggtctggtattgtagtagaaagggtatagtctatacgttgagatatattttaaaagtaggttaaggccaatttgtgccacttccacccagggattcctgatttacttctgtatacagtgggaaacaattgcatattttaaaaacagggtattaacactgataactaacatttttgggggatccttaaaaattgccagcccctgatataagtgtcttatatgaattaactcttaatccccttaacagtcctatggggtagtctatattattattatttgcaattcacaaaggggga

SEQ ID NO: 3031 - DNA, 813 bp, Homo sapiens
ttctatcttggagagatttacattttaattggtagcaagcttgaaaagaaaagaatgaagatcttggatacttctaatcatcaaggaaagggtacaaatcaaactgctctgatggcctgatttgcacttcttctacagttgacgatggtcgtacttctccatgttctgagaccagtttaaacaaaaacaaaaaccagacaacaaccttgcaagggaaagaattcagagtaaataaacagtctttttctgggaagtaaaatatttccctaagatggagaaattgagatgagagctcatccacaagattacccatcaatgagcaccaatagcaaccaaatccactagaagactgggagcttttaagtcaagaaacttacatcagtatcatcattccaagaagcggtatccaagctgttttatcgaaagtgcgcatgggagataagactctgagaatttatagaaacaaacattagaaggcaggaatgtggagagaagaaagctacctgacaagggaatctcaggatacaaggaaaacaccaagaagacacctgcctgagggtcttatagctaatggactgcagaagacttgagtcatcattcaaattcagtagccatcctctgatgtccagttgaagattggtgattccagaatagctcgcattgccccagttgacttgccacacagcttctttcaggacttgaaaatgtcctagccacccccatcttacctcctacttccaatgccttttaagatagaaaacaaaaaacaaaacaacaaaaaaacaccagccacccttgtgggttagataatcc

SEQ ID NO: 3032 - DNA, 3217 bp, Homo sapiens
cctgtctttagaccagaagttttttgaattgcatctctaatgacctatcagatcagaagactggtaaacctggagcctcatcccaagaggtgatggtgtctgggtttattatggatcgcaggatgtaactatcaatctggagctttagggggaagaagaaagaatattttgaaccacaccaggagaattaccctagagaatataagttcacctgccaaaatgggaggctggcatctttttgctctatgagaaggctgctgagctaacaggtctgccttggcataaatgtctagaagagcatgtgtctcctggagtatggggacatttgtgtttccataaattggcagctgcttctggttagagacttctaaaaggtctggaatactggaatactggtatagtccaaaaggggaagatgaaaaggagccgtggaacattgtaccaggaagaagatgggacattactctccgcatgccctggagctttcggaagacgtataagaggatcttagtttccatagctccacatgaaagagcaagcagggctgctgatgtccactgtgggctccaagtgagggactggcccatgggcaggaggtgagggagacttacttgcttttctctgagctggtccacaggagcagaggagactggggtgagcctcactccagaatacttgtagagtatgtgacaccggttaccaaccttggctccacaaaaattacctgtgaaccttctaaaatacacataagaaattcttactgaattgaactgggacgagattccacgtatcaggattctgtaaaagctcccccagtgactcaagatgaagtccgggttgaagaccagtgatatgcaggaaatgtgtcctgtgatttgaaaccacattccatttgtcaagcaagacactacggccacataatggagatctacttccatatgaaccagtggatttcactctgcttaatggtaagacatgacgtggctaaccctggccatctgtgctgctaatgttctgatcttgcttgagattttgactgcaaatgtaaggaaccagacatatacagataggctgtttgcagaaaggtctcttgagacaatctgagctgacttgcttatcttgcagaaaaatatactgaggcccagaaattatttaaataaagtcctcaaatatggtaattttagaaaaaggacaagtgaaacctatatctgcccactactcccactactagcaccaacgttttgatttttatagttatttatgaaataaggtgtgtgccttttgtagaaacaaatagagcacatcctacaaggctgtcagagagctgggaggcaaggagcctggatttttatcatttctttgtagttgcctctgggactctgggtaaatgcacgccttacttggtataaagtaggcacagtaatagcatggtaatacctgtaatcatttgtcccatgtgtctgagcacctgaaggtaaaacaacaccgtcatcagaaacaattcagtgggtagagtcattcagaaagagagaggaatttttatctgcttttgaaaatgtcttaaggagaaaaagacaaagctttgaaggcattagtaatttaagtattgggatgatgtccagggactttttgctgtgattcacatcctgggtaggaaaaggtgatggaagttgtaggaatgtcatccaagtgcctgattgatttgatcgtagagaagaaagaagtggctattggagaaaaaagtgcagtagaaacaatgaaggaaacaggataaaaactgtgaatattgttcagcttcaaagtgtgttatgatttaaatagtacagctggtttggagatctttgggtgaacaaagatgtgaaatgacagcatgtcagagttgggtctgagtatggtactaaatggacgctgtaatgtcaatggctgagagaggtgtatggaacacacctgctccaaatgtgacacaagagaagacttggggtggtttatggtgtgtttttgagctcatgtgttaaggtgtggattgttgggacaggaaagtgcatggagaaagaacattgtctgggcagatttatagggaaaaagtgtaccaggaagccagcttcctgaaggccggtcgcaacatctagctcagagcaattgggaaatagcaggaggaagcaatgggcatcatatttcagttttcatggcaaaagaagaactaaaataaagatgcagagcagtcgtgttctgggtttagagaaaataaacacagaataatttgggcaagagaaaaaaatgttaactcaacttttggacccagaaacaatgatctactttagtgtatcaatttaacggtttggtgttttcaatttattttgaattagttaatggaagtcatcgtaaatcatcagacaactaatgcactttcatcttacactgtgaaccatcatatgcagctgtggatgggtatcggagattaagagacaggatgtgtgatatgtgcagaggggctccacagctgcctcttggatggcccattaggtccaactcaatttttggggggtgaatttcttcattctctagttattggtccacacagagaaattattaaccccaatgacactttaattaaagatttattttccctttaatcctgtggggcacctaggatcttggcgccaagatcctaacttttgtctccaccaccttgtgtatagtgagctgactgtaatatgcattatttttgatataagaatgttttgtaacctgtttgtttcttctccaaatgctacaaactaattttaacatcatggaatattggcttctgaagtagcagttctctctttgaactaatgctaatgcagtttatgaattacatggtactgcaatccctcacaaggcttttctttactataaataaaatactctaaacaagagccaaatattttactagacaaattctattaccaaaaaaaagacacaaagctctggtatgaatgcattagttaaatatatacgaaatagatggaattgcctaagaatgcacaaaatcaaacaaaaggtggattctgattacaaaataacttttttttttggtggaagagaaagcaatgtaaaaagcatgagtcacattttagattctaacactccttagtagtggcttccttttcagtctcatgataaacaacttgtctatgattctctttcttcctttagtaactagagacaaaagtgc

SEQ ID NO: 3033 - DNA, 3573 bp, Homo sapiens
tttcgatcacggcttctactacatgtgcttgaaatgaatgttgtgtgtgaggacctgtgtggtttgggccatgttgtgcccccctgccagtgtccttcggtgttgaaaggaaaaggtatttctctcccttccatgtatgttctgcaaattgacgaacatttgcaaattgctttgagatgcgttaatttaaggtgtgaaataatagatcttgtgcgaaggctcagccacatttctggcattgatggatttttctcccgtctggcctgtgatttggggaggtaaaaatagtccttttttccacatttttatctttttttttttttgctgacatcattcttaggaagtggtgtgcacatgccgtggaactttacatggaacatggagctctggggagcaggagtgctcttggagtgaggggtggtctgcggtggcccaggcaccccctggctgtccgtgaaatggctttgaaatgagcaggcactgttgagggcctcagtggctttttggtatttggctgtcttttcacttatgactcttgggtaatggcaagataacttttggggaaaatgttagtttaaaaagaaaaaaaatcaggccagcactttcactcattcctgtctgagctggtcccttcctttggccaaagctgaactaaaccaatggccttctcagactcgacttccagacagaggagccgacattggggcaaatcagttggtggtgtaatttcctgtgatgttaactttgggaacttgaacttggagtgggagctagcattttgacatgtgtccctctaacaggacttgcttgtgtggaaacagacccccacatacatggctgcgccattgtctccaattctggatttttccacagatgacttctcgggtgatctggtggtaaaggcacaggtcttctagccaggccttcttggcctccagcaagggcaggatcacagcaccccaccagacctgactggccaccaccgctgtagctgtggctgggcgagtgggggggccatgggaattgaaagatggggtggccgagatctgaaatgcattcagttgcagtggcctggatctgcacggagccgttctttctttctcttagacatctgcatggtggtgacctcatagaattctaagaaaaaaggggctttatgtaggaattccatagagtgtgaaggaatttggacaggggaagggggagggaagttgccattcagagcctgcagtgcctgcattttccccgaattgtttaaccctcatgcttcagaattaggctgaggcttgcggggtgggtcatgttgacctgggtgaacagagatccctttaagaagaacttctccatgttccagaggcgcgttcttactgcaggtgagtggcagtatgggaattagtccacaggccccttctcgaatgcctgccctctcttgttccttgtcctcaacgtctttgaaacttgggcttgttgggaagacacctgcaaaaggatggatgcacatgaccttcagctctaatgaatcaagctgctgatgaggaattcactgggctcccaatccagagagcttcgcacacacccactggggttgagacgagcactgggtttatttattgtggacttttggagtctgaaggactcttgccacccatctgtttcacggaacagaacctgaggctcagagggagcaaggcgctcccccacagccgcattgagagcctgagcctgggcacccgatggagtgaatgaggctggagtcccagacctgcctctcatgagcacgtcgcccactgagcctcagcgtcatcatctggaaaacagggataatattatgacctcagaagcttcgggggaggaagtaagtgaaataatgcatttcagatgctcagcgccttttaagtgcttgatgctcattccccaagattacatgagagacatggaaaatctttaatgaccaaggacccacccagggtcactcagccgggacccttggtccgtggcccagagtgtctccagtgcccctgcattgaggccctaaacaaggccagaagcaggtgccggggacccctctggattccaccagagcaccttcctaggatcatggctcccaaaacggaagggaaggagacagcgcagtttgcaaagaggcaggatttaagcaccagggtggccctgtggcgcctcaggaaaatgtttgcctgtcagtatctgctctcgttcccacctgtccccacaaagcgaggccataagtcctcggcgtggcattggagggtctctgaaggccctgagagctgtgtcagccacggtgtgttatgaagcaaggcagatgttttgttaattatttacacagcgtcggccccgcagaggactgcgctgacaggagcggctgtcacaggcctggccgtggggcagaagtgagcagccgtcttcccctggcagtcctcctgaaaaggtctgcatggcaaggcctgagggagtcctgcacattttatgcccccgccccccaaagccatttgggtttcccttaaactggcttgttttcctgagccggtggagagatccttgtcctccggaagtggctatcgctctggggcggcttctctgccagctcgtcacaccctagacccagctgtagtctgtgtggtgggagagggtgtcaccaggctctggaggtccactcctctgtagtcacctcatgcacccttgggggtgatctgccttagaaattcaactttaggattagaattctgctaagaggtaccatgtgacaaaaaaggtagtgtaaaaatcacaaagaccaggacaggctcatgcctataatcccagcactttgagaggccgaggcgggcagatcacttgaggtcaggagtttgagaccagcccagccaacatggcaaaaccccatcgctactaaaaatacgaaaaattagctgggcgtggtggtggacacctttaatcccagctactcgggagcctgaggagcctgaggcgtgagaatcacttgaacctgggagacagaggctgcagtgagctgagattgtgccactgcactccagcctaggcaacagagcgagactctgtatcaaaaaaaaaaaaaaaaaaaaaaaaagagttctgcaaagaatggcacctggcatcagagctttccctgaaaggccactaaggatgaggaacgtgagctccggggaggcgaagggggcaaagccacctgcctgttgcctgttttacataaggaggttttgcataggagtcattttaagatacatgaagtagccagaatagataaatccacatagacctaaagcagattggtggtttccagggcctttggggaggggagactggggagcgactgattaagggacatgggtttttattggggtgacgcagacgttttggaaccggatgaaggtggtggttgcacaacattgtgattgtaatacatcccatccagcggtttgctttaaagtggttaaatatatctgagaaaaatgttaaacataaaagttttggccaggcacggtggctcacgcctgtaatcccagcactttgggaggccgaggcaggcggatcacg

SEQ ID NO: 3034 - DNA, 7428 bp, Homo sapiens
cctgacctcgtgatccacccgcctcggcctcccaaagtgctgggattacaggcatgagccactgcgcccggcccaggttttctctgagaggttcttttctggattcctttcaatgcctaaatggaagatcctttgatatttctatcatcctcattttcctcctaatgtaccatcctgagacaatctatttcaataaatttgagagggcttgaattgtgtggagatttctgcatcacagtgaatttgactcaatataatgtatttgtattgagtgctcaacagatacaactatgagtaaagtacagtccttctagtctagtgagattgaactaggtatgaacataggtgatgcaagatagaaggtgatcctttagttgggaagataggtgactacacacaatggagacaaagaaattagttttcaggctgtttaattagtttgggactttacataggacagcatgcttaacagggaggaatcagatttggttcaaagttaggagtctaagactttgagaacatatgagggtgcttttgaatattcactgaaatagaatcagaaggatggttggaggctagggaaactaaaagtctttgacatactcatcatgatgtgtcttcaggacatttaacatgaagatgcccagtcaagagttggtgatgagagtctgagcccaagagttacacatatggggttggagatagacccttgtaggtcactggggtacaggactggtgattaaattgtgtgcgtgagtgggctttgcaaagttaacacatacagaatggcaaaagaaggtagttatctctttaggtccctcttccttccagtggactttagggttgaaattgctttaaattttacattaccaacagaccttcatggcacttattttaacctatcttatagatattagtttttatggcacttattttaacctgtcttatacatattagtttttatttatttacttttataacaatgaatgttctctgaggtcttagaatatacattatcctttttggatccactgtagcactaacattaaaatttgacccaggtagagcagaatatttgttgaatgatctcttacttctctagtaagccagcttcttggacacctccttattcatacaattctcgtttcatttttcataggtataatcaggattaatagtacctaaaatcttaatatgggatccacagaatgtaagtataggaaaaataaacacacatgcattaatggagcatttagatataaatatgatgtcatcatatggtttgtttcctcaatccttgatcttcatgaggaaaaataatgttgtgagctcataaaactcttctgcctaaaaatgcttgtttctcaaatataaaacacacataaggcagtctgttctttggttagaatttgtagatacatttaaagcatatttgcatatcagcatttgccaaccctggagttgtcaagttgctgtatgacaggttaatctgttagctgctgtaaatattccagcaaccacatgtgagcttctttgcatacatttctgttttgttgtgggcttctattctgtttggtctgggtgcctatatttgagatagttcaaagcactacatgataaaagaatccctcatctggatcagatgtccttttaggtatgggagatttagtgattataatatttatcttgttcagtttgatatcataaagggatcatgataatataaaaaggaaaaatgttcagtgtcaaaagagaacagggggaaagaaatcaaaaggaaaagattgaaaagaaagcatgacaagaaagtggtagataaggccttttgtcctgatgggcacttacttcctgccccagaaaaaaaaaagagtgaaagtcaaataaaaaacagcagtgaacttttttgtttgatctgtggtacgctcttgcagttaaagtgctgaactggttgcacccttgccccttagctcacagttgttcagatcgacaaaaaaattatacaactgccaaaatatcctccatggacatagcttcagaatcatctgaaaacctgtatcaagatatttcatgtttgatgaaatatcccgaatagaaactttttatgccttctaagaagattcaagattcactaagttctacaagtgtcaagggtttctcctgaacaaagagtgtttgttgaaataattgcattgttcacacgggtttatacactaaactgttcactcatttagacagtcaacaaatgtattaaatgcctattctatcccagacactgtgctgaagatacaaagatgttgtcctcactgtgctcaaagtggtggagaaggcacagcactaggtggggatatcagtcctctgatgaggtttgcaggccctgagggctgtgaaagaggacctgaaagacatttgacacaaataacaggatggggtgaaacttcccagaagaggtggtatttttgcaatgtcttgaagtactcctggtgaagacattggagttcatcaggtttagaaaaggggtggaggcttactctagaaaaaggggatgccatctgtcaaaccactgtcaaaacaaggtttagtgctgacgtgttagatcttttaaacaatcagaaccattcattttttttctctgacgcctgccatcatctggtgatgggtttcttttctttccttcaaataaaatttattttccccctttattgtttcttgtcaggctgaattgatacacacacacacacacacacaaacgcacacatgtatatatatatgtatacatacatatacataagcatataaatatgtacacatgcatggatacatgcatatgtttacatgtgtgtatgtgaatagacattttacatatgtaaatatatatatatatttgccttgtatgattctttattacaaaataaatgatagagggacttaatgtaggaaataggaagttttgtcatgtactctaagcttttctactctcagtattttgggatttgcctgtcagatatttaaagaccattaaaaaaaaaaacttatatttttacaatgaagaatcccaaattcttaatcttaccacacacttcaggcttccctcctcttctacaacacctattgttacaattgcatttttctttttcaagttgtggcagccaaaactgcacacaacatttacaccaacatgttttctgttttactttaatagccccatttatgacaatctgtgagtttacttgtcttcaaaagtagctcagtaagctggaaattataaagaactatctgtgataactttgtggtcctatttctgagtaactaacattcaccctttacttttacttgcactgattggattttttaaacaccataaacattgtatttgtcccccactcccaaaagagagcaccttcatattgcttccattgctatgtctgagataggattcactttcatgtctttattcagggcacagagtgctagtcccatctggatatttttcaagttccgcagacatctttaagaattatgactgatcctaccaaaagatcggaacagcatattggcaggttacagggtttttatgagaatatatgagatcatctagtgactttacttttaaggtaggtagagtataagtacatagagaggccaggcgcagtgcatcatgcctgtaatcccagcactttggaaggccgaggcgggcagatcacgaggtctggagatcgagaccatcctggctagcacggtgaaaccctgcctctactaaaaaaaaaaaaaaaaaaaaaaaaattagctgagcctggtggcatgcctctgtagtcctgtagtcccagctactcgagaggctgaggcaggagaatcgcttgaacctgggaggcggaggttgtagtgagcaagatcgtgccactgcactccagcctgggtgacagagcaagactccatctcaaaggaaaaaaaagaaagtgcatatagaaggtaataataaataatagagattcgaaagactaaaatgaagaaggtttgtgttttaggggtaagcactggtattgagtatttttacttcatattcagatatactgtaaaagtgctatttttagtttacaactaaatttgcttagttatagtataatggtttgttttctggagcataatttatgtgttttcagaggctgaatggtgtttctcttttgcattttaattatcattacctggaaaatgtgattataaacaggaaacaaaaatgctttatcatcttatttttgttacaaattaatatttatgctaaagaaattctcttgaaatgtaaccttcgtgttttttatactttcaaacctcttacaaaacgtgaacctggagaatatgaaaccatgcatttcttttttctgcaccatatcaaatactcagaaatttgaaactgtattatctgagcatttgagaggcaagaccaaattgcagatctagagtctagattaataaatggtaaaaagatgcttgattaaaatttttatactcattctttaaaaaataaaagtaagtgggtatcaaagactaacgaaaaacagaaattacggctcttctcactccttcagcttcattttaattgttttaaatgagaatctttgacggcaacctctaattattttgacatttatgccttttgactgataggagcacagggtaaaataaaaagcaataattgctagaaccaaggaaataatattgttaatgaaattttaaattttagtctttacaacttttaatgctttttcacgcatgttctcatttttaagtctcttttttttggtcagatgggtttaagtattcactaatttacagacaaagtgacattggtaaatgtcgtttgaagaagtactcatctgagaggtaaatagaaatttgtcaacttatcctttacatttatgtttcaggttttacaattgaattactactcagttatgtcttcccttaccttttatttctggtcatcatttctagtcaatgcatcttaccctctgtaccatatggtctaaacatttacctagttttaataatgtttagagttactgataaaaatgggttctaaatgcagggacatgtaggatggagagaaaattttaaaacatgtttaattgaaattattactgatattaagtatcaccatctgtcataacacatggacagcatattgtctacaaaagctactttttctagtctgtaaaatgaatagtttttataaagtgtttgcaaattgattaatatcagattcatcaatctgttgagccataggaaaagatcttctcaatagaacaaactagcaaagtgcatggacgataggataggatacagtggaaaaataactgtttcgtttacatgggaaggtgcacgtgtaaagcctactggcagggggcttagaatttctaatgttcccatggagatcaacagggccagctgcatgctaaccatgtcatacaatctagaaaatagctctcaaataccaacaacactgcatctgatatttgctaagagaccaggtgttgttacaggtgaataaaataatgttccacagcatgatgcctatgttttattagtggcacctgaggagagcagcaatgttagtaactaacggaaagtcaatttctgtttcattttcctgatttgtgtatgtgtgttaaggtgcagagctatgctaaaaagcataactaatagcacagttattgattagatccatgtttgccctttcataaaaaacaattttttttgcataagagcagttataattgttgtactaaaagatgcttcaaaatacatgtgaatggaatataccttctatctcttagcaggtgttcacctactcattctgagtattcactcagttatgtcttattgggccaatgatgattaatgttttttaaaacaataaatgaacttaattattaaattttccattagttcttatttatggtgacatttatacccagtgttcaaatattaatctttcatttaggttgaatatggtcccagtgttggggagagctatttgaaactgatttgtgaaaactttactacaatgatataatgatccctacttttgcccaaaatgcaatataagacaaattttttaaccttagattcaactcactggaattcagccctaagagttctagagttcataactaaagaattgctcagctttaaagtgtgcttgcatgatcctcagtgaagcgttgtaatgagattccagttagaatatgactttgtttcctccaagcagctattattatttaatcatcttaagaaatagaggtccttatgttagtctgcatttgaggtgtataactacattttacctttcttcgcattaaattttgttctggaaatatgtctgaaaatgtagtgttgataatgtgtggtgccattagaaaagtttgtattgcatgtaattttgtgaaatcatgttttctttagaagactaataatgttatgtgagaatggattctaaaaatggcactaatgaggacaaattattttgtgttgactattgaaggacccaaagaaataatgattcaaagataattttataaaagccaaagtaacttgtagctaatatataaaatacttttgaccaggaacttttaaagtggatgctatgaagatagagagtgtttttacacattgtttattgattttaatttcactttttctctccttagggtgtgattaggcccactgggggatacgctgtcatgctacactggtcaatgtcttccatatacggacttcaacccggagaggtgtggtgggcagcttctgacttaggctgggttgttggacattcctatatctgctatggacctcttcttcatgggaacacaacagttttatatgaggttcaaaacattatttgtggctggagaacgatgtgatgtagagaccctggaatggtccaaaaatgtcttcagagtacctgtcttagaccattggtggcaaactggtataaagcactaaagacctctttatcttctcttctttgtttcttatatctgtcctccctctaagtgttccctgggaaacaaattttcatattaaatggatcaactataaactttggaataagcagacaaccaccacaacaataactctatctgctgcttcttttgagggatggctatatatatgagaatgggtacattgtctagaagccatttacctcctcacaaagtacagagattttaaaaaatttgactcactgaaagcagctatgagccatgggagccctacaacctttatatgtacatattttattttagtcccacttagttcaatgaattagatcaacctttttatatacatattttcagtattctcaccttctctgcatctggggcagaatatcaaatttgggttaaaaattagtgagattactttgcaaaaaattag

SEQ ID NO: 3035 - DNA, 2185 bp, Homo sapiens
gggaaacaatttggagtctaactcctgccaagtaggcgcctcaggttttccattaaaaccccagaaaggcctccgcttaggctcaaagaccatgtaccaggactaagattcatcctaggacttggggttataacagtaaacagaacaccctggcattacaacagtaaacaaacagttaaaggtgtagttgggaaatttatattctagttgggaaaactgcaataaaccaataagtgttatgcagaaaaatcaagccaggctgtggttgggtaggttagtcagagaagaacttactgggtgtggaggagggggtcacattttcagcatggactttgtagggggattgaatggcgaccctcaaatggtggttctcaaaaagatgcgtctaagctctaacctctggtacctgggaatgtgaccttatttgaataaagagtctttgcagatgtaattgatttaaagatctcaagaggagattatcctggatgaaccaggtgggtcctaaatcctatggcaagtgttcctataagtagcagagactcaaggaagaagccatgtgaagacggaggcagggactggagggtgcatctgtaagcccaggcatcagaagctcacagggaggcaggggtggctcctccctcagggcgcccagaagaaccagccctcccaaggccttgattttggatttgtgctctccaaaactgttagaaggaaggtggattcttcaagggaactggagagaagagaagcacattcatgtatttccacattcagcctccatctcacgagttacaccattcccagcacgtcaccacccccagacctttggttaccagcctgggggcagaggataaggacgtcattcaaaaatagagagattctcaagcctccagagtgcgggggcccagccgagcatgctggcggcttccagggaggtggccacgccccaggggaagtggttgcatggaggaagaatctcagaggaggcttggacgtggtagagcaacgctagtcctgtgttaggactggctagtccgtcctgcagggatgaggggcagagcctcagcagaagtccaggccagtgtcccccctccagcataagagccccccactcccacagggcggaggaaccactgtggtggcggagcttatttcccagcagccccgcgggatgagacccaaacgagaagttagggtgagtttggaggacataaagtgagctggcttcccgtatactggctgtgtggagtaatgttcacggcaacagatttccatctcctcagcctcaggcccaaccctgctaccccagccatactcagaggctctggaaatcttacctggaggagactcttctgttaccaccaagccaggaagtttcatggcttgggaagaccaagaggaagtccacctccccctctcctgcacctggagtctcccatgtgcacggaggccacgcccccaccccgccctcaggtggcatcagcccaggatctgaccctggactggctcacactcagttgcctctggccagtgcagggctcagccagggatggcttctagctgacagtgggaggaattaattcatctgaccggaatattcttttctcttctgggctgttggtttttcaagtgcaacaaagattccatacagctccaaggaaggagccaagaaaaacattctgtgccaaagtgagatcctggaagtgaaaccccggaataaagctgaaaaacgggctccagttgggtgccaggaaatgcaggactggaatgtgacttgacttccggcagcgcgcaggtgctcccgggtcacctgctttgaggtccagcctcctgccctgcctcaggtgaccacatgaccactgtggactttgccctgaaaccttctgggaggagaagaggcctgaccttggcgctggggtccagtgggcattgctctggtccgaggctgctgctcttgacctctgctctgcggctgttttccattggagtagaggctcctcctgtcctgtcctgcctgtggagggaagcaaaccttcccctggaccagagagaggagaaagcggagacaggtagcaacgctgtggactggtgatgacaggctcttcagctccctgcaagtgaccgggcctggggaacaggtgagtcattgtttaaacctctgtgccctttgtggagtgtctgcctg

SEQ ID NO: 3036 - DNA, 7515 bp, Homo sapiens
aaagtcagtatgtcctattcagatccctgctctgccacttactattgatcaaactttaattatacaacctctctacatctcagttttttcatacatacaagtggcatagtaataatagctacattatatggttgttgtgaagataaaattagtcaagtaatttaattaactggaaaagcactggttctagataagtgttagtaattatcattattatgggtagagagtatggtatattggttaaggactctggctctggcattagacatctatgttcaactccaagtttttgctacatataggaggttggagaaactattcagtctctctatatctcagtttctacatcggccaaatggcttatgagaattgtaaaggtaagaaagactggatgacgccatttaatctgccttaagtgacgtagaaaaagatatgatcgtatactattggggtgataatttatggcctcggaggaggtaaaagggcatattgcacagtctacttgtgagcaatcactttgctgagcccacagtgatgatgtcaagttgaggccaaactcaagttagccaagtgaacctcacttagccaagttaactctgtgggtcaggtctattcctcatatattcacaagagagaacaccagcagtgatctgcaaatgctgcaaataatacctgaggagtgaaaatagtaccataacaatgttttgcggttgccttctgtttctatgttctgggccatctctctcattggctttaaagaaagagaagtgtggaaagattgcacaacaccaccaccactaaactgaaacaaatataatttctagcaaagttgaatttccacatgatcatgtttaaaaatcacaaaagtaagtctgggtctaaaaaagtacttgagcaatttaccccatttgagaactctctaggtttgaaatctcatattgaagcgtgactgctgtggcttggttttccacatttatcagtgtgggggcactggccatgattcttctttcctttgtcctccccaggcattggcacagtctttggacatgaaaatcatggagaaggaagaggctgattgttatccatgattaggcagtgcagatatagctcaatattccaaatgggatgttttggccttggagttaagttccaagagcattataaaataatcacctgtataggaagtcctgacttaactctattaacaacttcgaaagtcacatacctgaagatgatcctgcatgtccatagagcctaggtccctcaaaagatggtgttgcaatgacagaaattgagacatcaagagaacgtttagcagaataagttagttaagatgtaggtgtgtcgaaagtttcaggtgtcagtaaacatcaaaagaaaatgtagcagtagctagaaatttccaggctgaagatgaaggttaaagctaaagatagactatttttgtcatctacatggaagatgatggctaaagctataagagtgaatgacatcagcaaggaagaaaatacaggaataaggaagaagagatggtgaaatggctactcgtaaggagtgggagaaagaataaatgagaagaaaatgaagaatgtgtggccaagaacataggagaaaagccaggaagatcaatgtcttatcaacagacagatttgagcagcaggtactcaacagagcttaagaaaaacaaatattgagaacagagtaaggactatttcatttggtgaacaggagatttctattgaactagaatagctaggtaactacattttcatgggttaagaagagaagaggagaaagaacagtgaggaagagaacccattgtattattgaggaattttgaagtcaaataaaaaagagatgtgagtggaatgacataattctagagataagtgaagctggagaatgttacatgcttggaaggaaggagtgagtcttagaaattaagggagcaagttccttcaagacagatgaaacgtaatgagcaacagaatgaactagatatgataatgatgcaaaactcttctttgttacatacaggctgggagaagggtccacacaaaaattctgagatggagatgatggctaaagttagagttcacattggatgactttgaactcagtaaactaggtgaatttgccagaagatatgaagctgtgggaacttggaagcccaggacactatgatattgattacagggaaatagttcaaaaatatcacaagattacaagcagctgtaagtgtcttgactagcgaaagaccttggatttgtagagcatcagtctatgtatgtctacaacaatattcatcaattttattaatccaagactgggtattagaacaggcagggagttaggagaacttggtattgacaggggcaatgtcagtcagcaacatggcagcatgcaaagaactttggtctgtgagatcaggaatctaggttctgggttcattcattacattgtcctaggctaataactttcttctttcactcttatgtcttcatttgtaaactggagatgctagactatgtaatttcaaatatggtttcaaatggaaagaaaatcttattcttgaggcaaagtagagttgcagaaagagcaacatctttgtggtcaggctttactctctacttctgccactttatcgcctgtgaccttgagaaagttacttctttgcacctcagtttcctcatccataaaatggtgaaaagagtaagttatggggaaatgttaaagataaaatttgaatagtagtcatcaataattgcaataattgtttatttgattatattgatttgatttttttttttttttttttgagacagagtctcgctctgttgccaggctggagtgcagtggcacaatcttggctcactgcaacctccacctcccagattcaagcgattctcccgcctcagcctcctgagtagctgggactacaggtgcatgctaccacgcccagctaacttctgtatttttagtagagacgggttttcacaatgttgggcaggatggtctcgatctcttgaccttgtgatctgcccgccttggcctctcaaagtgctgggaatacaggtgtgagccaccatgcctggccctgatttgatcttcctaaagccatatactttaaccataatttaatgtttcttgatgacttacaatcatcaagtacaaaggatgattaatgctataacattgtgacattcttgtgcccagattgcttacacacttattgagcccaagaatcttctttgtgcaagttgtcaaattatcattgtactataatcaatatgtctgtaatctgctaagatcttggagagtagacaactaaatcatataatatgtacattaaataaaagtaggtgcttatggaggccacgagtattaggtgtgcatagctattttgacttctaagaaactttctttgcttactttcagattctgaaatgtgatccaataagtaggacactgaataaacactctaaaaagagataaagtcatattcaaacacaaaaactgtcaacatacagtgattgtgtgtaagattggtggaagagagttcactgactctaacagaccctaatactgcattgagtacctctgtaaattttcattctatttttatgagtgaggaacggtgagaaaatggtatgacaatgaggagttgaaaatggaaaagaagattttattttctactaattatatattgtctatgatctcacatttaaaaatatgcattggcttagtcaataattgaccctggggttgatttgtttttggaacaagtctcagcaaagtcccttaaaaagtaagataaataagcaatgtttatacagctttaattatgttaatcattttaggactgaattcacaaactgtcagggaacagcaagagagtgagcagaccacttttcctccgaccttcccttttcctatctgattgctgtctcccatatattcttttcctgaggcatctgaaattgctgatttaggtggagtagaagatttaacaaagctaattgcttctgttgttagacagacagacatgtatctattacattcactatattagaactacgaattgctttaaaaagtcaacagaaataaacataaaaagtgtctctaaccctttctacttttaatagaggtacttccatagttgtagggaagtttgtacctgcgagtacaaaacagagaatgaatctgaatgatgtggtctgactgctaatgtttacaagctgaagaggagatgctgtgagatttccctgtggatgcagtcttgagaaaaggactagcgaaattactacaatcctagcacgctgaattagttgaacaggctaatcctcacaaatggataggatttaagatatgattgtgagattgttatccaattgcataaatctatgtataaatgcaggttcagatttatagacactgaatataacagaaaaagacatagatattttcatctaggaacttttatgtacattttaaatcattgtttagtatatatttctctcaatagaagtagcatgctgaaatggaagaatttgttgcaataaaatacaaagccaagctattatattactagctcaatagcacaatgccttagatatttaaatttgtgcagagggagttagttatatataaaactctttggccaaacccgccacatatacagttgggaggacaccagttaagtatgggtgaatagagaagtttagaatcttgcattaaaaaaaacttccttacaaaatgtgcacacgagaatcactaaaatttcaaggatcctttttacttaaataaaagatgcaaaaggtattgtggtagtaagtgtgcatctgttcacccttagaacagaatttcaaatacttagtgttttgaaaaattcctttgccaacctactttattaccccatgtaaatgaatcatttgattttctgtgtaaattgcttgtaaacttgctttccatttaattataattcaagacagtttagaacacacacatacacatacacatatgtacacatacacacatacacacacacctgggttagagaatctgagcatttaagagctataaggaaattttgagatgtttggtcgaaatccagcctcaagttagcagacgtgaaactgggatcacagaatctgagtccttgtcccaattcacagtgcacaaaatctggcaagaactttgacgttcaggttcatagtcacctttctatcctatcaccctcctttatcatttcacaactattgtctgtgtttcaccttttggcttggtattatgccagcatgcattcccttctcctatacctagagagggtcatggcgatttcccatatttcctccaacacagcaaacagactaaacacatatggtccaaagtccaacctcatggtgtcagtctaggccttatttcttcagatgattctcttctcagatgaaaatcactcactggttacaaaatcaatgttgtaaaaaatgaactatttttttcgtgacatatctgttttgatcacattcccaacggatccataaaataacacaaaataacatcacatgcactacttttgaagtctgtactgagttactggtctgaaacattatcaattgcactgtggtatgcatacagagcttccggcagagtgtgtatccagtgagtcatttgagaaatggggtgtctctgccaggcattcttttagtagcccatgtaagatgttactgaagagctggagagaagagggagccactctacctcatcattcacactgaacctaaatgaagagatcttagattagactcacctccatctttcatattaatctagggtaaatattgaaataaatcattctgtttctttagtcctaatttatcttttcctaggaaaagaagaagaatctagcactgtaaaatacacctgggatcttacctgagataaaactacaaactatagtaggctaacatagtcaagactttatatttccaaaacactttaaaatatattatctcatttagactatattcaaatatttaacctcatatgtctctatttgggaactgtgaaaaataaggcctaaggagatatttttttttccaggccacaaatctaacaaatgttctatttgttatttttatttttagctattattttcagtcttaaatttcctggtactatacagtgctgacagtttttagactgtatgaagaatatggcatccccaattagggactattatggctcaacagaaagggtatatataccttggaaagggccaaaagctcatatgaatgctttgtcactagcatgcatctatcttgtgccaagagatctttttctagttatcctctagggtattaaatgtttaaatgttttctgcagccaccctgttctctagatcccatgtattgaaagacttacaggtccctaggagaatattttgtgaaggtcttaaagaaagctacatttgccttccttttctacttgtgagcctttttgattaaaactcctcccttactgatgtcatccagatcagctcaaggaaaacatttgacaggtccatctgtgtccacagtcacccacaaacatgggaaactgccacccatctgcctccctatgctttgttttgctcctgtcctggttattttgttctcttgtagctacaggggatattaataccctcctgtcttccagaaatgtgaagagaatggatctatgttagcttgtgctcctgagagaaagatgttatagaaatagcatatgctatcacactgttatttacacgcaattctacaagttttctagtaacatcctcacattttaatgaacatgtttcttaacttcctacctggattcactattaatcatttcaatgtaattatggctcatcaattattctgcgtttcccaaatagattgtttactcttaatgacagaaatgttataaatttagggacactttttggattcaattactttcttgtctattgcctgcattttatgatgtcattcactaatgttgccaagagttgaatatttgcattagttccttttttattttgaataacaacatacactttttggtaaaacaacaccaggatgatttcaaatcagggaaaatgcaaatcagaggcttaaagatgtgaagcaatccaaatattttcttaatcacattcctggggcattgtatgaaattccaatagcaatcaatgatcttatgattcaaacaatcctataaatatgataagaattcataatagctgtcaaaattcaaaacaaaacaaatatgtcagtgaatttcaaaaaggattatttgagtcaattttaatcattgcttttttataaagacatattatttgaaaccgatatgtacagattagagctcagtgtacaaatttacagccatgtcacatgaatttaaaatcttttaagatacacacatcgcaaggacaaaaaaccaaacactgcatgttctcactcataggtgggaattgaacaatgagaacacatggac

SEQ ID NO: 3037 - DNA, 4332 bp, Homo sapiens
gcagcattgctgatggcaaggcagttagcttcccagacaccacctctgggcgttaccatgactcatgggagtgacagatgtaatgaagttaagaatcttaatataagattatcctggaatacctgactgggacctaaatccaatgacaaccgtccttataagaaaagtggagacacgtggaggcaaaggtgctgtgaacatgaagctagagatagcagtgatgtggccacaagccaaggaagcccgggaatgccaacagccaccaaaagctggaagaggaacagggccaagggaggtggtcagcagaaatgaagcactgtccggatggtgtgaaagtgatctatgctgtggtcagaacagtggaaggccatgaactttgccggcgagtgcctttgttctgagtcaaagtgttcctcggtatgtgaaggacatcaggtccaaaggctgctagtgactgaacagataacgtgaattccatcaaagcttgacttctgctcatccctacctctcctcccgaagatagtacggaattgcaagggaagaattggtccacgtctgtgagaggaggcctctgaaacacgctgacttcacagaggagaaggaatgagctcaatttcaggcacctcctccggggcggtcaagagcagaatgaaggagaacatgtatggccctaggttggccttgaagaattagagaagctgctggtgccccgcccccaacctggcccaacagcagagcctccgctagggggagccgtggagacctgatttcctctgcgccgcctttcctaatgaataccccaggggagctcctggcagcaccctgtggaatggccccgcggagctctggcccctggaatttgcccttcacaattatgctccctgctgggagaagtataaatatggatggagcgtggcgtctttaaacatggcacaagagtagaggaacaaccaagtccaaatgataatattttgaaacgccacggggagcctctgctgctgttgagttagaattgcttctctttcatgtgattaaagaagcccttgtgggtttttgcttttccttagagacataccatggtttctccccccgcactacagcactgaacgatttttaaggtttctaagtgcactccatttacatttcctactcattctctaaatgaaaggcaggctaaaacacattaatgagcttcctgattactgcagcccttgagaaattaattaatgacaatgcagccacacttaacattcctcctcctttctgagtttggaaagcgggaggagctgcgctttaatccacgcccaaccaagagccaccatgtgtctttagccgaagagttggtttgccaggacacatttcagattgcctttcctagagaaaagccattccctgaataattaagagacagcatcttttccattgtctggaatttttttttaccctaaattaggtggtttaagctggtagatgttgggtatgacttgtttcttttcttttcttttctcttttttaagtaaataagtgtcaagcaccagcatttacctggcccttcccttataataatagccaacactttaaagttgcttgtcagggactgttccaactgctctgtctttctttgcctctctctgtgtgtacatatttacttattaaatctcacaataaccctggggtaggtggtattattatcccctatttacaaagagtgaagaagaagaacaagacatatccacggatctaccagctaaaactacctaatttaggactttaaaaaattcctaagccattaaaaaagatgccatcactgaagaacatacagtgagaaagtggaagagccatgatctgaactcaaagggattggctcagaatccatgccttagccagtaactacatctacagccagccatatgtacatttgtatcttgagttgtttttattttttaatctgtgtttattttattatttattttctattgtatatatttaaggtatacaacatgatgttttgatatacatagtgaaacgattattgcaggtaagcaaattaacgtattcatcaccttccctaccttctctagttaccctgttttcagtaagagcacctaaaatctagtctcttagcaacttttcaatatacaagactgtatgattaactatagtcctcctgctgtatgttggatttttaaatttatccttcccacataactttgtaccttctgacaaactccccatttctttcccctccccacccttggtaaccactgttctactctgtttctatgtattagactttttgttagattccacatacaagtgagatcatgcagtagttttctttctgtatctgtcttactttttagcataaagtactccaggttcattcatgttgtagcaaatagcagtatctcctttttaaaggctgaatagtattccattgtagggatattgtaatatatatagatatcacaatttatttatccattcattcatcaatgggcacttaggttgtttccacatctaggctatcatgaatagtgctgtgtttactgagatgttttccactcatcttcattccaggtgccttcagtgctgcttctgcctgcagagatgtcctccagtcaccatactttgcctccggtaggctggctgaggacagagaatagtcaacacacacaaccactgttagagcgtgggtaaaccccagagtgattttatagcatgcaggcatttcacatccagcagataggcattgggctttgcaccatgcatttcatcttgtttcctcctttcttatggggagagatgaaggaaatcctttgcaagaagcatattctcatgggggtgtcatcgccgctgaaaacagcggacagaggttagcaagactgctcctattgttacaataaggaccctgaggcttggaggactgctgacttatttgctcaggattgcgcggtttggttactttgccttcttgtttttgttttgttttttatgggactctgcaaacgtgtaaactgactgattccaacctgctgttctttcttctgcaccactctgtgcccatgtggttctggggatgaagcatgcacctaggtggctacccttggagagtcctttctggtctcagagctgacataagaatgaatcagccttacaagtgtgagtccccggtgccagggccttgaaagaattgcacaactttttggcagccccaggaagccctgaaataaagctggggacccaagtgtactctgtgggcatcctggtagcaacagcattcaccacataaaacaatgaagccacaaagaggaagccacccagagaagcagctttggctggacaatgtttccaagcaagagagagaaaacagttagaaaagaaagtggcttttcatgatgagcaaagcttcttccaggcaaactaggtctcaaaagtatcctttcctccgcacgaagtgctgtgggcctgtgagcgctctcccactacaacagagtggagctgtgggtcttggaggaggttgggaacagagggttttggacacagactagatacaggctcaagtctcagctctgccgtttcctaactctgtgacaggagtgtccaatgttttggcttccctgggccactttggaagaagaagaattgtttagggccacacataaaatatactaatgatagctgatgagctaaaaaaaaatcgcaaaaaaaaatctcataatgtcttaaagtttatgaatttgtgttgggctgcattcaaagccgtcctgggccactggttagacaagcttgctctgaggcaggctaggttatctttcagcctctgtttcatcagctataaaatgggaacagttggatctatgtcacaggactgttgtaatagttaaatgagaccatgtttgtatggcgcataagaggcgtgcaaagtgcttgatacatagtaagctcttaatagatagcagctgctttttagagttcacagtgctcccagtcagattcttccttctgctaagcactggacccgcggctccctctgagatgctctgccctaggcaaccccgaggcttgcaccctctaaagtcaggactctctgctcaaaggttggctctccggagactgcccctgaccacctgacccagagcagctcccatccttctaccccactctgcgtgtttcttggcatctttcactatgggaagctgtgctgtagattactgtgtttatttgtttattgtctatctccttcgcctagaagagcagtccattctttttggcaccagtgactggttttgtggcagacaatttttccatggacccagtgggggtggggag

SEQ ID NO: 3038 - DNA, 878 bp, Homo sapiens
ggtgttaatcgccatctgcagtgcctggaggtggggtggggagaagtgaagaatctcttcctttttaatagattttcaagatgggaaaatcatattgcaacccacaggcatttggaaacaatttgtgccgaagacagaaagtacacctaacgttaagctgaaaaaactggacgctcccagcaaactcactttgcagactcctggttgtcagaagaaaacgccagaggatttcacttggcattgacctcttactacttccagccacttaccctgggcagtagaaagaaggaacagaaagcagagtagattaagaggagcaagtacaaatggcgtgggacttcaaatcaccacctaagattacttctttgatttctgaaaaagtaggtcaaaggaagatgtcaggggcaagaaaccaattgggtgttgtgcctaagaacgtggaccctgtggccagactgcttggatcagtgtcctccctccaccactttgtagccatctgacctcagtgctggagcagaggtactgaatgaggaagtggagtcttgggatacctttggagggatccagttaatggactggctgccataattggtctgagacactggtgcaagcatggagatgacgacacagatactatccagagggatgaccaggtgaagaatgaccaggtgaagacacagaaagaagacccccttctacaagccaaggagagaggcctcagaagaaaccaaccctcacaactccttgatctcacactttcaatctccagacggcgtggaaataagtttctgttctttaagtcccccagcctgggatactttgttatgaccacctcagcagatggacacaaccaggttgcaaaagctactctctctgcc

SEQ ID NO: 3039 - DNA, 4036 bp, Homo sapiens
cgggcgcccagagggcaaatgaggggcggcggggtggcgggtgggggggagacgcggaatttcccagcgcgggggctctggcttaccctgcaaccgggcagtctctttctgtttacggagagaaaggggaaatggaaaagtcggggaggcggtggctggcgtccgctgcgccgcccctgggcaggctcagacgccgtgagtcaggggcagagcagggcggtctgagcgtgcgggcgacgcgggtctcactcgtccgctccgctctggactgcgcgccacgctctggggtccggcgccctggttcctgcttctgccgctgccgccgccggatcccagtggcccggcgtgctcggctcccacaggcctgcagccagcatcgcaccgaaccttcggggggccgcggctggagcgctcggccggcgtgggagcgccaaggccgcaggtaatccagggttgggggtctccggcgtgtctttcgggtcgcgtcccgcctgggtgccccggggattcccatgcagaaatggagggtgcccccagcagaggggaaaactctggcgtgggaagaggtgggggcgtgcccacagctgcgctcgcgggtcgccggctgcaccaggcacagctggaaagcaccttgcgcaagggtctcacggggtgcagactcgcgactcctcccccttcctcctccttcccgtatccgcagcgccagggcagtgctggtctgggcagtgcgcggggaagcggggacccgctgtcactgcgcctcccgctgccgacgccgcctggacggccgcactctccctgcccgagacccggtgagtgcagctcggaggctggaggacccgatcctcccaaatgctgggtgctttgataatttataagccttttaggctcccttgacttagagaaccaggaggaaaggagtgggagtgtgggttggcggagcccagagacttgtgaatggctggaactaaattcaagtttgtaacccggactctatcccatgactaaagaggtcatagcagaacacgaaggctgggcttttggtctaagaaagaatactaggagaaaaaaaaagttattttcacggaagttgttttcgagcgatagtgcatgatcaggactctgaaatttttctagctctgggcggagaaggacgcctagggattgtctccatagttaacaggggaaggccaccggctgcctgtaagagagaaacgttgcgatgcttgtctatttcacttttgggaagacaagattaaaggctgctcttgataaaaaacagggacagaaaggctcttgcagttgctttacatacctgtggcctgagtcgtttgtgccaaggagagtgtaatccacttccagctgacgcccccagctctctgcgacggattgaggtttgtgtgcaggacgtctggcatacggcccatgaggactttgtcgtgtaaagcaaatgggaacgttgaggcatgtagaggttttgaagcagagtgtcggtccttccttccatacgcctgaaacgcataatccggggctttttgagagcaaaaacatagtcagaaatgtgccctgagggagaatgtactattttggcacacatatgtatatatgtatatataatttttaaattttttttgagagggggtttcactcttgtcgcccaggctggagcgcaatggcgcgatctcggctcactgcaacctccacctcccgggttcaagcgattctcttgcctcagcctcccgagtagctgggattacaggcgcccgccgccacgcccggctaatttttgtagagacagggtttcaccatgttggccaggctggtcttgaactcctgacctcaggtgatgcaccctccttggcctcccaaagtgctgagattacaggcatgagccactgtgcccggcctaaaaaaatattttaaatgagaaataacacaagtaatagtcattctttgttaggcagaagcatatgctgttatgctggccattttcattcacacttgccaggaaacactcacattttgtttctgtatatggaggcagccaagagtattatgttaatgtttaggaagagaatttcctcgtgattttattgctgatttctgaaataattcagtgtaactaattttgactgtatttgcacatctctccaattccaaaagctggcataattttctgtttggttaggaagtaggaattttatgaggacttttattgtaaactgtgtcaagggaaaaatcatcttatactaaacgtctttattgccaaactagaataccttcacaatctgaactttctctagatgggcacagatcatgaataactcagaaaccattagcatattgtgtgcttaattaaggctggaaagtgctgaggctttttgcaggcgcagttagcaggcgaactggtcagcagggtttctggggaacgtagatttgcgtgacaggggccctgtgttgctaaggaattactgcaggcactgagaaaagtctcagcgtcagacactcctccacctcccgggtcctgcttccctccctctcccctttccaggcaactcacagtttaggggtgtggttgtgtgtgttcaagctcttgggttttacatataaatgcctgagacttttctgcagggtttaaaaactaacatcttgtcttacagctcttttaggatttgtcttttagaatctccagtcctcacaggaaaaccccccaattaaaaaaataaaagaataaagaataaaaagaataccactactactataaaaaaaaaaaaaatcctctaaaatttgtcttcccagatcagcagagtgaatttgaactgtgtggacttttttcctctttctttcttgagtcatgttagtactgagaactttttttttttctgtcaaatcatctgtttgataaataagtccaggagacttggatcctttcaacccctgaggccctaaattaggctgttttttttttaacctctgtgtttccagtaaattcgacaagcagaaactgcaactaaacggctcagtaaaaccgaagtcaaatgttcctccattaatctaagaagttgctctcctaactcagcagactccaagaacctgaatcacaatctccctcgaagatgtacaagatctcaggaggggaagctgccccctcactctagatttcacggtggtgataacagccatgaaagcatttcataggtttctgccttttttttctctctctttatgtcttgttttagatgcaatcttcttaccgcgaagaagccaggggaataggtagccacatcttgtttgcagataagaaaggaagctaacgcagtatctgcaaagccaggagtctgactcagtacttttctcactcatgcatacaaagcagctaaaaatgacacagcttatttaccatgcccctgacactgcactgagcactttatgagcttgaactctgttaatcctcacgaccacctcatgagactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtacgtttctttccgatcagttgggtgctatgtgctcagctttcctactgcagcttcatttaatgcagagtggtgtttgaatttggcttagatgggctggcaggcatgattttaaaaaatgtaatcatcagtaagaagtacttccatgttaaagatgcaaaaaaaaaagtcttcattaaaatttctatttaaagattcttgatcata

SEQ ID NO: 3040 - DNA, 824 bp, Homo sapiens
cagacctccttctcctctgcatcccggtggtcctgactcagaccttctacattgtcacttagcattcacaactcgccattgatcaatgtcccccttgggatcctgtctcaccaggagaacaacagagttgtaccagcctgtgcccttggatgccattccaggcagcaattctgaagacagctctggggctcctcaggtctctctgcagtgctcctccttcccctctgcctccactgccccatctcaccagccctccccaccaacatttcctccaagcctcaacaagtcacccaagagtattctaaggtccctgctggtctatctgacaatatgcagataggccttggttgccttggctggctgtgaccttgctgacatctatagacagagaggtgggaatgaaagacacattactcctggatgttggtggagaaggtggtggttgcagttgctacgcaagagtcaccaggctgcagactctgtccacttctgagagtgcaatgtcccctgtgattggctgggatttctgagcttttcagcttgcatatggtgagaatgttggcacaccgcagccctgagggcctgggctttggactccggcagtcccacatgtgtgtgctacctctgccgctctctggttgtatgaagtcaagcaatgtctgtaacctcactgagtcacagcgctctgctctgtagaatggagatgggatcctctctacctcctgcagtgtctgtgaatgccataacacaagccagagtgctgagcaccgtgcccaccctagaagagggctcggtgtatagtagcagctcttaatgctcccagg

SEQ ID NO: 3041 - DNA, 8389 bp, Homo sapiens
tttaggtatatttctcattgttagattttttctattcaaattcctctaatactcgttttctaattggtgaatttaacccattttcatattaacggtgataactgctgtgtttgtacttctccctgccatctgattttatgttttctattcatcatgcttttcaaaaattattttcttgatacttgctgaattgttagctatatcccatttctatatttcctggtggtttctcttaaattattagcaaatatattcatcttgatattaagaattcatcagcatctaaaacctgttaccaccaacgatagtagctaacagttattatttcctgtgtgtctgacagtattttaagcttcttaccagtattaactcaataaatcttcacagtcaccttgtgagaagggagtcagttattcccattatttacagatgaggaaaccagtaagaaggtaagtaattttctgaaaggcacacagccagtgagtagtggaggcagaattcatactcaggctctgtacctagagacctgcttgcttcagcactgagctgttggaatatttctacttgtccctgcctagacaccctctccttccaggttatgctgaaatttactttctagattgttgtcttatctgttatgttttaagaagtctctaaacatttacattaaagacaccagcaatctttggacttgacttcaaattttactgatttatttttccttgacatgtagaattggcatgctttctgggtgctttcttacctgaaaaatggctttattttgccctcatatttgattgatagattggttaatagatatttgtgagtttcattcaacattttgttgacattgcttctttgtgttctagcattgagcattacagatgaaaattcctatatagtttttctctctggaaattcataaggtttggaggggtgatgtgtgtgttgttgttgttctcttattctttcactttagcctctcttttttgaatttctgttattgcttttatcatattatctatttcttttctttctgtgttctcagagaatatcatcactgagtctttaatactgtcagcttcagctgtgtgcattttgctcttcaactttcttttgaggctttaaattaggcaaatatatttttcttagaatttctgaaaactccttttcactggagcttattttaattatatggatgcattatcctcttaaacttctgtgaaaacaataattggagttttcatttgcattagctgtttcatgaaaggtcaagttttttgcttatttattttgatgtttccttttcatgatattcgtgtcttgggatttggttgtatattcacatttttaattagctacttgatttaaataaagtatcagtagttactttcagggttcttggtgattataataattactcacctaccaggcttcttccttgcatgcagctcactacaggaatctgttgtgcctagaagatttcgggacaagtggggaaaccacactccgttaactgcatacacagggaaggagctacgagggagatagaataatttggtctctactattaccttaagagaccttcccctgtcttcgatttaaaaaaaaattactgcatacaaagggtaggagctacaagggacatagaataatttggactccactactaccttaagagaccttcccctgacttctcttttaaaaaacctatgggtctctgcacccctgaacttactttctacacctatttctctcttcacccccaaaatccatattagaatgcccctgcaggctataaagcctttcataaaagtaaaatacccagtcttttcaagagaacaataaaataggcagtctcctacctcttgtcttactctaatataaactccatgaagataagtattgtctccatactgttcatgctgcacagcagttgcccttatctgcagggcgacgcatcccaagacccccagtggatgcttgaaactgcagagagtaacacacgtgattgccaccatcggaacacatttctgtgcacgtcttccacccacagatttaatgccttttccgtcttaactaagcactcatcatggactgtggccataacttttgcagttttagatgcaacagcaaaactaacattaatttttccttcttcttcacaatttcatgggtagatttgttcttaccgtagatcttagcaacctcagcatatgatgttttttcttttgagaactttcaccttttcccttaaagaaagcactttacagcttctctttgacatatctcaactgccatcatcactgctcttgaactttggggccattattaagtcagaaaagggttacttgaaaacaagcactgagataccaccagagtccatctgataactaagatggtaactacatgactaacaggctggtgacgtatacagcatggatatgctggacaaaagggtgagtcatgtcccaggtaggatgaagcagggtgacttgagatttcactattcagtgtggtgcacaatttaaaacttaggaattgtttatttcctggaacttttttcatttaatatttttggactgcagttgaccacaggtaactgaaactgtggaaagtgaggatcagaggataagcagggactgtggtattcatttcattgcacagtgcctagaatacagtaggtgtactataaatattttgtaaagggacaactttgctgaaactgaaaatatttatgttttacccaataatttttcttctggaaatttatgctacggaaatattcagagatgcttacaaagttttatgcatgagtgtccgtgttatttgtaattgtgaaaaatgaaaataactcaaaagtttaacagtggtcatctaaagtactgtatacactgtatatataggtcgaatagaaggtcatcctattcatttattaatgagaggtacaatctccagggatctgtaaaatctattttgtcttaaccaaagaacaaatttttgacatatcttgaataggatgactataaattatgactataaattatgactataaattatgactataacttttaaattgttataatttttgtactattatctgatatttttatttttatgtatgttcctaagtagtttagagatagtcacattttaaaaatctaagatcaaacaaatgaagcttatttttatgtattcatagtataaaagaccttcagtaaatagataatatttttgttttattctagaaaacagctccttgaacacagtgagctggcttttcacacattgcagttgttagcgtttactgcccttgccattttaattatgaggctaaagatgtttttgacgctgcacatgtgtgttatggcttccttgatatgctctcgacagatgctgtcttcgcaggtgccatgcctacaatggcaagcgtcaagctgtctacacttcatcccattgtgaatcatccactttacgaagatgcagacttgaggttggcagctgatgagtatttcttcaagactcacttggcgactcccaattcttaggaattgggaaaatttttacacacacacagacacacacacacacacacaaactcatcctcattttcgtactggaagttaaaaaaaaatgacaataaccatccagaaatgacaatatgtacctgttgcctctggagcaagcagacctctgaaaactgaaaaatgcaaaagccagttttttccaaagtgacaaatgtgtcacatatttatgatgtgtgcgtgtattccagtaaaactactaggtagttggaagagtaggtaggatggattttactcacagccatggtttgccaacccctgctctacaccacaagccccactctgatttaagaaatgatttctagatcttactggtggccaatgactagctttttgtgacaggtagaaaaagtacatgaaagttgctattatatagtacgtgctttcatgaaaatttagagtatttttgctagtcgattatgagaactctagtttccattgatgtctaaaagttttgctttccttaaatggctggtttaaaaaattattttggttattctagtagttgtcagggtaatcatttttaaaagtggatttttggcctattgttagaggcaaatgtttaaattatttaaaagttttaggtcttctgtctaggagccagggcttggagtcagacaccttagaagtgtacctgatgctctctctgttctactgtggtgaactggcatggaaaccactgtggtgactgagcatcccatatgcttgaaattctaagcaacatccaatgcataagtgatagtttgtcaggattttgtaagaattcccactacggtcaaatcacctattgtaccatattttggtgaccatccccatttctcaagattctgtgaaggtgcttttcctacctcttctgataccgtggatgtccattgtctaagtgttctacttgatacactaaatttcaattcatttatttgtcagagcttctttagatgaaattaagcattgaaagatgtgttttcactacattcagtctctgtcagaatatattctctgaaaactgtgtgaattatgagaagaaaactgtatatcctaagctgctctctgctacccagtacaactttagactatcttatacagtaatgagcagtatatgcaaaattaaattgctgtaagttttattacattcaaaatataagtaggaatgtggaaactgccatccccaaaatagttgatgctgttttgagtcatgtatatcagtgttccatccagtgagtattgagatttcaatttgctagtaagatttttttagtctattctattatcatttattttaaaatcttttaaactattgtttaaatttaaagggctcggacaaaaatagtttattctacatatagtcgaaaatctgccaaagaagtaggagagaaattgttggagttacatgtgaattattatgttttagaagaggcatggtgtgttgtgagaactaagtgagtattaaccctatgctatctgatatggtacatttttgagcaacaaatgtttcactttattacagtagtcctgattctttaagaatttttattttaaatttattaaaataatatcctggtaccttagtttaagttatttcatctagggacgtaaaactatactatcaatgaagtagaatttaattccaaacattatagtatatttaatatcctgatttttcaatttaacatcttccacttagcttttttcataatttttgaaatatttatgaaaatttttattagatatctgaaatatggatttgaatttacagcaaagtgagatattggcattctgtattatagctgaattatattggatttataagacttaaaagaaaagtgacaaaacccaaaatgacataaggaaaacattcctaattaaaattttttaatttctgaattttgaatctctaaaaatcataaaattctaagatgtgtaattgatcttatgaggactttgtttagactcctaagcacagatattagctgctgcacatgacaggaaattcaggcacattaattgtctcctagaacgacacattggcaatcagaagaacaaaacaggttctacagtcacttcagtatatcatttacaatgtgcaaaaggtttcagagatgcaaactgaaatgagaaagtatgaacaatactctgaaaaaaataagttaatagaaaccgattcaagtaggtccagatgttggatttagcagccaaagactgcaaagccactattacaaatacattcaaaggcttaagaaaaatgtattcaatgaattaaaagaaaacatggtatccattagtgaagagctatggaatctcagcagagaaatagaaacactccagcccccacggaaattctagagctgaaaagtataataaatgaaatgaaaatcatttaaatgtactcaacaattctgagatgaaaacagaacatttgaacagaaaatgcagtgaatttgaagatagatcaagagagaatagttaatcaaaagaacaggagccaaaaagattgaaaaataaccaaagtcacagacctatgtaacattaagtagttcaacacatgcataattttagtattagatgtaatgaaaaaaagaacatgacagaaaaaatattgaagaaatgttggccaaaaatttctcatttgataaaagctactaactgagagatctgctaagctcaacaaatccaactgggtgaagcccaaagaaaaccaaagcaaggaacattatagtcaaaacggtaaaatcaaagattaagagaaaatcttgaaaataagagaaaaaaattatatgctatataaacatctgacttcccaacataaatagtggaaattatcagacactggaatgataattcaaagtgctgaagaagaaaaatcaacaattctatatttaatgaaagtatctttttaaaatggaggccaaaaatatttttcagatcaacaaaatctaagataatttgttggtaacagatttatacttcaagatggacaagaagttctatcagctgatgagaaatgatgccagatggtaactcaggtatacaagaaatactgtgatgcgctggaaatggcctggttgcagtatgcttgaaatctgtgatgtggaagacccttccaatgcagctaaccctcccttatgtagcgtcctgctcaaagatgccaggccttacttcaccacagtatttcagaatagtgtgtacagagtattgagggttaactgagaaggaaactacccattacactatggcacaatgtggtgtgtcaaaaacaatcaccctttggcttatttacattaataaaaatcacaagctttaataacagacacttaaaaataagataaaaatggattgaaagtttctctgattactaaaaggtaaattacttttctgttcattgaatgtcagccttattaagcttgtcatataagttattaaatcattcatgtcatactgcataaacaaatgttcatttcagaattttaaagaaaaatgtatataaaagaacaatgaattttaataaatcaagggtacgtaagtcctttttcatccaactaggtgaattgcttcagattttccctagtaccagagtgtacctgctcaaactctttgaaccacttaagggagaagaacgcaagctctgaaatgacatccttaaaatgctgatactgatcacaacctctttacctctgtgagcaaattgtaacagtgtgtcttttaaggtgtttttatttcaccagcccttaagaaagatctctaataccttttaatactttttttttataatttcaagttgaagtgtttttaaaaacaccttgttttgtaacgttttgaatctcttgagatgtatttaccccactagatacatatttgccactggttagttctccatctaagctcaagaggttattcatctctctttagattccaatggtttttcttttaacatccaggtaaaatagaaactgctatggtatacaaccaaattttggggttaaacataatcagaaaagaaaatccagttaaatttatgaagtgagattttcagatcctagatcttgaataaagcaaacggcttttcatcttgatggccccaaagcttgttggtcatggtctttatttctggccactatcatcttcttaaataatatatttttaagccctcatttatttttggttttggatgaggaaagtcatgttttctaagtcctctcccctaataaaacctacccaacaatagtgctttgaaaagtggtagttatcttgaagatagatactcttgccaaatgcaaagataaacattctttttgtctgctttataaatatgaaatatgccagatctatagtattttaatgtgcatctactttaaatgagtcatcttggggtttttataattcccttacattcttgcccctctacacttgaaataacaaaatgccttaattttatagattagttctcttatagcagacaggcagctatatgcagcaaaaccaataaagttatttttcaactttaatagttgtaaaatgttataacagaatacataacagctaagaaaacatgccacattttattttagcattttcaaataatttgtttttggtgtaagcacaggataaaaaaggagagcgtcaaagaaaagagacttaaaaaaataacattcataaaaattaacaaagtatattttggatgatgtttttacaggaaatagtttaagttggtagaatttttaaaatggtactgtattagctaataaaatattcagtacatatatatgtttggatttatgcattaaaaaactaataaaattatttccaacttt

SEQ ID NO: 3042 - DNA, 8329 bp, Homo sapiens
tttatgatcattattatgagggattataaaagaatttatattgactgcctttacaaatctgatatggtttaactctgtgtccccaccctaatctcatcttgtgggagggaccttagggggaggtaattgaatcatgggggccagtctttcccgtgctattcttgggatagtgaataagtctcatgagagctgatgggtttatcaggggtttctgcttttgtttcttcctcattttctcttgctgccaccatgtaagaagtgcctttcacctcctgccgtgattctgaggcctcccctgccatgtgcaactgtaagtccaattaaacttctttttcttcccagtcgtaggtatgtctttatcagcagtgtgaaaacggactaatacaaaatcttattaactgttagaaaaataaagacgtatatgtgtgtatgcacaacatattcacacacacagatatcacaaggccagaagtaataaggtacagtgtgctacagtaatgaagaggatgaatgggtcatttataacaccagcagataatttattaaaatattatcatgtaatatttttcctaccctgttcactgaagatagcctttaataagttttttccttgttgaagacttgtgtatagggctggcaatatcaatgagaaaagagtgactaatttattcaaagccaaagtcagcagtttgatatgaaagtagaggaggatctggggagcaggacttatttagtgtgagtccctccaagggataatgggccctagaaggatttatttctaaataagtcctagaagggccctgtgtgtatgatttatttaaggagataggaacatagggaatgaacattctgaccttggtaaatgttcctggattctacataggcacagaagtagaaccatctgatctataggatccatgtagactggacaatgggcatcagagtgtaagctactgtgagtcagtaatatgcatggagggatctccttggccctgtatctttgaaccaacctgggaaaaagagctgcacttatatttgaaaagactgagggctcagggtttgatttgatttaaaggaattgaaatagtttgttattttttgttcatataagtttgtggactgtattttatatctactgcatgtagagatttactaggatttactaccatccccaccaaaaccagatctgcttcaaggtttggttgttgttgatcagaatggggcaaaacaatttcgagacaattgctgaaaatttgattggtattcaggaaagagcatggtctttcaggagtcactgacatagggcacattagtgtgttgtgatgagaatgactttgaaaacccttggaaagttataaactgttcacaaaaggaaggaaaagaggaatatatataccttctaatactttactgattctgtttgtgtctcttctattcacaaaataaaaatttggaagagattcatcaaagatgatcttttaagtccctatgttgattttggttttttaaggagaggaaaggtacttggaagccacagttgcagtaacctgtgtcaggagaacacttatcaccacccctagatatgacacctgaaacacagactaatgcaaggggacaggtggtagagaaggttgtttgaaagaagcgattgtgaccttccagatgcagaatttcgggacataaagatgtcatatagaagaagaaagcttaggatcctggagcatgccttagaggttctgcagcagtggcaggtggtactgaatccagaataggcaacagttagggatgactgagtccatgattcagacatggagatcatcatacttgcaagggaaatatttaagggattgtgtttgaatatttatgtaatactcatcatcataaaaaacacaggcaagtgtaacacccacagtcttataaagcagttacacaatcaagactgcaaaaacaattaggtaacaattaacattatgctatgaagaaaatttcacatatcaacactaaccttaaacataaacaaactaaatggtccacataaaatatataggctgctggaaaatattaaaaaatcaaaatccaaccattggctgcatacaggaaacccacctaactgataaatacacttacagattcaaagtaaaggagtggaaaaagttattccacacaaatggaaaggaaaagtaagcaggggtagctatacttttatcagataaaacagaatctaaatccactacaggtttttttttaaaaggccattatgtcatgataaagaatcagttaaacaagaagatataacgactctaaattatatgcatccaacactggagcacccagattcataaaacaaatactactagacctaagaaaaaaatagaaggcaatgcaataatagtacgatcttcagtatcaaactgacagcactagagaaatcaccaaggcagaaaatcagcaaagaaactctggatttaaattgtaccctggacctaaaagacctaacacacatttaaagaacattctatcctattactacaggacatatattcttctcatctgtgtgtgggacatagtcaaaaattgatggtatgctaggcctcaaggcaagtctaaataaatttttaaaaatcaaaatcacatcaagtaacctctcaaaccacagtggaataaaactagaaatcaatactaagtgggactctcaaaataatacatggaagttaaattatctgcttcacaacaaccaaacctttgggatacagcaaaagcagtacttagggggtatttatagcattaaatccctacatcaaaaaggtagaaagatctcaaattaacaacctaatgtcacacctcaagggattaggaaaacaagaacaagccacacctaaagttagaagaaaagcagtaacaaacatcagagcactactaaatgaagttgacaaaaaaaaaatcataaataaaaaaatgcatcagtgaaatgaaaaattttttttgaaaagataaacaaaattgatagattgctagctagattagccaagaaataagattcaaataagcactatctgaaatgacaaatttgtcattacaactgatgcaacagaaatacagaagatcgtcagagacttacaaacgactatgcactgacaaattagaaaacctagaggaaatagctctagtttctagaagaaacatataacctccaaatattgaaccagaaagaaatagaaattctgaacagaccaataataaatagagaacttgaatcagtagtaaaaaaaaatctcccagcaacagcaacaacaaaaaagcccaggaccaggcagattcacagctaaattctaccagatgtacaaggaagaactattaggtgcaaaagtaattgtggattttgccattgaaagtaatggcaaaaaccgcaatcacttttgcactaatgataccagtcctcctgaaactggctgaaaaactcaaggaggagggaatcctccttaactcattctgtgaagccggcattacacttattccaaagccaggaaaagaaacaagaacaacaacaaaagagaaaaatacagaccaacatctttgatgaacatacatacaaaaatccgcaagaaaatactaacaaactgaatgcaacaacacatgaaaaagataatacaccattatcaagtgagttttattccatgatgcaaggttgattcaacatatgccagtcaatatatgtgattcactacataaacagaattacaaacaataatgatatgatcatatcaatagatgcagaaaaagcatttgatgaaattctgcattcttttatgattgaaaactcttaccaaactaggcatagaaggaacatacctcaaaataatgaaaacaatatatgagaaacttacagccaacatcatgctgaatgaggaaatgttgaaagcattcctcctgataactggaacaagacaagaatgcctactttcactattgctattcaacaagacactggaagtcctagctagagcaatcagggagtagaaagaagtgaaagggatcaaaattaaaaaccaggaagtaaaatcatccctgtttgctgatgataccaagacaatgctaaaaatcttccaaaaccctcctagatttgattaatgacttctgtaaagttttaagatacaaaatcaatatacaaaaatctatatgcatttctatacagcaataatgattaagttgagaaccaagtcaagaactcaatccaatttacaatagctaccaaaaaaaaaatacatagaaaaaaatttaaccaaggaggtaaaaaatctccaaaaggagaactacaaaacactgatgaaagaaatcagagatgacacaaataaataataaaacatcccatgctcatggatcagaataatcaatattgttaaaatgacaatactgtctaatgcagtctacagattcaatgaaattcctatcaaattaccaatgtcatttttcacatagttattaaacaatattcctaatattcatatggaaccaaaaaagagcttgaacagccaaagcatttctaagcaaaaagaataaagctggaggtaaaaaattacttcactttgaattatactacaagattatagtaacccaaacagcatgtacttgtttataaaaatagatgcatagatcagtggaacagaatagaaaacccagaaataaagccacatatctacaaccaactgttctttgacaaagtcgacaaaataggcactgggcaaaggacaccctatacaataaatagtgctgggaaaattggagagccatgtgcacaagaattaatctggactccgatctctcaccaatgtaaaacctgaaattatgaaaatattacaagaaaacctagagaaaagtcttttgttcatcggtctaggcaaggaatttatgactaagtcctcaaaaggaaatgcaacaaacacaaaaacagacaaatggaacaaattagctaaaaagtttctgcacagcaaaagaagtaaccaacagtaaacagacaacataaagaatggaagaaaatatttgcaaacaatgcatctaaccaattgctaatattcagaatctacaaggaactgaaacaagaaaaaaacattaaaattgtacaaaagacatatttcaaaagaagacgtgcaagcagccaccaagtatataaaaaattctcaacatcactaatcaccagagaaatacaaactaaaaccacactgaaataccatcttacaccacttccagtggccattattaaaaatacaaagccaacagatgttggcaaggatgcagagaaaggggaacatttatacactgttggttggaatctaaattagtataacctctatagataacagtatggagatttctcaaggaactaaaaatagaactaccctttgatccagtaatcccactactgaatatctatccaaaggaaaaaaaataatttgatcgaaaagacatctgtactcatatgtttactgtagtaatattcacaatagcaaaatcatgtaatcaacctaagtggtcatcaatagatgactggataaaaaatatggcatatgtgtgatctatctatctatctatctatctatgtatctatccattatggaatactacttagccataaaaaatgcaatcatgtcttttgcagcaacacagatggaacagtaggccattatccttagtgaaataactcagaaacagaaaatcaaataccctgtgtggtcatttataactgggagctgaacaaagggtacaaacagacacatagagtggaataatagatattggtgactccaaaagatgggtctctatcttttggtggggaggggtatgaggtattgggtacaatgtacactctttgagtgaatgggtactctaaaatcccagacttcaccactacatgacatagccacataacacaactgtagttgtacccttaaatccataaaaataaaaataatcaattaagaaacccaaatggggtttgagactgtttgagagtataccaggtaactggcctaaatacccatcagattaaaattagagacttggtcagaaagagttccagttctagaatccttagactcagatgtgtggatctagtcctgaaacattcctattgcccattctacttttacctaacacagtctggattatacataattttctacaagtctaatctccagagacttggtaagatgctctgttacaaattgccactgcacactgtatgtttgtgttgtacttatcacaattgtaattaaattttttagcaatttattttcttaatctaagtcccaccagctcaggcactgttatcactaaattctcagtacttagggtagggcttgactcagagtaggtgttcaataactatgccttgaatgaatgagactgaaacatgggtttgccataggaagttctgggaggtaaaacttaagagagaggctaaaataaaattctggagtgttctaagtatcaatcagtgtagtttggtctttttctaagtcatggacaactggtgggagtttgtaaatcagaaaaatgggtagttacttcaagcaggcaaataaagggaagggaagggaagaaagactttctatagagagtatctgtgaaagagctatgtttatcttaaattagctcagtctaaaattttggcacagtagaaatgacttagcagatgatttcggctcagctttattgtctgccttatctgaagatggttttcaatatccaaacagtactcaccatgcatgaatgactgggatctaattatggcaaattctccatccagtagcttttgcagcagggcttattcagttctataggccagactaaagcagggtaaaggtctgtttttgctatttcaaacaaaagttcaactccaagtctcatttttaaaaactttcatgttatgaatggccttactgctcagggcttaaagaaatagagagcaagggcaagtgagttagatccacagccaaacacatctccgccactctggaaactgcttccgggccttaagaagttgcatagaataaagaagaatggggataaagcagatatgaaataaaatactaattactaccgaagcagcaggtgctttaaacaccttttataggtttctcatttgatcctcacagtaattatgacataggagctattattatctccatttgacatatgagaaaatgacagcttagagaaataattaagggagccaggtctgggcctttttagctcataactgcatgggtggaagagaaagatgaaaggatggggtatgtggcccttgatctcagatcatctttaaggaaggttagaaatatggacaattaagagagtagctttttttgaggtcacaaatattacaaattaaacactgaaaaggaaaactcagcaagagttacaaatcaaatgtcaagtcatactgagcctgagagatgttttgggccatggaagaaaagagtgtttggatgggtgggggaaaggacagctacatggtgctctgcttgccattacatcaggatcagaaataggaatacgtgagaaagtaaatgtgtccagctggaatggaagaaacaggtgtggtggtggctgcagctaaattgagagaataatggatgtgaggctaaggaatttgggttgtatagagtaaataatgggagttactaatgtaatttaagcaagaaaacctttgatgaaaaaaagaatgaagttcaagtgatcatgtgaaaaataaaacagttgcattttctggttaaatactaatttgtagagaattacatgggtgttgcttgttaaaattgccacaaatagcagtattgccatttgtattgttttttgtacaaaatgccatggttcaaattatggtttaaataacatcctagagaaacatgtttaatttattagccataaacagagtccaaattttagagaagctgaaaggaaataactagaacacatgctgactctaggtgtacgtatcagcaaatctggtaagggatggcttaggaagaggcaatgaccgagtcacctcagagtttctttaaggagtacaggtgcctctacctgttgtgtagatgaccattaaagtctctcttaactttcagaagactatttcaaaggattttagtttacaagggttcaatcacttcatgagaatttttaagcctctgttattgtagagatatgtaggcatttgaaggagatagaaggaacagaagtaattcctacctgctagaaactccaagtaagaaagtgtttataaaaactataaagatctttcaaaatcaacttgaaaataaactagaaatgggtt

SEQ ID NO: 3043 - DNA, 3090 bp, Homo sapiens
gtgctacaaacaaaaagtactcttcaagtgctgtcaacctaaaggttaacaggttgaagggaccctgggctaaggaagcacaagctggagacaccaaaatggtcttcgcaactcgcctctatattttctgccctgctcctaagccagcctgttggccgactggcccttctccacagatgtcatcttgagcctcttacagagtttcagcactgacattaatgacaagatggatcacctacaggacaaccttggatcctcaaccagcctgattaagcattgacactgcatttgtcaccaccagctctgatggtttggacatgtagaaatgtattgcaggagaatatgcaaacagctgctgtaaggtgagctgatcgggacaactgccagcaggcagaagggaaggcataattaatgggcacccttcagcagagctcagagcagaccaaacgccaatgcagaaggctcaagaaagaggcaaacagactagccactgctccaggatgactgtggctctttatgagtgaagagaaagggtggagactgaagacagaactggggacagtgacaggcttggggaagaacagctgattcagcagtcccaaggcttgtgatcttacagtgacattttattctaagcatctgaacacaaggtggacattctccagggtgacatcgcaaaatacatgggtgaagacaacctagtggccgtgacttggagcacccttcctcacaatgaaggcattctgggccagcctgaaaaacagcatggaaataaatcacctaagtacaagggactggcttaaaaatggtctaatgaaatgtcaaaagagttctcctgtggagcttcggagaagtttccttaccctttaaaaaaagaaaagaagaaaaggaaaaggtgatgatgatgacacacagaaggcatacacatttccatttctccctttggaaactttcatgtctgggttgagaagttaacagaaaggcaaacagcctgaggtcaaagatgacacactgaggataacaaaatggaaagacaatctgagctcttgatgatgtgtgactgaatgagccaaattaaacaactatagagctgttctacttccaatctaattatgtgagggataaatgttaatgcgctttttctttaggttttcatttagattttgtagtttctacggtacaaatcttatattcttttattgaatttcttaaacaaaatgttcttttcagactatataagtggaattgttttcttaatttcattttcagattgtttgtttccagtgtacagaaattccactggctttgtatagtgatgttttctacaacagtaatgaactcattaagtaactctaatagcatttttgaggactccttaagacttttcacacacaagatcatgtcatctgaaaatacaaatagttcttctttactccaagtaaaaagacatttttaatttctttttctagcctaattgttctggctaaaaattctagtacaatcttgaaagaagtggcaggagcaggcatcctagtcttgttcctgttattagggagaaaacttttaatctttcaccacgatgtattagtgaactgtgtgggcttttcacagatgccctttatcaggttaagaaaattatcttttcttccacgttttttgagtgtttttatcaagaaagtgtgtcagattctgtcaaatgctgtgctacatcttgaacctggaaagagaaggttgcagtgagccgacattgaaccactgcactctagcctgggtgacggagactccgtctcaaagaaaaaaaaacaaaaaaaaacagactaaggaactcaatggtaattaggtacttatgacctaattactcaggtaattatgacaacattttcgtgcctatgaattataatatcaatgtctcttctgtttctctcaaggaaaaattttaggccactaataattctaacttagagatattagcaacaacttggttcctcatgattataacttaagtcctcagtaaaagaatagtctcaaataactgaatacctacatgaaaaacctctctgctaactacacagcccacctccattaaatctacagactaaaattaccctatttgtgcatatatctcctaacaacactttgcctcccaacttgactgtgtgaccaatacacaaaaatatacatgctatttcaactgggaggaatgttgtggaaatgaaagcttttagaattaaaaaacaaaaacaatcctctctttaaaagaccaatacaccagaaataccaatgtttaatttggcacctcagttgtagacaacagccccttttctaactttatgttgcttctcagcattctgtgctttttcccctatactccataacctctgctggaagtataaaaaattccaggattccgtattactgtaggttcagctccttagagctcagtcccagtcattcactggcccatccaggaaactacttcctctcatttccaaggcttcctttaaatattccccaagtttgccttatctaaaacctggctttcttctgtcttcagggagcttacaatccagtatgggaatcatcgggaaaagtaacaaatgatgttccttggatttgtttttgtaattgcatgcactcgctatggaaagctaagaagggcatcaaactccaactgggggtaaagactcaaaaaaagatatctatagtaggtttatatgcaagtatgacaaacatgtttgaaaagaatgaaggttaagacagacacactagttgataggctaggcctgaaataataatgaactgaactaagaaaaaagggagattgacttcagataccctttaagctatgtcaaaagttttttgttttttttttttaattgaaattctaatacttacataggaataggaacttgacatggaggacacggtaatgcagtctgaataaatgctggctcagaaggctgttcccaagggcctgtaggctggtgctacaaataaaatacataagaattttaagtcagagggattaaatcatatggccattttaagaatctaagaaaatagttccatgtatcctctgctcaagcaggt

SEQ ID NO: 3044 - DNA, 2572 bp, Homo sapiens
tatcaatcaggaaaactgggtgaacaagggttttatcatccccagccaaggcatagctgagtattttcagaaaacagaatagagatattagagaacaggaagaaaaagaaaaaaagaaagtaaaacagctcttcagaaactgtattactgactttcacagtttgatgtcaaaacctatagccaaaggaggcagactagaataataaaagtgccatttatttatacagtacctttttctgagaagttcttgatacattatggtcatctggttattccctgagcttcagtccaaatagctcctaaaaagtaccaagtcacaactattctggaaagtaagccacatcaagctatgctaactaagaggtggctggaaacttggttattcaatgtctttgcattcattccccatgttggtcaaatctccccctacacacacgtgcacacacacatacacactacgcacaggcacacacactcatataactcacacaaaaacacactcatctttatttaaattcagtagttcaacttaaaggaaaattactcatgtggcttacgtgtacaaagtggagaaaaatgctgtgaagttcatcttcagccagaggaaggaaaactttctaagccaaacctctgattgtcttccttccgcaaaacatcaagagtctttggcatttgggtggtgcttgaaaagttgagggttcgtatctaagacattgtttaagtgacaataaattatcttcttttcaaccgtgtaggacaaagaaatagggagggggctgggagaaggagtaggtggatcattttacagacaaataaccagaagcacataggattgaactgatttactcacatgtgttcagaaggttctagaaatagggagctgcaacacttcagctctcaatccatgactacaacacaaggttttctctcttgtaagagaaacagtgttttcttcagatatcagataccatggtagttcagactactaaaaataaactgaaaaagatcacgttgcccaggaaatttattatttaatggactttctgtttctgttttcagaaaatagtattaaatgtttttaaacatttaacttgacaaataatgcatgacattgtcgtggacagtattatgtttgctataggaaaaatgcacccacaaaacaataattcctgtattttccagaacatcctcccaaaaaaaattagagaaaatccaataactcttattcattgatttactgattcactcactgcttcaaaaatatgcagtaggcattaaatttgatgccataaataaaggaaagaacaagactcactattgaaagttgattgtatcagaaaaatctgaaaggatgatcactcctcctagatactctgccaatggctttttgcactctcataaaattggaatgacttcctatggtgttcaaggccctatatgatctatccctgagctatgccaccctcctttacttctaaatctctaccatgtatttggcactaaccacacttgctcccactatttcctctaaagcaaataggtcaagtttcttctgacctcaggaaattactattttccatgacctctgcccagactaatcttgtcccataatggactctcccttactttattaaggtctctggtcaaatgtgatctgctcaatgacgccttcactaagcaccttacctaaacatcctctcagtcattctatttccccaaagcttgcttttcttttttatatgctttattagtatctaacattagaaatatatctttgtttattttcagtctttcccagctgaaggctaagactttatttctctctccctaaatgaatgaattgcctccagcaggtatcaagaatgcctgatatccagcaggtatgaagaagggataaaggtccgaggcatccctgggaaactgaaacagcattgctttagtccttgggtccagagtttctataggctcccctttgagaaagacaagtgaaaattggttgttgcaaattagataatatgaggaatatatgaatagaaaagagtcacagttctgtaatagacttttacacttgcatagaaaaatcaagaagttccacaactaacctcaaaatgctttaatcgaattgaaaaatgatgctatttgtcatcatttatttattttcatgctttgtgccaaaacaatacctctcaaagaaaaaaatgagtttgggaatttgttaaggttattatcttttgaacagaaaactactcagaggagacaaattctcccaaaatccttttctatgatgtgatgcatcatagaaagttatgttttttgggggaaaatagtactgaaaataggagaatctagggcttaggtaatgatctaagagaatgccctagggtttatttcattttttttcctagccagtcattctaagatggaagttctcaaaagtgtgattttgagatccttcagcaactaaagagctttattttggcaaatgtagttatttttgtaaaaaatatgtatttatgtatttatatatttacataaacatgtacatatgtatttatgttaatgcataatgggt

SEQ ID NO: 3045 - DNA, 4346 bp, Homo sapiens
agagaattgtcagaatagtaactattgtgataatggtatgcagcactcattcagcacttactgttacctggcactgtgtcagggactagacattattttatttatccttctagtatttcccccattttcagaagggaaccagaggcttaagattacacagctagtaggcaatagagctggaattgagcccctatctgactctagctagtgcccttaattactattgtaaatggctaggaatcgtatttgtgaggatttggtaggtttggaaaaggactttcttaatcctgatattcagaattgtcctaaaacttacataaaagcctaacctagcttttactgtattgttaggcttcagggatactatgtgacctgaaatatatacacatttttaacaagtggtccatgttttaacaggtttggccagcccttcttacaagcttcctttgtgccaaattttcattgttttttgaaatcaccaaaccatgttactaatgttgtgttttggtttgttttacagtgatccttttctgtatggctgccctaatatttccaataggattttacatcaatgaagtcggaggtcaaccttataaattacccaacaacacagtagttgggtcatcatatgtactttttgtcttatcaattttctttacaatagtaggacttctatttgctggcaaagtttgtttaccaggctgatgaatgtctaaattgcttgactcttattattttttattttattttatttttttatttttggagggtggagaggacaaaggcgaggcatctgagcaggcctctcatgggaagatgctcagatgaaactgatgctgagaaggaaaaaaaaatgctttggtttgttctcactatgcactttggatttaaaaaaaaaaaaaaaaaggagagccttttccataaccaaatacagacaatattgactaaatctcctgagcatattcaggcagtcaggtctgcactgtgatagcaacctagagaaggagaatgctttataccgaaaagcatgtggccctttgtgactctgttattccgtttttaatgtctaatgattcattagaggaaaaaaaaaagtctaagtatttatgtgtcatggtggaccagagggatgcaagagaagttcatgtggggctggcctcacctcctaagaaattagtgttcacaacttccttgtaatagtatgagcctttggcaccagaatggattgccgttgcattactgcaccaagaagccaatagatcaaaacttgtttgctaaaatgtatgtaaaaattctgaaattccctctctctgtgtacaaaaaaaaaaaaaaatcaaacactaagacacatgttttgggtgggtgggtgggggaaatcttccttatatttatataaatatatataatatatatattttgctgatgcagtatacagtgtgtatatatgtgtgtgtgtgtgtgtgtgtatgtgtgtgtaaatttatatacacacacatgcaaacagttcctggaagagaattctgaatgctttgctagcaaaacactgtggtgtgcaaacctagaacccaatagaaaaaaaagccatttatctgaaggctgcatagtggagagagtcttcagtttacctcattctttgtagcagcccttgattttaacaggtttttgtaataggtacagataatcccatacctttctaggtgcgattttaagttaagctaaaaattatttgtagggttaatttatttgtatatgatagtagaaggtaagatcatgtcaaaccttataatttggggaatctgacactatttaaattattggcaactgttgtctgttgtacagagattctttttctactggctcagtctgttacattaataatgcattttatatgttcaggcacactttacataaatacaaagttcgctagtaaatatctggctattttggctatttacaacactaatttcattatttttatctgtaagcattattaatacatctttaccaaaacctgagcaatacaatattttctttatatgttatatgcctttgtttgctaaaagctaatatttttgcatttactttaaagggctgtactaaacccacagctttaagttcttccctaaaagaagcattgcagctaacccttgaactcacagttttaaaatacagtatttctcttctccacatctccatgccttcgcatcaatgcttgtttttcctggtgaacactatagataatctcctgtttgaaatgtgggacagggtgtttcatggcagtggagctaagtttctcctctttatagtgaactggtgacccaaatgtccctgtcatttatagtgaactgatgacccaaatgactccctgtcagtagagtcccatgtggcccatgcttcacacaagcagaaatgaacgcactgtttttaaggctagattatcagttctagaatgattacttcaaagatgggagctacctcctcagatattcacactatgaaatggaggtgcttgatgtgtttcacactggcttgtttgacagtcttctatcttactgttaattcagcagtattttattgtgaaagaaaaccccagtgtttgagctcactcaggaattggggagagagatggaccaccactgtggtgcatttcttaagtgttctgggagaatgtcatacttttccttcccagagtaaaagaaacctttgggagatcctgagggagactgtttctccccaagtatgatgatgtctagtcaagtctaagaataccactggacatgttctatggacatttgggattgcagttgctattctgatttgattggtcctcagtcaaatggatcactttgaaggaaagctttggttgtcaccgttatataccactgagataaagtgttagcaaagtatggttcaaattaacttatgacatgaccaagagcttttctcttccaaaagatgaattgtattgtaaatagtttctcaaaatatttttaactggatcatgagcatggggagagaaagtttctcagctgctaagaatttccccactgtttacttctttcacttatggtggtattgcatttaagattacaaaatttaaggttttatttgtatctattacccaaaccattaaattgtctttaatttcattgttgtcttggaggtccagtgcatacagggctgatgggggaaaactccctctagccagtcagcactctaacccaggattaaaccatcccatcaagtagtatgtgaagtcaagtcttcgtactcttgcagaccagacattgaaatggattcattcatatagatttctataaatcctataagtgaaaagatagacaactgtccgcagttgcttttaaaaaaggtcactataataagtactatatagtacagtattaatttatagcaggaaatcgtatcttgtaaactgtatataaaacactgttttatggtgcaatcatttgtcaaacttttgtctgtttcattgtttttagagtgtgtgcattcttctcatacctaagaatatcactgtaaaatctgctgaaaactatttttaggttttatttgcacaagactgaattagtttgacatttttggaagctcctattgaacatacccaaacatctgtaaacatgaaaaatcttcaatttattaaaagcaaacatttcagtatgattctttccaaagtttgctgctgattcttccttgtgtggccttttgaggagcctcctggggaattggaggattaagacatgccactatgagaagattataggaaaaacaccaagactagaggactctgggttccttttatgcaaagtcaactcttctgggtcacagttacccagcaacaaaaataaagaatttccccatggactccagatcctttactactgaactcacagggctgtaacactgttactgtacagagaggaccaggacgatgccagcaccccgtttatcctgagtgaactctccggaggcctcttcaagcttgtgggttctctgctgtcttgaagccatccatccatttgataggttttgcaaagacttggtcctgccaagatggttttaatcatttctgctaaaaggaatggactcgaggatttgatctcattttagatgcagttgtcctcacttggccattttacagcactttagtaaatatggccagtgtatttggtcactattaaatcaatccccattcattatctgtcagggcaactcagtgaactaaatactatgttctgacctctggcactctttctcatgttgtttaaatatttaatattgtctaaggcaattcaagtattttcttaaataaaaaatatgaaaactca

SEQ ID NO: 3046 - DNA, 1376 bp, Homo sapiens
gagaggaggatctggctggagcagctggggcagagagagctcctaccatccaggagctccagccccaggaatgatagagtgaagggtgagaggcagcgaaaggaccccagccatcttagctgaactgcgccgaggcttcctgcagaaccgggctcctcttgctaaccttgggctccttcccatgtgttcaaggctctccctggagtcacatcatccagttatgtggcacttgcagggctgagctcagatctggagtctgcagagttcaggaggccctcacatggggtagagtctagacatggcctgggggacagctcacacacgaggcacatttgacctggagaagagaccacctagaggggaggaggctggtccagtgctgggaggacagtcctatggagcatcaggaaattcagcagatgagttttacatctgttttttccaactgcagttcagtcccggagcagacacaaccctgtttgcagagagccaacattctaattgacagtgcgtggtgggaaacagtgaaccgagggaaagagtgccagtgttagagagccacagtgcagtgaagaagagaaggcaagaggatgtgatgcaaaatcacaggacctggcttccagaccattctgcttccatgagaacatttcagttgagaaccggatggcatgaaactttattgaagtatcagagaatcattttcttaagagatggtaatggaatccatgcatttgaaataaatcaacagaaaaaaatgattcagaagagagggaactagcctaaggacaactgtgatattgtgaaatatatatatgggtcttcatcctgtgtcctggcatacctaaaacccttggaatatccaaaggcatgcttttcatgtgcaaatgattgactgatgtcttcaggatggagccaatcaccagaaatgtcaaagcataattagagtgttgggactttcagccataccccacacccctgacctttggggaggagagacgggcagaaggttaagtccatcaacaatggccagtgatgtaatcagtcatgcctatgtaatgaagcttccataaaaatcccaaaggactgggtctggagagcttctggatatctgagcacatggaggttcctggagggtggtgcctggggcagtcatggaagcatctcatcccttcccacatgccttgccctatgcatctcttcatctgtatcctttaaaatatctttgtaataaactgctaagcataagtgtgtccctgagttctgtgagccatcctagcaaattaactaaactgaggagggaatcatgggaaatccaatttatagccagtctgtcagaagcacaggtaaaataacctggggcttttaatcaccatcag

SEQ ID NO: 3047 - DNA, 223 bp, Homo sapiens
ctcagagaaagggagcacctgttttggtgcacagaattgtgctgcactgtgactttgacactagccttcctttgagggcactgtcatggccctcttctcagcagtaacaggagactaggtaggagagtctttgtctcatttttggcagtgaactctcagtatgttactgtggtgaagagctggtcaggagtttgaggaaaaaattcgcaaggtgtagtggcgg

SEQ ID NO: 3048 - DNA, 6567 bp, Homo sapiens
ggctgggaggcacagcgcccgtgtgctggaggcgagttggctccgggtgggggaggctggggttccaaaccagggcaggggaatggtggccctgcgtggctcgtggacctctctcagggacccctctcagcaggggccggaaaagcaggcccacacccagtggtcattgcaggaacttcacttgagctggtctgcttgtgagcctgtggtttggagaggagaagacgcacttccccatgagaaaaaggtggtcatccccatgggctccacagatgaggacaccggccctcagctctgccccctctcagaagccttcctcacctgggggttctgggtgaagggagctccccgccagagactcatgtgggatcgtgtgtggaccgtagagccacagagcgtcatctgtaagccagtttagatccaggctttaacttcagtttcctgtgtgacctttgagaagccatccctccaagtgcttcctttgaagggtgagccctgggtgcctctctctgagggaggcccttgctccatctgggcttgactgtgccacgggggatcagaagcaacatacattctgtcagcagctgccggaaatgctggagcagcagtcctggaggcggggtgaagcagtccctggcttttggaggaggcgtgagaagaaattcatggggggctttaattcttttcagattcccaaccattttcttctagctgctactgcctgcatttgtgtaacttagtttgcaacacaggtgacaagctttctctcgttggatgctcattgcagcactgtggggcgatgcagccaggcaggtgctattgcctccatttcactgattgagagactgagactcagagcagctgggagctctcctgagataacacagctagttagaagtcaagccaggtccccagggtagagctttcagtagtgtgtgaggacagcataaaatgaagtctgtagactgtttttttctctgagaagttcaagtcttctgccttgctgcttcttccctccaagacaataagttggttcggtgccctctccggtgacaaacttaggaaacatctcttcagtatgaggtagcagcctcctttagctattgtcacagccaattcacagaggtctaaggcccccagcttaattgatggttaaggaccaattccaccctattcctccacctccatcaaaaaaagcaggcaaacaccacttcatgcctactagaatggctattaaaaacaaacaaacaaaaacagaaaataacaagtgttagttagaatgtagagaagatggagaccgcatgcattgctggtgggaatgtcaaatggtggaatcactgtggaaaacagtttggcagtttctcaaaaagttgcacacttaccatacgatcctgaaattccactcccaggtgtatagccaaaagaatggaaatcagggatttaagcagatttctatacactcacgttcatagcagtattagtcacaataaacgcaaagtagaaacaacccaagcatccataaaaagatgaatgaggcccggcgtggccgctcatgcctgtaatcccaagcacttcaggaggccgaggcgggcagatcacttgacaccaggagttcaagaccagcctggccaacatggtgaaaccccgtctctactaaaaatataaaaattagccgggcgtggcggtgcatgcctgtaattccagctactcaggaggctgaggcacgagaatcacttaagcccgggaggcggaggttgcagtgagctgagatcataccattgcactccagcctgggtgacagagggaaaatctgtctcaggaaaaaaaaaaaaaaaaaagaaaagaagagatgaatggataaacaaaatgtgagctatacacacagtggaataatattcagccataaaaataaatgaaattttgacatatgctacaacatggatggacctcacatacattgtgctaaatgagatatgccagatataaaaggagcaatattatatgattccacttccatgaggtacctatactgggtaaattcatagagacagaaaatggaatagagattactaagggattaatgaggggatggggaaggggagctactgtttaacgggtagggaatttatgctggggatgatgaaaaagtgttggaggtagacggtgggatgaggacacagcattgtgaacgtacttaatgccactgaagtgtatactcacaaatgattaaaatggtaaatggtacattatatatatatattaacacaattaaaacagactgttaaaagaaagcaaacaggccaggcgcagtgactcatgcctgtaatctcagcactttgggaggccaaggtcacttgaggacaggagttcaagaccagcctggccaacatggtgaaaccctatctctactgaaaataccaaaattaactgggacgtggcagcacatgcctgtaatcccagctacttgggaggctgaggcacgagaatcgcttgaacctgggaggcggaggttgcagtgagccgagattgcactactgcagtccagcctgggtgacaagagtgagactctgtctcaagaaaaaaaaaaaaaaaaaaaaaaggaagcaaacaaacccaaatagaaaacaacaaccgaacaaacaaaagcaaaaaaggaggcaaaggaagaagagagggcccaagggtaaaggacaggggctggtgtggaagacacaacagtacatcatgaaaaggaacaaggtgtctctgggagaggtccaggtggtgctctgcccaaggggtcgcataccttagtgctgggaagagaggcattctctggggcctgagactcctgcagggaaactgtcccagtatcagccagagaagagatggctttcttttactgcatggcagcagccctggagccccggggcaggatcatatccctagggtgggagaagtgcccatttccaatttatttatgtgttttatccccagagtgggataaatgactatgaaactgacctaatatttatgtctattttaaggccgggggttgatatgagtgctttcttgatgaactgcgcccttagagctatttactttagtggaaggtttcttttgaggaggagattgggaaaagtcatcaaattccgtggttgctgcttcctctaattatattctcacttttgaataatttttaagcctttcggaagtagaagaaataggggcttttaaaatgatgggagcattcccaacaaaggtaaaatgctccctaccttggggcccagctctttactgtgagtttgtgacatctacttttatcattctaaaagtttcatgttgtccatactgcctgttaggaaacatggaaaagctggctttcaaacttggacttggagccaggcatggtagcatgtgattgtaatcttagctacttgcttgagctgaagactttgaggctgcagtgagctatgattgattgtgccactatgctccagcttggatgacagagcgagacctcagtctcaaaaaaaaaaaaaaaaaaaaaaagggactaaggctggcagagacaagaagactaaactttgtattaatttgttgtatggtcattccttgttttttcagaatggactcctctcttttttccctttaagcaacaagatagtggagttacaacccagcccctgccggtagatttctctgttcggtcccgaaggttaaagtccttagatgaaaaaggctggaatgcaaggtgtgaacactgagataaagcagagcatgggcacatgttttgtttgttgccatgaggctctgttttattttatttttaagacagggtcttgctctgtcacccaggctggaatgcagtcgtatgatcgtggctcactgcagcctcatcctcctgggctcaagcaatcctcccacctcagcctccccagtagctggggatagccaccacacccggctaattttttgtagagatgggggtctcagtatgttgcccaggctggcctcgaactcttgggctcaagggatcctcatgcctcagcctcccaaactgtaggagtacaggtgtgaaccactgggctaaagtgtcatcaggctttagaaccagaagctcaagaactggcctcaaaagtaaagggacttcagaaatgaaattacattctgaaaccagtgcagaggagccaagtattcagcactgatttgctctcaggtagcactgagcatatatttgctggtgacagaggcagatgactggaatttattttttaccaaacggttttgtttcctgagtcctgagagatgacctggtcgaaacttcccctttaatcttattaaggaaaatcgatgggcacaagctgggattaactacaagggaatttgagcagcaagagaagctcattcttccaaggtgcttggtaaatttggggaattctctgaaaattctgagtaaatatctgggtggagggcaaggaagtgactatattattactagtaatgcaaggagatagtcatagctttgacaaatacttttaagtttgaagagtttttattttctcattttgtctctatgccacccaggtattgctattgccctaatttctcagagaagtaaactgaggctgagagcagtccgggggtttgttggaggccacagaaccggttagaagaggcgtggattaggatgcagggagtgaaacttccgtgcatggcagagcctcatgacagaaggagcctggctccttgaaagaccgggtggagagagctgctcacagatagagtttcactcttgtctcccaggctggagtgcaatggcgtaatcttggctcactgcaacctctgcctgctgggttcaaatgattctcctgcctcagcctcccaagtagctggaattacaggtacgtgctacaacatctgactaatttttgtatttttagtagagatggggtttcaccatgtcagccaggctggtctcgaactcctgacctcaggtgatctgccagcctcagcctcccaaagtgttggaattacaggcgtgagccactgaatccggccaatgttatgcatttaagtgtggggagcagaagactggatatgcaagagcatacatctggataccttttacctcttggcttgtggggaaaatgacctgcaggattttacatggagcttcctgtgtgcatgctggtgactgttggcaacaaggtgtcaggaagaaagacattgctttccaaactccttttcccaaatgatcctttcttacccagtctgccttacctgcttctgtactgttcaacagaggagggggaacagggaaaagcaggggcagttgtgaaaaatagaagggaaacttgagtgtgcctttttcttctccttctctttctccaccctcagtcatcattaacagaaaaatatttttaaaagatcccttgatggcatccccaaatgttaagtctgacattttcttagctgatggcctcctttgtgaaggtactttgtgtccgcccagcatgcctgctggatccctggtttgccgcagttgctgaggtaaatactctttccattaagcaccacagcccaagagtggcctaaagctcaaataaatgaccaagaagcaacttaaacattccctggggcgattttaacctatgcaatggctttttgaaaaaattgcctattttttcatgttttggccgggggggtgtctcttattcccttcttttttattttcctttcagctgagtacaccttctctttcatttattcatgcactgcatgaaggatggaagcaggatgaataaatcacagagcattgcccctctccccactcagggtctgtgaagagagctggagcagaatacagtccaggcattatgtcaactttcaggggacctggggcaggtggccgattctcacagagaccccacttccctttcctgtgaaaaataccacagcccaacagccactggagaacagtgttcttctggaagcttcctctgggcaggaggagtcaaagatcctggtcctcagggacacttgagatgggtgtgcccaaagctgtgcaggatggtttggtttgttttgtttttctttgcctcaggaagaatgtgttcacaaacctcaggacaaatcgtttaaaaaagtgtcctgacagttgtcatgcttcatcacttgatttagaggcaataggacagccttattttcttctaatctctggtggttgaggagtctggttggcctggcagaaggctgagattggctgagggagtcatgagcgagcaggggcctctggtgcctgaagcgcccctcaggaagagcgggtctcaccggaaggccacactcatctccttcctggttacccagtgtggggatttgctactttgctgagtgtgttttgtctacattcatggtgctccagaactgtgtctgtgtttctcacattctctttcgtgtctgccagagcaacattctcagcaaaccatctgaatgcaactcctgtgatcacaaaagtcaatcactgatggaaatgaagaccacgaccctgattcctcaggttggcccttttcaaaccacgtttctcag

SEQ ID NO: 3049 - DNA, 1781 bp, Homo sapiens
ctcaataatagcattaaaaaataaagatgtcttcagatgctcctcccaagtatagtgacttggtacatggagacaccctcaggagaagaaggcatggaggaacagccttgtccagcttcctccctgtgggtgagacccctgaagtcatcctgacagcctttgcttgcaccctgcagccatctgtccagctggccccatggggaaggctccatgctggggtaggtaccaactgttccttgcttcctgcctaggggtccagcttatcatgggcatgctgtctgaaaaaccaaggtctgggactcctgctgaagtggcagcctgtgagcgagtccagcagaaagctgcagtgaccctggctcgtctcagccgagacccagatgtggcacgggaggccgtgcggctcagctgcatgtcccgtctcatcgagctctgcagatccccatcagagaggaacagcagtgacgccgtgcttgtggcctgcctggctgctctgcgtagattggctggggtctgccctgaaggcctccaggactctgactttcagcagttggtccagcctcggctggtggactccttcttactctgcagcaacatggaggagagttttgtgtagtgagtgtgggcgaagaaatacatttggctgttctcacaccccctctgactatgcaccagtgaacacatctgagtacataccagctctcctcatcttcttatttatacttaacttatttttgtgtgaaataaatggaggacaaaatcttagagcaacatcatcaaacagtctttggtccttgagaatcttctttgtgttttattttttgatttctgtagcttttcagttgcagatgttgaaattcgtaatgacaaatatgacaaattgtcatgggtgattccacttcatcttattttttctactctcactatacaatcttgcctcattttttaaaactttggaaccagaggatttcaactgcctagcaagttttttttttaagttggatttgctcttcccaaaaatctaaaatgaatttaataattgggtagaatatattggaaagaagtttctttttctttaataaatggaatcatataaaatgtatcccggattttcttattaaattgtattttaaactaggttcttgcttcccaggtttcattccccaaaaacttttccaaccattaaaagtacacacagaattgtcttgttttcataggtgtataaataggttaagttctgagtgacttagtgagaaaccaaagtgactttcaaaaatacacccaaaggcaccagaaaccctgcttcctttggcttctttgcttttgtgtaacctcctgttcacctcctggtgaatagaatcctcagatgaggcttattgaatgattgattcctcctcaaaagtatacttgaaagcagtggtgtgctgaagccagctcatgcccactcacaagggacaactgtgagaatttcttcctaactctgcactcagtgaccttgcgttggtagccatgagctacttcatgagccctcatgttgaaattggccatagtgggagtatttacaccacagaaattcacagatgctataaagcacagctttcgctttttttttttttagagagagctggtttaccaatttcactgcttgaaagtatcacaaaaatctggggatccttttgaaaatataaatgccatcatattgtgatataatttatacaatataatataattgtgtaaaatcatgattataataatgtttcaataaacatttcttaaattcccaa

SEQ ID NO: 3050 - DNA, 7069 bp, Homo sapiens
ccgcagtccgacggtcccacctggtcggtgtgagggcagccgcaacccggtccccttcacggtccgggcccagccgtacgaatcacagtcgcgcttttccctccccggctcccttcctgccccaagcgccccgcctaccaggtctctccggcggccgctccagcccggccgggaccccagagttgcaggcccaggccagccgttgcaccgttaagccgggccggtgacgccgggcctttacgtcgcgcctgtgagcggccgaggccgagcggcctcccctcgggctgcgagacggagacattacctcatccctcaagattgctcgctgcaaacacaacgctgagaaatggcccaagtaaagcgtgatcagggtcttgcattcttggcacatctaggaagaacgtgcaaggatgcgaattgtgaatcgcttctccaaacaatccattatttgggcaggattctgtagggaaaactcatcaccacttcatatagcatcagccatgcggctcaactgagggctgttggatccacttctaagatgactcactgctggctggctgttaatgctgggttgaggccctggggccttggtttgtctccacattggcctctccattaggcctggacttcctcacaaaatggtggatgagttctaagggtaaacatcgcaagagagaaaaccagacaagagagcaaaacttgccttttgtgacctagcctcagaaatcacatagtgtctattaattgaagcagtcccaaagtcccacctgggttcaaggggaggagatactgactacactgtccttgatgggagggtggtaagattctggaagagagatgggaccagaaatgttgttgcagccattttggggaagtgcaatctaccacaacgcatatgtatgtactcctaggcaatatgctatttaattttgcatgttttacgctttatagaaacatccatactgaatatgtttttctacaactttgttccctcaacatttatgagtcgcttatatttttggagttcatttatttttagaattgtataatatttcattgcaattatttgctacaatttagttctctgttattttggtgaatgtttgtgctctttctatatgtttccaaccctttttttctatatatttatgctttttgctattttgtacagctgctctgaacattctcatagaactttgcacatgagcctagggcaagaattatcaaccagtgtgatttttagcaatgtcagaggcatttagcaaatgtcctacacattttttatttttatgactggagtaggaagcgttggtactgacatctggcaggtagaggctatggatgttgctaaatatcctacaggaaagccccctataacgattagctggtccaacatgtcaatagtgctgagattgaaaaatcctagcttagggtatatatggaggagtagaattctcactcaatgataggatattcacagtttcaactttattatataatactaaattgtttacccaagtggttgagcaagtctatactcctaccaaagggaggctccacatcctctgatattgtcaatcttcttagattttgccagttcatgtttttttccttctgaaatgcacatttgtgtgctttgtccatttttatagagtaaatgtttataggattgatttgtaggcattatttatatattctggatactaattctttgttggttgtatgtgttgaaaatatctcctcccagtctgtggcttatcctctcacttcttcctggttcttttgatgaacagatgttcttaagcttcatgtagttaaatccatcaatcgtatactatccatcaggcttgtgatttagggtcattatttaagaaagaatgtcctgccctgaggttatcattgcttcccaagcctggcagcattttggggttttatcttttccagctggcaagacctggagttcctcttgctgaccccagaggtgcctggccttccttatcctccactgtttgctcagtccttatgaacactcagattgtatttcctaatgtactccattttctctgttgggctctttctacaacctctgtagccctctctacccaggactggactctactgtctcgggactggcctcaaaatgaactgacttctctggaaccacagtgccccacttagtatcagcactgctgaagatgtcccttagagattagccatggcaggattgagccccagttttctaaagtacttggatggtttcatttgcactcatgtggggtattctcctctagggctaaaatcaaaaatggggcaaagctgaagatgccaagtggtccccaggaacattactgctcacaggagggacaccccaagatgagcatatctgctctgaccacataccttctagccaggcctatctacccagggcccctcagaaccgaccatgattaaaggacagccttggtgtgatctgctccatccagggaaatcattcagagttaattttgcttccttttccctccattccggttctgtccacatcctgacttctgatatgtcctcccttctggatccttctcccatcctttagacttcacattgatctgggtttccctggctttgacactcagtaagggctttgggcaaaacccaccttttggttccagcagctcctgtttgccccaagaaaggcaccttatcctagctcaagtcatgatgacccaaacccaaggacctagataaagttgaagagatatgattccaggtgcctaatctgaacagttgtcgagcttgggagaagataaatcttaaagtggggaacagggagaaggtaaaagtaagaatctaaaaacccaaacagcaggaagagataggaaagtagacaggcataggaggatttgagaacccaaaatgtatgcctatgatgcagagccagcatgggaggcattataatggctgagaacttgggctttgtagataggcaaggatctcctcaccttactagttgtgcgacctcaggcaggttatcctcccagagccctgttttcatcatctgtaaagtagggctggtgtaataacttgctcaattgtatgaagattaaatgataagtatgtaaagcatttgcatagtattttacactatgttcaaaatgatgggcattatcaatattaattgatgttaatattaatattcatggactaatgaacagaggacccgctgcccggttcctttatggctgttctggcacacactgagggtcagcaaattacggcctgtgtatcaaatccaggttgttggccatgtggcccatgagctaaaagtggtttttacatttgtaaatggttgaaaaaaatcaaaagaagagtattatttcatgtgtgaaaataacatgaaattcaaatttcagtgtccatagagttttactggaacatagccatggttgtttcttttgtattgtcttattttctgcctctccaagaaagcttgctgactcctggcataggccaagtggactaggggcaggtgctttagtcagctggaccttggagaactgggcaatctcctccactccacagctctatacatggtggctgcccttcttttcctactggccctcccctggggttccagagtaccttttgttcaagccagccccacttgacccagggcactgggatctagatttctgaacaatgagccaaatcattgcagaatcatagggggaatcaggacaaggctgttttgagattaaaatgaaataaaatatgtgaaagtactttgtaaatgcaaaggatgttattatttagcaagtaatggttaaggggtatcagtgaggttttttactcttcttagtaaatttagtaatgtatgttatgttcacttttaacaaaatgtattattaaccagaataccctaatttctgtccagatcaaaaaagattttaaaccaaatgaaaccatccacaatgcatgtcaaacgcacccccaaaatggagttttgagcttctagccctttctgcaaagaaaatcctggctcctccatcttgttttttttttttttcctctcctcttcacttcctgtttaccatctccattttcttttccagtctctgtgcctgtgctttgggccacttgattgctttgggtggccagagtagagagcagatgaatgtcattgtgtttgaagaagccaaggaaatgtgacagaagagttttaagagaatcatcagcccagtgtagacatttcaagtgatgttaagagttggagtggaagaaacattatgagtcaattcctcagtcactattatgggataaccaggatttggtaggaaaagcagaaggaagaggtagatggcataagaatcaaagatcatttgtacaaaggagagttgagcaaagtatcaggggagctaggacaatgctgatcgcttctgagtccccacaggatgtgggaaaatgagcagccttccatgaaaaaggtggcaaaggaaggccacagaggagtcctgtaagggaacagaaaagaaaaggctgaggtttgggtgttgtctaccttaagcaggccctgagggtgggagggaattccaggagcagtgggggatgaggtcagtgggaaggaggttggaaacaatgtgggtttgaggatgagaagacatgtcctgaggggtttaccttttgggtggaggccaagggcaacaggaaccggagtcacctaggattagctggtcccaaattgtaaatgaagcactggggtcatgttgttcacatcctgggattgggggaggagggaagaggtgggcatgagaggccctgctgggctggaggtgggtattgcagctgccacataccattcccttgctgcaaaatcctttagcagaatgtctgctatccaggagtacgtgcattgttaagtttgttctcatttcctgaacaacttacgcactaagcaattacttaaagcgctgaaggaagaggctcaggtttctaatgacattctgtcaacatgactaatgctaccctggaacacccttcccctaggtatctgcatggctcactttctttttcaaccaagtttccctcaaagaggggtcttctctgatcccaatacccaaatagccctactcatcactcactatcctcttgccatgctttatttttcttcattttacttatgtccaccgactcatccttatttgtttattagttggtacctgtcattctcactagaatgtaagccacatgaggttaggagtttccttttgttctctaccctattctccactgctgaaaatagtgcctggcatacaacacagctcaataaacagctgtgggcaaatgaatgaatgaatgacttggccctggccaagtcattggacctcaggaatggcatctttcaattagaagttgttgctactctaacgattttgttaatcattaggtggcctatcttcaccatgcttcctatacaaaagtgaattgcctaaaactcagcatcggcgcttctccctcaaagttttagacaataaactctgactgtttgaaactcagctgtttgccttcaccactcctcctcccatcttgcctcctcccatcctcctcaactgctttttctgatgttggccaagatatcagaacctgagattagtatcagaaaattgagctcctaccatgaccccacaccaaagcttgaggctttcaataacaaagacagacaccctcctttctccaagagcctatatattgtgagggaattgataattaaatatgtgattgtataatggtttaatgagaaccacaacaggggaggtgctaccttcagaaaggcttccctcgagaaatgatacctgagtattaaactgcaggatgagtaggattcagctgagcaaagaagggttggagaaaagtagacagcagggaaaatccctgatcctagagaagtgggtcttgttggaggagccagaactggcaggtggctgggaacccagtaggaggtgtgagtagtgggtaaaaccagggctgcaacaagcgttagaaacagattatcctaaggcaaaaataactccctttcactgctgctgctggtttggttggcaaaaggaaaaaaaaaaggactccatgattttagtaatcagattgctggtaataatattggtattattattctgatactattcactatatatataataggatagagcaaataagtaattaggctaatgttgatagaaaccaagattcttcaccataagagatgcaaatataaaatttttaaaattgtaaaaattctgtaattttaaatttgaataaaatatattagtgtaaactaatgatacattttcttatcttaaatctgtttcctatctctgaccactattaaggcctagaaacaatgaccagtcaaatgcagtccatgcccctagtaccggtttgtagtctctaaattatgcttcccaccaaatggaaccagggtttatttcagaaatggatggtccagaggaggaattgcatatgatgaagcttaaacaccatgatataccagatagtgagggaagtgtcagagatccctggggtcatgtcaacaggactcagaagtcaacttgtcaaggctctcactggccacaaatgggacaatgttaatatgaataagaataactaaaaaggactgaaatccacatgaattctgttggaaattcacaagtttataatgatgttcaaaaaagaaaaataaagaccattgttcacctttggataatactggggaaccaactcattattctgaaaacaggaaagcaaagcaaaggaatctacatttgccatataaattgaacctcagggtaaccaaatagtggagaagggaatgtttctttctataggagtattccagccaataatttagaagaaatattgggccaggtgtggtggctcatgcctgtaatcccagcactctgagaggccaaggcaggaggattgtttgagcccaggagtttgccaccagcctgggcaacctagcgagacccccatctctacaaaaaaaaattttaaattagccaggcacagtggtgcatgcccg

SEQ ID NO: 3051 - DNA, 1000 bp, Homo sapiens
atcacgttgtgtcacaatgggagtgactcacagagcaaggagagaacctgaggattcctcacacatgtagtactcagagctctacggaaacccaggcacctcgacctcaagaggatcagcctggccagggtggcacaactcttccttccccgtgcacagcaggaaagctgccatcagctgagcaagtccaccaacagtttctgtgtcccacttcatctttaataaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtgagtttccgggcggtgccaatgtcctctagaattctttgtcctgaacagcatgaaggagattcaaatacagatgaaataacaaggttctgagta

SEQ ID NO: 3052 - DNA, 1567 bp, Homo sapiens
aaaaaatttccaagagaagtttgtaaggtacactctaatttttttttcttgttgcttatatttaatacaggagaaatgaaaaattttttaaaagcaattttctaagcaaaaaggaatcaacacttgatgatttggaaaaccatcagcccatccagatagcgtagcctcaaaacaaagtctaaggtctgaccttaagaaaataggaccttccattttctagctcctggaacacttccacttagcacccagccatcagactgtgtatgaggagaggaactgagacctgcagaccaataacctaagctgaactcgcagctgaaagctaacccacctctaatggactctccactcaaaatccagattagtgaaccaaatatatgactgttgtttttaagccactatgttttagcatggtatgttacacaccaatagataactaaaactgttctctcaccatctcaacatcctcttcatattttctaaataataaaatatgccatttgattttacaagaaacaaatgttagatggcagggctgaagttaaatgggaacctaatgttcacaacgactaacagatttgtaaattgagcttatatgtctacatcaaagttctcaatctttatttatgctatagtttaaagcatgactatacttttcagctgactctcttgaaaagtggagtataattaatatattgatacctggatatattatattttagttcatgattccatttagtcctgaaaaatagaaggcattgtcattttgtagacatctccttgatatatttgtgttagagttaactcaattttttaaatgtaagatttaactctatgacactaatcacctgtcatcagtcactgactatagttcaatatcatttgagtcaccaaggctaagatataccagataactgtttcagtacaggtgatttgcatttatcatctaagagcttataagaacctcctctcactaaaatatcagaggtctaacttttacccccttcctcacatcaaaagcataaaacgctgagatatataaagaggagatttcagggagtttgagaacttactcaaatgatgtaactcatttgacaaatgacttgcttcatgcatcttttagatagctaagtccaattagctaaaattatagttgaattgaatatgtaaatatctataaagttggcctaattagatccatagggtggtgtagcatctgtgtttaaagcccagcaattgtgaagaggttttggttgcaagcttaggggaggctgtgaagactggcaagtctaagtcctcccgtggaatctgagatttcacaggtagtatctgaggatgggtgtgagattactgctcaagccagaaagattaacagctgcctcaatgggaataagagtcactaggaaatttgattctatcattcctgaatccaaggtggcgttaacaagcttattatgtaagaaagcagcctctgttactaatctaagctgtatctgtttttctgcttacgcctatgaaccagaacataagaagtagtagaacaaatgatatgaatctacaaattatg

SEQ ID NO: 3053 - DNA, 5166 bp, Homo sapiens
gcgcaaaggccccacgtgttccgacccgctaggccccgcgcggctcggatccggcggcgctgtttcggtcgggagtgggtgggagagaagccggggcaggggaggagccgccggagctgtcggagccgtgacacccagggcagctacactcagaagccacaaggaatgctagtggagcccctcatccctcccagcttctcttccaagctgccccgtggggcttgatccaggaagctacttcagaaagacaatcattccaagggtacaacaaggtttaccacaatgtgagggactcagccattgcaaattgtacagatgaggtaagttacaggtttacatttttttttcccagtaaatttggcacagatttaaaatgtgaaacagttctataccccttgtttttgctgttctctcaccagcaaaccctttagtttggccagcaatggctttctgcatgaacttcagatttacttcatttgctaggtggtggttctcaaacttactataagcacctgaagggctagttaaacgcatattgctggggcccacccctagagtttctggtaataggtctgtgctggggcttgagaatttgtacttctaacaaggctcaggtactgatgctgcagatctgggttcttcactttgagaacaactaccttttggccaaatgtgatatatgtattgcagtaggttgaggttcagaatacctttgtttgagtacttctgtgttggaaactagtaatctgatcttttatagataatcacttaggtctgaatattttgttcgcaaaattaagaaagcgtacttaaaacaactgaatgctatatgccaaatttgaggtgaaatattgataagttcttccccttgattttcttaattctcttgataggggcttcacgttttgatcaaaatattacacctgtattctgggcttttgctgtgaattcctagtattgctaaaattctgcaatttcttaactacctgttaagttcctcaaggtcagagcttctgctttttttatctttctttgcccagcaccttgaatagtgtgggacacgtaattgacgctcagtagatatttgtgtattgaactccatcccttgtcctcctcccctcttgatgtttttctctactggccttatgctacacagtaaagcagggcatgattatgccacttgattacccccaagagattggaataaatgcttatgccaaattcctacagctatccctgtgaatggtttattacccaggagccctgacactggctgatttctgaattttcagtgcttctgtaatatatactagttgggggaggagaaatagaaagcttaaactcaatgtgcgtttattgaataccttttctactaagggctccacaaagtggtaggcactgggaatataaaaatgaataaggagacccttgctctcgagggcagggcccacagtggggagacagacgttaagccatgcccacgacaagaatgacttctgagattccttctctggatcatgatttagtcttcagtggaaacctggtactcctcagattcctctggttcaacaggcggggatcccatcccttatcatctcctcaaatgctaaaggacccttgagcaaagccaggaggaagtcatctagacgtgaaacagggagtatccacacaggctgtgttaatgacaaagctaaaaacatagtaaatgacttttgaatttactgctgttatgaattatctatagcaacacctccggtcagctctgttatatatgttattgcgttatttcccattaaatgatggttcctctgactatctgattggcattgactatgtttgttgtagagattgcatacatctagtttaactctggctgtcaaatgagagcagttactcttatcaggatgggtgtcaggtttgatgtcccctccttttcctgcttcaggttaatttgtcatgttctgttttaaactgagacatatagcttgacctcctttatttaggccattaactgctctggggtagttttcctgaaggttaaaaagcctagcttcatgatggaggttaaccaacatgaccatgatggccaggtgtataaatctggcctcttaaaaatctgtatttgaggctgggtgcagtggctcacacctgtaatcctaacactttgggaggccaaagctggcagatcacttgagcccaggtatttgagaccagcctgggcaacatggcaagaccccttctctataaaaaatttaaacattagctgggcatggtggcatgtgctgtagtcccagatacttaggaggctggggtgggaggatggcctgaacctgggaggcagagattgcagtgagttgtgatcttgccactgcactccagtcttagcaacagagtaaaccctatctcaaaacttaaaaatctgtgtttggcccctagccgtcctcagctcttgagtaaatctcagcatcctaggctgttacattatggcccaaatattcaatagagatgctgtatatccttgttcctctcaaaacccctcctcatcaccatcaaaaagctggttcagttctctacctttagataaagaatcatcccaagactcaacatgagctgccgtgacttgtccaagatgacacctctttacaatgtagagcagtggacagaacacaggtcaccctccgccgaaggcaactatctactgtctaacattgcctcctaggcctgccatatataaccatcaaaaacagtttagaataaagtgaattgttacaatttttatttttcatttttgtgtttacatttactctcaatgacatgtttattcccacctaatatcttgaggctaaccacaaaatctgcagcatttccagacagaagatacttgtgacttccctgtactatccactacatacttgacctctttctctttcttcctgtcttccctttctctataccttattgtctttctttggaacctcttgtaacaaattttgagccatttctcccctcactactcaaatatcacttttatgaaggggcgggggggaaacttaggtggcaaaaatattttacagaaacagttttaaacatgttttgaagcatactggtcacgtgttagaaggccaaaagccagggaattcattccctttcattcattgtgctgtctaggttaagttttcacaggacttcttggtacactgagtttgcctcagattgtctcctgccagttacagggagtggagaggactttgatatattggtaattagaagcattgctgatatggtcttcggtgggagaacctgtgtctaaggttccttctcatctgtattccaacactttcatttaatcctacttcataagtgcctccaaagcaaggattttttttttggtttagcatggtttctttgatataacaatagaccgaccaagattttccttatgccatctgtttttttgtaattatgatgcaatagagaactgtttgcttgtttatcatttaaatcttgccttcttcccaaaacgatttcaaatagcttgaaggaaaatgaataaaatatattgagcacctaccctatgccagactctatactgaagggtttctataggttatttcatttactccttaaaacaaccacatgagataagtagtattagccacatttttgaggataagactgaggcttagggaaattgtgttacaaggctaataagcgaggtcagggattcgaggtcagggattcaaacccagcgtgccaaggccactaaccattatgtggaaagcttaggtaagcgcttgtatataggacaatcaagaataaaagaatatgtccattagaaggattgtactgggctaatctttcgttttaaagaacagcagcagcattggaaaagagcggttaacagtttttattagccaatttctattctagaacactgagaggagctgttgacaggccctggttagccccagcaagtagttgtattaaaattaccaaactataggcctgcattaaggtataaaataagaatggggactggaagggatataaatatctgctaaatataataatttcagttctaatcactattttcttctgaagattatttgccagtacataggcagatcactgtctctcctttaggttgatggtatatgactacagactttgtcatttagggtccagaaagatcaccctagctagtagcgttttaaggtagagaactagatattgtttcattgcctgtggttttctgttcttgtaagagaattgagcttgggtcttcactgccacgtgacaccttcagataaggggcagagacagctggcctgaggattgtacagaggtcttaccttgatagctcctctccaatcctatgcatcctaggaacactcaagacactaggttgtatctttgcagatactgttttagtgtcttctggaaccaagtctcttacttaatcctggcctggtttcatattctctctattgtattctctctatagtttttgtcttactctggaactcttccaaggacagacattgaagaaaggtattagaatagcaaaggcaacaaattgcaaggtatacttatggcatagcacatcccattaattatagaataaaaacacaacatctgttttctgcctctaatattaaatcttgacatttgcacaacacattttagttcataaagctctcatatctcagataatcactgagttaggagactggttatctgcagagggctttatcctttacaagggctcttgggtacgttacttcacgaaaccctcagggaagctccagtttcttggggatctggggccggggcatatgtctttggatacccagtttggtgctgtgcacagcactgctgtacctcctattcatttcccatctcttaccccacaaagactccttccttcattccttctattgctgatctgttttccttcatcttcctaggctgccaaagtaaatgcaaaacaagcaccagaaatctcagcttgtgatttctgaagggcatttttaaatggcaagtttggtgtggcactgttacatgttcttttttctttggagagcaaagccctttgagagagcaggaactcttctgtcaatgcatacgttgtaggatccatactgtggaatctcttgtacctagtgc

SEQ ID NO: 3054 - DNA, 14813 bp, Homo sapiens
ggcatctaactctgtcacccaggctggagtgcagtggtgggatcttggctcactgtaacctctgcctcccgggttcaaattattcccctcccttagcctcctgagtagctgggactacaggcccacaacgccacgcccggctaatttttgtattttttggtagagacggggtttcaccatgttggccaggctggtctccaactcccaacctcaagggatctgctggcctcagtcttccaaagtgctggaattacaggtgtgagccactgcacctaaatgacatacttgaaaaaatattctcgggccgtgtgtggtggctcacgcctgtaatctcagcactgtggaaggttgagggtggatcacctgaggtcaggagttcaagaccagcctggctaacatggtgaaaccccatctctactaaaaatacaaaaattagctgggtgtggtggcatgcgcctgtaatcccagctacttgggaggctgaggcaggagaactgcttgaatccaggaggcggaggctgcagtgagcagagattgccccactgcactccagcctgggcgacagagcgagtctccgtctcaaaaaaaaaaaaattctcactttctgttgttgttgtttgtttaatgattaatagatgatttatttaagcaagaatacatagtcatcattgccagacttaatatgacaggttaaatgttggacccaattttccttcccagataagtttttctttcctatccatgtcagttttaaaaacataataccagaagaagaggggcccaattccacacagagctcccaagagtgagtttttaggagtgggtctgaaattaggaaagacacttgctgatcttgcataggtccagggaatcaaggcaggattttcgatgagccctcggcagttagggtaagcaggtttcagccaggctcttaatggtcaaccacttggcttgcgcccgctgggtttccaaaaatatgtcctgttcggctgggttgagggcatagtggccaggggcgaaggagtatactttgggaacgacatcttggcgacccagcgcataactcacttttttttggaaacaaggttggctctgtcttccagactggagtgcagtggcgcaatctcggcgcactgcaacctccgcctcccgagttcgggcgattgtcctgcctcagcctcccaagtagctgggactatgggcgcacaacaccacgcccagctaaattttgcatttttggtagagacggggttttgccatgttgcccaggctagtcttgagcctcctgggctcaagtgatctgcccgctttggccttccaaagtgctgggctcataggcatgacactgtgcctggacagatttttgttatactgtttagatatgatggtaactgaatgatcatgcaatctctgaccatgtgacattcagggataccaaaaatgacttgagatgggccaagggagaattggagaagcatactttggctgaatacttaggccaaagtataatttggaacatttcttttaaaaaatctactcccctatgccccccacttgcagtaccttacaattacagttaatctagtagcagatactggattgggatattaggtatttacagaccaaatgcccattgggatattactaggtaacaggcagtttcactctggttcattgtagattcatccagtaagcatttctagagaactgctatatgaaaatattgtggaaagtatcaactttttaaacttttgatgtcatggcacctagaagattattttctgatactcatattctaagggaattttgttttctgagatttgtttctgtggaatttctagttccccagtctgcactgaaagcctaaatcaagaggataatttgaaaggtaatgaaagtaaatcaattctagcttagatacccaagagagtaaatgaaatataaaaataataacttttaaaatgtctcaaaaaaaagctatggcaagctaattcagtttgacttattcatgcaatagtctgtctctgcttatgacataaagtataatatattttaggaatagtgtggttttcttcatgatgtcaaacatacaagcttatggatatatttaaaaattcttaattttctagattaatgttcagcactacttccatcttgcattggatgggggcagataattaataattatcagatattttcttatcaaaaacaaatttgttggaaaaaaaattttttttttgagatggagtcttgttctgtcgcccaggctggaggtgcagtggcacgatctcagctcactgcaagctccacctcccgggttcacgctattgtcctgcctcagcctcccacatagctgggactacaggcgcatgccaccacgcccggctaatttttttgtatttttagtagagacagggtttcactgtgttagccaggatgctctagatctcctgacctcgtgatccgcctgccttggcctcccaaagtactgggattacaggcgtgagccaccgcccccggccgttggaaacattttgaaggaactctttgtaaataaaatacatggcatgcctttctgttttactatacagttgctgatttatcctttagttggttactttgaatcatcattaacatctgttgtcaccataatccctgtgatcactagatgtcatactccattttatgttttattgttgccttggggagactttgagagtatgagaggtgttcatgcagactgctgctgagtgttgcatagagatggaataaagtacaaataccttcaggaacagactccaaacttggtctattccagcttcctttcattttttttttttaaacctattccagataatttttcattggtattctctgaaggaaaataagagaaatttcctcttagaatcccttctccttggatttgtaacctttcccagttcatttctgtggaagtacttgtagtccagcatagtaattctattcagatatgtatagttcagttaagtcacgaagggaaaggaagctttcgttgagggctatctactaggtggtacagtgctaggtaattaactttatctcaatccttaaacaactctgcagtggtaagggtgattaattcatcccattttgtagacaaggaaactgaatgttagagggatggcataatttgttcatgttcatataggtagtactttgggaagcagaatttgaacacagatctttctggttctagagctttgtgttcttctaccttgctatgatgttaagtaattagttttaacatgccacttaagtttaaagccttaagtagtccttttaagaaatcttttgttgctggttattctcatttaacactcctattttaatttccaggttcaggtgacctcactttgccagaaccgtgggtcttcatgaaataagagatttcatttggtttttgttttggtttgcatcctctctaactttaggtagaaattgctgttagggcaatcacctacctcactatattccactctctcttctggatattggtgctcagcccttttttgaaccgcaaaccttattaataaaatagttttcattctttgagcgttcctcttctcactgcccacccccccgccaccaccaccctactgactttgatgagctgaactgaaccactcttttttttcttttttttcttttttttttttgagacagaatcccgccctgttgcccaggctggagtgcagtggcacaatatcggctcactgcaacctctacctcccagattcaagcgatttctggctaatttttgtagttttagtagagacggggtttcaccatgttggccaggctggtctcgaactcaagtgatctgcccacctcagcctcccaaagtgctagggttacaggcatgagccacccgtgccaggccctgaacactttttttttctttttctttttttttttttttttgagatggagtctcttgttcttgtcgcccaggctggagtgcagtggcgcgatcttggctcactacaagctccgcctcctggtttcatgccattctcctgcctcagcttcccaagtagctgggattacaggcgcccgcaaccacgcccagctgatttattgtattttttagtagagacggggtttcaccgtgttagccaggctggtctcgatctcctgaccttgtgatccgcctgcctcggcctcccaaagtgctgggattacaggcgtgagccaccgcgccggccctgaaccactcttcatcaacttatctgggaccctgaaatgaaatagggtgacccattttctagctttatatgattttctggcttcatatgatttaaatatttttaccgttttttgtttgttttgttttgttttgtttttgagacagggtctctgtcacccaggctgaaatacaatggcccaatgacagcttactctagcctcgacctcccaggctcaggtgattctaccaccccagcctccagagtggctggagccacagccacgcacctaacacctggttcatttttgtatttttttatagagacggggttttaccgtgttgcccaggctggtctcacactcctgggcttgaccagttcaccctccttggccttccaaagtgctgggattataggcatgaaccaccgtgcccagcttttgaaaaacctgtacaataaaaagtttggactaatgttctttgagcccttaaaaaaatgctattcaattaaaaaaaaaacaaacctatagtgtcttataactccaaatcccatactgtcacccaactggtctgccctggtgaccaccatttcctgacaaacattcaaatcactcctgaggaattgaagaaattcacatttatgacccagtgacactggccttgtctcagttcctatagtgtgtcatactctgttctgcacagaagttttgctcatcctattcctttgtttgcagaggtcccttccccatcccctatctctcaggcagactcctcatctcagtttatttacgacttcctcagggaaagccttccacacttccctgacggatgactttcccctgttgtgtgtgctcatagcaccatttacctacttcgtatacttgtgtggttattttatgtttatttgtgtgattctttgattggtgtctgtgctgtcccaagattaaaaacttcatgagagaagaaaccatgtctttttcttgtttttgtttgccattgtatccccactgagaacatggtgaataaatacgtgttaaatgaatgaatggccttttttttttttttagctggaaggacataaaattcttacatacatatagtttttaagaattatggctgcagatattttggatttcatctctggattaagtcagaatgtcagacaattgtgtacttgcacagtagtactttgttcctttacataattgttttttcttaattgaactttggtagtgtgcccttggctcaaattggcatatgctgtaagcaataaaatgttgcattgattgtatggacactcttgaggacagtgtctgccatatcaagtactatccattatatcaggtaatatcatcaggacccagaggagaaatttctctctgatcttactcccagaaaaaaaagtgtgcttttcttgagcaactggtctgtttttgtctcggaagcactgttgtcttaggcctaacttttgtttcctgaagctcaaagtcagatttgtgactgacatctaaaaattagttaggggtttctggcataccctgtgtaagctaatctcagttttagtttcatcttaatctctagaattttaactgtgattatgtgattatttacatattttatagtttgttcaataaaatactttttttttttggaacagagtctcactctgtcggccaggctggagtgcagtggcacgatctcagttcactgcaatgtctgtctcctgggctcaagcaattctcctgcctcagcctcctgagtagctgggattataggcatgtcccactattcctggccaatttttgtagttttagtagagacggggtttcgccatgttggccaggctggtctcgaactcctgacctcaggtaatccgtccgcctcagcctcccaaagtgctgtgattacaggcatgagccaccgcgccaggcctcaataaaatattttataaatacctttaaggaataatacaaacacaaccagagcttaaataaataaatgtaaatcagtctgcttgctggttaagtaatgagttcagtgtttctctccgcacagaaagtgggagagatagatgaagaagaaaataaagcttattacatgttgggaaggatgctaggcactaagttcctttttttgagacagagtctcattctgtcgcccaggccagactgcagtggctcgatcttagctcactgcaacctccgcctcccaggttcaagagattctcctgcctcacctcccaagtagttgggactacaggcacctgccaccacgcctggctaatttttgtatttttagtagagataggggttcaccatgttgaccaggctggtctcgaactcctgacctgaagcgatctgcctgccttggcctccgaagtgctgcgattacaggcgtgagccactgtgtttggccagttctaggcattaagttctaattggttcatttggggactcgaaattctccattttattttattttattttttctgcttttgtcacaaaagcacagacattgcttaacaaagaggtctgagatgggatatgaatgttaagctcagggacatagggtcaacacttttgagtgcacagactgggaacctggcacagttttaacaatcccctcccctattttcaccatcccttattcctgtagaagtagagcagatgattacgtattcactgctatatggcttattacctttgtaggaattctaactgaagggcttggcatttggcctgactgaatatcagaatccctttatttttcgttccattgcaaaataattttttgtgccatcagtgaaataacagctatgcagtggcatatacagctctggagaccaggcattagaagactgtgagacaagaataactagaacgatgataaggagacactggaagtcactttagattgatgaccaaagatttccttattttgaccaggaggtcagatctcaagggtccttctgagtccacttttgattagccaaattgtcttttctttcagtttgactataggttagtcaaccttccctccacattcatcagggaatgttagcaatatgtcatatttttttcttggtgtaccattaagcaatctaaagctatgctgttacctgtaaccacttggattaattattttagattagttggttatacttctaggttttatggctttatcttttcagtcagcattattaaccaagttttggtagctttttcaagttttgtaacccccatccagggagatcagtgtcctctcagacactcccaggtaagcatgatctcctggaagacgtgagaagtctcttaaatcatctaattattacattggagctatataataactccagtatacctggagttattatgcatatatgcaagttaggttctaatgaggcaaatgtaagtaaatatgttgttgattcaggaggtaaaaattaggagagccatgtgtagttttaagaacaaaagaggaattacttgtaacaaaagtaagtaagaaaggaattctcagttatctcttgggtagagataccttgcatagagttcagcaaaaattccaaaggttgtcataggactatggaggccattaggctaattaaaatttataatattgcccatatatttgtactaagtctcattcctgaaggattttatatttgggttgaggctttgagaaattctaagactggcttgagcagtaaaacaaaccaagtaaaaattgccatggctgtaaatagtcaaaaaggggtaagctaagtttctgcaaactaaacaatttcagagggtgtaagaatgtattggataaaggatgaagataaaaagcactttgaagactattgatactcatcagattttaccactgataatttttcaagaggaactgtttatgaaactgtaaagagaaaatggagatacaaaaagccatccaagatgtaaatgccgaaggccaagttttgagataaacagaaaatcacgaaaactcatgtctggtggatcttccatggccccagtgtgagcagacagtattttccttgaggagaaatactagtttggtgggggtaaggtagggagttagtttaaggattaatcaagagaactatacatgtgctatttaggttgagggaaaagatcagaataggcatgggcaaagcctagactcaaatcaagttatctatcaagcaagctgacatattcagacagtttattaattacttagagaaatgcatgatcagcatagtgtcagctcctcatgtccctcatccgcagggtaacactgaaactaaacgggaccacatgataggtaacatgagtggtgggcactctggctgaggaacagtttccatcctgtagctaagtagttttttagcctacagctacatcctaaggagtgggcaaggtggtgaatctcagacctcatggaaccagggaaggtggatgagaaactgcctcccagcaggctcccacaaaatatggaggttggtaagaaatagccttgtagcagcacctcacaatactgcctatctttccatattctgaaggaacacagagcattctgccaaagcttaggtcagcctatcgttgggcttacgtaagtagcctatgtggaggcatgcgagttttccagggcacgagtacagagcagttatcctaccttatcatctatagtaaggaagaaacgaccgtgtgaattagtacaaaagcatgaaaagaaaaatgttataagtaatcatttcaaacatctaggaaattttgttctgttggtcttaggataagcattctgcttctattaagttgtttgctcctggactgcaaagaaatcctagagattctgacacagtcacttggcacattctgaagattgtctttttttgtggtgatcatattatcccaagaagtttgcattcatgagtaatgtcattgtactatcatctatcaggagtacttgtatagtcttttatagaggcttttgtgtttcttccagaagactcagtttctgatctgtagcttgtaacaggagcctttaggcaagcataaaaaaaaagcagaaactactgtggaggtaagactgaatagttgaggttaatttattttaatagccatcaatatcagagtggaaaaaagtagaatcctctattaaggcatatcagtttgtaaagatttaatgaataattaccttagaataagaacatcatgggtgacgagggtactgaccattttcagagtcttgaatttttataccatagggtattatgattttccccagttgtctcaatctagatacttagatctagagaaaaaatatttttaactattttttaaaataacagctttattgagatacatttcacttttaaagtgtacagatcactggtttttagtatattcagagtagtacagtcattaccactatttaattttagaacattttcaccactccacaaagtaaccctttacccactagcattcactccctatttttccctctaatctacctggcaactcctaatctactttgtatctgtatagatttgcctaagatataaaatcttttaaaattattgtttattaactgaacagttatttaccagtcattggtacaagaacatgaatatgctccttttttaaaaaggacataatcagtctattgtgtttatattaataaaacgtcacatatataattaattgactgaggaacttatctatttgatgtattacattttttaaagtcttgtgtttagtaaacaaaacagctcttatataatagtattaagctagttcaaaatctagagaatgataagaactcttaattatttctattacctcttctaggtatttcccaagatcactaggttagtatctgatacattactaggtgttcaattaagaaagctttattttattttggtgatagagctggaattagaatccagctttcctcccatggagtctccttctctttccattataccacacatgctttccacatgcgtccaaagctgacatttcaaagggtttggaagcagttcatagtgtgaattatttttctctatttcctctttctctcgcattttttgtagccatacaaaaatatacaagtttaaatctgctattatatgaatgctgaaatgataagtaggctaagggaaactaaaaaaaattttaaaagcttgcagtgttttatatctcgtaacaaatataaatgacccacatttcacacttaaataatgtatgtaaagtaggacatgagtttatgggcatttttagcatgtttactttgtttttaaatagctctagttaaaatgctaaatatgaagcagtgatttccagatgtaattttttttatgctttaaggagctcacgttgaaggagaggcgcagtaaaagaaaggataaacacttatagattttttttgtcatttgtgttttaaattttattgtggtataaatgtagatagcaaagtacacaatacttaaatgtataacttgatgggtttttacaaatgtgtataatgtatatatagtaatcacacagattaatatacagaatatttcagtacctcagaagtttccttaatacccctttttttgtcacttgcactcgtgcaagaggtaatcactattctgacttctgttatatattggtttgtctgttttcaaagtgcatatacatgaaatcatacagtactgtcttgtgtctggcttctttcactcctcattatgtctataagattcctctatattgtttttttgtagcagttgttaattttttctttgtagtattctatgatataaataaagcataatttatatatctatttgcctgttgatagagatttgttatttataattttttactattatgactacagctgtcaaaaacattcttatacttgtcttttggtgaatatgtgcactcattttctcggattgtaaggttttgtagtttataaaagttcaaaacattttaattgaaatagccagaatgccaagactgcctcataagcaattttcaagtctaagtgaatattacctctctgattttatagtagaagctggggaaaattccagtgactttacagccactttagggtcgtatcatatgcctcttctatgatgcaagagttatgggtattatacattcagggattcagtaaatagcaaggtgccatgctaggtgctagagatacctctgtaaaagacagtcatacaccctgctttcaccaatgaacaaacaagtcatttgacataatgtacagagtgcaatgataagagaaatgagaactagcagaggagtacttagaatgaagcatctcacctaaatctgggtagtaatgggagacatcttgtaggaaatgacatctaaactgcatccgaaatactgaattggaattagccaggtgaaagaggtgtggtgaggctggtgacatgagctgggcattgagagattttaggcactttttaaggcttgtagacttgagaaattgaaagtagctgggtgagcagagggaaccattgaagattatctttttattatagaacacctcaaaaagaatagaatgaatcctcgtatacacatcccagtttcagcagttaccaactcatggccaatcttattaagaccacgtccactatccgtagtggattattttgaagcagatttgagatatatcatatcatatcattgaagatttatggcaggagagtgacatgatcagttttgtatttaagaaattacacatacctggtaattctaaattacctttaaaatgcccacaccatagtttagttgtttttcatttgctgccatttatacatagacagttacctttctgcatgtactatttgtagtagtttgcactttttcaaactatagtgttttggaagtatgattaaatgttaaaattgttttatgtattcatctttccatgtgtatcggttggtttatttgcattttaaaatactattaatgaatattttggtttctatctataaaatgtcataatcaatataaaagtcagtttgtttctaggattcagcctccataatagcaaagatactagtatttggaaagaaattagatttatagttctactatgaatcttttttacagattcaagttgaggaattgttttgtggcttgagttttgttactatctgtgtatgaaaatttggttttttgtttgtttgtttacttagtgtttgttggtaagaattaatattgactggctgggcacggtggcttgcacctgtaatcccggtattttgggaggccaaggcaggcagatcacttgaggtcaggagtttgagaccagtctggccaacgtggtgaaacccccatctccgtaaaaatacaaaaattagtcggatgtgatggcgtgtgcctgtaatcccagctactcggaggctgaggcacgagaatcgcttgaacctgggaggtggaggttgcagtgagctgagatcgtgccactgcactgcagtctgggtgacagagtgagaccctgtctcaaaaaatatatatatacatatagatagatatattgctttttaaaaaatttatttttttcagattatgaaaaacatttgtattaaatatgaccaacagtactagttttgaataaaatgttttacacagataagtttaaaaaaatagtatgaccccaatccaaaagaaggacggtgacacaaacaggcaaagtatgcaagcaatataacaggcagggaaaattcaacttcactagtcatcaaagaaagtaaaattttagacctattaagctggcaaaaaaaaccaactgaaattccaccaccaacattagtaaagttgtagtaaaactaatctgctgattcactgctaaagatgatctaaattggtgcagcccttgtgcaaagcatcatggcgatacacgtcaaaattcatgagcatggtaatttctgtagaccagaaatctcactcttaagtaagccccatatcaagaataaaattcaaccaaagaattacttcatgcttaaaaatgcttattgccgagttatcggcaagcaatcaaatgcccagctctatgtgaattatttatgatataaaagaacttgatcaaatgaatatacagccatgaaatgtaaaatatttaagtacaaaatacaaattgtcgtatgcacaccaactaaaatttctgaaaatatgtaagcacaggaaagggaacaatacaataaagaaaaaagttatgattcaaatgaagaaatgtttaattatttgatactgatacagtattttttaacttaaaatgagacagatccttatgtgccttttgaggtttccctttaagccacatgcctgtattatctattgaaagaattattttttagaaataaaaataaaaaaagaataatttggccgggtgtggtgggtggctcacacctgtaatcccagcactttgggaggccgaggcaggcagatcacgaggtcaggagattgagaccatcctggctaacacggtgaaaccccgtctctactaaaaatacaaaaaattagccgggcgtggtggcaggcgcctgtagtcccagctacttgggaggctgaggcagtagaatggcgtgaacccgggaggcggagcttgcagtgagccgagatggtgccactgcactccagcctgggcgtcagagtgagactccatctcaaaaaaaaaaaaaaaaatttaagaactgtatgcatagggacaagccataagctgcaccaactggatcctagatcctctttcgccaagggcagcccattcttggttcttagattccttttattttaaaactatagctgtctatgagccactaagttaaaaataccttcctgtaagtcgagtgtttcttagagcattttagtttaattcctttttttgaagaaaatttagtagatggtaactattggagtactttgggatagcactgtatttattcatgcattcattttgtgagaatcagtgattttaatctaagaggtttgcaaacttcggctgctgataatggttcttacattcttaaaggaatgttaaatgaagacgaattcgcaacagaaaccatatatggcctgcaaatgtaaaatatttactatctgggcctttatagaaaaatttttcaagtgcttgtctaaatgaatataacataaatccttggcatatgctttttttcttttgaaaatctttctgtaagatttgttttagaatgatatttgaaaattaaaattttccttctatagagaagatggcgaattagaagatggtgaaatagacgatgcaggatttgaagaaatacaagaaaaagaagcaaaagagaatgaaaagcagaaaagtgagaaagcctacagaaaatcaagaaaaaaacataagaaagagagagagaagaaaaaatccaaaaggagaaaacgtgagaaacataagcataattccccatctagtgatgatagttcggactacagccttgattcagatgttgaacatacagaaagttcccataaaaaaagaactggtttctacagggattatgacattccatttactcaggtattgccatttttttgttttgtgataaaacatagatagc

SEQ ID NO: 3055 - DNA, 1452 bp, Homo sapiens
gctgcttcctgggaggtggtgctcgcaaacctggcagctgactgggtggggcgtgccttccctggcagtcgcggaggggaaggctgagggacccggtccccgccccgcgtgctcaggctgaacagcttttcttccctgatctctcggaggcgccggctgctggccaacgcagggcagcctcctgcgtgcgtgctgtgggtttctccttcagtttcctctcattgcctgaggttgggcccgaacacggcggtacatttccttgagagtcttctacattcatgctgtagaagctatgaaagtcgtgggaaactatagagtcaacactgcaaactcaagcactgatacgtccggagagcacttgacctgccttagaaggtatgatattgtgattatacacattagattttattcatggtttctgcctcataactcccatagcccttgttataatgttggggtgctttaggcctcagaagttggcttcagaaaatagaatctctctctctgaccttcttctgcttgcctttcacctgcttctttttctcccccaggcaggcttttcaaactaaaaatatactctatcccttacctttctgtctaggagctgatcttaaagaaattctttgacttatcttgtctgattgtgggtcataagaccctcatttcagaaggggtcctgctccatacctgaaggaaggaatgtatacagagaggccatgaagaatctgaacagaaaaggcctgctgagtttgtccattcagtctattagtattagattatgcactttttgtccagttacatttctatacagttgtcaattatcgctgtccagtgaagtgtctgtaaaaggatcaagagaacagggtttggagaacttccaggtaattgaacacatggaagttcctggagggtgctgcacccaagaaggcatagaggttctgtgcccctttctccataccttgtcctgtgcatatcttctatgtggtgtatatgggtatcctttgcaatattctttataataaactggtcaacataagttaaatgttcccctgagttctgtgagccactttagcaaattagtggactctgaggaggaagtcagaagcacatgtaaagcaacctggagcttgcaattggcatctgaaaggaggggacagtcttgggaactgagccttcaacttgtagaatctgacactatttccaggtagacagtgtcagaattgaactgaattagaggacacctagctgatgtctgcacagaattgctttcttgcttgtttggtgtctggggacaaacaaacaccacacatttggtcacataattctgtgtttgttggtgtgacagaagaggaaggtcagtttgtgttttttccactcagggaaggtgaagctccttctcagctccagcccattgcagttgtggaaaaactacctcagttgccagatcttccc

SEQ ID NO: 3056 - DNA, 3080 bp, Homo sapiens
gtccctgttttctggttgcctaggtagcacctctaagccttgtcgggtggcttctttacaaacacttttatggcttggtcagggtctgggtgctgttcataccccagtttcagtccctggtgcatttttttttaattatttatttatttatttttgagctggagtcttgctctgtcacccaggctggagtactgtggcgtgatctctgctcactgcaacctccaccttctggattcaagcgattctcctgtctcagcctcctgagcagctgggattacaggtgcatgccaccaagcccggctaatttttgtattttagtgaagacagggtttcgtcacgttggccaggctggtctcaaactcctgacctcaggtgatcctctggtgcatgttttaatggggccaaaaggagatgacacaagggcaaggggaaccataggcatctgtgcaactcctgagttgcatgaaaaggaagacaagttgacggagtcctgctctgtcgcccaggctggagtgcaattgcacgatctcagctcactgtgacctctgcctcctgtgttcaagtgaatctcctgcctcagcctctccagcagctgggattacaggtgcccccccaccacacctggctagtatttttgtatttttagtagaagcagggtttcaccatgttggccaggctggtctcgaactcctgacctcaagtgatccacccgcctcagcctcccaaagcgctgggattacaggcatgagccaccgcgctcggcattatatgtattttctaatgcttctacaaaagcctggtattggtattgagcaggcaaagaagaaccaaggctctcacacatgctgtcccatccagatagaacagtcattctctgagtctttgcttgtctgactcctactcatccttcagactccagcgtaaatatcccatcctgagggcagctttccctgaccgtctggcctagccatggctccaatctcagatggaaatgcagaaatcacccgtcttctgcgtcgctcacgctgggagctgtagaccggagctgttcctattcggccatcttggctcctccagctgttttgtgtttttattcttgctgacccagtcctttttcagactccaccatttttatttgtttgtttgtttatttatttatttatgacagggtctctggctctgttgcccaggctggactgtaatggtataatctcggttcactgcaacctccacctcccaggctcaagcaattcccctgcgtcagcctcctaagtagctgggaccacaggcacacgccacagcacccagctaatttttgtattttttagtagacacagggtttcaccatgttgcccaggctggtcttgaactcctaagctcaagtgatccgccgacctcagcctcccaaaatgctaagcttacaggcgcgtgagccactgcgcccggcctccttccccatgtaatgtctgtctctattactgttttgttcactgctctgtccctggcaactggcagagtgcttgcagcatggctggggctaaataaatgtgtataaactaaaataataaatgaaaaaagaataaacgttgaaaaatagaaaaagcaaatcactgcttgtattagtttcttgttgctgctctaacaaatttgtaaacaaagctaccacaaatgtagtggcttaaagcagcacagactgatcttcttacggttctggaggtcagaagtctgaagtcattttctctgggctacagtcagtccctgtgtcttttcctgctcctggcagctgcctgccttccttggctcatgtcctcttcctccgtcttcaaacccagcagtggagcctcttcggcctccccatcaaggggctagaagctttgatgtctggctgcttccagggttcaccctttttctattttagttttattctactagaatataaactgcagtgggcaggcccttttccgctctgctcactgttgagtcccatgcactcagaactgtgcttggtccatggtaggcactcagtcaatatttgttcaatgctaaatgaagaaactagcttttgtcatgcttcatttacttacccttatgtaggtgaaataaccctaatttctatctggcggtgcacacaattctaaagctgacaccacagctctgaaaagcacatgatcaaggtacaggccaatcccctggccacagcaagtggccagaagtgggcatgggcctaaacgagtctaatcagagtaaagcccaaacaaatgtttttttttttcttctggacacatctgagggaatggaaggagaaagccatggctacagaggcagaacagaggcgcaggaagaaagaagccattggtttcactacggaagcactgcaagaagcttcagctgcaggaagacccatatctggagttttcaatgatgtgagaacaaactatttccttcattattcacatcaagttcgggctgcctggagtgaaacacattctaaagccagtaggtagcatcacaagtgcaaaatgaaaaaggcacccacagaactgggacaaattttgtttcattgcactgagactagaagggacgagacagctcatgtggtctgtgttcctgccttcaaggaggagtagaatcaagaaatggaagaagccttggggctttcaggtcacccacgcctgtgtctgacccttggctgtacaccagatcacctggggaactttgtaaaaacagcttcctccaccccattccattgcgttgagccaaaatctctaggggtgaggctcattatctgtttcacaaactccaagtgattctgagggaccatcccttaacaactgtgaactttcctttggtagaaggaagcagcatagcagatcctaatgctaatgccgacatcaaattcaaagcactgaatgtgtgtatcatggtcttagaagtatgtataactcatttctgaatcactttattgaagacccaaattaattaaatacttagactatgcatgagagtctgaaggcctttctcctgtgtgtaaaaggaatctgtttcactgctaattgctttttgttttttccttcctgttt

SEQ ID NO: 3057 - DNA, 1351 bp, Homo sapiens
aggtaacaccatgtttggtaaataagtgttttggtgttgtgcaagggtctggtttcagcctgaagccatctcagagctgtctgggtctctggagactggagggacaacctagtctagagcccatttgcatgagaccaaggatcctcctgcaagagacaccatcctgagggaagagggcttctgaaccagcttgacccaataagaaattcttgggtgccgacgcggaagcagattcagagcctagagccgtgcctgcgtccgtagtttccttctagcttcttttgatttcaaatcaagacttacagggagagggagcgataaacacaaactctgcaagatgccacaaggtcctcctttgacatccccaacaaagaggactggagatgtctgaggctcattctgccctcgagcccaccgggaacgaaagagaagctctatctcccctccaggagcccagctatgaactccttctccacaatacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggtaccaacttgtcgcactcacttttcactattccttaggcaaaacttctccctcttgcatgcagtgcctgtatacatatagatccaggcagcaacaaaaagtgggtaaatgtaaagaatgttatgtaaatttcatgaggaggccaacttcaagcttttttaaaggcagtttattcttggacaggtatggccagagatggtgccactgtggtgagattttaacaactgtcaaatgtttaaaactcccacaggtttaattagttcatcctgggaaaggtactctcagggccttttccctctctggctgcccctggcagggtccaggtctgccctccctccctgcccagctcattctccacagtgagataacctgcactgtcttctgattattttataaaaggaggttccagcccagcattaacaagggcaagagtgcaggaagaacatcaagggggacaatcagagaaggatccccattgccacattctagcatctgttgggctttggataaaactaattacatggggcctctgattgtccagttatttaaaatggtgctgtccaatgtcccaaaacatgctgcctaagaggtacttgaagttctctagaggagcagagggaaaagatgtcgaactgtg

SEQ ID NO: 3058 - DNA, 12937 bp, Homo sapiens
cactggcttcttagcagtagctttgctgggagctgcggtattccaacagcccctagtgtcggctgggatgatgtgacttgggggttaaatgcagtttgcagtttcaaaaaagaaaagcatgatttgttgaaagaggctcctgaagaagaacatctgcgaagaagtctatctcccatatggcttttaggacactttgcagtatgctcagatcaagcaatatggacctgaaaaggaaaagaaaaaaaaaagaaagcaaccagtctccttcatatgaaaatctctgtggcattctgggtaactgcaatacaaagaatagtgtgatggtttggctttcaaagatactgttagtggcatttctacaggttgttttgattgtctgtgaatgctgagaggttttttttggtgtaaatgtttattgcttttttctaaatataaaataagtctatgttcactgaagaaaatttggtaagtgcaggagagtacatggaagacaatgtacaataaccccgtttggttttccaaattgttttatatccttattttgttcagtgtcaccacattttttttttttttaatgagatagagtcttgctctgtcgcccaggctggagtacagttgtgcaatctgggatcactgcagcctccacctcccgggttcaagcaattcttctgcctcagcctcccgtgtagctgggattacaggcacctgccaccgcgcccagctaatttttgtacttttagtagagatgggatttcactatgttggccaggctggtcttgaactcctgacctcgtgatccaccctcctcggcctcccaaagtgttgggattacaggcgtgagccaccacgcccggctgaaaacatggtttgtaatggctccataatttataataatagtaccatgtgcctgttttcttataagatatttagggtatttctatttttaatggaaatattgttataaataatgtgataactgtgaatatgtatatttgactatattccttattacttcatttggatagatattccaaaactggcattactaggtcagaaattatgaatctgttttaataaccttgctacatacttttgtattggtttataaagtctctgctatatgttactaccaccactatatgtggagtgtatgtgaatttcatcctcaaattcttcaatattctagtagttggtagttttttttacatctttgccatttcaacacatataaaataataaaattaatatcaatatgttcctaattattaaaacaatgtatttttccccttgtatgtagtccattaatgctgaagtttagtggcttggtttaataacctttccccaaacccatattctgtataacagaaatttctttggaaaaatttcagaatatacatctctttgtagtaacctgggaaataatttttctcttaggacatttgcatactgcatggaaatctggccagaacttgaacagatggttccaaaacttggggtaccttaaacttaaacatcagtgtaacttggggtcctctgcaaggtcatccgcaaggactgtgaaagtcctgcttcttggtatcatttcctgacaggtgtgtgttaatgtttcaggaatatactggagtgtactgcttttttattcctgattctgctcacaaacttgtcatttatttgaccactgactgttgagattaggatgctctcaataaggcatatttggatcatgtttatctcaaaactgcttctactagaggcttttgtggcttgctttcacatatcagggttactgctaatgtgtccctaatactttgttgagaaggtgaaagtggtagttgaagtcactttaaagtcagtcctaggaatgcctctcaaattctccctggttttctattttctaagttaccatttattgagcacctcttgcatgccatgcacatttcacacttgatctcgcttaagcattattacaatccaatagagtttggataacgatgcattttcacagacaaaagtaacctcagagagattaagtcatttgcctggagacatagagattataaataatggttgataaatacacagaggctcaagattcctgtttggtaattacagaggctgtagaaatagacatgtcaagggctctcaactactgagtctccaaaagtcaactgggaatcttttaattatttacatccaggaaaaatcttttacctattccctgaataaaatataacatgttttaaggtcattttccaaactttcttgctttaggttaatcattagtgagagaccccaacatttctcagattgtgtgcaaaccctgaaatgatagcagaaatttacacagtgaccccagacagttagatttatcctgtagcttgggttgagcaccttaaatttatatccatatatgtcttgcaaattcttttgctttgtggcttagtagcaaggcatttaccctctggacagtgcagtcaggtgtgcccataaaaacaggagttgatcatttatgaaagctgactgtggaataagctaaaggtgctttgaggacatgcttttagtgtccactcttagaaacctgtatttcaacttccctggagctcaggattttaaagatcaagcttcctagcctcttcagcctctgcaagttcagataacctgttgctatttttgaatataaataggccttattagggattaaaagaactgcccagaggtttttccccttttctcattttggtgtttggattgtcagcggaagtcttgagctttgagacttggcaaggcagcgccttcaaacaaacatcctgtggacaaaattgtctggcccagcactcggtgttccaggatgattgacaggaagcagcatgtgctgggaggagggaggatggacactctgagcacggtggcttccagttccctcaaacaatagccaagctcccagggagcctcacaccttctttttcccatctactggggtggtgggggttagggaggatgtgggctgggcaggaggtgagaggaaccttggaattccacccagcaattacaaataaccaaccaaaacctttcgataatgcttcaacttgagggataggaagatacagctatgcagagatctgggatgatgcttgaatcaagcagtgagccaaaaggagccatccaaagctaaagccaacactggtcaccttgtggaatggggcttgatgaagtgagcagaagtgaggagagatctggaagggtgaaaagaagtgaaatgaaactcacacgtaaaagaaaatgaacatttaaaagaaatccagctatatgccaggattttgcatatgtgtttgcttttggtcctgttgcaggtatttgaggcaggtattatatgaattctttcagatgaaactgaggctcagagaagctaaataaaattatccaatgtgacaaacttagaccatggcacaactagtatttgagttccagtcctttggaccctcaaaacccatgcattttcctctattacatttcctctctaaacttgtctaaatcctaccctcttctttctctgcttcagtcctggtggggaatatatagaagagaacttatcaccctagctcagtctcctacaacttccaatttatatcttccattcctgtcttcccaaacctttcaccattgtctgaatcatcaggtatttccatatctctgggtctttatcatgttgtcttctctgctacaatgactttctcttcattcaccctaatacaatctaccatgcacccttcaaagtacagttcaaatgccaacttcttcaaacagctcgtgtatcttactgtctctcactctcccaaggaggatcagtaccttcctgacacagtagtcttacagtaatttgtgtctatctctgttataattatcacatgttacttggaatctgaatatccctagttattactaaatcatgaacaacaataactgaaatcaccataaaatctagacctatcttttggtgacttgattgtggcccatttgggcaagtgttaggcttcaatcctaacattgatagaaggagatctatccctctatctctgagagtccccaattgattccttacgatactttatgaattaatataagaagaaagggtgggcagagacattggaggaacagtggaaaagtgaatctctgtctaattccttccttccttccttccttccttccttccttccttccttccttccttccttcctcccttccttccttctttccttccttccttctatagttactaagtatcacctaagagttttgtgctagggtagatgctgaggacacaatggtgagcagaacccacacttcttctgctgctgtggagttagggtccattgaggaagacaaacattacaaatacaactcacaaaatatacaatcgtgaattgtactagatgctatttaaaaaaatgacaaaggggctacatgaacctaattctgatggacttgacctagtctcaggaacaggtaggtggtggttgacagtttaaagtgaactttcaggaaaaggagttaaatcgatctgaaaagtgatcaggttgccactaaatctttaaaggcaagaggtgttgctcttgttcatagaagacaaggtacagagggagtgcctcttccatcaggaggaggagagataacagtctcataagagaatgctctgtttttggcactgccaagattcggctcctatgatgaaatctcagaatagaaaaattagaaaagggcacacctcctattctcagaatggaaagaatagcaaggtgcccacttcatattctttcatgctcagtcagaaaaacagtagaacattgaaagttgatgatgaaattcatgaatttttttttcaagttgcattccccctaaaacctcctacggctatataaggtcagcttttgtgatagatatatatgtatgtacacacacatatacgttatatatcattgtctgtttattaaacctcttcccttcaatttgcagcaagactaattgttttttgttttatatattcttaggattgttgataatggagggaaaatgagggatgggaatggaggtggtggaggtgatcaaatggcccactcagaattatcctatgcatcaaaatacttagggataattcacggactgtagcctttcacatgaacatcccatatggggccttctctggctgtgtgagccttgcagagaacttatgatttggagaggcccagtggctagcatgccagaggcagacgctggagcagagatgacactcccaagacactacacgccaacctgctgtttatccacattctctgggaagtcatggagatatgattcaaccatatgttcatacacaacgtgaaaccttcatgagacataggctgcttgccaggtgcctatctcccttccttcttcttttctattcttcctctgaagtactgattttggcgaatcatagagaccaaattggggaagttatattgtattttctttagtatttgaaatggttgtgatacatctagatttgtaaaagtttacattctcaatacttctgtttagagaacaaaatcaaatttccataatttggcattaaaaacttcatacacctcccagcattatctactctgactccttgtctgaggcaatctagtctccttgatcttggaacactcctactctctttgttcctgctgttacgtcgaccagcgctgaccaacacccacatataccgcattctctacctacctccggtctatcctcttaaaaggccctacctggttcccagtgcctcccccttagcacttccagcttacctggcaacttgtcctgtgcaggtttctgaaaaagcttgctttgctgttattgtattgttgtggaactcaggttattattttatttttccacttcagattctccactgtctcctggtctccgtaagagctgggaccttttcttttatatttttatctccttggctgcttgaaacactgtgtaatctgagcaaatcatatgtctttaataaatcacttgtttatttattgaagagatcattttcttcacttaaactaccagaagaggggtcaaggaggagagaactgatatctattgacaagatatcataataaggcacagggataagattttttagatataatcttatttaatgtattcccagacatggtaaattaattatttttatatccattttacagatacagacatttcactcagaagttttgtgctatttgcctgggagcatacagaatatgtgtcaaagcttggttatcttttttccccacaaaaatgtattcattgaaatagccatgaaataaatgttcactggagtgcatgtgtcaggtagtagagaaacaatgatgagccaaaatctacccagggcttgctttcatggtagtcaggtgagtgggaaaatatctgcaaaccaaacaaccacctaaataaatgtgaagctgcaaatgtgaaaagtgctaggacacagagatccatctattaagagagtatataataatagggtatttgacctgttcagggaaggaaggaaacatttccttattgaagtcatacttgagctggatatgtaggctgagtaagagtttattaagtgaaaggcaaaaggtcatattcggagagaggcccacaagtgcaaaggccctgtggtaggaaaaagcatggcaactaaggaagactgaaagattccagggtggctggagtgtgtgtgcctgggtgtgattgtgtgtgtgtgtgagagagagagataaggtgtgaggctagaaatataaggctttctggttgtttctccatttatcttaaaaacaggcatgatggctcacaactgtaatcttagcactttgggaggccaaggcaggcagataacttgacttcaggagtttgagaccaggctgggcaatatggcaaaaccctatctccacaaaaaatttttaaaaaattagccaggtgtggtggtgcacacgtgtagtcccagctactttggaggctgaggtgggaggattgcatgagcctgggaggttgaggctggagtgggccgtgattgcaccactgcactccagcctaggcaacaaagtaagactctgtttctaaataaataaataaataatacagtgaatccattcaagagattgcagtctatgaatgacatgatgattttaatgcagacagcagatggaagtgaggcaagagtggaagagggtaagccaagcaggaggctatcgtagcagtcatggtgatcaacaaaaatagctggactagtaaataaaggaagagtggtgggagtgtaatgaagaaaaagggatggattggaaagtagtttaggttgtccaattgaaaggagtttttcatagattggatatacagatgaggaagaaaaggtgacagagatgacactagaatttttgcctgcaaagcttgctgaagtgtaggactattctttatataggaaactgtgaaaggcaatcagatttgaggtggaagtttataacagatttagatgcattgcaaggtatattttagaccttgaaatgggatgctaatttggatatgcatgtctgaagtttaaatgagaggtctgtcctgaagataggaatttatgactctatgtagaggtagttttgaaagtcatgaacatgcatgaggtggctggaggagaactgatccatgggggagtgatgctgaatcaggaactcctggaggcatcgaggacacaatgttaatgatactcagtccctggattgaaagtacttgccacttagtgggctgaactttgatttatcagattccaaagcccacagtgttttagtgacatcatcctttgagaaagcaaaggctaaactgagtaggagtcaatgctgtagttcttgacctttaattttttttttttttcatttttagctttgtggtttcctgccactgttttggcatgcttgttgttgagattgagaaatagtagtgtatattatatttggcaattatgcttataatctgaaagtgtttgtgtaagcttaggaggtgtaaactttttacttcgcaaacagggaaacagagatccaggcagggccaggggtgttttgggtgagatcaccaaaggcccagaaataaagagtagaatccatgacatctcaactccagaagtactttccgtgcctctgaaacatgatgcttcacttacttaggttttgattttttttttttttcacaagactagttagaaaaagaagttggtattgctgtcccagatggactcctgatctgtccaggtgctctagatcctgaccatcctactaatcattagtaccagaaacatcaggatcaatcatcacatttgcaaactaaaaacagtgaaggtggaaattgcaaatcacttccaatccaatagcatgccgtccatggtaatagaaatgaaccacgacaggactggtttacagtagttgagaagacaaattttcagaagcaaatattggcctaaagaaacttccaggaattaggggttctccaaaataatttgtattcaagggtgatatgatttttaaaagttatttgtttgaacaaggagcatttccatttggaaaaaatattcaaacaacacaggaagtacccagtgaaaagaagcctccattacagcactgctccccagagccgggtctccttcctctgaggcaacaactgttactagtatttttgcttatttatctagagatactctatgtatatctcccttttataaacaaatggcagcttgtgatgcatggtgctttttgccttgttttttctgtaggacataattccatacctgtatatacagatctgccttgctctctttggtggcttcagaatacttcattgcaagtgtcccctaactttttgaaccagtcttctaccaatggatatttaggttgtttctaatcttcagcaattaaaacagtgatgaaaggaatatccttttatcatctttacatatgtaagtatatctataggagaaatttctagatgtgtgattgatgggtgaaagggcatatatgtattcacaactttgatagagattagaaatattcctttaaagatgttgaattaatttttactcccataaaacatatatgagagtgcttgtttctcccaaccacttgtcaaattatcatttggtcctttccctaaaatgggaaatgcctttaatgatttttaagctatctgttttgccccaacttcttgcttgctcaggaatcagaaggtttctagattctgctcttatggctactcagagagatttaagaatatcttagttctctctttggcaactgacctaacttttatgcaacaaagaagggagaagagagttaacattcattggatggtctcaaatgtttggtattcatttagctaatacttgttgaacacctactctgtgggctctgttttaggttctaggcatttatcagagaacaatgcggacatagactcctgacctctaggaccttacattctagcaggggaatgagacattaaaaaatatgataaacactcaaattagaaggtggtaaatgtggaaatacaaaaaaagtagaataatataatggagattagaagaacaagaggcaaataaatttaggggattaggtaggatggccagggtgatcctcattgagaaggtaatacttgattaaggacttgatggtgttgggaagtcagccaagagatagctgagagaagagccttccatgcagagattataggcagaatgaaagctcgaaggtgagtgtgtgcttgaggcttccagtgtgactggtgtgagtgggagtgagggagggagagagagaaagggagaaaaggagatagagatttgataaagccttacagggcattcattcagtgaggctgaaatgcagcagtactgcaaggttttgagcacaataaagacaatgatctgatacatgtttcaaaaagtaaagacttttcttttttgagacagagtctcactctgttgtctaggctggagtatagtggcatgatctcagctcactgcatcctctgcctctcgggttcaaggaattctcctgcctcatcctccacgtagctgggattacaggtgtgtgcaaccacgtctggctactttttgtatttttagtagagatggggttttggcatgttggccaagctggtctcgaacttctgaccttaggtgatccacctgcctccgcctcccaaagtgctggggttacaggcgtgagccaccactcctggcctcacaaagtatgactttgaatgctgtgttgaataataaatatgacaagattccctgaggggttgcgcataagatgtcagaggaaaagagaagttaagaacaactccaaatttctcaaagaacttaaaacagaattcccatttgacccagcaatcccattgctgggtatatatccaaaggaaaataaatcattctgccaaaaagatgcatgtacacttatattcactgaagcactgttcacaatagtaaagacataaaatcaactttggtgtccattaacagtggattggataaagaaaatgtggtatgtatacagtgtgggatactatgcaacaataaaaaagaatgagatcatgtcccttgcagcaatatggatgcagctggaggccattatcctaagtgaattaacacaggaacagaaaaccaaatacttcatcttgtcacttataggtgggagctacacgttggcacacatggaaacaaagaggggaacaatagatattggggccgacttgagggtggagggagggaggaggacaaaggctgaaaaactacctattgggtactatgcttactatgtaggtgaaagagtatttatatcccaaacctcagtgtcatgcaatctactcatgtaacaaacctgcatatgcaccctctgaatccaaaataaaagttgaaattatttttacataagaatgactccaagatttttgtcatgagttaccatcaactgatatggtaaagctcacagatatagcacaattttgggaggaggctagaagttcacttttaatcatattgtattggaaacatctattagatatccaagtggaatgtcaaataggaagatagataaatgagcctggagagagggagggagagagagatctgaagaaggaagaaaagcaagagagttacatattatatctcatttaattctcatggtaacaggtgatgctatcttcagtttacaaatagagaagcaagctcagagtggcttgctctgacttatctgcattcaaagcccatcatcagcctccagaagttcatggcatcaatttttctgccatacaggttctatgttccaggatttgttcaaggttccttgtcataaagaacttgggagaatcccttgaacccaggaggcagaggttgcagttagccaagactgcaccattgcactccaacctgagtgacagagtgagactctgtctcaaaaaaataaaaaataaaaaaaaaaataacttgagacctgctggttacacgtggggatgcaatagatgtaggtgagaacatggacagagtgcgtgctatggatacaaaaccccaaggtctgtggaccaccctgagatgacagtcccttgtgcagaaggcactttgtgcagaaggagtaatctggggtaccacagtttaccctagtgcaagcctatttcatagtacctagttttttcttccagctgtgttctgttggcctcactaatgtcataataaaagaagctctctgtttatttctgatatctcaagatgctttatcaacaatgtggttacgttgttggtcatcccatagataaactcagatccctctactttccaagtgtgagaagattttgttctacagtcgcttctgtgagatcaccacagccctggcaaaccaagagggaggaaccttgtgcctttgaagtgtgattcacagtgcttgataaagtgccagtattctctaaattttaggttcacagcaaattggatggaagttacagaaattcttctatttttaattttaaactaacatacgacaaaaggatttcctgatttatccaccatttcaaaaaaaggtccgaagaaaatgaaggagcctcttcctgtactcatggtacataaggtaacagaaaccacagaaatcaaaaccgtggataagaggagactacagaaagatttctccttctggagtacatgaatcaaattgcattgaatcaaaagttttgtgaagatttgagatgagaatgagagccaaataagccatatcataagaagctgtgatcagaaataaaatgaggacaatgcttactgtggctttcaaggcaggagaaagcacacccgagggggtcgtgtcccacactaggcagatctaatggtgccacaaaagacaggtgttttgtcagatttcagccacacactttcacacctgcaacgcattaactaccgcagcaatgttaatgaagaccaggtgcctgttctccagcataaatgaggaactggcaggagatttgctgtttgctacctgacgtctacccctgagtctctgaaccccgtccttctggttgaaggggaaggcgtgatgactataatgttgaagagctttccagatttggtagtggaagatcccatgtcccctcctttcctcgttgaagatccatagacaagtgtgataagaacacctacactggggtgagccgggtggagggctcgactctccttggtatcttcctgggcaacatcaactttaaaatttttaacagtatttgggcataacaattattcttcagacagtcttatttttcctttttaagtgcatttagcatttaggaccataataggcattatcaaacatctgaggatgcattattcaaagtttagaggtcacatatacaatcacac

SEQ ID NO: 3059 - DNA, 1312 bp, Homo sapiens
ctgtggtgacagacaccgtctgtgttatcacttgaagagctgtcctgtgggagaaatgacagcatgacaaacaggctatgtggacttcagcacatcggcacaatgtgcctccagttttttcatctggaaaaacaactggcagtgggtgatgattaaatagaggcccggcatggttaagcggcaagcccagagtcagccatccaacgcagcgcagagctgtgatacaacccacttccactcccacggcatctcggcttcgtgggagttgaggagcgtctcaactgcatgtcaggagaacccatgaaaaggaaagaacccagaacaaatgggtgagaaagttcaagactatgttcagcgtaagagcaaaagcctcctgagaattctgcttgcagcccattcccaggcattacagtgcaaagctaattagggagaatggcatgagtagaagaccaccaagaccaccagctgaaacgggtgttctcatggcctccagtgggctcgactatttttatatttttaatattttggtccaatcactactctatacaacttagctgtcttaaaacaataaagccaaaacaaaaataaaacaataacccaggcctcccagatgttggcttcagtctgtgttcacaagttatcttcctaatataacagcatgagtactacttccccatactgttctcatgagatctatggccaggtccaaggtcacatcatagtaaatctttatgaaggttaagaaatttataacatttgcatttgttcacgaatgtcaataatcccaaccggcaggttttacgctcaggtttgaatgacactttgctaaccaagccattaaggtttgtttcaaggagtcgggggaagctccccagcagctctgagcaaatgaggagccagagaaaaacaattaaaaattttttaaaataagatctttgaaagtatattattaattctatcatccaataagtgttttcgaagactatgcaaatgacatcttgcggtataaaagctgttacagaacagaccttccaacatttctcagtctccttctttccttcccacgcatgccctatgtgtggactggcagcaatgtttttacttttaagaggaatttcatcatttgggaaaaatttagagatattaacgaaaaattgctatgtgtctcatggctacctactgattagaagcaattaacttatttctattttgaaaaattaggctagcaaatgaagcctgtgggagaagcatatttaataaatatagaaatattaattgtaggaagtaacaataacaccatgcaaagttgtcc

SEQ ID NO: 3060 - DNA, 4675 bp, Homo sapiens
gaaatacacttcttaacagtaaaatcgaagccaaaacataatttttgtagagacagcatctcattatgttgcccaggttggtttcaaattcttgggctcaagcagtcctcccacctcagcctcccaaagtgttgatattacaggtgtgagccactgagcctggccagttatgtgctacttaataggtacacctaaagcctgtgtactaggttgaaagtaaaatgatggaattaagttataccatggtattatcatgtaaaatagtttaaggcaaatggcattactaagaataaagaagctcactttgtaatgattaaaaagtccagatcaccagcaaagtatactgattctagatttgcatctgcaaaaaaagactccaaaacccatgaagcaaaaattgacacatctacaaggcgaaatatgtaaatccacagtcatgatgagaaattttaacattttatatgcatataaagctgaacacatgactaacaatctagtggatgtgtatagaacccaacaattgcagaatatatattcttttcaagcacacattgaatatttataaaaactgatcatatactgtgccgtaagtttcatctcagcaaatttcaaagttttgatgccatgaatgaaatgaaacctgacatttcaaaattataaacagaatatgccctggagtaacttgtggtattgtttggggatgaggagagccatccgaatagtgttttaaggaaagtctctattcattgatctggggtaacaaggcaggaaccattccaatgcagaagctttggctaagcagttgagcgttcagtagtgcatgtaaattcctgtgtgaatgtcatggctaaaggcatagcctctggaaccagactgtttgggttcaaatctcagttgttgcctaacctctgtgtttcagttccttcatctgtaaagtggtagtattctacctcaaagcattgttggtacattatatggttataatttataaatgtatggtggcaagttctataaaagtagttgtacagcaccacacatgtctgcttgcttttgtagagtacagtagatgaatgtatccggatatatatgtaaataataaattgaaaagtgaaatgccctggcaacaggtttggacacgcatcaaaccatgacagaccatgagttaatgatggttgaacctcgacaataggtacagggagatttgttgtactgttttctctacttttgtaaacacttgaaattttccttattaaaaatttaaaaaaatgttggcctacaaaatccaattaggagctcatgtcagttcacctttgcatctgaccatttagtcgtccaggaggttgtttgcctcatattcacattttagagagcatttgattcatgaaatattttcattcagtcatgttagaaaggatttttcccaactcattcatcattgtgactaaatttcaaggtaacttctatacaaacacaaaggtttgtgactcaggtagagacagggtcaaggcctccagtgtgcaatagcattatttattaacaaatcttttaaagttaaacagtagctaaaatatcttagctgtcatgtttaatgattagtttatgtaacctcacagcactaacctggaagctgaactcatttatttttcttacgcactgtaagcaacagcacctgtggttcaggactgggatctcacatgaggagttaatgaagctcaatcagtaagcagatgtttctaaaaactgtgccgtttcttgatttcacactgtactcaggtgcaggcagccatagacttttttttttttaaacaaaaacataagtgcaatgttggtggtaaagtattgggaattttatagtctaaacgttataactcattttcatcaaagtaaagtacaaggtctgagacaggcttgggtctgaatccaatttgcaccagtcacaagttgtgtggttcttggcaagtttcatacgctgtctgagccacatttttctcatttgtaaaggggagtaatactagtctccagtgaactggtaaatgtttaacaattagctgtcagggttagccaaaatagggtttgctaatttccatagtgtaattattcccaccatggcctctttcaagctaccaacaggacatccctgaacacagaaccagcagagaatggcagcagcagcacacctccaccagggagatacagtaggcctcagtgaccccagaagccaagatgatggtctaggaagcagtgtgtgttatttaggtttatataatttgattttaaataataacggggtataaaaactagctcaccaaattcctgaaaatttaacagttggcccatttgagctgtatacctagttcaagcacattgctttccatctccagctcctggatttcctaaataacactacaatgaacatttatccatgatgcatacccaaatcacaggctgtgcgactggaatgtgactgagtatactgccatgttcttctccagaatggccaggccagcttgccttcctactagcagtgcctgcgggttcccgtgcttccctgatgaggtgcatagatatataataaagtgtaacagcagatgggtgctgccataccacacttgaagcaacagtgaggcctccaacttggaaagtccactgataagcatagtgcctggtaaagtaaaagcagaattagatgtatagtacaatactgtacatttaaatgcatacaaaacaatagacttattcaagaatattcaaattaaaagatgcacatcagatggatttgaatggtggctcatggagggaagtgatttattatatcagtgagccacattcaagcttgtattcctattgtctctaataaatctgtgaaagtttacacgtttatctaatttattttccaggaaaacagaggcctcctactattttacaggtgagaaaattgacggcaggcaagactgagtgacttgtttgagacacacgttgtcttaatatctaaggggcagtcctggagttggacatgcagtctgtgtgaccggcagcccatttcccatgctgtatactgactggacgaccttggcctaatcacctaccccttttgaccttggtccccttatccagctctgaactttgaggaaacttattactagatgagctataaatccagtaatgtcataactgttgccaaatatctgcttctctttctcctcagtatttgttctaagtgagggtaaacatagttggcatcatctgatggtttaggttccctttggtttatttattcacaaggactctgtttctctaatggatgctttggcctggagcgtgtagttcatttagcagtttaaatcctcttcctttttcaccctgcttccccagtcaccattgttctgggcttcattataaaacaaatacttctttccactatattgaccccaaatatttcatcaattcacttgtgttactgaaagccaagtgttgattcaggctgggacaaacaaaggctactttgtgaggctgtgctgcagacaggccagccagattaccttgtgcgggactggttgttttttcaaaaggcagtgtctttttaagcataatatcttagtggcacataattacgccaccgtaacaaatagtctgttgtcattttaatctatatttacttctagtgttgtctgttttttcactgtatttatatagttgtatagctataatttaatattttgtttattcatagatttttccattctgtgaacctttactttatactcaacaagcatttattggttcattcagaaactctttagctaataactacttaactattccactatgagttacttccagtttttatcatcataaataatgtaataaatatctttggacacatacctctcctgatcttttggattattttcttaggataaattcccaaaagtaagatcattagggggagaatttaaatacctcttcgagtgtgtcagtgaacctgtttcctcatgatcctagtcattcataagttataattcacctttttttggtaaatacaggacccctccatgaattggcttttgcctgtctctccctcctaatttcccaacaatcctcaactttctcttctattcctaccaccctccctctgcccccccaaaatagataggtttgttgttgttgttgttggttggttcgttggttttgtgttgttttttttagagacagggactcactctgtagcccaggttggagtgcagtggtgcgatcacacctcattgtaacctcgaacatctggactcaggcgatcctcccacctcagcctcctgaaaaaataggtagttttttacacagagaataccttgttttgaacatgaacttcctgataccataggtgctctactggagcaggacactggataccaaaagtcactatcaaccataatccctttgctcagtgttatgggctgaattatatcttcccccacccccaaattcatctgttaaagccctaacctcctgtgtgatggtatttggagatggggccttgtggaggtacttgggcttagatgaagtcctgagggcggggcccttataatcggattataagaagaaacaccggaagacatgcatgctggctcacatgcatgccctccctctctgctatgtgagcgtgctgcataaagatggc

SEQ ID NO: 3061 - DNA, 918 bp, Homo sapiens
gtcttgagactgcaagtacacctaggaggcagagggtagagggtgtgacctagaactgtccttctctctgcagaatacaggtggctcccagctgcattctgagaactctgtgattgggcaaggccctcccctgccccaccagcccccacccgcctggagacacaccctcccccacaatctttctagacaggtgcttcaggacagaggacaggcatggcttccccttgggcctcctcagtaggcggtctggcctgacccccaacaaagaagcctggaggtcagagaagcaaatgcggagcctgctccctcctaagaagatcccaagaatccaatggctcagtccttggtgatctaagacagcaaagaagtgtgcaaggagggccctgttagctcccactgtcctggtttctcctcctggagtctaatttccttggccctctgagccttttgagtctgggccctggtccaatgctgctgttgtctgaggaatggtttggtgagaacagatgttagaacttgtttgttgattcttgtctggctaataaatcatcaccaactgccttctcctacagggattcaagtcctccaggctccttctgtttctgtctctgactttctctctctcatactgtggaaggcaaggagttgaactgccactgcagtgagggtggaggggcttgaggattgacagacaccaaggccaggaatacagacctctgcaaactattccttctttagctgggatgggttgagtaggcagccagggacataggggtggctataccacctgaggcataaagaaagaggggcagagaggtgagcagttgagggacagccccttcacctcctctgcaaccgccctgccaagtacaggactcgggaggaggaagatgtgtgtgtgagccccttagaggacag

SEQ ID NO: 3062 - DNA, 3810 bp, Homo sapiens
caggcatgagccaccgcgcctggcctcgcctcgccatctcttacctgggctactgctttgcccttaatggatcccttggccctcggtttctcctccgtctggtctagccacagaatgaccttcctaaacaaagatctcatcttgcactcggccagggccaaaccctcatcgttcctcactgcttacatgcaaaagcctgggctctgtagcctccccttcagggtctttcatgcccctggagttctgttggcaagtctccccaaaatgttgtcttctcttgcctgccagggaagcaatatcaaaggagatgtgccagaagcttcctctgacatgcctctggcctcctgggcctcgactccagcctgtactctagggctgcagtcactaggtcctggtggccctttccttggcagcagggtacccagtgaggtgcttgggtctcacttctcttaccacccccagggtctagcccagtgggcaatccagaaatgtgagttgtttgaacggattgaattgtaacgacttgtgggttcttcatatcgaaatttggctgtgatccatccagtacttttgccctcatcctatattactcacagtagaagctggtgttctgtgttataagttctccttttttttccttcatctatgacaatgcaagcagaaacgttcgtgttgcggtaacaagtccgatggggtttctgtatatggggtttctgtacacgtgcttttgccaaccgggaaattaaggtgtgccgcatgaagtcagtcacttcattattggaactttgcctaaaatgaagaaactcatctagtggtgcaatttgacctaagtgttttacccatacagtcaacttcaacttgggtcacacatctcaggagcagtttgcactgttgatctcaggggctctttagtattggttcagagagatctctgtccctcttagagacactccctattgtaggaggttttgaaagaggcattctttttcctcctaatgtgcttgtccccttctgaaagttgatcctttaatcccaaacaagtttataacctatgtctaactggtttttgtgtaaatatagtaaaagaaatagtttccatatttgctttgggatcattggtctgcccatgtcacagccctgggtacattcatttcagtccatatttttggggcactttccctgtgcagagctccgggtgggtcctgtgggatgcagaagcctatagcgtattccctctcattggcagcctctttcccagagtgtctcggacagggatgtaatggagctattttaccagtcagagtagaagggatgaacaataataccatgtgcccaaatccagctggatttgaacccagatctagttgacttcagtgcctgtattcataaccgctgctttagccagtgcagcccaaactttaataggaatcacctgcagtcttgttactgcagcgtctgattcagtaggtctgcactggacttagagattcaacaaacaggatccaggtgatgctaattcctgtctgaggacctgctttgagccgccttaggttaattctttgccacgtgcctgagatggaagcaaccagctggggtgcgggactcgaagggggcttccgaggaggagaaggagtctttcaaggctcctctgttcctctaggcttttcatgccaccccttcccgctctctacctacaccattctctcccgtttgtcttattttccactctgctcttctcctggcttctccttgtgttgaaaacatcctcaggtttcatccattctaaataaagctccccttgacctcaagcgatcacttctttctttcctgcccactcactcctcagcactgatcaggagctcttctgtcttctcctcttggacacctttcaagacctcctggttactttgatgtccccgcagcctccctgggatggaacccctctccgtgagaatcccatctcaggtctagtgagggtgatggggctctgacctccatactcagcatccacaccctgctgtgatcttgaggtctcctggcggccttattttaaaaatcattttctgtctctttgcttgctcagctttccttcttaaggtccatttaagattttttaaaaaatcctggtgttcctctttataaggtgaattgttcaacatgtccatttcaggtggaatgcattcatttggcttttagaactgattttctgtttgtaagtagaaattaactcccaattagctgtgtgagaatttgtatcctctgtatctgctatcaatagaaaagaacaattcggttctgggcgaagacccaaagggctttttattaataatgcacctacgatttgtgaactgtgtttaggttcatcagaggcctctcgtttctttctggactttcaattacgttctgagcatggaaagttggcaaataacttaggcttggatggatagatacagtcattgaatagaaaaaccatattgatatttttaggtttttaagatctcacatactttaaatatttcaaaattttaagtaaatactctttcatacattctgaaacattatatctaatttatctcagccaaaaatttaagacatatacatgttgcagttgcacacctgttactccaaaacaaacaaaccgctccagccaaaacccaaatgggaaagcacttgattttcagtagcttaaaatatgttgaattaagaggtaggttatgaaagtgaaaatgacatctgaatgttttagtggttttggatataaattttcttaggaattttttgtttgagttaagctgatagtttagtttactgtgtgctatgttggttgcaaaattcagctacatttgtttattttgcaattaattcaatttgtttgcaaatattgcatcagacatctaaaccagctaataactctataggtttgagccaggttagaaaaaaaggcttggctgtaccgttaagaagcagctagctctctaaattgtgctgatagtcttaatttcccccggatgttcattttagccacacacacataaccatttggatttatgatttcatacattttttattggaagtgctgaatattttaaaattctgtgattagataaaattggtcattgtgcttcagaatagggtgactcagcttcatgggatgtactttacccaacacaggattctcccatttgagatggaatttattaatttggatttgtatcaggtcttcactccagaggcatcagagagctttcaggcagccaactattcttaaatatttcaaaaggaagttgcagtgggcacgtggcgtggagaacacagcagagcaaagtgatgtaggggccataacagccaacatgctttgtttccttcattcattcacctacctccccaaaagtccaaagaagtgttttccctgctctcggtgcaggaggaagattttatctggaaattgaaggtgtcaatggccagagaaagaaggaggaacattgattttcatgaataaccagctgtgtgaccttgggtaaattcttaacctctctgagcctcagtggcctcattcattcaaacaagggttggactagaggatttttaagaccccttttacgtattgggattctgtaatccaaaggtttcagagatcgagaataatctgtcttccttggaaaggcaacaccttgtatctggaaggtagtagttcaaggtgggagagcaggaacaaattagaaatgtgttgagaaagaagatcttttttaaaaagtcctctcactgtccttgcttgtttctgttgaaatacacagactgtttctcccttct

SEQ ID NO: 3063 - DNA, 6990 bp, Homo sapiens
gagaattgcttgaacccgggaggtggagtttgcagtgagccaagattgcaccactgcactccagcctggacaacaagagtgaaaccccctctcaaaaaaaaaaaaaaaaaaaaagaaagaaagaaaaaaaagataaaaagagctgaagatcaaagtcatgacttgtttgttgtcccatggctatttttttgttgattaccaacaattggtttaactttattgggtgtcagattctctatctttttaaaaataaaaatcatttccaaaaagtttacctgtatttatacctatcaatcatctagtatcatgttttggactgcaaaggtatggtattttaaatgggtttattcttcacattgtactataattgtctgattatacgtatttctttaaaaataccagactgaattatttgaggaaggcgtccatgttttctttgaactctctgtccctggggtctagtagagagagctttgggatgaattaatgagctcatcgtataagagaacagagactagaggcactgactttgtgtgtgtgtgtgtatttgtataaactaagtggctaacaaatagtgccaacataaactaatataaaagctaacataagagttgagtgtaaaagaaggcattataaggattagaccctcagctagtccttgacagatggagaattggatctatggatagaatatcagaagatgcttgaggaaggggaaatggtgtgaactaagatgtggagtcaggggagcataagatatgcctgaggagcagttgggatcagcgtgcccaaatgggatggtttgtgttgggaaatcacgggcagaagggcccaggtttgggctagtgtatgagcaccttgaacatccgtaagacattcatattttaccctttatgcacaaaatgatgatgttggggtatgaagtgggatggtaggtactagcagctttgaagagagtactgggctttcgttgtgatactgccacagtgaaagcaaaagggtaagagagtttaaaagtactttactcattctaccgattttttttttctatgccatacaaagtcccagccactagggatacaatattgataagagtcagtgagtatctgccctcaggagctttagaagaggcaagcagcagacatttacaatacacattatcagtgctaaggggtccatatgacgtgattagtcattagaaggaatatctgacacatccttggaggatgggcagggaaggtttcccagaataagtgacatcttgctgagtcctaaaggataagtagcaagttatagaaggaaggaaggcacctgaagaacaacaacaaaagagctcctagcgtgccacagagaagagcgtggcactttcaggacatttcaaacagtttaacttggagaataagggactgaaggggaggagcagaaagtggtgacggggggaactggaaaggtcagtgggctgacttgcaaccctaaccagctcgttattaagaatggaatattcttaatatctaaaatattcttcttccttatatctcctctaagatgtttatcagtttacattttttatactctgtcatcttaattcattgcattctcttttcttcttagaataagggctttcaaaaccagtgaacttctgtccacaaagtacagggactctagttttcttcactgataatctaaattcagttaatggatttctaatattataattcaggcgtttctagagtaaaacttgatttattaaaaaaagtatttttctaataattgatggattcatttaccactactctatttcagagttttgcttacgtattttgccaatgggattattttgcagctgtgtttttgagtgggctgtttgtcagatttcagagaagactcaacccagaggcatgctcttccttcttccgtggaagcagaatgactccttgcaataatgaagagaatacttgacatctcagattgcagtgtttgggttgcagtgactttatggacagctagagcttccatggttaaagaataggtacctttacagaggacatttgcatgccgaaggagactcaccttgaagtgcctctcagaacaaaatgtctgccatttatttttaagtaaatccaagcttccaacctaaggatcacagaaagcgtgtttctggaagtcttagaatagcaattttgttcctacttcttgctaccaaatgatcagacacactgaagtcctttctcagtgtatcccggtacatagtctagaatgttttctttttaagtgattaaagaaatggacatttttatgtctagtaggctttatttataatgtaactacactagaagccaaaatattttaccattcagtttaatactaaatacctagaattgccatttaaatattcattgtgaattctaccctttagcaccgtaacagaaccctctttggaatgtttcatgcttttgactatgaattctaatttttctgccataaatacagctatccctattttagttattgcaacttacctgacatatctctgcttattcttagaactttttggatcactttgttttatgtttgtacccagaactgatagaggatgggagtaactgcttctaggatttctctttactccttgcagcacacagcattttttgctctcccctgaagggcagggaatcactgcctcccttcttttagcccagctatttctgtaagatatcttttcctatttgtttccaatagggaagcctaattctgttgtattagtccattttcacattgctataaagaaatatctgagatgagataatttataaagaaaagtttaataggctcatggttccataggttgtacaggaagcaggatgctggtatctgcttagcttctggggcgacctcaggaaactttcaatcatgtcagaaggcagagcgggagcagacatctcacctggctggagcaggagcaagagggagagaccgggcgggtgccacacacttgtaaaccaccagatcttgggagaatggactcactatcacgtgatcagcatcagggggatggtgctaaatcattcatgatatccacccccatgatccaatcaccttccaccaggccccaccttccatactgaagattacaacttgacatgagatttgggtggggaccagatccaagaagccatatcagttgccgtgaggagaaatctgatttgttgtttcttaacccagctctcctcactggaaatgactaacagagtctgacattatataacctctaaacctgagtttttggcatagcacattaccatatttccctgtaccctcagcaatgcgtagagtgaatttggtaaagatgagcgccattttaactagaaatttctaagtgctatttttaatccctccccggctggaaaggtagttactatctgtgggttaatgtttctgacttcaattttttttttttcctgttcagcatgaataatttggggggaaaacaattttttgtttttttttttgcttggtacttccctttcaagaaacatcaagtacattatgaccattacttagaaacaatgcatagtttatttgggtcttgtgtgtttggtatgtgtgtgtgtttttctaaacagatgttgagtaaaatcttcagaaggtcatgtgtgaggcagaatacttagaagaatgcttcagagcccagccgactttaaacaacttgctaaatccattgtttattaaagtgaaacaatggaaaagaggaagtggcagaaagctgcttggttaatattaaatgaaagtcatctctctccccctcataagacatgtcaaaccaccgtaaattacaagctagatgaagttggagagctggttcagaaatctttgaaccaaaccgaaacaaaacacagccctaatgacatgagtttcttgtaaactgttttaccaggttgtttactgcagaacagaggtgagtcaacaagagatagattctcagggtcaacctgagaatgactaccaaatgggagaagagatgtagctgatagaggtcttgagaaaagtggatttaggaagacaaggaacgttttcctattgctggagaagaactggctctactttagattgactgaatgctttttaatgtttctttctttctttctttcttttttttgttgttgttgagacagggtctcactctgttgccctggctggagtgcagttgcacgatcatggctcactgcagcctctgcctattaggttcaagtgattctcctgcctcagcctcccaagtagctgggactacaggcatgtgccaccatgcccagctaatttttgtatttttcagtagggacagggttttaccatgttggccaggctggtctcctacttcagacctcaagtgatccacccgcctcggcccgtcaaagtgctggtattacaggcatgagccactgcacttggcctaatatttaagtaagatcaaaacattcactccaatcaggcttagtactttacaggaaaccaagccactaggaagaggaagcaaggttggagggataagaaagaaacctggtttcctttctatgatggctaatgttatgtgtcaactttgctagggcgtggtacccagatatttggtcaagcacctatctaaatgtcactgtgaaggtatattttagatcagatcaatatttaaattagtagatgttgcttaaagctgattaacccccataatgtggttgggacttcaacaattagttggagacctaaagaggtaaaagactaaagcctcttgaggaagagagatttctgcctgtcaactgtctttggactcaaggtacaccatcaactcttccatggacctctatcttcctggcctatcctgcagattttagccttgcccactccacactcgtgtgagtcagttttctaaaatctctctccctctctttctcccctcatccatccttttggttctgtttctctagagaaccttgactaatacacttgcagaagtccacagaaagtccattactccagataccacctaggtgagtgccaactgattctttctctttctttggtcataatgcagtcaaactccctaagccatgcagtcagctcacacctgaatcagcatagtttctagagtggctcctcattgttgagaagtcaagttcagaattttataactgagtggtggggatcattgtaatctggcctcatgctctctgtcctaggtctctttttacaacataaaacctctgttgtagatcaatagtttcttttactctacttgtatctctagtaagcctcacattgccattacttatcctatactattgattggatatgcttttaaattcaactggagtctcctggagagaagagaccaagccttttactcattctgcccgtcccgtgatgtctactagagagctaaacacacaaaaatatcatccagttcatgacaattgatggctgaaagaatctcatctggggttatgcaaattaaccctacatctcctagacccataggtgcatgttaaactgtgcagtcttctatatgctttctattaagggaaatgtgacttcaatgtgaacaatggccatgatttcctagcagttattgttcgtgtcacccattagtagattgctgtttactgccttctaatagcttctggtagaattctcttttgaggtgttgtttgcttttcctatgctttaatatttcatcagtttatatcttagagtttaaagacatttagtagaccccacaattccttgcacatagtaggctctccatgaaccaggccataataaaccagtaagccaataagctaagtgtaaacctgaaagatacaatcccaaacactataatcctgaatgttgaaatcctaaaagatcaaaatccccaaaatttaactctggaaaaaataatttaaaacattttaaaaaggcatttacttacattttaaaatggggatttatttgagaaatataaaaacatgacaggacacttcacaggccactttacacaataaaataggcaagaagaacgtacatatttttgcaagcataaggattcagttatgctaatgacagttgcactggtacaatacttgtgagcagatgaaccacatctataaagaaatagataaaaaagggaaatatataaacacatattataaatggcaattgtgtgcacccaactttatcactgcagtcatctgaaatattgtgatagacaacgtaagcctttgacaagattgttcaaaaaccatgatgggtcaccactgcatatgcacttgttcaaaaagccagatcttgagaaattttatctttcataaatgcagatgtaccaaaaggacatctcttcatttactgaggaaattttaaagtttttatgtacacgcacaatgttaacatgcaacgtcaatgttgtgataatggactttcgtggagtcaagtttgcaaaaaatgcataaaacagattagaatgctctaaaagtctctatataacttatacttccactactggaaataatgtgaatacgaaatacatagtgtagaaaatttttaaaaatgtgctgaaaatgaaaaatggtgaaaaaaactaaaaaaagaaaaagggaaaaaactgaaaaccaaagcacaataaactaaaaagaaaattcgacatataaaatagtggattacagggatagtttatgggcattcacatggagatagcccataagaactggcctaacatgatgcaactatcctgtgattatgattttcaggattttagactttagagattttgatctttcaggatttcaccattcgggattgtggagtttattgctgggtctttggggattatggttcaaatccgctataaagagtatggaaagatgtagtactcttttttgcaatagtttatcaccaactttaaccaagagaaggcccctcatcctgtctaagcctggccatggaccatagtgggaacaaaggaactca

SEQ ID NO: 3064 - DNA, 944 bp, Homo sapiens
ctacatttcttcctgaaggtggcagtattttagtgacaaaaactgacaacaagctgaggaactgtaccagagctctcggagatcaacaaaggtgccgcttttgaatgtgaaagttttttcaagacttttctatttcttggtttgaatcgtgtgcctgtagggacacatgctacctgcttactggacagtgactacttaggataaggactcaggcaagtaaggttgcattttagtctctcagatatggggggaaaattttggtgacattggagagagagataaatgaaatattttattaaatttagaatttaatgtaaagtagcatatacagaggcaagaaacagaataatgtgttttatggttgtcagctaccatctttaattgacacacaagtggagaagataaatagtaatttggaaccaaaactcaggacgtcccaggagaggctagattaggaattctttgatttgggatcacgaaaatgaagtatccatattttaacagaatgattagtggcagaggaatcatctaagaaaactgagaagactctgccagagtgatgggaagaaaactagatgagaaagcaccattctggaagacatgctcccatgaaccatggagagaagaggagagggaagaagttatttgtgatgtcatttgcctgtgtcatggcctgccttccctagatattgtcctaatgtgagcatcacacctaaggtactgaagtagagttctggctgttccttacggacatctctggtggacctccatctgtttttgatacaagtcagtcttttcctggacttttggtatcatatggacaatgtcagtcatttggctgaaaagttcaacttgagcagttttaacatcttggagcactactggaagattcatttttccgtcataactatcatcatcttgattacaatcatcagatgtcacag

SEQ ID NO: 3065 - DNA, 8403 bp, Homo sapiens
atttcacttaaagttgcagtttccaagagcctattgaggacacgaaggctgtcaaccttgaggctacataccttgaggctgtcctaggctaaactctggtgatccatttctgataacctctttcaaaccttcatttgaaatgctttttatcaccccaagtggaatgtatatgaaaccaaaccccttgtttttattcccctttccgacataccttttaagagtactaaatacataatagcgttttaagagtactaatatttctgccaaccagaaaacctcaccaccatctttgattccccccatcccgcctacctttttttaaaggtctagtgatttttctttccattgtgtgcagaattttttccttctcttatttgtcttaacacgggtttcatgcagctgacctcctgattgatccagtggctgatactccccactctgccctgataattggtcacagtgccttgatggtgtttatgtgttacacaaaaatatgtaatgacttccctcttgcctctgagcttgtccacaaacataaagaatttcaggcccagtttatctttctcatcttgccccaaccattcttctgatggtttacttcttgttctcagaacatgcctatattctttcacattgtcagtacagaaaagaggtatatgcagaaaaggagtgatgtattttcaagttagccactccatgagtgactagtactgaatcccactgaaatcccactgaaacttcccaggaggcttatgaaatgaatcttagaaccagcttccatattggtagccctacagctattaacttcccatacttccaggtagtgaatgagtaaatacagagcagtgctttttggttggacctgcctgaagtcagtcacagcttacaagaaattgatcctccatagctggcataagatgttgggtcaggaagtttttgaaatggtacatagcatgtgtctataatggtgtgaaagttaaaaattccagaagatacagaagaatgtagaatgagaagttacgtctcttttccttttttgtattctagaaaaagtttgccaacccctgttctagtcattctggttcctttcctggaaacattcatcattaacctgtttcttgagacgtggtgtgtatttatgatacttacaccatccacatgtacacatacttagtatatactttttctcaacttcaaaatatcttaatgattttctatattagtgtatagaacattcttattattcttttagctctataatattccgttatgtggatctaccatttatttaactagttttctatcaatggacatttagttgtttttttctttctctttgttttgagacagggtctcactctgttgcccaggctggagtgcagtgatgtcatctctgctcactgcaacttgtacctcctgggctcaagcgatcctctcacctcacagcctcccaaatagctggaaactacaggtgtgtgccaccacacccagctacttttgtattttttgtagagacagggtctcactttgttgcccaggctggtcttgaactcctgggctcaagggctccacccatctcccaaagtgctgggattacaggcatgagccactgagcccagccgacatttagttattttgtctctttattacaaatgatagcattacatttatacatatttgtaatccgaaaaggtcaattccttgagtgtttctgtcttgaacttttttctgtaataggcctcccatactcattgcccacagtttgcattcagttttattgtagtgggtcaggatcattaagagctggagttgctgggataggcctttctcaagaggttctacttgagttggaccttgaggaatctggatgaagagggggataacgaaaaggaggtgggaagggaaaaaggactgtgtggctgaaggcttgtggttagcaaaagcctgtcatgctttcgagctgcactgcccagcactgtaaccatgagccatgagtatgtgtggctgtgagcacttgatatgtggctaatccagagttgaggtgtgcggtgagtaaatacctaccagggtctgaagatttaatatgaaaaaaagaatgttaaaatatctcagtagttttaaaaatattgcttataatttaaatagtagcattttggatatattgggttaagtaaaatgttattaaaatttttacctggttttacttttaaatatatggctaccagaaaatgtaaaattgtattatgtggcctacctttgtggctgcatgattttttgttagactctgctctggctcatccttcaggatggagaagcaggttcatttggggaacctggtatgtgcttcagtgagaactgttggatagttaccagaatcaagtatttggtatgaaaagaccattacgtttcttaaaacagtgaagtaacatgaaattagtttcaggaagattcaactgttcatattttgtggcactacaaaaactaattgagcacttactgtgtactgagcactgtcctaaagggctttattcatttaatcctcacagcaaccctttgagacataggtagcccttatgttacagatgaacttgagtcacaggggggtgtacctattggcccaaggtcacgccgtaactgataatgccttggctatgaactggcagtctgattccagagcctatacacttaaccactacactgtgtccctgtgaaggtgaattagacaaagaagatgatccttgcacatagcagtgaaggaatggtaatggatcactttttaatcctgttaatattttaattaaaaaagatcttctatcttcacggtaccccgatacttttcgttttaagttcttgtcaccatgattggttgtatgattttggccacccaggaccagcttagtatgtaacaagctttatgtttatttttcttgtgttttgtgtgtaggaaggttttaagaatatgtagcatcgcttaatgatggggatgtgttctgagaaactcattatcaggcaatttcattgtgcagacgtcctagagtgtactcaacacaaacctagatgtataacctgctatacacctaggctaaatggtatagcctatggcttttaggctacaaatctgtacagcgtgttactatattaaatactgtaggcagttgtaacattttatatatataaaaaaacatagaaaaggtaaagtaaaaaatttggtactgtaatcttatgggactactgctgcatattcggcccatcattgatcaaattgtcatcatgtggtgcatgtctgtactcttaaagcaaattttattttatccctacattttacagaggaacagagattaaataatgtggctgaagtttcatggctgggaattataaaaccatgagactgtgtagctttgatcactattgtgtttgatttaaaaagtaaacattttgtgtttgagcttagagctaagtgatcataaatggtgtatatttattcctaaaatttttctgggatttcagatcctgaaattttatacaaacctttaaaaagcattttcaggaggaaaatgtgtcagagccaagttgaaatttgaaatgcccttttttttttttttaatataaggattcttaatattggaagagaaaggaagttgttgttttgagaagggggcttgctccatcacccaggctggagtgcaatggtgccattacagctcactgcaggaagctcgtttttaaaggaccgtcaacgtaggtggaaccaaaataatggagagaaagcaagaagcccttaaaatgatacttgcttaattaattaaactcaattcattgagagccagctgtcaaggcaacaaatactttccattttgttaaatttctccagtatttagctcagaggtctagtcttaatggtaatgcctaaatttttctgatctttactgtggaattttataatctttatgttatgtgttaaggaatgacatgcacactaagaatttatgattttattcttacctgtgactagggcctttgtaataaatctgtttttacgctgtccaaaattactatgttcttgggtttctttttctttatctcttgggtttctagagattcataagcttaaaaaattaaaaataagttattaggattggaagagacctttggaagtggtttatctagcccagggcgtctcagtctgggaactgttgacattttggatatataattcttggttgtggaagggctgtcctgtgcattgtaggatgtttagcagcgtttctggcctctacccactagatgccagtagttcccctttgattgtaactaaaaatgtccgcaagcattgtcagatgtcccctgggagacaaaatcgccctggttgagaaccgcttgtctagcccatttcctgggagtggtggttcccttctctggaactcagacgttgagaagagaagggtatttaccacctcctctagcagtctgttccaactttgggtgcgtctttggagacagaaatctctcctctctgttaagctaaaacctgccatctctaactttttagttctgcctcttaggaccgtatggattggatagattcacttaaaaactttcccaattattggaacatgataccccgtccttcctggtccctcacgggattgttttagagccaagtcagcaaacttcttgtagttgccatgtatttgcaggctaccaatctctgatgcataatcttcctttccttccctccctcctccttgcctcccaccagccttccctccttttctctttcttcttatttcttgtaacttcttaaaaatgtaaaaaacctttttttgctcttataggctgggttttggttcagtaacttgccatccctggttttagagtctgacatctgctaatcttcagagggcagtgcagtgctttagaactgtatatagaactttggggaaggtctgagcagcatagaataacgttggacttgtcattaactccttcatgcgaagagcttactgcttttttgaagctttgtcacatttacagcgtaatgacagccaagacactggtttgtctttttcattaggccactttaccttctttttttttgagacagagtttcactcattgcccattgtgcaatgggcgcagtctcagctcactgcaacctccgcctcccaggttgaagcaattctcccgtctcagcctcccaagtaactgggattataggcttccgccaccatgccactttaccttctaagatatttttagacttcagcgtaggacgatctgtgttaacagctgtattaaacttgtcttagctggaaccaactctctataccctgctgaggtttgtgggtcttactctgtccttcagagtgttaatgaaatttttcttagcttcccgtcgttcaaatgttttttaaacatacctgggtctttcatgcaagttactaatacaaatttgaatgagatgtagctaagaactaaatctgaaatcacaaatgcctaacaaataaggtaattttggccaagcgtggtggctcacgcctgtaatctcagcactttgggaggctgaggtgggtggatcacttgaggtcaggagtttgagaccagcctggccaacatgatgagaaaccctgtcttgactaaaaatacaaaaattagctgggcttggtggtgcatacctataatcccagctacttgtgaggctgaggcaggagaatcgcttgaacctgggaggtggaggttgcagtgagccaagatcacaccactgcactccagcctgagtgacagagtgagattttgtctcaaaaaaaaaaaaaaaaagggaattttaatgcatggatatagcaggtctgtactctgttcttaaaattgttttggagaattatatgtaaatctgcattatacatgtttagtatcctcaatctaaaatccacagtgctccaaaatctgaaacttgagcactgacatacatgaaatgctcaatggaacattttggatttctggattaggggtactcagctatgatataaatattccaaaatctaaaaaaatccaaaattccaactacttctggtcccatacatttcaggtaagggatactcaaattgtagcaaccatcgtcagaggttaccgtcgttactgatggctttcagagtgattagacagtaaataagtgtaatgaccatgacaagaaaattttcaaaaaaactaaatcttatttacgtgcaaaataaaataattttgaataatgattttaagaagtaactgattttttttttccagaaaatatttacaccagcagctccagttcataccaataaagaagatcctgctacccaaactaatttgggatttatccatgcatttgtcgctgccatatcagttattattgtatctgaattgggtgataagacattttttatagcagccatcatggcaatgcgctataaccgcctgaccgtgctggctggtgcaatgcttgccttgggactaatgacatgcttgtcagagacaggatttcgccatgttgaccagtggtctcaagctcctgggctcaagtaatccgcccgactcggtctcccaaagtgctgggattacaggcatgagccaccgtgcctggccagattttgtttggctatgccaccacagtcatccccagggtctatacatactatgtttcaactgtattatttgccatttttggcattagaatgcttcgggaaggcttaaagatgagccctgatgagggtcaagaggaactggaagaagttcaagctgaattaaagaagaaagatgaagaatttcaacgaaccaaacttttaaatggaccgggagatgttgaaacgggtacaagcataacagtacctcagaaaaagtggttgcattttatttcacccatttttgttcaagctcttacattaacattcttagcagaatggggtgatcgctctcaactaactacaattgtattggcagctagagaggacccctatggtgtagccgtgggtggaactgtggggcactgcctgtgcacgggattggcagtaattggaggaagaatgatagcacagaaaatctctgtcagaactggtagtttctctccctggctcatcttgcatgcttgctctgatggaaaaggtcacctggaaaggaactgaggatagccttcagccagcaagaaaccaaggccctcagtccaactgcccatgaggaactgaagtgtgccagcaaccactaagtgaggtggaaacagatgccacctcagttgaactttgagatgactgtggctcccaccaacaccttgattacagcctcatgaaagaatctgaagtagagggtccagctaaactgtgcctggactcttgactcaccaaactaggagataacaagtgtgttgttttatatcactaaattttggagtaagttgttacacagctatagataactaatatactatacttctgacctgatataacaaaaaagaaaccagagttccaattctgactataatttcccagccagtgtctttagggaagatttttttttcccctcttgaaaccccaatttcagtattttcaaagtggggatattacctacccgataaaaatatctgatgtgtaaattatatttcataattcatataaataacctagccagagactagtacatcactgggaataaatggtagttttgagatcagacacatctctcatccaattttctttttagaggcaggtgagactctaaaatattaaattaaaaataagtagtaaagtataatcacatccccgttataagtgaggaaataaagtatttttgaaaaatagttttcctattaattattgagtttcatcttttattggggagaaattaaaaataattttttttaattataagaaacatactttgtcagcagctgtctcaggaagagactcttcaatgccaagttctcgtcgtctttcagccctaacttctgcataactacaaatggaaaaaataatcaaattttagtgtctggtcattcgtttaaaatactgcacagctgtaactattcagtgttgttacgtgtctcatctgttcatctagactatttgctatgtgctacacaaacctaaaatatacctataatgtcttaatttaacttgcatttttctaggtatcttaaagtttcatacactgctgtaaacgatccataaccacacaatacttaaattaagaaaaataaataaaggaagtgtatgcttatctacctacagttttccttttacatgactgacattactacataaatgacagtaacaacttctgctgtaaagcacaaaatttatatcaagacttatatatctatatcattcctatatttatatataatgcctataagtaaatttaataatatattgaaaggat

SEQ ID NO: 3066 - DNA, 2147 bp, Homo sapiens
gttgtgaccagagcggttgcgggctgagcggtttcgagccggcgtcggggagcggcggtaccgggcggctgcggggctggctcgacccagcttgaggtctcggcgtccgcgtcctgcggtgccctggggtctcccgaggaccttgtacccgcgcggcttccttgggctggctttggacgacgctttcgccttcctgctgcctaggatccgccgacatgaatcccatcgtagtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaaaaacttgggaaccgtgggtgctgttgccttggactgcaaagggaatgtagcctacgcaacctccacaggcggtatcgttaataaaatggtcggccgcgttggggactcaccgtgtctagaacaatcaccctttttgagcaggagctggaggttatgccgacaatgacatcggagccgtctcaaccacagggcatggggaaagcatcctgaaggtgaacctggctagactcaccctgttccacatagaacaaggaaagacggtagaagaggctgcggacctatcgttgggttatatgaagtcaagggttaaaggtttaggtggcctcatcgtggttagcaaaacaggagactgggtggcaaagtggacctccacctccatgccctgggcagccgccaaggacggcaagctgcacttcggaattgatcctgacgatactactatcaccgaccttccctaagccgctggaagattgtattccagatgctagcttagaggtcaagtacagtctcctcatgagacatagcctaatcaattagatctagaattggaaaaattgtcccgtctgtcacttgttttgttgccttaataagcatctgaatgtttggttgtggggcgggttctgaagcgatgagagaaatgcccgtattaggaggattacttgagcccaggaggtcaaagctgaggtgagccatgattactccactgcactccagcctgggcaacagagccaggccctgtatcaaaaaaaaaaaaaaaaagaaaagggaaaaaagaaagaaagcagcagcatgatcctgacatgacagatgtgggagacccacagcctgcagacactgtgggctggaaggtgggaagggaggggccggtggaggtggagctgtttgaaagtgacacagcagcagtagaagcagtggtgggcgaagcccaggtgaccctcagaacgttgcacaagaacatcagggaaaagaaccagaatcctttaaggaaaatgttcttcatgtatgagagactaaagtgatttttctaagaaagttcagcccttctctgacttacctggacatttctagatacttccaaaggaccctctgggaatccatagcttcctaatctggagatgggaggtcataagggagacgctgtggggttccttgaagtttcttgggttcacagaggagccccctcacttggtgttctcccgtgagccagcctccacctgccaaagacactctggtcctcgtatagtgagtaatggggctcagggcctctccaacaacagagaggagctgatgctgtagggctgaccccgtgacttcctgagtcctcaccctgtccagtgctttgagattcttcccacctccccatcctcaccagccggatcgggcgctgtgcagtgtggtcagcatggtgaagaaagtcatttcctcggtgggcagtattcctctttatctctcattacactggaaatgttatttctgctgtatcatccgtgctcaacgttttagtctgtcaggctcaccttctctctggaaagaatttgcttaacttgacattccatgtgccgctaataaaatatattttgaaag

SEQ ID NO: 3067 - DNA, 6173 bp, Homo sapiens
gtgtgtgtgtgtgtatcttttaattgccatgtatttctaccaaaaaatacaaaacttaattttgcgtcctgaaagaccctcgtttgagaatccctgcttttatgttctgctttagtccaggcaacagatagcttaggttgtcactttacaactggagcagcaggtagggctgagaggctcgccatactccaaattaccagtgccagtcccatggcaccaagacaggaaaggcaggcactcaaacagaaaggtagtgcaattaattgcttcaaattctttactcagggctgcccttagtcatgatcaaataaaatgtacacattgtttggcacttggtaaaatgttgtttcctttccttcctccttcccctgatagactctccttaggtacaaaaaagatgaggctgtacacagagctaaaagtgtacacctttgaaaaaggtgtctttttcaaagagcaccttcaccccttactggactaaactcaatccaaagctcttttctctaagctttataacacttactgcctggatgagtcatttgtcaataaatacagaatgtttgtataggtggggttcttgtatatatgtacgagcccctagagtctctaacttaaaatttatttttgctttagaagttcaggaataaggaggctttgatgatcaattttaacaaccgcaatatataatacagtaactaatggttaggtgtccaggctagcccagggcagcctgtgtgattcatgctgctggtgaaccatggctggctgggcgaactagatctggaattctgtggtgcctaagggagggaagggaatatttcccacactatctcatcctgccctcactatcgctacccccaatctctctctacattctaccccacctactttgctttttctgtgaaagaccagctggggcaaatattttggattaagtaaaatttgtcttgggtaacttccctaaaatttagtttttaattgaataatcttggttaatccatgagtaaataagcttgtagagtatagtcagcctcactgtgagaagctgacaaaccagaaaaccagaggaatatacaccaattccttcctgtcctgcaaacctctgcttcttgaggtttttaaagagtgggtgcctaattgattagtcattagttattgacaggaccaaagagatatgcctggctcctcttggaaaaaccaaaagactgagagggaaaagtacaccaaaaagatacctaaggaggcagactgctataaagaaaataattaggagaagaaatcatatgttttcagatgaaaagaatctgaggatgaaaaaagcagccttttcaggccgatgatggaaagatagaaactaaattcagaaggatcagaagacgattagaagggcaagaagtcatagaagaccaagatttcccaaattaccaaaagaaatcaagcccagtcttgttcaggctgcagaatgagaacgcccttctagtaagatccgtacaatgaatttcacaaatgttgatttctttctgtcctctttgagcccataatcacctccttctacttgcacaaccttgaccatcaccactacctataactaataaccagttcttatgttcccctcaaggcataacacaaaaatattttctttatgattactttctctacaaaaaagagggagagagagagaaacaagtcaggggacttcgttggtgagtgtagaccacagcaagaacctaaaatcctagtgggttgttagtatagacaggctgaaaccactatcctgaagtggtggttctaggtaggtatgcccatcagaatcatctgtggataagtattttcagtaaatacacatgcaggacctctacctcaaatgtactgaattgaacttcattgctggagcttaggcatttcatatttgtttcctaagctgctataacaaattaccacaaacttggtggcttaataagagaaatgtattctgtcacagttctggaggccagaagtccaaagtcaaggtatgaccaggattggttccttctggaggctctgaggaaattctgttccatgcctctctcctagattttggtgactgccagcaatctttggtgttctttgatttgcagaaacatcattccaatctctggttctgtcttcacttgaccttccctatgtctgcgattggtctcctttctgtctcttttaaggacacctatcactgaatgtagagcctatcctaatgcacaaggagctcaattataccttaattatatctgtaaagaccctttttccaactaaagtcatattcacaggtaccaaggtttaggacttgggcatatctttggaggatacagttcaacccattacacatatgcattgaagggaaaaattcacgccacaactgattatcctataaagaatgttggcttaacttaacgcatttaacgcaccatttctccagcacttaggaaatgctaggagatgcaaagctgaagctaaataggcttctttattgcagaacctctcagaggctctcatctgtttgtgtgcattataaatgtccaagagaaagaaaagaatcacaacatttcctggaaatacttgaccagggaacttcttttcaagggattacctgttaactacctcaatggacactaatgactaaaggaatacatgctgctggtgatcatggcacttccaaactatgctcaatggtgtgggcatgagtctaccacagtgtctaaacactaagattgttaatgtctacacgacctctccctggatatgagcacacatccttcatcaaatatccacagtggtttccctagaggatttgcatatgtgcatggatttttagatgtctagtctctactcttgtcttcagccatttttgtagagagaaattggcaaaatattagcatgaatggaagggaaaggtggccaagataatacattatgcctttttttttttccctgaaaacagcccagaatatctgaaaagggagaagtgacttaatcatttctattcccacaattctggtcctacaaaattgatatcagtatatgattcatccagagaagttcacagtggtatttttttaaaaaaaacttttagaggttaccagggcatctcactattttaaaatttaatacctcaagggaaataagcaactaccttgaatttttgcatgaattgcatttgagaataactgaatagttggtggaataaagttgtttttttaaaagtaggcatattctagttaataaatataaaagaaatggtaggattagaaaaatcactacattacaaactctaatgacataatagatttaagcaagatgatcagtgaatgataaaatatttaggtatgctgtcttctaggtgaatcaagctgacaataccttggacccacgttaatcttaccacatgatattatatgtctcctgatacttaaaataaatatcaaataaatcttgataattgttgaaaattgttgatgaacatatagttcacagcaccacccatgatgtattctttccatgagaattgatctgaatcaaagtaagcctctaggtctaactgccagtgtgtaggaaataccagggatagagaaacatttttaaagtctttaagattgcagtaagctgaaagaaattgtctggtttctgcaataacagcaacaaagttatgtaataagaagagagagggagaatcacggatttatacaaacttaagagacactgtgtgaatctagtttgtatcctgatcaaacaaattaactgtcaaaagatgtcttttgaaacatgatgggaaatttgagcataaactaagtattctacgatattcaggaatcattaccaatttgttagatatgatgttggtatgtttttttaaatgagaaagtttttagcttttagagatacatacctagatagttatgggtgaaagcatatcattaaaaaaaagatagtggaagtacacaaaacaggattgctatatgttgataattgttgaaccttggtgatgaacatataggaattaattaaaccatattttctatttttatgtttattttgcaaattccaaaataaaaatagaataatccctcatgaacagatggtctcaaatttcatcctcaagtaaacacaattcacattctcaggggaacccatgagaatattatgaagtatatgtctatctcatttcattatatatggaatcctaccattccttttgtctttattactagtggccagagttctatcttgaaaggtgggaaatgtccttatatgaacagattagtttagagaattattgtgagaaaaccagaaaatatttgagttctagctaactggatattgaatgagttgtgctgaagtatgtggtcataaagggttgataatgaaatacttgctttccagtggcaaggaaaaataaatgtcttagaatttacaaggtcattcttgaaatcaatcaacgtgggctgaagatctcattgcttctgttatctggcacgatggtatttgtttgtgcacagctctgttgatgtgagctatcaaatatttcttagagctgaaatcatctaatagcaaacattgctatgtcccaatggagattccaagactctttggccatggaacatttacattctatcccctttcatcactcctgaacaaacaaaaacaaaaaaaggaaagataaccaataggctttttatttaattgaaaaccaaagagagagagaggaaagaaccagttagttgccattttctaaatgcaggcttttgtttgtttctgccttctaattctttgctcttgaagctatagctttcaagcttgtgtatacaggcccagagagaacatttgaaatgtggccaccctacccatgtccatgccactcttcctgcctttctctctgcctacttctgctccaccatcccaggtcaggggcttggaggctgacagcattacaagtaatatagtcgttcaagctcatataaacaagatgaaatccaaataataaccaaaatgtattttatttcaaggactggactactcagttccctcagtttcgctgaccgatttctaggagccctaggctcagctcttggttgtctcagaactgaggagagtactcatttgcaccatatgcatctgcttgttagcctgtgctaccaaaattgattcattacttggccttctctgaaaagaaaaatgaaaacaaaaatgcactcttaaaaataattattaaaatacaaccaggaggtatgtgcctagacatggctcaccttctaccaaatcatactttatgattttccacaatattatcttctattcctcctgcccctaaggttccatggagcagagcaagttgaagaatgttaaggttttactaaacttttagaacagaggctttggggaagcaagagagaggtacactgaaaatgaagtgtctgtctctgcttctattaatgtcataggactagaagttgacctcatagctgattacaaatgaaccctgcaaattgaaccccagcacatgcctctcattatccattcttctctttgcaggatggggtccatgctcacatatcaagaaaatggagtcttacatgcaagcctaatgcagagtagagaagctcaccaacttgaaggaagcatgaatgaaattacaaggaaatctagcttagaaaaattaaccctgtagcttggtttttccactctttgctcttggcaaaaggatcttacgggaaaactggagcttagagaacttatgtaacattactagcaagttgcacagctgggattcaaactgaaatccagctagcttcaaagactgtgttctttctgctgctgcatactacccctacctaccaaggctctgagattagaaagcaggatgggtgtgttttaaaggaaataaggtaggaaagttttcaaatattagaaactctgcacaagaagattaggtcaagtttcccactgaggggcccttgagtatctatgaactcgatgaaaactctgagcttctcaggaaggtagaccaaagggaaaggattcatcaaaatggatgttagcactatgccatgtgtattactccatcctcacacggccaaaaggacatacctgagactgggtaatttgtaaggaaaaagaggtttaaaaaagttctcttcgatggc

SEQ ID NO: 3068 - DNA, 5771 bp, Homo sapiens
gtttccccattttcagaatatagaagaattcataactgctttttaaaaatacatgtacagttcctttttaaagccttgatttaaatatctgatccattgggaatttatcctggattatggtgtaagaaatggatccaattttatctttctccatatggctatccagttatctcagcaatgtttatttaactgtccatcttctacccagcaatttgagatgctacctataaagcatactaaatggtcacatgtgattgtatcttgtttctgaactttctaccttttcattagtttgtctgcctattcatgtgctaatatcaaactgtttaaataataaagtttttaatagtactttctaaagaaatctgatatagtttttccttccagctgttgtcctgaacattgcttttcttttttagagtttatctggttattcttacttgtttttaaattcctaatgaactttataatcaatttgtttaactctagaaaaaagcctggagacattgaactaagatcaaatttaatgtattaagtaagtaagaggaactaacgtctttatgatatttccttctctctctcccagatgatggtatttcttttcatttatttgtgactagttctttcaaaagcacattatagttttgctcttataaatattagacacttctgattaagttgatgccaaggtgctttcttcttttttctctattttctatcacaaatgagatctattattcatttatatattctcactgtttttgtttatatatatgtatacatatatacttatatatgctattgatttttacgtgccattttataacattattttatcgaattctcttattgtttgttatatttccccatggattcttttgagctttccagatatataatcacatgtcctctaaataaatagttttacctctgtttcccaaactgatgcccattagttgctttttcatgcttgatgattacattggttaatgtatcaacgtacaaaaacactgaatgtttgtttccttccaaaatttatatattaaagccctaaccctcagtgttgctctatttggagtaaggaagcaattaagattaaatgaagccacaagagttgagcccaaatccaataaaattagtgtctttatgagaggagacaccagagaaatatactatctagcatcccccttcactcccccaacaaacacacacacaacacacacacacacacacacacacacacacacccctctctcccctcatgcacacaaagatgaggtcatgggaacacacagtgagatgatagccacctgcaacccaaggggagagcctttgccaggcacccaccctgctggcaccttgatcttccagtatcctgaaatgtgagaaaataaattcgattgtttaagcacccagtttaaggtattttgttatggcagcccttgtatactaatacagttagtgtctgcaatatgctaaatgttgtggatatagtaggtatctttgctttgttcctgcctttcaagaataaatattataatgttaaatattaaacattaaagtttccaaagcttttgggatgatgtaaatatattttaatatgctaagaaaatttactgattatttttaacatgaatgggtgttacattttgtctaatgcatccactgcattaatgaagataatcaaataatttttctctttagcttggtaatttaatgacttataataatggatttcctaatactaggctatctttgaataacttaataacttaaatggatatgatttgatcatgtctataattttaaaactgggctgttgagtattttggatagtattttaagatttagatttggttttaaggagaaaattctggcaatttttgacagatatggtagaaagaagagagaatgaaaaataatgttaacaatctaggtgaggaattgctgaggagacaaattaaggtaagagttatttgtaatttctctgttttatgtcagccttcttttcagtagtctataaatccagggagaacagggcctcactgcctttttcactagcatgtctacagatcccattacagttgacaatacattcactcatttaatgaatggatttaaacaatcttaaggaataggaattaactgaagaagataagcctaggtgatacttaccaggtagagtcaacaggatgtagggactaaataaatatgagagattagagagacaaaattacctactattgttgccactaacttgaacagggaatttaggaaagagaactgatttggggataggtaagtaaggtattgattcaaaagatttggatatatcatcttcaggtttttataagacatctgagtggagacatccagtaggcctggctctattttctaagaaagagccctacatggaatcatgtattaggttttcactttttgccagatactgtggtaaatgcattatgaaaattgctttagtctaacctaacaagatagcaggactattaacattctcaaattacaggacagtaaactaagacaatgaagttaagtaatttatcaagatcacctatgattaaatggtggaactagcattcaaacccaggcagtctaatgccagagcccagctatagccatatgaactcctaggatttgaagagagaccagtgtattcactgtagatgaaagaattaaattatccttcaagagtgcatacagcaatagtaaagtgtgagaagcaaaagagctgagagcaaaagaatttaagaaacaggcagaagaggacctcaaggaacagactgagaaggagcaggtagagagatgaaaggaaaaccaaggagagagcctgtcgtggcatgtgtctcaggagtgatggagagttcggggaggaaatttggtttattttctgaccctgattctttaagttccaaaatttcttcatgctaatcaattcccattcttttaatttttacccatcttcccccacaaaaagttatcgggtatgaaatattgcaagatatcaacagctactttaataaaaaaattcacaaaattatcaaacagcaagaatgcccttaattattattaggaaagatcagcatgtttgtaatcccagatagttggtaggctgaggagggaagattgcttgaactcaagagttggagcctgcagtgagttgtgcttttgccactgcattgcagcctgggtgacagagtgagaccctgtctctaaaaaaaaggagaaagatcaatgttttttatgctttagggtatttataagcttaaaaagattcccattttacaagctgatgttgcttacatattgccatataaggaaggaataagtaaccaacattgtgatcaaatgaacaaacaatatgtcaacatttttaaaatgtaatgtaactagtacaacacagaagtaaatacctagttttgctttttgatctgtatgtcatttccttccttgtaagatataagaagcatcagtggggttatccatttggtcttggttgaaaacgttccagtgcaacattgccattcatcttcatagtcatttaaatgcaatttattatccagttttgtgattctactttatattttatggagttggtaagactccagaattactttcagaatcatccatcttatatataggggaaaggtttaatccttccatctctaagcaaggaaaactgtcatagaaatcaggccccaaaatgaattcttcaagagcaggaaggatggagaggatgaatcaatcaaatttttttttctcctcaacttgttattctaaacgagcttataaacagttttctgtaaggaaagggtttcttgaatatggtaacatctgccatctagtggctgacttgagctactatatgattaaactagaaatttttatttttatgtaaataataacatggaggtgggcaaatcattgtacttcatctctctctcttcatgttgcaaacaaagtaggaaaatatagattttctttgatgaactattatttttagtgccagatttgatctaataattcaatccttttagtgtaggcatcttcaaagtaaaggagaaaaataaaaacagaaagaaaagaagaaaaagagaaagaaaaataaaatagtatgtttacctgccacaacagaatacataaacaaagtataattatagttattaaattatttcagttctagggtgattctattttgtcattaaacaaaagttaatttatttgtacatcagatatagttagaataaataaaaccggtatctttaaatgaaaatgtcacaggtaaaagtgaatgtataatacctcctcccttatttttatgagagttaaactattatgcacatatactttaccatctaagctgatagaattagcttaattagatagtctccatgccaaaaacaatgataaattttgagtcttcatctctctcaagtctcaccagcatttgacacagttgacagaccttttcccccatctggaaagcactttcttcactttcaggacaccatactcttcctgtaggtcatagtttgtggggccgggcacaggatgagaatgtggggctccctcgtgcaaaaaatcagcaaaaaaaactgtccttaaggtacatataacttatgtgaattacacaataaatattttgtagttcatacttgcatatgtacttcattcttcccggaagagtggaaacattgcccaaaactaactcagctattttatttcacttcttcatacagtaaatcctgtggaaggaaagaagaaaggaggaaagaggattggatggaagaatctccacttctcataggtgtagtccttccttagcctgctttttaatgagtgctgctaaagcccttagcctgcctgtttacccttggagtggagcaatgaactgaagatatttgagtgagttcaagagagactcagaagagaagaattggaggcagcaaacatagacagcacttttaatgcttttctcatatgctgtaagacatgaaagcaatctattgggatgaaagctgaaaggagaagcgggacaagagaagtgaatccgtggaagacccccaaaagaggctgcagattcttagtggacagctctcatatcccctccagggaaaatgatgaaaaatgtcttcagaaaaatagctttatgaaggcaagaggactttttgcacctgcaagacatgtctgaaagctcctcaggtcaaaacacaagtagtcaagagatttgtccatctaattcatcatactactctgatccaagtgagacccacactgggtcagctccatcaaggagaagaacattccacccacgtttggattctggaatatcatccttgcttccatcagattcttgtaagtacctcacttggcacaaggtagacatgacgttcaaggaagtcaactgcgttgcccaagagtaagagaaggaatctctgaagaagagcaacttttcagacaggtagagtgtgccttgctcccaaggaaaagagttcttgaaaaaaacaaatgggaaacatggctacaagaaaactgggaagactgcaagaaaatctcagaatctgcttgagaatccggtccttcttcctccatacacccatggaacactcccaaactctgtatgctgctcactaattctgattaaggtcttcaccctccctaccttggaaattgctacaacataattgtgtttgtatgtataattaatatatacaatacattttaaatgaataactaaagttgacaaaaacctc

SEQ ID NO: 3069 - DNA, 3985 bp, Homo sapiens
cttactgggcccataggtgcatctgattccccactttgtgcttgcagtgctgtccccggcccaggccatcgtggtttacaccgacagggaggtccatggtgctgtgggctcccgggtgaccctgcactgctccttctggtccagtgagtgggtctcagatgacatctccttcacctggcgctaccagcccgaagggggcagagatgccatttcgtgccaactaggtacggggtcgttctgggagctgtgatcgggggtgtcctcggggtggtgctgttgctgctgctgcttttctacgtggttcggtactgctggctacgcaggcaggcggccctgcagaggaggctcagtgctatggagaaggggaaattgcacaagccaggaaaggacgcgtcgaagcgcgggcggcaggttagcgggacttggggcctagacaagatgggaaggagaaccctgggagccgccgggcagcagtgaggggtgggatgggaacagtcaagccccagtcgctcggtgactgatgtgtgcgcccctcccccagacgccagtgctgtatgcaatgctggaccacagcagaagcaccaaagctgtcagtgagaagaaggccaaggggctgggggagtctcgcaaggataagaaatagcggttagcgggccgggcgggggatcgggggttaggggtggagtccgccaaaggcccaaaggtgatggtcatcgagatggagctacgaaaggatgagcagagcccggagctccggcctgctgtcaagtcccccagcagaaccagcctcaaaaacgccctcaagaacatgatgggcctgaactcggacaagtgatcgccacccccccaccccaggccctgccagagcagggggacctaggctcctcttacccccgtctaggtgctttccctctttgctcccccgccctgccctgccctcacctccctttgagatgtaagtttcattccagaattcattccccaggcaattgtattctcccccaccttcacccctggctttctgggagcccaggagctaatcctacccctcacctgccccgggggctgtgtgtttggtgcctgtccacctgagcactgagaagaaagggactttgataccctctgcctcaagtccaggccacctggcattcccatctcctgcatcccccagcctgtccccctggctgtttcctctcccgtccctccctcccctctaccaggtggcccagctccatactctgtccccccagctaatacccagagcacccagatcagactctccttcagggtttatttaggttattattttttattttttaatccattctttgtttgtttacctgtgctcatcctctgcccttacacccatgactgaggaccaatgacgtcatgtggcttttgcaattcacgccccccttaagtccttaatgaagagccagcccaagtagaggggcccctgatcctcacacttcagtatagcattggttccccctgaccactttggagcactgttctgggactccaggtcttgaggagagagacagagagagagaatggatcctcataggtcagggagtgggggagggggcaaatgagccttaagaaatggtttttaaacaaccaaacaaaaagcaggaaaaacaaatgggaaatgggggggcgggggggaggaagaggctgcactgcagccacaggggattcttaggatttttctacattctgtatatttcttctcaaacctccaaatgtccttaaatgtttaataaacactgacatttccagaagctgctgccttgtctagaatttcctagtcctcctgggaataattcctgccccttatcccatccccaaccttccatacttggcttcagttgtttagtttgtttttttggggtgggcttatatagtatactagaaagaactctgaaatagcctcacaagacacattcataccttcagcaaataatcagtgagattatactacgttgtaaactctgccagtctctgcttttacatgagttaaaacgcagaatctgtcttcaccaagatctgaattttaaaacatcccagccactctctagctgtgtgatccccaggacagttacctgactttggtaagcttgtttatgtacttgtaaacaactgagataatgatatctgccctgcttaattcctagggattttataataatcaaatgagatcctgtgtatggaaaactttgtaaactgtaagttgatatacaactaaatattaaggtgttcaatatttgtttctagtgcttgcctaaggtagtacactttacaaattagcacaaatcccattcacctctctaaacaatcactgctttgttttgttggtacatgattttacttctgtttacctattaataggtatactattaatacctcattagctagtttgttggtatgttgatttaggtataccattaatatcctggtatcctgaactgattgtggaaaaacatatacgtatcattttcccctggggattactgatggcacaaaaaaacccaaagtgcccacaagtaatttcttccccttgttaagaagctaaagatatgattaacaccagctttaccaaaacccagagtgcttccatttgtttgaggggtgtcttcaatgtcttttaaaaaaaatcaatctgccttcatttaaatataaaagctaatagagtatatatagccttttgttggggggaagtgggagaggaaacttagtcacaacccagtaataaagttgggaatatcttaagcccaagattccttattagttaagatgctaaactgtccattattcattagatagttgcagctgggttccctgcttaaacttcccagactgtcaggagagtcaaatgaggttggatgtggtggctcatgcctgtaatgccagcactttgggaggccgaggtgggcagatcacttcaggctaggaggttgaggccagcctgaccaacatggctaaacactgtctccactaaaaatacaaaaattagccgagcatggtggtgaacgccttctaaccctggctacttgggcagctggggcacgagaattgcttgaaccgcggaggcggaggttgcagtgagccgagatcatgccgctgcactctagcctgggcaacacagcgagactatgtctcataaaaataaaaaagaaagagagagagagagagtcaaatgaaatattatgctacttatgagatagagtatagctcaaagcttctcatttaattacacttttgttctaaaatttatcagccacctgcattttgctagctcagtttatccaattattttaatatttcttattccatcaagaatcctggtaccctgggacaacattttgcaatctcttgcattaggcattttcacaagcattgcacacttaatgtgggtttttccaggactgtgcccattttccacaatccccaacaaagtaagccacatcccccctttctttcctctgcagtaaagcattaaataaagtctagaataatgattcagataaagggaaatgacattgttatatgggaaactttgaatcccatctaattattactttgaaataaatcgttcacaatcctcagtgcgttgttaataatagcaataattttgcccaggcatgtgagcactttgagaataatttaaagcctttttcagtgttaaccataaaaagaaaaagattataacccaatttatgaatacgcagacaaagagtctaaataaaatatttgcaaaagagaattccacaatgagttaataaaataataaattatgaccatgaagaatttactctgggaatgaaagaatagttcagtatcaggaaatttactaacaggatgtgttatatcatcagggaaaaaacgtaattctatcaagaggagatgtaaaaaaaaaaaagcaattgttttttagtagctattcctacaaaacattctaagtaaaatagtaatagaaataacc

SEQ ID NO: 3070 - DNA, 1667 bp, Homo sapiens
gctccgggaccctggcaccaggggaagctcccatgacagattactgtggtctcttgcatgctgctatagattgcaatactgagaccatgataacctgccactccccaaaatattcttgtcttgcctacttgctcaaatattggaggatctgaagaaattacgaagaagttttgatccttagtaatcagtgaggattgtccagaaaaatagaaccaataggatgtgcgtatatatatgtaaatgaaagagatttattttaaagaattggcttatgagattttccagacttggtgtgtccaaattctgatgaggaagcctggaaggctgaagacttaggaaagagttgcaatttgtgtccaaaggcagtctgctggtgagccaggaagaactgatgttgcagatgaaatctaaagggtgaagcacaaaggagattcttgcaagatttggaagacctagggaaggaagtgacattttatggctgacctatgctgttgctgatctgctgcatcatttcaatggcataaagcagcatctagatctgcggttgtttagccttttctggattcatcttcagttttttgacccctgagccagactcagagttcacctcctccaggaagccttccttgagacgccattgctcacctggctctacttgcttgaccagaagtactttaaagattatatctttacattttgtatctgcaggacttgaaatataatgaacattccagacataattgatgaataaaataacatccaatcccttcattttatagattggttgatgaagaccttggacttttggccaagattgaacatctacagtggagattatttagtgctgttttctattcacaggcctagccactccaacctgtctgttgtctttacatcataggactttacccaaggtgcactctataatacatgccagtccaaatatacattctgacagacaatctagctgcccacatctgtcagatggctctttctgtgacaactgaggataagaatttttttctttaagaattagagctaaatattatgaaatataatctagacttcaagaaactttgacagttacctgtatcaccgtctgtggatgaataaaaatctctttgacatctaagacaaaatggccattcaccatctatctgaaaattctagtgaggacagccatactttctgaggcatgttgaatggctaacattttagaattcttccttacattggctgaaatatgactgaagtttcacagatttacccttattcctcatgataaaagtacagaagtttgttaagtgtccttggtgacaggttggtcaagattggaccttccataggattacttagtctcacatcccctcatggctacggatctcataaggatgggtctgaacatcaaaaatatcactgtttttattcaggtactgacagcgccatataaatatggcttaaagcatggctataagaagagtgaatattctaatgacctgtcttgagtgaagctgatgagactgtattttgagtcttactgtacctgttaaggctatgcagcgtatttagagagaaatgtggaatttgttatataaaggtaagtttaaatagggtgctaatatctatgaaggtcaactttgttaattcaacacaaataaaaatccaag

SEQ ID NO: 3071 - DNA, 1325 bp, Homo sapiens
gatcattttcagccgttcaaaaagtttcctactgtttcacctcgatggggactttacttgcttttctgtgcaggttctctattagttaacatgttcctctaccccatttaacttttgaagtgtggggcctctgaatgagaaaatggattgcgtcttccaatatcaaaatggagtcctactcatgataagtagtttaacacttttctgagagtattgagttgctttaggaagaccaagtgattgggtttcaagaggtatggcttaaatccctactctgccaattattacttgtgagatttgggaggaggtcacttttaaacctcgcattcctcatgtgtaaaatagggataataatatctagcctattcatagttattttgataaccccaatgagatgaaccgtacgaaaagtgccacgaagacggtaaagcccatagacaaatagaaattcttattataacttttcttctgcatgtatctactatctttatgtaactcttaaccacattctactttgtattacagtgacttttaagtatttttctttcccctcagagataccaagttaaaggaattcacatcattatatctcccagaggacaaagcctagaactttctacattcaagtcagtgaatattggggagtggggaatccatgaattcattatgtggaggcaattttaattcagaagatggaaaccagcataatatagatctgtcgtggcttcagcatcaggaaacaacacactgatcatgacatcaaactccagaggaagccggctaaggatgtgcttgttttgatgtgacatgtgcctgcgatgattaactctcatgctcccacaatctctccagggccccagacttggtccttcctcgcctgtaaacaggatcaggatgcatcctggagttcagccaagggcatctggccttgggtaagacagactccacaaaacacatacattgttcctggcaagggaaccacgagggaaggaaaaggagagaaggaaggcagcatgggacactgacatccatccacgtatgacaaatcacatcagatgcaactgagcacatgcaactcagagggaaaagacaggaataggcccatggaacacattcaccttctacatgatcaacagcttcgggaaagcaatacagccaagtgccaagtgagaaaaagggaaaagcatgtaaaatgaatgaaatgttgactgcaatggaagacattttagactgttcttgttacataacaaagagagggaggaaaccatgctgggaggagacattgggagagacctgccaacagacctccaaatgcatattcaaat

SEQ ID NO: 3072 - DNA, 4221 bp, Homo sapiens
ctgggtgccagtggagatgctgcctactgcagtgtggagaatggattggaggggtcagaatgaatgtagagagaattcaaaggctcctgcaggagtccaagcaagaggattgcagattgtagcctggaagaggccagtagctgtggtgacaatggacaccaggtggatatgttggagagacacttagaagggtctcactctgtcacccagactggagtacactggtgtgatctcggctcactgcaacctccgcctcccaggctcaagtgattctcctgcctcagcctctcgagtagctggaattacaagcatgtgccactaccaccctgctaatttttgtatttttagtagagatgcggtttcaccatgttggccaggctggccttgaactcatgaccttaaatgatccacccgcctcagcctcccaagtgctgggattttaggtgtgagccactcgcctggcaggtgattatttaaaagcagaagtagtataatcatatttttttgtaaatagctttttaaaaatggatgggaaataatatttggaagtggagttgttgaactacctctgtgaacagcatactctctctaattgttcattgggttgagggtggtgagagggaagaaattgcaaaagttgctttgctagtgtttattagcacgttgtgcacgtgtatcctaaaacttaaagtataataataataaaattttaaaaaaaggttttaaaaaaaaagaaaatttcagcttaatccattgcctgtatgttacatgcgtttcatttacctttgctgtactgtatatattgtgtatatactgaacaaatgagtcctaattttataatatttagtcgagtctctagagagtaaaaaggttgccaatgtatgacagaaagagttagtaaactagcataagttgtatgctttgttaaaattcacagaaagactgtcttctgaaaaggacttttgggagtgaaataacatcagctctaagtgactcatgtgcctatatccacctggttggtggtgaagaggagttgaaaggaatgaaggattctaggacagaaggttcctattgagaagacactttcggctataaccactgttacgtgtgtgtaatttattcaacactactgtgtatataacggacaaacaaatcatatttaaaacatcatctagtctttttagatgtttagaagtgcacaaagtatgttaaaagtagaggtaaataacacattttgtagatatccttttgatgtgaaatattgtcttttggaaattgagcaaaccaattccctgagccgtacacattattatatctgtgtcagtttggggaggaaggaggagcagaaagtacaaagggcttttcaccagtgtgtttatggtgaggcacattgactattatctttttttttttttttttgagacgacgtctcgctctgtcaccaagctggggtgcagtggcgcaatcttggctctctgcaacctctgcctcctgtattcaagcgattctcctgcctcagcctccagagtacctgggactacaggtgtgcaccaccacacccagctaatttttgtatttttagtagagaaggagtttcaccatgtttgccaggatggtcttgatctaagtctgcattttctttgtgctgtgtagatagcgtacataagaggacaaaccaatcctaatctatatcatctagtctttgtagatgttagagaggtccagtgcgtgacaaaagtagatttagtgaattaaaacactgagtacgttttgtgttaaaattcatagggaagactgttgttaaaaacatagaagtgggcagggcacggtggctcacgcctgtaatcccagcactttgggaggctgaggtgggcagatcacttgtggtcaggagttcaagaccagcctgaccaatatgatgaaatcctgtgtctactaaaaatacaaaaattagctgggcatggcagcgggcacctgtaatcccaggtacttgggaggctgaggcaggagaattgcttgaaccctggaggcagaggttgttagaatcctttctacacaatacatttggcttatagctgtccacagggtggacagaggttggaacgggaagggttctaggccaaaatgttcaggggaggggtgctaggccagaatgttcgtatttagaagacactttcaaattacagtctatgttatgtatatgcaccatttattcaatgctactatgtatatagtggaaaacctaagtcctctttgaaacatctagtctttctaaatgtttaaaagtgcacaacataggttagaagtagagggctaaagtgacaccctttaagcattttctttattactttttaggagtgtttgcatttggaaatggaatggttaaacttgatgctttggactgttcatagggtgatggtgggtgtaggaggaggaagtatgcaaagggaagggttctgtgcccaagagttagattagttcacatgatctaaccattgttctatatgcattttagttaatagtgttttgttttttatttttgatggagttttgctcttgttgcccaggttggagtgcaatggtgtgatctaggctcactgcaacctctgcctcctgggttcaagtggttctcctgcctcagcctcctgagtagctaggattataggcacacaccaccacacctggctaatttttttggtaatttttagtagattcggtgtttcaccatgttggccgggcttgtcttgaactcctgacctcaggtgatccacccacctcagcctcccaaagtgctgggattacaggtgtgagccaccgcacctggccaatagtgggtattaaaagataaacaagtcttaatgctcaaagtatgttaaaaatagatgtagtaaaacaatccgtctacaaatgttcttttgttatattttaggaggcctgtcttctgggagtgacctttgttattccacctcttggagctaggcatagtcctatacctagtcactgggatggtggaagagggagaaaaggaaggatgaaggaaagagctatttgctagtatctccacatctagaagatggttttagatgataaccataggtctacatgagcatttttagtaaagtgcttgtgtgtaattctggacaaagtttattattttgcactatctaagctttatgaatgtcctggggtgataatgtgtgataaaaagtagaactagtgaattagccaatttgtaaattttttcttgttataatttatagaaaagatgcaacttggacatggaactgttaaaccatctctgagctttgtatgccaggacttgttcattaggttggcagcagagcagcaaaaggaagtataaagagagagatgtatgcagatgtgtcgatatttacattttgatgatagccattgttgtatgtgcatctcttttagctgtactataggaatacattaggtatttcaatgaaaacataccttgctaatatttgaatagtatagatctgctaatggattctcttagaaacattatacttagtgtattctattgctgtatatttcattttaaagtgagcactaaaggaatgcggtattttaataaaaactctgccaacgcttttacttagaggcgtgttgccaatttttgtcttttatgaaaatttggcccaagaaaggcaggattacattgtttttccaacagattgagtgggtgtagtgtattcttgatgatcaaaatactcatatagctttgagattttgaattggtaaatactcaagatgtgtgaaaaagcatgatacatactatatgatctcagtcccataaaattgactattgtatctacacccacacaggacctagaaggacatgttaaactgtaaactgcttgtgattgtggatgacctttttcgttgcttcttgtgtttttcagtttcctataatgcacatagtaacttaaaaaaataaagattatttttgaaacctaaaaaaaagaggttacagaattgaatactccctgagataaggtaaaatcatcttatgctaacggttgcaagataatggtataagtaagctttcgtcgtacatatcaatgaactttaagatttggaagacaaaattcagtttatgtattcaattaaatgtgctcagattgtattgtgctagataggcacattattctaacataatatgaatgaatcaataaaatccttataatactgatg

SEQ ID NO: 3073 - DNA, 727 bp, Homo sapiens
cggggagtgtgtgttgccatcgcgtctccgcctgcaggggcgggaccccaggaggagggagaggacagagccactgcagaggaccagactgggaaaacaacgatatggcaggagccagtcttggggcccgcttctaccggcagatcaaaagacatccggggatcatcccgatgatcggcttaatctgcctgggcatgggcagcgctgcgctttacttgctgcgactcgcccttcgcagccccgacgtctgctgggacagaaagaacaacccggagccctggaaccgcctgagccccaatgaccaatacaagttccttgcagtttccactgactataagaagctgaagaaggaccggccagacttctaagccaggctgggctgccagtgccatgcaagccacagccagccagcccatccacttcttccactcctccccgcaggccccaaggcatcactccggccaccctgtcccgctactgcttacacaggccgggttcccacgcagaggggaggctgctccacccctactctcctcccttgctcccagcagcggaagcgcctctgacccttggcttgagtcccacgtgggggaggaggaggcaggcagcaccagcaggggtccaccaagagcccagaccagcccctctgccctcctacccgggcctcgaagggtgtggcacaggctacgtgttgagcgtggcctacgtgagccaacaagaagcaggg

SEQ ID NO: 3074 - DNA, 887 bp, Homo sapiens
accaatgttcaacaaatatttgagtggttgttatggtgatgctgatatatgaaatgccaaactatatactttcctcacatgccagcatctgctatgtccctccctgcccttctgacagtagagaagttctagtaggttaaatgcgtatacgatcaaataattgctatattaggggcatttaccagccatcgtggtgaccaaagtatcagctttgcagaggtgatcaagaaataaattggtccttggtttagatatagagagacaaatggatggaaaaactttttggccctcttccttaggatcagaagagcttcaaccagcactactacttgaggacctatgcagtgtttgtccatgagcatggaatgactcatactggcctcagagttagggactcactttaaaggaaaggggatgcagtagtgggcacatgactaagaaatccaccgatcctctcatatactgcaccaccagaagctgctggattagcagagcaaaggtcacagaacgttttcctgaatcggattctgggttaaagctgccagtaggaagaattcacatgagatttcaaaggtggaagagaaggagaaggtgtttttttcttgcaacagtttggctggggagctgagatcttcactgagggcttcctttggctccgggttcccgtggacaggcagccgatgtcatcagtggtggcttctctgtgatcactataccaccaggtctcctaaagtggccttcttgacctttgcctccccagctctttcaatggttatgtgaaactctaattatgtacattaaatatctttcagctcataatacatagagtcatttccctccccacatatggagtaattctgaatgacataaaggcttaagcacgaagg

SEQ ID NO: 3075 - DNA, 1001 bp, Homo sapiens
ctggagttgctaaagctggagctggagaagtagtgatgaggagggattattgatctcagtgcccactggacattatggcgacatctgccactcaaggtacaactatggtattttgtgcagtgctcagttttctcagcattgttagattcaagtaatttcctcctgattgattaatgagagtcttagttttgatctgtgccagcacatctgagtcttcattgctgtctctgtctcattattgacgcaagtagcccatgttgcagtgtctgtcttggagccacattcttttttaccacaatgacaatttgacaagcccagtgaattatacattaatttgcctccttcaatgggattcctttctcatcgtggaagagtggagtgagactcagagactctatatccgtttctctttctgcttcaattcatcaatgtgccattttcaatcaagggaactctaatggcccaggaagacattttgatttgattctgtagatatccatggacaaagaggaagggaatcctctctaattatgggttcattcttcagcctatttaagaatttctatagcctcctcaaggtgattcagagttggggagtctccttgctctccatgctctcatttctcgctattgacgtctgtgaaaatgcttatctcattcatttagtttggaattgccagtgtcagcatcttagatctcaatatccatgactcacaccaaaatttgaagtttagattttcagtctttttatgtgatagagaacagttttcactcccagcagtcaaacctagacaataagtttattgttccgttttacatctgttctgtctttccctgagtgatgaaatttatagatagtattcatcttaatctggaaggtgcctttccaaacacttcacaaataacaaatgtaaatcaaacacagagttttggagaatattcaaaagactattatatgcattattttgggtaacatttatatataccattttcattttgat

SEQ ID NO: 3076 - DNA, 7246 bp, Homo sapiens
tttacctattttttttccattcttttcttcccccacagttcatccatgagctcggatttcccacattacaacttcaggatgcctaatattggattccagaatctgcctctcaacatatatattgtggtttttggtactgctatatttgtcttcatccttagtttactcttctgttgctacttgattaggctaagacatcaagcacacaaagaattttatgcctacaaacaggttatattaaaagagaaagtaaaagaattgaatttacatgagctctgtgcagtgtgcctagaagacttcaagcctcgagatgagttggggatttgcccatgtaagcacgccttccacagaaagtgccttattaagtggctggaggttcgtaaagtgtgtcccctgtgcaacatgccagttctacagctggcccagttgcacagtaagcaggaccgtggaccccctcaggggccccttcctggggcagagaacattgtatagcttaccgcaaggatcagactgttgctggacacgacgtctgtgtggagccaggaggaacacatgtggtgtctgtatggctgctctctacctaggacaccagctgccacttcttttgcctcatgaagaactcttgggccagccaaactgggaacctaggtgtctgggtcttgtgacaaccaaagcactttgacactaccccctgccgagagaagaggagtggatgagcctgcgggtttgcctcaagaaacttcatgagggtctcttactaactccattacactctctctcctggagcctcatctccatgtcaagcaggagggtaaagaagggaactaagagcaggtctttcaagccacacccccacctgcggatggatgggtttctctgtaggccatgcaggcctttgtcgcagcaaaccttcccagcagcccttgagccaagtaaaaccagcacaaccagccaccagtggttggtgaggcagtgcccacaaggctcatgttgtatgcctttgataaggccatcttggctttgagtagcagtgttcctcgtcacccatttccccctcaggattacaacacctgctatcaaatcatctaagctgaaaacatgagatgcgcttggaaaggcctagtcagaagccatttcctcttatcatttccctctcctatgcaccagtaaggcccgtccagagccccagcagggagtgggccctgagtccacactgtccctgagtgatccaggaggctgcccacatccccacatgtgcactgtggttccagtgtagctgctgtgagcccactgccactgcctcagaagggagccactgtgaacctctcgagtggctccaaagagcagtggctttttgagaatggcccatacttctggcccggctggatgaagggaatgccgaccctttggcctctccccctccttccatctcttctctctcttgccctatctctctttctacttcagaaaaaaaaaaaaaaaaaaaaaaaagcctgtcattcactttttaacactttatcccaaataagatccctgtgtaattctgaagctggtgatccacttggaattgtagatagtttcaggaagctcctgcagggctgtccaccgttggtgtgtgcctcagtatttggacttccgaaactgaaagtgaaagtgtctttataggagagaaacgcatgctgctctttggctctttctgtccaacttttctagaaatgactcaaagtccattaagatttgtgaatattgtataaattagctatggaaagtagcaggtcagatggaaaattcttttccacagccctgctctccgcctccctccatcttaggagcgcctgcctcaattcctcgtcaactgctttgctccactccatcccacaggtgtgagtgggggaagtttttcattaggaatacagtctgcgtgacatggagaatggatggagggagctttgctactctgctcttggcatgactccaggatttttttctggaatccaacctctgtcctcttaggagaaggaacctgtccttggttcagatggctgggcatgaggaggaaaatttccattagtgtagaacagtgctggacagaatccggtttggaaaattacaaatccagttggtcaaaataggccatttcctatgtgtgacctattcgtggtatgccaactggactgcttcctaaacaggacgaggaaagtgaggaatatttttatatgaaagccttagcctgtctggcacccatgaaaaaaactatttatgcactcctactttcaccgtctttttgcattctctatttgtagcacaacagagttgaatgccacaaaacaccccgtttatagtgagctgttttcagtgaccaatatcagaaggaggcttgcttctggactagcctcactaattgccagcagccaccattttccatggaatggccttgggacagatgtcacctctgttatggggctctaataggaaagagaatgttttttcccttcctatgatcaatactgcaaattattgctgctcacagcttttataggattctcccaactgaaagttgcaggctttttctgtccctgtgcatcagtactaacaaaagacagcctcaccaagtctgtatatttgaacagaggcaagttaattcatccccccgtgtcagagccacaggcatgttgagggggttgatacgtagcactggaccagggcgcaaagcccagatagttccagccatgagaggagagcacaagaatgctctgcactctgcactcagcaccaccttgggtctgctttgcccagatgagggaccactaacaaccttctcagcacatgtgaatgtggactggttttaaaatgcattcattctgctaggattgggctggaagctggaacagtgagagtactttttctgctcctagtcatctccctttctcagcgtgacatcctcctgcagcaagcctagtatcactagcagtagttcctgcgactcttagcaacacaacccgaatatttgctccctgcatctgggtcctccaccaggatgggcctgcgcatctgcattgctgtacagacaaacaggccttttaatttacatcctcctttaattctcattaaaatcgcagggtttttgtttgaaagacagtcctttttttatttattttgaaaaaggaatgagttagggacccctttataactctcttggctcagactcgaaccccatggtaaagtcaccctttccgcatctatcttcaggagttgctgggacttgttactgtgtagctgcgtggggattctggtctgctcttggaccactggctggtatcctttgtgtgtttcttaagcagctcaaagatagaatgttgctggtctgctatgggttagtggagcataactcagccccaactggactccacgggtggctgaaccattagtagttgctaggggtacaactgaattcaactgccttcagaaacagggaacaaaaccagcctgacttgattcctggttgggtcagtatcagacactaggaagttgacatctgctgcttttctttgccacgtgtgatttggttaggcctgtccctggcagataaggtccttgaagcctatgcttgcctagccagggaaggcaggacagaaatggccaaataggggcaggtggcccctgggaaggtctgagctgagggatacaggggacctcccaccattgccggataccctgttcttgacaagaagatccttttccccagtgccaagccccttggatccatcagagaaatagcctcgggccttgtcctttttcacaaccccacttcaaaatcatgtcatctccctggcctgatcccgctctaagctactttgaacaactaggaattatttttctcagaggctttttgggcattatgaaatacatcctgatacatccagggcagtatacccagagctccaggcagagagtgatggaatcacctcttgtcactcactagccttaggcccttctgcaggttagcctctcagtctcttccttagcttccttagctaccacccagggattgtagtaacgtccctggcacctcttgtgggggttagctggtgcccagagcctggtaggcagcaggcctggtgtcatgggggctgctgataccacataacatcatctgggttacatgggctcctctgccatcatgattgataggaacagaacctcagccaaaaagcttcctgagctgtaggggctttccctgaggcccaggttcacctggcccctttcttccttggtcatctctgcctttgcccacagtgaactctgacttggttgttcagtgctgaatatttctttcttaatgttttgaataggtaatccattcatgtggttcacaaatcataaagtagttaaaagcctttcttgagttcctgatgcctagcaagctccgctcctcactccatgaatacctactattggtttgttccttgggtatccttccagagatcatttatgcatgtacacacatgtgtatgtgtgtctatataatttttctccttttctactcatgtgataccagacaagtgtattcaaggaacgctcctactaatgtgggaagagccatcccagaaatcagaatacaaaatgtgaacccagaattgggggatgtttttgcaatcacactcctgttgagtaagacatattttcattttattgcaacatactgaaattttagttttctgtacaaatcagaatctgcagtccctcccttaccccaaatgcccagctaatccaagagcacaaccagatttttctgattgactttctatctgcgacaggatgctcaagatcaggctctgtagctgacagcagtggcacaggcctctcccagctctgagcagcctctgcaggtgcctggacagctgctggcccctcccctaccttggccagttccaagtgaggaccagtggtgatgtgtggctgcaactgttgtggtcacttaggcaagctcttgtgtctttgatgcaggagtttgagcagcagcaactgaaggcttctattttgtggggcagacatcttagctactgagcaagtgcacagtgagtctcatgtggatatgcctgaatgtccagcgtcagttcatggagctactccctttccctcccaacttttcgttgttgttgagacagggtcttgttacccagactggagtgcagtggcaccattgtagctcactgcagcctcaacttcctggactcaagtgatcctcccgcctcagtctgtagctgcgtctacaggtgcacaccagcacacctggctaattttcgtaattatttttttgtagagacaggtctcaactcactatgttgcccaggctggcctcctcactctgtgcacacactttgaaaagaaaatgcttctggtcgggcgcgatggctcacgcctgtaatcccaacatcccagcactttgggaggccgaggcaggcggatcaccttaggtcaagagttcaagaccagcctgaccaatatggtgaaaccccctctactaaaaatacaaaaatttgccgggtgtggtgacgcatgcctgtaatcccagccactcaggaggctgggacaggagaattgattgaacccgggagacagaagttgcagtgagccaagatccccactgcactccagcctgggcaacagagcgagactccgtctcaaaaaaacacacaagaaaagaaaatgcttcctacagaattttccctttatgccttgttttccatttgacaacagaaattaccccaacaattttttttttttttttttttttttttttttttgagacggagtctcgctctgtcacccaggctggaatgcagtggcacgatcttggcccactgcaagctccgcctcccaggttcacgccattctcccgcctcgggagctgggacaacaggtgcccgccaccacgctcggctaattttttgtatttttagtacagacggagtttcaccgtgttagccaggatggtctcgatctcctgacctcgtgatgcacctgccttgacctcccaaagtgctgggattacaggcgtgagccactgcgcccggccaataatttttttagtttaagttcatttttgtccccgctgatgaaagttagagctgcttcctccaggcagccctgggagtaggggcacagacttgtgcctcgcttcccagcagctgcccagtgcctctgtccacacccacctccctggtgtacttgccccctacagcagcagcccagatcctcccctggattaaaattgcaactggtgccctaacccaaaacttgagaaaaaattctctatcacatccactcttctggcatttgtagaatctctggccctgggtgtgtcttttcctgtagctgttacagatttcttaagcagatttcttaagcagatggacatgtccagattcatgcctaaatatccagttgataactggaaaatgctggttcacggttctttagtaaagattaataagggatccccatgtgctggggagtgtgcttccatttgagtggggatatcagaagaaaaagaggggcttgtgtagtaaaccttactttgccaattcagctgtagagcccaaattgttacaagatgcaaagatgtactccactttttgaccaagcatcagcacctttggcttaccatccagtccttacttctgtgactgtaagggccccaccagtgtcagcagacttgtttgtgctttgggggaactctcttctcagctccctttgccagtcccaagcctggtggatctgcatctcacgcccactgcacaccgttcctctccatctgcccttccctcccaggcccccggtcgggggagcaggtgtggcaagtgttaggaactcccttctggtgacagctggtcttcctagagtgttgctggtaactatcgcctcttggtcttctgacatcattgccaggaacggggcactttttcgtcttgtagtttggccctcgggtttcctcactaggtattgtgtaactccctcaaaaaaaggtttatgaaatgctgaacctcaggtttcatagacgtctttgtacactaaaaattctgcagcagaatatttttaaacattcgcagttttttgtaagctatatttttgtatatttaattgctattttaaaattttaatgcattttgctaatcactcctcaaaaataaaacatgcatgtaattgactcaaacgtgtaaataaaagcaaattttgaaaaata

SEQ ID NO: 3077 - DNA, 16004 bp, Homo sapiens
gagaaatactctcacaaggacaggatgtttctgagccaagttgaagcaaaagaaactttttccagcatgtcaggaacgaagctgacgttccattaagaaaaaaaaaaaaaaaaaaagaagtgctagaggaaggagtaagaggtgaaaaggcaccagaattcagacggagctttaaattccagacagggccagcgttgggagcacgtaggaggcgcccctcggaaaggagccggagacccagctgacttcgcacttgagctccagccccgtggacatttcctgttctgcctctggaaattcaagctgaaagttacaaaacatccttttccctggaaccaagtgcttggttgggagaccatgccctccccttccttcctcggaactcctccctgatcgccccgtggcttccccaggagagatgcgaaatcagcggtagcaggtggcgcagaagggagaggggagcgaccctggggaccgactctggggaccctcgccgaagagatatcattgtgatggtcccattctgaagccagctgatttgttaccaggcaaagcactcagagaagacaacatagtgggccgcgatgaggacacaaaaattgtggaagggcccagcgtggggacatttagggcatggaagtcatttgactcaagggttggatcctagaggtcaagaattgggaggccctaagaaatgacctagctcagccacctcctttaccaggtggggaaaattagtcctgatgtgggaatttccttatccgccgctggtcagtgacaaggcccggactaaaacagaagtcttggcactcaatctaaggacttctcctccgtgcctccctatcacgccttcccaccaactggcctcctccccagcatctgtgagaattctttgtaggaattctacccccaatagtttcatttactgaaaggcagtgggaatgtactcgatgtcaagtctgtgatgcagcatgaaagaagaaacaacactggggacagtggcttcgctcagtgccactcacagtgccagttctcgatgagatcaggagactgggctggaacagaaatctacatccagcttccttcatggagaaaatcttgctgtggaggccaggcaggggagcagcagtgcttagtgaggtaactggcttaccttctgccacaggctccttatctcagcactggccagtgtgatggtccctggctggagaacaccaggaacagcattgcctcactgctgcttgagcaaacccacctcccaaatagggcatggtgatagaagaatatgcagaaaagacaacagtccctctgtccagatcccatctagacaatagagctcagattgggagccattcttttttttttttttgagatggagtttcgttcttgttgcccaggctggagtgcaatggtgcgatctcggctcaccgcaacctctgcctcctgggttcaagcgattctcctgcctcagcctccaaagtagctgggattacaagcatgtgcctccatgcctggctaattttgtatttttagtagagatggggtttctccatgttggtcagcctcgtctcaaacttctgacctcaggtgatctgcccgcctcagcctcccaaagtgctgggattataggcatgagtcactgcgcccggcctgggaaccattctttaagggaggtaatgatattctagagatcttcctgtagttcctgactcacagagcacaatttttgtgaagattagaagaggctaggtgtggtggctcacacctttaatcccaacactttgggaggctgaggcaggaggagcccttgacgctaggagttcaagaccagcctgggcaatatagtgagacacccccatctctccaaaacattaaaaaaaaaaattagtcgggcgtggtggcaagtgcctgtagtcccagctacttggtaggctcaggcaggaggatctcttgagcctgggagttcgaggctacagtggagcctcggcttcccaaagtgctggaattataggtgtgagccaccatgcctggctacataaattatttggaattccatcatggacatttgtctcttctcttcatttatttatttgtttaatcactaacttatatttgtaggggcttgtggatttcttttaatactttgagttgtaatcaaatactgatttattaatcttgttgctcaaattgttccagcttcgcccattgagcgctctctcatttggcttctgtgtccctttgctagaccccattattgtgggtcttggtgttgtatttgtgttttgagcactttttttttttttaaccttctggttctacaagatactccaggctcatcttatatgttccctgaccaagtcctagaatcagccatttcttcaagtatccctggttcctttcgttggtgcatggtgttgaaaaccaaaatcttggtgctagatgtgcttgttgatactggggtgccattggttctaggccctctcagctgatagggcaaggaggtatatgtgtgtgtgctgacttcttttttttgagactgagctcacactctgtcgcccaagctggagtgcagtggcacaatctcggctcactgcaacctccgcctcccaggttcaagcgattctcctgcctcagcctcctgagtagctgggattacaggcacctgccaacatgcccggctaattttcgtatttttagtagagatggggtttccccatgttgaccaggctggtctccaactcctgacctcgtgatctgcctgccttatgctcctgaagtgcatgggccactgcacccagcccatgtgtgctgacttctatgtgtaaccatctgtatctatattaagctaaacatgaattcatactgatgtctataactctaattcattgtcatatgggtcactgtagacctccccttgcttacctgtaactttccactacaacctgaaacctggctcccaccatctgccattcatccactcaattgttcaactgcaatgtacacatatagtggtattagagtggttaacgtggatccccatgagaagcaactttatcaaccagatgtcagtgcttacatacagtttcttttgcctttcgtcttaacggactccactcattcctaaagttacttaggtcaacagtttttccctacaccattttcggtgcagttgttttacacatttgtaatacagttagattgatttgtcacagtcggcatttcatctgcatttcctctgactgcctaaatgatttttctttgatttgcatacgtaaaggttcactttctgtgttgtaaagttctatgtgttttgacaaatgcatagtgtcctgtttccaccattacagtatcatataaaacagtttcacaccctaaaaatcccctgtggttcacctattaagacttactgaggagtaacacctaggggaggagaaggacagaaagcaggactggataatagagccttcaggctgtgatgcaggaaaaacaaagtttctgcctgccccatggggagcaccatagcaaagcttggcccttagagagtaccctgttgggcagcagtggccaggactttatcctactgccttgctcagccattgtttggggctgccagagaagactgatttcagctcaagagaagagacagacccagaaggcactaacagctggaggttctcagctaaccacattccttgaagctgggttgctaagtcctttcttggcgagagatctgagtgctgtaactctgggtctgccagaaatatctctgaggattccaagcaggggttggctgaccactggtcaggaatcttgagctgaggattcctccatcacgtgggatttgggaccagatgatcccattggctgccttcagcctgcttgaatccaggtgatccagccattccattccacacattcagcccactttgctcaagcctctgcttcccttcttgcattaattatcttatgctctgctgcatcctagaggtaggctcagaacacctccttttccccagggaccattcctggagggccagagaagccagaagacagagtctagggttgcccgcacctttttgatcccaaatgtggctgtctgcacctttttgatcccaaatgctcaagaaagtggttacagtatccatagcaatatagatcaaggagttgaatgcacataaaaagcataaaaagtttgtgatgatgggcaaaaaaatggaaacattctaagctaagacttcaaaaactaaatctttgtctgaaatgtctcctccctgtggaatgtgcaaaaagcaaaacagcactccctactgatctatccatatactatatctggcaggtaccattcttttattttcttccatcttaactctcattctcatggtgctcctggatttccatttgcaggcacagagtcattttagtgcaattctgatctttctccgcaggaagatggaaaactttcagacctcttggagaaagcatggctctgatgttgtgctctatctgtgcttattcttccttgtatttaacttgcttaaggttaaaagcctgttgtgttttgttgtaccttggcagctctctctggctcgcgagtatcctaaagtcactatatggcctctaaggacagtcttgacttctaagccaaaagaaccttttattttactttgtctgtctttagagatttcctttgaatgtttgcttctgttctgcagcattttcaggctctgtagaccttgattgttttgctcagccagggcatttaaaaaaatactcatgctgctattttttttttttttttgagacggagtctccctctgttgtccaggttggagtgcagtggcatgatctctgctcactacaacctccacctcctgggttcaagcagttctcctgcctcagcctcccaagtagctaggattacaggcacccgccaccatgcctggctgattttttttgtatttgtagtagagatggggtttcaccatgttggccaggctggtctcaaactcctgacctcgggtgatatgcctgcctctgcctcacaaagtgctgggattacaggcaggagccgccgcgcctggcccatgctgttatttttacacagtgaaccatgaatactgattttaattccaaaggctcacaaattaaagagcttccttgaaccctggccctcaggattctttcagtctcctggtttttctgtctgctttgtcatttctcagtggaatgactaaagccagaacctgctgggttagtgaatggaaataaagtattggtggatgtactcttcctgccctgcccgtccaagactagactgtggggttggaatccatgtttcaatacccaaacactgcaccagctcacgactacaaaattagatgagacccaaaaaaatacaaagagtcaatattccaagaagatacttgcggttactgggtccaagatgtttgaattataggtagactctatctctgccagggactgaaatacggccagggcataaaaaatagcctgtttaaaaaaaaatcaataaaaatctcagaaagagcacactgtccctggaccattatatacaaaaagaaatgacaagtaaatggaacaaaacaaaagaagtttataaacacaaatgcttttattcctctctctgaaaatacagactgacactgtacacttggcagctgtttccacagcagggaagcagggtcacaggtctgaagcatgagttctcttctggaaaccacctactgattataggtgacagttgcatcaccttgaaatggaggaacaaagacttttttttgccagaatttggcattgctagcacaaagtgttagaaaacggtgacacacagagtggctggtagaactgcagaggaatttctgaaagtgagccttaggcaaaaggttggaaacttgtgctggaaacttaccttatgattaagcatgtgactcccacctgacttaattctcttccagtcccaagggttccaaggccagagagaggtcctggtcttgattgctggcatgtttactcttccaagtacactgagatcaaatgcaaagacaaaccatcaaaggtaattcttttctttgacattgaatatacctgggatggattttaaagtaaaaatttttatttcctagtgaaaaataacagatatgtaatctttgtatttggattaagtgtgaatgaaggaaataatgatcgaggaaagaacaaagaactgggtggtggtgatgcaagctgagtcctggttctggctttgctactaactataacttgggcaagtctgtacttctgctgcatagaatatatttacttatttctttttttgcttgtttgttttgattttatttcgagacagagtttcactctgtcacccgggctggagggcagtggcacgatctcggctcactgcaactttcgtctcccaggttcaagcaattcccctgcctcagcctcccgagtagctggggctacaggtgagcaccaccgcaactggctaatttttgtatttttactagagacagggtctcaccatgttggccaggccggtctcgaactcctgacctcaagagattcacctgtcttgacctcccaaagtgctgggattataggcgtgagccactgcacccagccaacttacttctttacttgtgtaaatgaaagaaggtagaactacatggcctctgagggcctttccagctctgttctgtgagtcagtttcttattttttatttttcattgtttaggcagtgccaaaacaataatgtcaggtgggttagggtacagatttgcaagacgttcatcctgaggctggtagcaggccccaaaaaactcttacctcatccatcatttttgcaaagatgaattcagagtaagacagacatcaaggtaggcattcagtatatatttgttgaatgaatgaatgaatgaatgaatgaatgaataactcaggcagccttgaggaggaagagaaaggaaacattctgccagaagaaatacaagaggaaatgtatttgggacaggggatggatttgcttgatgataatggttggggggcagttttatagacattttcagctgcagctgaactttaggcctgggcagtgttagggttagggctagtttacagagcactccttatctatagagtagggtgaaatgattgctggcaaggctgccaagaaatacagttcttccaggtacaggtggcttaactacaagataatggtactctttttctcctcaatttaataatgagtattaattaggatttgatctggctgagtgtcatagaaactcaaaataatagtgactaaatgatatatatgtttatttttctctcccataaaagaaatctgggccaggcttaatggctcatgcctgtagtctcagctatttgggaggatgaggcaggaggatcacttgagcccaggagttggaggttgcagtgagctatgattacaccactgcactctagcctgggcaacagagtgataccctgttaaaacaaaacagaacaaaaaagaattctgggtgggcaagatagggcaggttcagagcctccatggtttcagggattcaggctcctttaacctcagcacatggcttgtacttcaagattaattatggctgcttgacgactggtccgaaggtagtgagttatgtcaattgattgtccacagtcagttacagatcagactccttattctactctatcccccttctcactaatgcactcgacaggtcttgaaaaatagtatgtggctgcttgaattcagcgatcccatcagtatcacagccagcagggaaaagaaaagaccaataaagggctcacctccgcactccccattcatgacacttcctggaagttgaacttgacacttctattttcttttttcctttttttgtatttttagtagagacggggattcaccatcttggccaggctggtttcgaactcctgacctcaggtgatccacccgtctcagcctcccaaagtgctgggattacaggcaggagccaccgcaccgagcctgacacttctatttacatcccattgactagaacctagttacttggccaaacttaggtgtcatggagactgggaaatgcagcttttcttcataatagctgtgtgcctagctatcagggttgggttttgtttatttgtttgtttgtttgttttacttagagagaaagggagaagtgatactaggaaatagtagcttctgccactttgagagatgacagacttattccaaccacatgatgatgcccccattgctcaattcctttggcctggatcacttaaaattgcccatcagggtccataggaactattttcggtattctttgattttaaaagtagttcaagtccacacaggacagctgtgatgagtagtcggccgggggtgggggcgggtaataaaactgaatatgaccataagaataatatatgggcttctgcttctgggtattatagataattctgggtattatgaccattcctgcagaaaataactctaaaatctggacatgatatacaaagtgactgcctaaaggagctgaagagaggacataagtggatcgcctctgctgttgcatgttggcttggagaacagaagatgaggagccaaataagcaagtccttcagccccaggcttctagcacggggctgcatgtaggctatgcattctggggagtgaggagatcatgaatgctgaaaataaatgaaggaatccagaaaagcaagagtcaaagaaggcatctgcaggccaaatctctgatcaacccctgacccacatacacacaaaatacactcaaagcagctcagctaaagacaaagatctgcactcagagtagagctgcctccccagaaacagagctcgcagttcaggcccagcaagaaaattacctgcaaaacaaaggaaaaacaacactcatcagagaaaaagaacagaatctggaatcttcacaacctagcattcatcatatccaagattgaaacccaaattatgggacatatttaaaaaccaggaaaatggaacgtagtcttaagagaaaagtcaatcaaatctgacctggagatgaataatatattgaaacttaaaaggcaagggttttaatttttgttttcttgttttttttctgtttgtttgtttgtttttgtttttgttttttgagatggaatcttgctctgtcgcccaggctggagtgcagtggcgcaatcttggctcactgcagcctctgcctcctgggttcaaggaattctcctgtctcagccttccgagtagctgggactacaggcgcacgccaccacacccagctaatttttgtgtttttagtagagacagggtttcaccatattggtcaggctggtcttaaactcctgacctcaggtgatccacctgcctcggcctcccaaagtgctggcattacaggcatgagccaccgcacccagccttgttttctggggttttgttgagatgaggtctcactctgtcacacaggctggagtgtagtggtgcgatcccagctcactgcagctttaaactcctgggctcaagcaatccttttgcctcagctagcatgctcagttaatttttaaatattttttgtagacatggggtcttgctatgttgcctaggctggtcttaaactcctggcttcaagcaatccttccaccttggcctcccaaagtggtaggattataggtgtaagctctcctgcccagccggcaagggcttgaaagtgttatgttattttatagttttaggaggttttgtagctctctatgatgaagtttaaaaattaagaaaaaaagcttgtttttgattaatcgaaatctcagcacagaaatgggacatttcatcagagaaatagatacaatgaagaagagccaaatggaaagcccccttttttggttgctctttttctgctttcaaggtttatattagcttgacttagatgtgccttggagtggacttcgttatgtcccttctgcttagtgtttgtctaatatcttgaatctgcaaatctctgactttcattacagctgggaagtgtttggttattatttctttaaatattttttctacttgagtttcttctctccctctgagatttcaattacatgtatgtttgtttgatatcatctaacaagtctctgagattttgttcattatgttctaagtctttttccactctgttactcattttgagtaattttgattgatctgtcttaaaatttactctttcctttaacatgtccacttggctgttaactccatctggtgaattttctacttaagaaattatacttttcagctgtagaatttacatgaagaagtacattatcaactgtaaatgggccatgaaaagttaaggttgaattttgtaatttataaatcaactattaaacagtgcagaatagctgtaaagcatcaggaaaattaaaatagaatatatcttaaaatattaagtaatttttaaaggcgggaaataagaaatgaagaaacaaatgtcagaggagacaaatagaaaacaaaataaaacaaaaatgatagactcatacccaaccatttcaaaaattacattgaacatttatgagctaaacactccaattaaaagacagagattaataattgtttttaaatggatacaaaaacaattataacatctcaccaaagaagatacacagatgccaaaaaatttgaaaagctgtttaatagtatatgttattaggtaattacaaattaaaacaacaatgagataccactacacatctactagaatagccaaaattcaaaatgctaacaacaccaaatgctggtaaggatgtggaacaacagaaactgtcattcattgttgatgggaatgcaaaatggtttggccactttgaaagacagttttgacagtttcttgcaaaacgaaacatacttttaccatatgattcaacaatcttactcctgggtatttacccaaatgagctgaaaacttatgtccacacaaaaccctgcacatggatgtttatagcaactttattcataattgccaaaagctggaagcaatcaagatgtccttcagtaggcaaatggataaaccgtgatatatccagacaatggaatattattcagtgttaaaaagaaatgagctgtcaagccatgaagacatggaggaatgttaaatgcatattactaactgaaaaaagccaatttgaaagggctgtgtactggatgggtcaaactatacgacattctggaaaaggcaaaaccatggagacaaaaagatcagtagttgccaagggttgggcagaggcaaggatgaatagatgaaacatagaagatttttaaaggagtgtaactattctatatgatactgtcatggtggctatatgtacataaatacattagacatttgtcaaaactcatagaatgtataataccaagagcaaactctaatgtaaactacggactttggataataatgatacatcagtgtaggttcattgattgtagcaaatgcaccactctggtatgggatgttgatagtggggaggccatatgtgtaggggtagggggtgtgtgggaactgtctgtactttcatctcaatttagctgtgaatctaaaactgctctaaaaaaataaaatccattttttaaaaacctaaatataaactatgtgcaaagacatactttcaatataaagacagaaggaaaccaaatatagatggatagaaaaagatatatcatgtaaatagtaagcacaagaaagctggagtggctacattagtatcaaataaaaatagatttctaaaaaaaagtatcataaaagataaagaagggcactttagaagaagaaaaggaataattgatcaagatgacataaaatttacaaatttatttgtgcctaataatagtctcaaattacataaggcaaaaactgatagaatgaaaggaagaaataggcaattataattggaaattttaatgtctctcagaagttgatagagtaaccaacaaaaaatcagcagacagaaaacctgaacaacattatcagtcactttgacctaattaatatttttagaacatttcactcagcaatagcaaaatgcacattcttttcaagtgcacatggaatgcttaccaagatagaccacattctggaccataaaaaagttttaataaatattaaaaaggttgaaatcaaatagtttgttctctgaccacaatgaaattaaattggaaaccaaaaacaataagataactaggaaaaccccaagcatttggaaactaagcaacacacttctaaatatttattgggctaaagactaaatcacaagagagattgaaaatattttgccctgatgataatataaatacacatttcaaaatttgtgcaatgtagctaacatagcactttgagggaaatttacagttttgaaagcctatacgaagtggggaaagttcttaaatcaatgatcttaattttcactgttaaaaaatagaaaaaaaagagtaaattgaactcaaagcaagcagaggaagaaaataataaagataatgacagacatcaatgaattagagaacgaaaaaaagagataaaaaaatcattaaaagcaaaaagcagtcctttgaaaaaactaataaaattgataaatctcaagactgactggcaaagaaaaaaaaatgaacaatatcaagaatgagagaagggacattattactttggatattaaaagaataacaattctctattgttatgaacaactttatgacattaaatgtgtcacagatgaaatgaacacattctgggaaatacataaattataaatctaatcaaagatgaaatagaaagcttgaacagccctgtatcaattaaagatattgaatttgtaattaaaaacttactgagagaattctgggtttagatgcttcattgatgaattctgacaaacatttatgaaaaaataataccaatcctacaaaaactgtttaagaaaataaaggaggaggcatgattttatgatgcagtattattctaattctacagccagatgaagacatcttaagaaaaaaactacagtccaatatccctcatgaatataaatgcaaaaatcctcaacaaaatattagcaagccaaatccagcagcataaaaaaggttatacactatgatcaaggggcaatgcaaagtttttttttgtttgttttgttttttgggttttttttgagatggagtctcagtctgtcgcccaggctggagtgcagtggtgtgatctcagctcactgtaacctctgcctcccaggttcaagcgattctcctgcctcagcctcctgagtagctgggattacaggcacgcacaaccacgcctggctaatttttgtatttttagtagagacagggtttcaccatgttggtcaagctggtctcgaacgcctgacctcatgatccacccacctcagtctcccatagtgctgggattacaggtgtaagccaccgcgcctggccaatgcaaagttgttttaacagctgacagttaatcaatgtaattcaacaaattaatagaataaagacaaaaacacagacacagtggtgcaatgtagctaacatagtacttagagggaaatttatcattttgaaagcctataagaagggggtaaaaggtcttttagtcctagccactcaggagactgaggcaggaggtttgttggagaccaggagttcaaggctatagtgcactatcattgcacctgtgaatagccactgcattccagcctgggcaacatagcaagatcctgtctcttaaagaaaaaaaggaagaaggtgaaaacaatatgatcagttcaataggtgcagcaatagcatttgtcaaaattcaactcctttttatcattaaaaaatctttcagcaaattaagaataaattaaaacttcctcaacctgattaagggcatctacaaaatctgtcagctaacatcctactacaatgtgaaaaatcaatgctttctacctaagacgaggtagagggcaaggatgttggctctcatcatttttatttaacttaaattgtataggagtgcctagtcagtgcaacaaagcaagggaaaaataaggcatacatgctagaaagaaataagtaaaattgtccttatctacaagtgacattgtatagaaaaccctaagaaacccacaataaaagctattagaggtacaaggttgcaggataaaatatacaaaaatcaattcaaggttgcaggataaaatatacaaaaatcaattctgtctcacatactagcaactaacatttagaaagttaagttataagacactttgtttacaatagcataaaatacttagcaaaagacatgtatgacctgtaggctgaaaacaataaaacatgacaggaagatctgcataaatgaacagctataccgtgttcatggattcaaagtctcaatattgttaagctggcaatcctttttgaattattcaataaattcaatgcaattcccacgaaaatcgtaactttttttttgaaaaaaatttgcaagagtattttaaattttatatgggaagtcaaaggacctagtatagccacatcgttttgaaagaggagaacaatattggaacacttcagctacctgatttcaagaacaatatgtggctctgaaggaatgaaccaattttattctttgatctataaattggcatttaaataatttccaaatgaggagagatgggtagctctgagataagcatgtgacttcccaaggtggccaatttgaagggtaattctcctttgggatgattgctaagggaaaaaaaaaatccatgttgaacataaggtttgtaatcaagacaactggatttaaatattggatgcaccattcagctctctaaaactgagtatcttcatcttaaaatgggatgtgcagtgtaaggattaaggcagtaaagtatagaggctaagccgtgtgctatagcactggagctatcttacccaggtttgaatctagcttggccattttctagctatgtggccttgggtatgtttaaccttactttgcttcatcttgctcatttgtacaagcactgctcgttttattgcatttcactttattgcacttcacatatattgcatttcttacaaattgaaagtttttggcaaccttgtgtgggataagtctattggtgccatttttctaacagcatgtactcacttcatgtctctgtgtcagcattttttagcaataaagtattttttaaatcaaggaatgtacattttttggacataatgctattgcacacttaacagactatcatatagtgtaaacataacttttatatgcaccgagaaaccaaaaattttgtgtgattcgctatattgcaatattcactttattgcagtggtgtgcaatggaacctgcaatatttctgaggtatgcctgtaaacgagaatactaaaagtgcctagccatagggttgtggtgaacagtaaatgagttaataaatctaaagcacttagaacagaatctgagcacataaaaagtgctctataagtattacccactgttatttttttcctggtgctatgaggcccgaatgtggttactttcgttaaccaccaagcgtagttcctagtatccaacaaatgttagtgcccatccctctgcagagcataagtagcattctgggggtagcgtttgacactgaaggatgtatttcgcaatcttataggcaatcttgagtttcaacagcttaaattttctttccttgctatttttccaatgtttaaagaataccttcttggccaggcactgtggctcatgcctgtaatcccagcacctgacaggctgaggcaggcagattgcctgagctcaggagttcacaaccagcctgggaaacacagtgagaccccgtctctactaaaatacaaaaaaattagccagatgtggtggcgtgtgcctgtagtcgcagctactcgggaggctgagggagg

SEQ ID NO: 3078 - DNA, 634 bp, Homo sapiens
tgactgagactttaaatataaaataaaaagctgtaacattgggaggccacagctacagtgacttggaacaaacacagctgagactaaccctgggagctgagactttgcttttccctgtacactctgagaagctaccatctgatcagaagagatatcactgttgcagtgaataaagtcagcatctaatcttcctgttttcacagcagcaccatatggcagtgacagcaccttctgcaagaagagaaactctaaaccaattacaacaatatcatttctgtgttgaaccataagtcattggaaacccactgcaaccatgcttccataatagcagctggaatctccaattctacagagaaaaggaatgttgaagtaacatacatgtagctttgaggaggaggcacgtgcattcaagctcatggagaggattgacagccacagacaggcactcataagaactgaatgtaaatcatcaaagagaatatactcaggaggcactgtctaccatagagggaaggaagatgagatgggtcattggtgtcttcccacaacttcatacatctgctgacaattgccaaatttggagtcatgtgaaaagagacgggctgagtaagaaagatcagaggatatctttgac

SEQ ID NO: 3079 - DNA, 1410 bp, Homo sapiens
aaggaaatgagaactccgtggtgtctcggacaggtcatctagtggctgttggataaaactcagatggagaactcttttttttttttgagatggagtctcgctttgttgcccaggctggagtgcagtggtgcgatcttggcttattgcaacctctggatgccccacaagagtgtgtagactgctgcaggcctaaggactggcctagccatcgcagccactgccaacaccagcacatactgcttgggggccagaggtttgtcctgtcactgctaccgccatcatccacatcatgcccaatgaccaggtaaaagagcccgctgacccacctggcccactgctgctgctactggcatctgagcaaatcacctggaggcccaagaattggcctacctggacccatttatagtagtggcagcatacgtctaaggataggcatgcttggcccatggagaggcccacctggggactccatttccaggaaactttaccatagcctccactaacaactgaaccataagtgactgaggaaatcatagacaccactgatgctgttaatagccaaaagaaaaataaatcatggagaatatactactgcatgtatccagaatcaaagccaaaatgtcctacccaaggaacacatcttcaggaaaaagatcttccctaccaaaacaaattcaaaaaatttgaaaaagtgactgttataccagataggcagatatcaacttaaggacctgagatacataaaaaaagtaaggaaatatgacacctttaaagaaatatgatagttctccagtaacaaattccaatcaaaaagaaatttatgaaatcctaggccaggggctgtggctcatgcctaaaattccagcactttgggaggctgaggcaggcagattgcttgagctcaagagttcaagactagcctgggcaacatggtgaagccttgtctctacaaaaaattagcagcatgtggtggtgcacacctgtggttccagttacttgaaaggctgagacaggagtattgcttgagactgggaggcagaggtttctgttagccaagatcatgccactgcacttcagcctgggaagtagagcaagccctctgtctcaaagaagaaaaaaaaaaaaaaacttatggaatcctggaaaaagaattcaaactaatgatattaaagaagccgagtgaaatacaagataattctgaaaaacagtacaaagaaatcagaaaaacagttcaggatatgaatgagaaatttaccaaggagacatcaaaaaaataaccaaacagaaattctggaactaaggaattcattaaataaaatacaaaatacattagaaaccttgaacaatccattagattaagcagaagaaagaatttcagaacctgaagataggtcttttgtaataacccag

SEQ ID NO: 3080 - DNA, 2270 bp, Homo sapiens
cttagctgtagttttatgaagtttctgtacttgtttttatgaagtttatatatgtagttttatgaagtttatgtattgatatgctaattatatttgttattatttgaacttacagtttttatttattcaatgcctggatacacatgcagtataagagagcggatgctgtattctagctgcaagagccgtctgctagaaattgtagaaagacaactacaaatggatgtaattagaaagatcgagatagacaatggggatgagttgactgcagacttcctttatgaagaagtacatcccaagcagcatgcacacaagcaaagttttgcaaaaccaaaaggtcctgcaggaaaaagaggaattcgaagactaattaggggcccagcggaaactgaagctactactgattaaagtcatcacattaaacattgtaatactagttttttaaaagtccagcttttagtacaggagaactgaaatcattccatgttgatataaagtagggaaaaaaattgtactttttggaaaatagcacttttcacttctgtgtgtttttaaaattaatgttatagaagactcatgatttctatttttgagttaaagctagaaaagggttcaacataatgtttaattttgtcacactgttttcatagcgttgattccacacttcaaatacttcttaaaattttatacagttgggccagttctagaaagtctgatgtctcaaagggtaaacttactactttcttgtgggacagaaagaccttaaaatattcatattacttaatgaatatgttaaggaccaggctagagtattttctaagctggaaacttagtgtgccttggaaaaggccgcaagttgcttactccgagtagctgtgctagctctgtcagactgtaggatcatgtctgcaacttttagaaatagtgctttatattgcagcagtcttttatatttgacttttttttaatagcattaaaattgcagatcagctcactctgaaactttaagggtaccagatattttctatactgcaggatttctgatgacattgaaagactttaaacagccttagtaaattatctttctaatgctctgtgaggccaaacatttatgttcagattgaaatttaaattaatatcattcaaaaggaaacaaaaaatgttgagttttaaaaatcaggattgacttttttctccaaaaccatacatttatgggcaaattgtgttctttatcacttccgagcaaatactcagatttaaaattactttaaagtcctggtacttaacaggctaacgtagataaacaccttaataatctcagttaatactgtatttcaaaacacatttaactgttttctaatgctttgcattatcagttacaacctagagagattttgagcctcatatttctttgatacttgaaatagagggagctagaacacttaatgtttaatctgttaaacctgctgcaagagccataactttgaggcattttctaaatgaactgtggggatccaggatttgtaatttcttgatctaaactttatgctgcataaatcacttatcggaaatgcacatttcatagtgtgaagcactcatttctaaaccttattatctaaggtaatatatgcacctttcagaaatttgtgttcgagtaagtaaagcatattagaataattgtgggttgacagatttttaaaatagaatttagagtatttggggttttgtttgtttacaaataatcagactataatatttaaacatgcaaaataactgacaataatgttgcacttgtttactaaagatataagttgttccatgggtgtacacgtagacagacacacatacacccaaattattgcattaagaatcctggagcagaccatagctgaagctgttattttcagtcaggaagactacctgtcatgaaggtataaaataatttagaagtgaatgtttttctgtaccatctatgtgcaattatactctaaattccactacactacattaaagtaaatggacattccagaatatagatgtgattatagtcttaaactaattattattaaaccaatgattgctgaaaatcagtgatgcatttgttatagagtataactcatcgtttacagtatgttttagttggcagtatcatacctagatggtgaataacatattcccagtaaatttatatagcagtgaagaattacatgccttctggtggacattttataagtgcattttatatcacaataaaaattttttctctttaa

SEQ ID NO: 3081 - DNA, 11568 bp, Homo sapiens
gtagtgtgggtatcaggagaatgaggcaagccaagctgtgaggagtctgtgggtcatggctttggcagcgtggaacctgggacatagagtcccccttgatacggctgttcagcagaccaactttgttgtaaatatttagataaaaatgggctttagagcagccacatctgaagacccacaaggctgaatgttacacagggggagcaccattatttaatctgaacatctggaatccatcatgtgtagtgaaggacaagatgtatcctcatttttaagccaactccatgataaaattgatggatgggaccaatgtgtacagcaatcagaatctgattgaagataaactcatcctatttggatcagagcattagaagaaagaaagaactgacacttctcaaccttctctagttgaagacttctctttgctataactacttgaagagttcagcagaaaaattttactgaagaatccctgatcctcctttaagtagctgtagagaatattcactaagtgtaatgggacacgtctctctcatgcccacttcttttctcttatccctgcaagaaaatgaagttttgttggagtcagaggtttattttagtttattttaatcagaaacgtgtatgaaatccaaagcacatgatcttcatttttaataacgtaaaccatccccatgtttatgtgctttctctggtcctcaacctttttttttctttttaattttaagaacatctgtccccactgcaacttcactttcatcaggaaatctaattacagagatagaaaagagtatagtaggtgaagcaaaagacagcagctccacctcttaatactgaatacttagatgactgccagatgaatagctggatccttttgtggctaactaactcacctggtgtagagaaagacagttgatagatcaaaaaagtatacagataacagagagcaagtgatatggatatgaaagacattagggagcatacaaatgcagtttggccaggatttatttctagttatggactgatgaggagacatggggaaaaattgtcaaattaaaaaaaatctttttggcaaatttaaactttgcctctatcctttttctcttaatctgctacccagatatgcacttcaaataggaatgtgggcctactggggcatgaaatagttgagagctattcaacaatgaggagaatgagagaaatctatttagaaggacattttagaatttaagccagttgaaccttaatagtcacagataatttaacatgacccctaaaccattaggggggtttttactacaaggacttggctctgtattaacaatgtcatccttcttagaaattgataactatagaagttatcctatgtggagtaagataagaatgactgctcttcatgtttacaagagattagagtggataagaaccaggtgaaacaggaatcccaagggatctccttccttctcagagtcatagccattccagggaatctgcacattttctggctttcccatttctatcagatggttacttaggaacaaatgaaaatcagcaaaagtgccatgataattatcacaaattcgtatgaaataatgaggcagttgaatgcattttttctgtcttatctctgtttgtcaatgagctaaacagtgtgttcaggtccctctgaatacttggaggagcaagattctttagccttgtctcactgattcccaaagtttatctaagtctttccagaggaggacctctattgtcaacacttgatagccaaacccttcctttgtttttttccttctatacactacttgttaatcaacttgcacaaaaccaatttctggttcaactttgtcctgagctgctaactggctatgactttattttacaggtgcagtaactttgttagctgttattttgaggagctccagccatgggctcatttgatagatttaattgccaacatcttgaacaaaccccttgattttaaaattttaatttagcatgtttaacatgaaagaggattgccgaataagtgtcccatttgatttactctataagtaatacagctgtttgtctttatttgaaaaataaaggtagacacttagaaatgaaagatgaaagcttggaatgtgacctgtaagtccagaaatcacagaccagaaagcaagaaaggaacatgaacagcacatgtcaagtatccaggaatttctaagtataatgcagaacttggggcatgagaaataatctctctctctctgtgcgtgtgtgtgtgtgtgttttctttatctgagcatgtttttttatatactgccttttctggtaacttcattaggtctgtataattatagtttgcttcaaccttagtctgcatcagtattcattattatctatttggtgcattgtagcagcataaatataactaaattactagggtcaaaccataatgggagctgttgtgatggtaattagagcagaaatatagtccttttttggtaaaacttgcagaattgtagcatgaggtgtgttcttatagggtacaattaaagccaggttgtgggttcaaggtggtaaaatgatggataatgaaggtacaccattaatcacagttccaaaagatgctctgtatcaattcttttctctctgaaaggtagctcagaggttgatgctaagacaaaaaccaacagagggcttagagatgaaaagggaaaaaagaaactgcgtataaatagtactagagtaagttaaaaagaactatcttataatgtgcttaaaattatggaaagtttctgaattctagcctgaaatttaagaacagttctaagtaattccttaaatttgttaagtcttttcaatctttgggttttcagataagacaaccaaaggactgactgcagtaaatagagcttttgaaggcattatcattctattaacaataaagctgagaggatagatttgttttatgattttcacatgatattacttgtcggtgacctgagctgaatttgaactggcattcttgaaaagaaagattccctttacaaatcctttaacctctaatgcagtcattttaattcacaacaggctagaaccttgcataattgttctcagctcaatacaatctttaacagcttttgatttacatattgggcagctgttttgaataagaagttgtccatcatggatccttttgtcatctgtccaaggaatgtatttataaatggttccaattagagtaatgaaggtttcatgtgaaaacaatgatcaatagccaaccttaaaaacaatataagtcaaagacagatgtaaactgtgaccaggcataacaaagtcaagttatctatggggaatgtataccatcgctcctggaaaacaaatagaaattttcaagtctttgactattggacagatgttgattccatgacacagaagcatttagattctgtgttaaataaatcattgacccacatatgactgagactatgcagattaatgagaacaaccgtggccagggaaaaggcagctcagtgaagccagctagatcagatcctcactgtgattatggactgcaccccatcagccttcaggaacagatgtctgttgctataagaaggagccacgttgatagtgaagtttctgtacaaacacgtttcagactatgtcagacacatctggtcaagggctttgtaatagctttatttatttcttgcctgaactggaacgtcagaagcatgcactccacattaagccaagagttccctttgttccacacggctgccacagctggaaccttttgttggatgacacagccagatcttctgtagagaccattatattctttggcgtatttcagtgagtttgcatcttttaatccacctcagcaagcagtggggagttcataagggccatgcacagagccttctcttaaaactgtacaggaacaccagctgggattgcaaaattgatagcatcaaggtggcctgctaccaagttggccttagtgagatgtgctctctgccatagccctgtttgcttagatcatttaggaaaaaaacatcaaaacagaagtaacttctcattcttgtgtgttgaggttgctcataggttactctctccagccaaaaagaaaaaaagccaaagaaattttgtcatagactataagatctgtgtatgatgaacagtttcatgagggttactatagaaacatctagcctacaaaagtagaagggaccagttaaaatgaagttctgcctagatttctaatataactaaagctgtttttttccctctccccctctcttctgtctctctctttttttctctctttaaccacatcaattgacagcccaatttccacatataaaataggagtcataagttaaaagaaggtgggggctgaaaaacaaaagtagatattcagaaatgtgcacctagaaaagtctttcagacacattgagttgattttgtttggcctgattatcagaagttcagtgccgtttttagttttcgggaacacagtctcaaacatgagagtagctctactccagccccggggcacccgccctcactttgcctttgccacatccttcctaccaactggcccccaactcagaataaaagctggtctagcctttccaattggcaagccaatgacattcacctgcatttctcttgctagtgatcctcttaactaatgcttaagctccaatttcttgccatagtgcttatcacagattgtactcctaagactgacctccagatttatctcctgaagcatccccatcaagagtgtctgatgggggccagacgcagtggctcatgcctgtaatcccagcactttgagaggccaaggcaggcagatcacgaggtcaggagatctagaccaccatcctggccaacatgatgaaactccatctctactaaaaatacaaaaattagctgggcatcatggtgcatgcctgtaattccagctactcgggaggctgaggcaggagaatcgcttgaaccaggaggttggaggttgcagtgacctgagatcacgccactgcactccagcctggcaacacaatgagacttcatctcaacaacaacaacaaaaaaaatagtgtctgatgggaagaaattctcctccagggtctactccatcccgaagacatttctgaaatgattgagaaagccctcaagcataacttgtcattgatgttgctagggcattctattaggaagcagatgcagaaagagctgtatgtagttaggggcatgcacatgtgtctttgctcaatatagggggttgtatacagttgttctccccacacagcatacaggaagtttaaaattaagctatactttacttacatggataaaagtcttgatttttagttttaactaagtatttgctgttttctgttcaaaaagaatgctgggggttcatgtcagtgacagagtgaaaagctagagcagtagcatcaagatataaaccaaggctcattgtctctcttttcatatatattactttttaataaatctatgtttttctaattacagaagtagtataagctctttaaaaatttagcaaaataatagatgagcacagaacagagaaagttaaagaaatgaattttatgcaagtaaacattattattttcttatattttcttcccatctttatatatatataatttttagcaaaaatagtaacacactacatatgctatttgtaacatgctcttatacttacaagtaaagcaaaaaaatatataatatgtcagtttagtatacgtaaatcatatgtaaatgaaatgccataataaaaatacatcacacataatttaaatataatatgtacatgaataagttaagttataatatgtacatgaataagttaatatgtacatgaatatataagaacacatctaagtaacactttttttacaaaaaattttttatagctacacaacattacactatgtgtatcataaatatttttacaatttttctgtttaacttttaagccatttccaaatttttactattaagaaatagaaagtacaatttagactaaatgttttaaaaatattcatgattagttatttgagattaaatactagaagttgaaattttgacaacttttaggacaattatagaacttttaatgattgttgtccaaattcagcaaggcttctaatagaatatacctacaggatatcaaggaggtacaagaaaagatacaaattttttagaggcaatactaaagtatactgtctagggatgcactgtttgagtgctaaaaccataaagaaatgcaaggaagtggttaatataaaagttagcagagcaggccaggcgcagtggctcacgcctataatcccaacattttgggaggccgaggtggacggatcacttgaggtcaggagttcgagaccagcctggccaacatgctgaaaccccgattctactaaaaatacaaaaaattagctgggcttggtagcacatgcctgtagtcccacctactttggaggctgaggcaggagaataacttgaacctgggaggcagaggttgcagtgagccaagattgtgccactgcactccagcctgggagacagagtgagaccatctctaaaaaatcaaaagttagcagagaaatgagtatttgaggatgggacacatggagaagacttctgaggtgaagggcaatgttctatctttttaccgaggtgaggaatgcaaggctattcaccttctaacaatttgttaatttatttgtttgggtggcttttttacattttattttataatgcaaaatctaaaagtaaaaatctagatttgattccaattcagctactgggtataattaattacaagagtaaattctgacaatcctgtgaacctcagtttttttttcaagtgtcaaattagactatgcatctttgcatgtctgcatctaaattgattatgttatgatattctattattttaaggcaagtcactcagggacaggggatcccacaagactgtgaataccaggaggtatcattcattaattggcaccattaattggatcattgggggccatgttaaaggctgcctatcacagaaatatcacaggttttggagtcaagtattcgtgatttttatatcctgttccactatttcctagctattttaccttaagcagacaaaataatcttgttgtgtctcagttttctcatttataaaattgggataatatttacctctttggaacgaatcctaccaaatatatctcatttctcttttttaacagaagtagcagtctatgtctagagctagtgtatttttatttcaacaaagtattcggtgataaattccttgacatccttgaggtcaagatgaaaaatggaagatttgggattgtccaagggaacagggccctcaagaaagaaggcttctgatgctattgcaaaacaatatattcctgtctgtttcaaattcaacaaatttataaccttcttgaataaaagcattaagtaatgaaagtattaagtttatgcctgacacaaaactagaagaatagctaatcctttggaggacacattcaagattcaaaatcatattaacagatatgaatgatgtgctcagctaagtaagacattaactaataaagacaaagttacagtactctgtttaaggtcaatgatacatttacaaaaatacagaattgagaaggccttctgtcatggctcagatttgtaagatagtttagcatttccacaatttatctttacctttattagcttggaattgacaatgctaggatctcaggttagtactttttgtatccaaaatccatgttctgcctatatctactatagctattccctctgtctgccttctatgctattcaaacatgtcacctcatatctctaaatatgctttcagttacaaaagccaccaaccaaataaggccatttaaacttaaattaattaaaattaaattaaaaatttagtccttcagacatgctaggcagatctcaaataatcaacagcaaaatgtggctagtggctactatattattggatggtacagaaacagaacatcatcattgtagacagttctagacagcagtgatatagagcagggcttttcaatgggccagttctaccctacagggggcattttttggaatctagtggggtactgtcagttttcacaataatttcataagaaaataatacataataaaaattgttctactttctcataattttttattatcttgtaaaatatttaaacagacaaaagtcctatttggagttatctgagtctagaactgaactgttaaatatacaatgcaaatagttttaatatatactatcttttattggaatgttcctatcatgtgaattcaggtactctgtgacttggcttagtctgttcagtgtttagaaaaatcacatcatgaacagaaacaccacttatggtgtttgagtagcaaataaaagtctacttgtatctctcattgaacacagccaagaactctgaggagcatacatggaattgagaactttgaaggataattagtagcaggcagattagaaaagaatactagaatttaaaatgccaccaaactagagatgaatttatcatttttcccttctaatcttcctactgcttagccatacaagagcaaagtaaactcaaagaaaggaggaaataataaagaaaataacaaaattagtaaaattgaaaactaacaaacaatccaaaaacagaaaaaaaaaatcaaaccaaagagttgtctgtttgaaaaaaaaaataagatggctaaatttctaagaaaaatgacagaaacagagggggaagatataaattaccaataccaagaataaaagagaaaatacattacaaatacccacaggctttaaaaagatgaagaactactgcaaacaactctgtatacgtacatttgaaactcagatgaaatggaccaattcctcaaaatcactaatgttcaaaactcattcaaactgaaatagatagcctattaagccctaaactgttaaggaattgtaatctattgtttaaaatccccacaagtaagtctccaggtccaatagtgtcactggcaaatcctacaaacattttggaaaaaatgacaccaattctattccaggaaacagaagaggaaaaacacttctcagtattagccagcattactgcaacaccaaaagcagacaaagacaatttaagaaaagaaacctacataccaatatctcttatgaagatagaaaaaaaaaacccaacaaaatattagaaaatccaaacccatcaacatataagtgaacaatgatagtaaaggaataatgaaccacagccaaatggtatttgttccagaaatgcaatgaggtccaatattcaaaactctatcagtgggctgggcacagtggctcatgcctgtaatcccagcactttgggaggtcaaggcaggtggatcacctgaggtcaggagtccaagagcagtctggacaacatggtgaaacccatctctactaaaaatacaaaaattagctgggtgtggtggcaggtgcctgtaatctcagctacttaggaggctgaggcaggagaattgcttgaatccgggaggcagaggatgcagtgagcagagattgcaccattgaactccagcctgggtgacagagtgagactccatctaaaaaaaaaaaaacaaaaaacacacaattctcacgatgtagccaaccacattaacaataaaaacaagaatgatctctttaacccttatgccactgcataagggttttcttcactatgctatctatacctgatttattctttaaaaaacacaattcagaaatcattccctcttcactgtgtctgcttccaccctgacactaagtaggacaggttctctaactctttctaataactaaaaccattggttaaaaatccagataaatctccactacaggatgttttctatgaaattgcaattatccttttaattgtctattttctgccttaggcaaaagatttttattttttttctttaggacactcatttctaaattggagttcagtggtgtgatcatagctcactacagcctctacctcccaggagcaagggatcctcttgcctcagcctcctaagtagctgggatcacaagcacatgccaccacacctggctaattttattttttgtagaaacagagccttgctttattgcccagactggtcttgacttgaagaaagaagaaagtaagccaagcatggcagcacatgcctataatcccagcattttgggaggctgaggcaggaaaattgcttgaggccaggaattcaagaccagcctgggcaacaaagcgaggccctgttgctaaaaaaataaagtaatagcttggtgtagtggcatgtaccttatggtcccagctacttgggagcctgaggcaagaggattgcttgagcctgggagattgaggctgtgatcatgatcacaccactgcactccagcatgggtgacaaagcaagaccctgcctcacacacacacaaaaaaagtatggcaaaggtactttactccagaaaaatgagaaaaggggtgctcacaaaattaagtaattgttctacagaaagcgattcctccagtaaaaataacatcagccttcatttttctttaggatttgggttataggattggtaattcagcgtgaagttcacggatgcctcttcaagaaacagaagcttcactcaatctggctttcaaaatggtgagaaaagaagtggactcacataattgaagaggcttgagttctggaagcttagaagtccatgactggggtcccagcatgcttggattcaggtggccttcagacacttcttccacaaggaaattgggcagcttcctgaaatgaacaacccgtaaagccatgggaattatggatcagctcccagaccttccgcttcatgactgcaagcctttgtgaaagtttctgacctctttatgcttcaggaatcttagcaatgaaacaaggataatggcacttgctgtgacgatcatgcttccaacagttcaaaaagccaagggaagatcagaagcttatcttccagccaactggggtgggttggtgggggttggtggaatttgacagaagcttgtaatcagccacattggaggatgaggggaaggcctgtcatctgttttgaaacgtgttacgacaagatgttacatttctggaaacctgggtgcagaaaaagatgcacttttctgagagtttgtgcggattgagtgaatctgcttcatttcagcccgaagttgctggagggtccttcgtcaggagacagtatatatagacttgccagaagtgcaataattattcagtctctttctcagtattaagccaatgtacaaaataattacacatctgcttctatagtatgcacagatgttgctgttgttgtcattgatttgttcatttgtttttgttcatcttccatgaatctattcacagccgggaagccaactccactgttggtggacattaaaacctaaacaaaacaaaaattccttagaagacagttaa

SEQ ID NO: 3082 - DNA, 3615 bp, Homo sapiens
caaggactgtgtaaaaggtaatacaatgactaagtactcaacaaaaaaacagagaggagcaggtagtttatgactaactttaccagatggcttccttaagcacagtcataaataataagtgaatgtcacataaaaagaatcacaggaagagaatggatggacagcttctttaccatatgccttttgcaagatccctgatggatttaaattctgttggttttttagagaagttgttcatacctcaatcctgtgccgttcttagattacactgatcagtctcttctctgctcataaacaccccacatgcccatgtttgttaactaaagatgtaatttacttctgtttttagcttggtacatttttttttttttttctgaacgtgtgtctctacaactccctttcacttatcattgttctgctttcagttgagtcactcagtcatcgctaaggactcattagctggttaatgagaagcactgtatggagagaaaactgtgcgcctgccaactgcctgccgaaggacctgggctttaattttcttgccatttcaatcccaatctttctttaggagactgatgataaggttcggagtggactctttgtttgatggctttctaatatggagacagttccaagagagccaggattaaattggccaacttcatgcacatgtgtgacccaacccaaattacagtccaggtggctggtggtgaaagccaactcattaacctacagtgacacctgttcatctgacacacctttcctgagctcaaaaggtctatttcttttgaaatatttatggctctgaaactaaaggtcattccattcttgtctttaacttcacatgatggttaaaacagacacttaaaataataaaatcacctttaaaggcagagaagaaacatacaaagaagtgtcctttctgtcaggacagaaagaaaataaaatgtgcatatagcatcctgaaagaaaaatcttaacccaattttaagtgggagttttattcaaatatccaaatgacagtttctatggcacatcttcaatttgttcatagtaaccaaattgaacatattgccttattctgttatgtgtatgtatgtcctcttggctgccaaactctggagagctcaaaacaagtgtgcaagcaaaactgaaagaggttaatatcacaagagaacctgccacttataaaggtcttctctgtgttgattctcagagacatgttaatggtcaatttaataaaaataatttagtaattttttgcctgacactttagatttaattttttaattaaaataacatataataaacagacaaagattttgtcattttagataaagttagtaactttggctttggttttccttctggttcctcagtgcttttttgcagtgtttacctatctgtggtctcatgtctttcccattaattcattgaaattgctgtcatcatgtttgttattaaattcaagtgacatttctcagttcttaacctatttgacctcttatttatccagccaaaaaatatataccaaatagctactaagtgccaggcactgcatttagatgataggaataaatgctgaagtagacatataaagtccctacagttgtggcatttacagtggaataggagagcttaatattaaacagttacataaacaattattcaattacaatatgattaatgatacaaagaacaaatatagcgtgcaataagagcatataaatgaaaaatataatttagttggatatgtcagggaaatgtccctgagaaaaagacagctaaccttaatattaaaacttatttactcaaaaataagtgtgcgaaactgtatagttaacttatcttcaattcagtcaatctaaaacatcaactaaataatgtattcacagatataccacacaatgacagttagtgttcgtaatgataatcttggatgagaaaagagcctacagggtcttttagatcatcacagttaaattatacttggctaatatagtttgaatatttagtacaatttcatgttcaaaacttctgaaacacttttattcacatgtagaccatataatacttatattatagtagaccatcctatttcacaatcaaattatacaacagtatactaaattatcatatcagttttttgtttctttaatagttgctaatatatgtgtatagttgtgaacatacctgtatatgtgtatgtgatatgtatatatatcaactgtatagttaaaacaccacatgtatagaagagaccatctgactagtatttaagcttagccatgagaatggaatttggaagatgaagaatgtgacctggaggaaagaagaaaatgattacagaggggcatttgagagtgagaggatagagaagagagaaagaggttgaggaaagaagatatcagagtcccctcactgccctccccattaacacactcaaggctaagctagtgaggggagagtatctttgggatactggacaaaatatggaattccaagaaccaggaagcttttgtcttattctaaaaggatataacttgcaggctgtctccagatcaattgagtggtagatccatattacaaataaacatgatagcagagtgtgattaggcagaagaaggtgcatctcagcacctccttctgtgtaatgtggaaatgagcagctattgtagtgggaatgagcaactccacagtaaaggcattaggctgtgccatctgggcagtggatgacagagatatcagtgtgtggctggggtctgaagcctgttcagggtcaagatgagcctaagtcatccagaaaggctgatgaaatcagcaaaagtcagccagacaaagggcactgtcaaggccatcatatggctctaagcatcccttttcccacctcctcaagagcaccaagaaagacaccaacatccattgccaatttccttctccttgccagtagggaggctgaaaaaaaacagatactctctttctattaatatatcttccttatagagtaggatggatatttggctaagtattgatcaataagataaagtggaatttgctgggtggtgggcgggggtcctttgtgtaataattttgtgtcttgataaagtaggaatatggctgggaccatccctgactctcttttttccttgaatgtgaacacatgagtgaagcatacatccattgtccatggggcaagaaacatgaggatgaaaagccaatatgttaaggacatgaagtgaaaagcgggaagagcttcttattcatgttatcactgagcagttctgccggaggcctctccagattgtgatgcactgggagcaagccaccatgaacatatcctcaggtctccagtcttctgccatcgcatgaaaaatggagcttgtcaaacacagagcagagctgaactttctgaattccacaggacagttcagagtgcttggaatgacacccacctgcaatttaaacaaaaaagaaggatgagtaagtgaggagctaaaaattgcatgtttccctaaattagatttatttgtaagctttaagtaagtgcaaacatatttcgaattatctgttatgaattgtggttttgttattaaatagacattttgtttaattctt

SEQ ID NO: 3083 - DNA, 11480 bp, Homo sapiens
tcgtggggaaaaggcagggagggggtggtgtccccagccggtttggggggtgcgttgcccggagacggaaagtttgggagcccgagcaggctcggctgcagcctcggggagggggtccagcgggtggcggccctggggatggggaaggagcaggagctgctggaggcggcccgcaccgggcacctcccggcggtggagaagctgctgtccgggaagcggctctcctcaggctttgggggcggcggcggcggtggctctgggggcggcggcggcggcagcggcggcggcggcggcggcctcggctcttccagccaccccctctccagtctgctcagtcttgctctgtcacccaagctggattggagtggcatgagctcggctcactgcaaccttcgcttctcaggttcaagtgattcttctgcctccgcctcctgagtagctgggattacaggtgtgtgccaccacgctcagctaatttttgtatttttaatagacacagggtttcgccatgttggccaggctggtcttgaactactagcctcaagtgatctgcctgccttagcctcccaaagttctgggattataggcgggagccactgtgcccggtcaacgtctgattttctattggtgatgacataatgaggttattggagtcatcacatgatgaatctggctggcattaggtttcctcattaccaggaactgggccttgtgagattttgacacttaccacatcatgctcaccactcttcctctgatccagcctggtggagtctgtgcattgacttttgtcctcaatggggccagccgcctgattcttgctttttcaggttgccctgcagccatgatcaaacttcaatgcaaagtccagcccatactgtagtatttgaagtcagtaactgagtagctcagaggtattgctactgacagtattgtaggtgagtgtgtatgtgtgtatttgggatgagtgggatggtttcacttcttgagcacttaatactttgtctgtgccaagggctttacatacatttatttgctcagtttaccttcacaacatgcctgcaagataattattgttatttccattttacagatgaagaagcaaaagttaagagagagcttaactgactgctttttgtcattgttttgcttgtgaataacattgttttcacctctttgattggtctttggtttcatgtggccgtcagagtttgagtagagcaaaatcttctctccctctttcattgatttttattttagccttcagtttgatgtgtaactacctgaacgaaatccttaagtttgagttaagccttaagtctgttcttgttgtaggattttggcttggttaaggtctgtctggatcactggggtctggcaagtatccatttctcagttttatcctctggtctctgtgcttgaactctgaagggaagaggacatggctagacagaaaaaacagtacgcaggaaacattgtctccaggaacttttctctcttagagtgcatactggctctggggaagggcctgagtgagcagtgcccctcggggatcttctgcctaatcccacctcaaccaccatctagccgtatgatcttgggaatattttttactcttcctgtagctcagttttcttaccattaaaaaatgggtggcagggggcagtgtttttagcgtttcctggcagaggtccaaggaaaggtgcatcagtgtgtcttaaaacatctgcagagttagactggggaaaggagcgactgcttactgtcctcttactgtgtgccaggaactgtgcaaggccttttacatgcctggtgcgaaaggtcaagaagagaaagaggtctgtcttctcccttcatccatgggagtgtgtgagtgggaggttgctctctctgctcgtgaaactttcatcagcaaatactaattagtgcttaattactatatgttgtgcataccactgtagcagataacttaggaacacaaaacttgacaactcccttaagaaattggcttggttatctgtgagttttcactatcaatgactgaataaataagtggggcagaacagacaggtctttcttacagaagaattccaattataaatgtaggaataatgaggggaatagaaaatcaccattagcataccatagtaataattgctgcaggcaagatctaccagtgaagaatgaaattgggtgaaagctgaaggagaaacaatatttatatggcttcaaagtatcttccccagaatatttattaattcctatggcagcttcaaccgatgtccacttgttctttggtagtcctctctctaggagatggaatttaattctcttccctttttgagtgtgggctagacttagaaactggcgtccaaataatagaatatggagagagaacagtggtaactttatagtgggaaaatctggtagccactgcctttaccgagtaatgaaggttaacatcaccagtgataagtcatgctgatgtcacatatccccagatgtgatgtgatgaaaaggacactttgcctcttgtgttccttccccaaatccataacctcagtctaatcatgagaaaacagaaacacaaattgaagaacattctacaaaatactgagtagtactctttaaaattgtcaaggctgagaaagacaagcaaagactgaggaactgtcacagagactcaagagccaagaccattcagtgcagtgtagggtcctggaacaagggacatgaatgtaaaaactagggaagtatcaacaaagtctgtagtttagttaagagtattgtaccagtgttaatttcttaagttttgatcaatgatttcttaagttttgatcaatgtacagtcatccctgggtacatgtggggtattggttcgaggacccccatctataacaaaatccttgtatactcaagtcctgaggtcagctgtgagaaacccaagtatgtgaaaagtcagacctctacacacacaggttttgaatcccacaaacgctatattttttatctgcgtttggttggaaaaaatctgcatgtaagtggacccaagcagttccaacctgcattgtttaagtatcagctttactatgattctgtaaaacgttgacataaggggaagctgggtgaaagggatacggggctctgtgctatctttgcaacttttctgtaagcctaatattatttcaaaataaaaagtaaacaagcaaagggcctatttgatagaggctctgaagtcaagctgcctggtttcatatcttgcctctgccacctaccagttgggaggtatagatagctttctgaattgctttgccttagttccttcatctataataatagaacttctcatataaagttgtgtaatgattaaatgaggtaatgcatgtgaagtacttagaatagtggcaagccaggcatggtggctcacacctgtaatcccagcactttgggaggctgagttgggaggattgcttgagtgcagaagtacaagactcacctgggcaacacagcaagaccctattgtaaaaggaaaaaaaagaacagtggctggaatgtagtaatgacggctgctaatattaatatttatacagaggaagtccagcctccttttagttactcagccattgagccagggatgtaaatagtgctggaggagtttggaggaagaggctatggtaatggagtagggtggtctggagacccctctcctagactacttgtacccctaggaagtggggccctacctttcaagaaagccaaagattcagatagctgatagaagattggtgtggaggagggcagggaacagctagaggcagaggtagagaagcttaaaataagaaagacctgtttgcccagcagtgagtaagcggctatccagcaggagtcagcggaggtgaggttggtaaggttggctagtgctggatcgtcatgggattggatgctggcttgatagagtctaagaccttgtgtctaggccactttatctctaagtgctttatttctaagcctgagagagagacaattcaaacaataaaaaagttgtttcagtttcaacaggattgtggttgtactttgtttgttggttgaaaaaatatgttgtgacagaatgattatgaactcggtaactctctgaaataaacttgtgttttattaaatatagtagcttctctgtaccttaggggcatcataatatattattctgtgacatttattctgcctactgctggtgcttggtgtacgaatgcatttgctgaccctttacaataacaacatggccccaggacagagtcaccgttttaagtatgcagacatgctttttgacttccaagcctcatcttttgggttgtcttctgtcacaggggagtgtgtttcttttattagtaaagaaaaaaaaaagaaaaattattgtaccactagaaatatggctaaaaattattgaagtataatttacatacagttaagcacttggatattaaatgtacagaccaatgtattcttacctacatacacatctgttatcatcatgaagataacattccagtgccccagaagtctcctttgtgtcacctgctagccaaaaatgccgtccttgaggttatcactgttctgaccttgatcaccataaatttttgcctggggacatgtttctttttctccaccgtacacccatgttcatgcagaacagtggagtgggagcagggcagggtctgtatgtgccaaatactacactagacacattcccagacttaaataaattctcccgtaaaacacagacctgggcttatataacttgtctaaactcaatcccatgtcattgatgccaaagtcagtgttttttccattgcgccatgctctatgtcttcaactgacatttgccataatcattatcattatcattaatgaaaagtcatctgacacttgccagtagtttatatgatcaaagaacatcagttaacacccagttctcatttctaagtgcgtttaaatggtcaagagcttttaacataactctcttgggaagcagaatgaattaagttaatttagaaccaaaagataatggcaatttcttcatttaatgagtgccttgtttgtgcaagatcacgtgctggccaacggagttatagagagaaaagaagtctcaatcccagctttgtgatcttctgatgggggagatagagaatagtgtgatgagtgctatgaaacagagggatgctggagcatcagagaggaaacaaggggcagggctggggaaatgttcctccccgaagggatgaggtctgggtggagtattagaactaaaaggagttgtacagacaaagaaggggaaaagcgagagttattttaagctggagtgtgtgtacagtgtggtggctcagtgtgtgcgaagaatgggtgtctggaagcattgtgcattgagacgactgcaggtaactgcctggtatgtaggagggagaggggttctgtggagtagaaagagattagctggggtagtaacagaggtgagatgcccatgtaaaggagttggattttacattgacagtagttatggatttgcaatttaggaagatcacttcagatttttggaagatggatcaaaggagttgagattaactaggagtgcaaaatgattagggcctgaaggaaggcagtaccagtgagtatgaagaggaagctaaatttgaaatattcaggaggaatgaacaggacttggtgactgttgatttgcagttgagtgggtgatctctcctatgactttgcatctaaataggatattacaggcgggtcacagtggctcgtgccctgtaatcccagcactttgagaggctgaggcgagaggattgctcgagctcaggagtttaaggccatcctaggcaacacagggagaccctgtctctacaaaaaatttaaaaattagccagatgtgatggtccctgcagtcccagctactcaggagactgaggtgggaggatcacttgagcctcggaggtggaggctgcagtgagctgtgatcacactactactacactccagcctgggcaacatagccagactctgcctcataaaagaatgaatgggctgggtgtggtggctcatgtctgtaattccagcactttgggaagctgaggtgggcagatcacctgaggtcaggagttcgagaccagcctggccaacatggtgaaacctcgtctctactaaaaatacaaaaaattacccaggcgtggtggtgggtgcctttagtccagctatgcaggtggctgaaacaggagaatcacttgaattcaggaggcagaggttgcagtgagccgagattgcaccactgcactccagcctgggtgacagagtgaaactccatctcaaaaaaaaaaaaaaagaaagaaagaaaaagaaaaaagaatgaatgaatgaatgaataggatattacaacataaaatgggagagtggggttttgtggaaggactggagttttgtaagggataactgaaatgaaacacttttttccctctctagtagaagggtagtattcattttagaacagctccattacttattttggtgtgcacaggagtttgtagatggagacctacagtggtatggtaactatttttttaagcaggcagataagtcaaacttttggtttatcttttgtttatcatggtgaaagctaagtctccaaatggttgtttttgtttccacagcaaagacctgtgaacctctgaactgagtgggaattagtggtatgaaagaagaaaagacaggcccttcctactcctttcagggtttatgtagttatttatttaccgacatgtgtgcagaaagccaaatcggtactttttgtgaaatggaatatagtttagattcaaaggattttatcaagcttaaagctaaccctgtttttgctttggcctgtgttctgctgtaataatctccttccttgtgcacaggataacagtgggggggatccttaaactggcaggggtattatttagccacccaggccttcttcaatcacactgagagtcctggttcttggctatgagaatgtctcctcatgaggctcaaggactatgtgcataggattgaaaacttctagaaaaggcaaaacaaattctccaggctttgtgattggcattgtctggagtcctcaccctgaacggtcattaagaaacccaaattataccctttatgctgaaaggaagcttttctcttcagctagccaaaatttagtcgtctgcttatgccaactcccgatttcctgttactataaatccttgacagtttagaatgaagaatggtggtgtgtagggcagagaatccttgttcaaatgaatagcagagcaatggcagtataccccttgggtcatatataataaaactacaggataggtttcttgcccttgaaatctcattgtaatagtgctgtgagccaccaagagtttccgccattctagttttcaggttgtgttcaggaaccattaatactttcgcaataacacaagttcttgttcatccagggatgtttatttcagcgttaaattgtaagtaaacaagcatgctacaatttatgaaagctgagtatgtgacctctgttcagtgtcaggatgaaatcaaacgctcataatctgacaccttgaatgatttgcgtgatcattgttgtactgcatgattattaggtaaacagtttatgtaagtaactataattagttataatttttacatggccaaatcaaatgttcacagtttcttgtttatttatttgttggttctccagcatctgtaattagcatcactgtcagcatttttcattgatacctgtgtagactgtgtcctcatcacttgctggttaccttatgttaaaaaaccaagtctaggttttctccctagcagtcctttagaagggacgggtggtcctcggctctattctctctcactatccaacctcaacctcagtagggtcttcagggagtaggagctccagaccctgggaccgtgtggcctgcccagaggttcaacagcacactgttgggatgagagagaggccccttcacctctgagaaggaatgaacaacagattttattttagagtactgtatagattgaaataactgaacatttctcacctaacagatagtaaggatttcaatagacatttatttgcagaattagttttctaccacaaagtcgattggggttagaaaaaggggtgcactagtagggattctttgatactgtggttagatggtcattgaaaagaaaatgatacattttggatggattgaaaagcgaaattgattttggatgacatttttgactggcttttgtgtatttgtgtggcatgcagcagtgaatggctgtgtttggtggttagatgcagaacatttcttgtggttctgctggctgtgtgtgtattgcctgttttgattgtggttaacctgactcaccatttggttccttaaggttgagtttcctttcctgtcctttatgaacatcgtcaccttgttcaaaagggaactttatcctttcttttcaaacgtttactgagtttctgttctgtgttaggccctgtgttaggagccaggtacagaaagatgatcaaatatcttgactttaaataatacctttcacatttacctctttaatctcaggtagccctaacaaccctgtaaaattgaaaaaggttgttcatgtaccccccaatataaataactagtcacagagaaatgaacagacttcaggttacacattgtaatagtgactgagctgaagccttagtgttttgaccccacccctacccattcactagttaggagagtctaaataaagtagggttgtttgtttgtttgtgacagggttttgctgtgttgcctaggttggagtacagtggcatgatcatagccctctgcagccttgacttcccaggctcaagcaatcctctggcctcagcatcctgagtagctaggaccacaggcatgtgccactatgcccagctaattattttagtttttgtagagacaacagggtttcaaacgcatgagctcaagtgattctcccgccttggcctctcaaagtgctaagattacaggcatgagttaccatgcctggcctaaacaaaatagtttgttgttgttgttgttgttgttgttgttgtttttgagacagagttttgctctgttgcccaggctggagtacagtggtacaatcttggctcataacctccgcctccctggtttaagtgtttctcatgcctcagcctcccaagaactgggactataggcgtgcaccaccacacccagctaatttttgtatttttagtagagatggggtttcaccatgttggccacactggaagtgatctgcccacctcagcttcacaaagtgctgggattacaggtgtaagtcactgtgcccagccaataaagtaattttttcttttgagatggagtctcgctctgttgcccaggctggagtgcagtggcgtgatcttggctcactgcaagctccgcctctcaggctcatgtcattctcccgcctcagcctcccgagtagctgggactacaggtgcctgccaccacgcccagctaattttgtttttgtatttttagtagagactgggtttcaacatgttagccaggatggtctcgatctcctgacctcgtgatctgcccgccttggcctcccaaagtgctgggattacaggtgtgagccaccttacccagccaatagtttttgaatctaaaattgatcaatcaggaagcatgacatctacccaaagaaatttatgtagacatttaaaaaattcatacaaatgattcttacactgggctattttatttttaaaaaatcattaaaaacattagaatttaaacaatattaattaaggactcattgtttgcccaataaaaataatcgtcacttcgtaaatcaccctaatgaacgatttagtcatcataatttgatttagtgttttcaggacgacattgttcagtgtatttttttattggtttggaaggtagtgagtaagatatttctaagggcaaaaaggaaacagttttgaaaattcttagctaatactgagttggccaggatgggtgaaacagagttaaaggaatgtgttggccccttttcttgtgcacctagaaatcctccagggcccagtaaccattttaggtttattttattaaaaaacaggcctttgggcttcctgtgttattgattcttcagtttctgcagaacttagaaggaaaatttaccccaagtaaagtgagaagagcattaacattgtaccatggatgcctaaaatggtatttattagacacaggcctgttcaaaggctctgagtgtgggagcaggggcagcagtaaagttgtctcttcctggtggtcttataagagcttctgggagcagcagtcagagggcagagctgacctgctgtgcttaagagaacgtggactttgaggccttgccaaactgaggtgattgttccaccttgggcaaattatttaatgtatctgatttctttcagctataaaatggggttatattttattctaaaatggaattttgcctatcgtatatatagaagaccattctgtttgaagtaggaagtattagctagctcatcacttatattcatttccagggtcatttgaagtctatctacctgacgagaatataaatcccatcagggctaaggccatgtctgtttgtttttctcactatgtctccttgcccctaggtcagtgccatgggcttggtaggtactcagatatctggcaagtgaaggagtccccgtaattagtactgcagctgtcgggaaaaagtgtagacttgccgcctataagcacaggtctgtatttgtcaacatcttagagctttaggcctatgtaggttttttgttgttgttttgttttttaagagacagggtcttgctctgacacctaggctagtgagcctcctgccccaacctcccgagtagctaggactacaggtgagtaccaccgcactcgactaatttttaaattttttctagagatggggtcttactgtgctgcccaggctggtcttaaactcctgggcttaagcagtcctcctgcatcagcctcccaaagggcagggattacaggcatgctgtatctttgtttttttttcttttggttagcaagtaacagtttgggtttttatattcccaagatgtctagaggatttctttcttctacttcagcttgattgatgaaaatgtcataatgaagtgaaagaaaaggcttgctgtacttccattttgaggtggaccatcatgtttttgaagccttgttctctgagccactctattttgtttggggttcactcctagtttaaggcagagctggtactctttgttcccatcttctcagagaaagtatttggtttcaggtcagagctgttttccttttagccacctaaaagcctctgaagaatttggaggtaaagaggcttcatgtctg

SEQ ID NO: 3084 - DNA, 24945 bp, Homo sapiens
gtaattttttggctttttaataataaggccattctagctggtatgagatgggtatctcattgtggttttgatttgcattctcgggtgattagtatacatgaatttgcttctgcctttgccacccctgagacagcaagaccaacaaccccttctcttcctcttcagcctactcagtgtgaagatgattgctgccctcagctgtgcctggagcacagggcacctccagttcggcctctccagaagtaaacttgtcttctgcctatcttgtgtttgttgggaggaggtgacctgggactctactactattgatgaagaatccgaaaaagtcttctattagccctgtgccacaccctacctatgagaaatcagtgtttactgcagagaacacagaagccagcaagcagcagggaagggaggcgaaccaatgcagcagcccaccgggaccgaggaggacacacgcagagcaagtcacaggaagcgcagctgaaaacaaatggacgcttatcccaaatgcacaggacacttaccaagaactgatggtccgtcaaagtaaagctcaacagctttggctggcaggacagtcaaacttttggacgacagaaagtaacagtgggaaatgggacaacatctgccagcaacgcgagaggccaagaccatggctgctacaggaggggtcagcgtcacagtacacgcatggcggcggttgcacatgcatgcctggggaatgtgagtgttcagacatgccaggagtccagcctcaccaggaaacaggcacacggggacagaggcgcaaacactgaaaactctcgctgaatccactcggctgagcggtggtcacgagagcacggccctgcgctccccacaaaactgcacctgggccccagggcgagacaggcgtggaaggtgcaggggtgtgtgtgggggcaggggctcctggctcagagccgtatccaggaaccccccttcaggctggagccctgccctgagccccctgtggagagactgtggagagccccctgtggagagggtgactgtgggagagcagcatcaggcctagtctcggctgtgaagtaccccccacctccacgcaggatcccggggattctgtcaaggtgggggccgcctgctcagcccaggctccctgaacgtgtggctagctgagtttgcggaagaaaccaggagagtgccaacaccaggcttgcaagcaagaggctccctgactgcctgatcctggagcgcaccccatcctccctgtgttccctgggcctcagctgttccccagtgaccttggagacaccctgccccaccctggctccacaggagccctgcccatcaccgcctcagctctgagtctcccctggggacacaaccttcctcctggtgcagaggcgcaggatgctgcccctaaggcccatcttcctctgcagcatgttttgatgtcagctcattcacaggaaagaaacaatcacatctcagtgcccagaatggggaccaataggagaggtcactgggaataaagcccacacgcaccccagggtccatgggctccccagaaatgcaggtggcctccgccagagccaacaagcctaagttgctgatcagcccctccctgcttccctgtgtggaagaggaaacagaggcccagactagtagggctctgccgtggtggccggctgcgtccccagacctctggtcccagggctggctgggagtgcccctccctgtgctcacttcctgctctcctgggaaatggctcagggatggggcgtgtggggacagatgctggcatagctcacaaaatgcttgcacaagggacactccatggcaggtccctgcaggagagcaaagtcacaacattcagagattccctgcactctgaggcccgcagagcctggccgaccaagcgaggctgggaggatgttgcctgctggtcagggcagccctctgatcagggcggccgagtgaggctgggaggatggtgcccgctggtcagggcagctgagcgtggctgggaggatggtgcctgctggtcagggcagccctctggtcagggtggccaagcgaggcagggagggaggtacccaccggtcagggcagccgaacaaagctggaaagatggtgcctgctggtcagggcggctgaatgaggctgggaggatggtgtctgctggtcagggcagctcaggaggtgctgcccaggaggtgctgtccaggcagagcctagggctggtgtgggtgtgccatgctcctgagaagtttctgggttgtggctttaatgttctcctgcagtgagaacgctgacacttggccaaagggtcctcacctctcccctagtacacttctgagatgccaggaaggttctgaacatcagattgattcctgggactcccctccagggtggccttactggagtcaggagcccctgccccactaggatggctctgcagtggcctgaggacagtgagcactgactggtcactggtgcaaagttgcccactgtgatggttttgaccgttgatgggaaccaagtgaaagccctgcagctatttctaggcatttcagagggtgcttccctgcatgtactctgctgcagaccatcctccctgggccaggagcccgctacacagtaggagattctttttcttctcttttgagcacttttattctctttttcttaatctctgctcctcctttgaactgagaaatgtgcaaatcttttttgttagttttgaggttgcttcttatgcatatttcatctggaactttcccctttgggggtgatctgttctatcagcctgcccgctgctagagaggccgaggtggtccggccagccgtgcgctgctgctggtgtctctgtgggcatgacctggtgagatatcattctgcatctgggggtccatcctatcagccctgtgttctagattccccagtgactgacatttagccagtctcctctgtcactctccagtgacatgtacacactgttggcacgaactgcagatgtcacgttctgtggctgagagcctcagtgtgcatctgtagtaggaggatgtcagtgaggactgtcctgtcgctgctgagctggcaccgactgtgcctggtctacactccaggtctgccaaacgacccagcaaggtccttcacaactcttctgatccaggatcacacatcacttgtgctttgatgcctgcttctgaacaattttacctcctgagatgtccatttttgggagtgtgagccctcctctcctggtgacagctggctgaggccgtccagcctcaggacacacagggaacggctgcataaggagatctggggcagggggcccaccaggatgttctgccctgtggggggcaacaccggctgtggtctgccggcggcatccagggacagtctgtctaggtgaggctgaggccgcccccactcgctccctcacccccatgctgacagcagtgagctgaccacagactgggggagccccacagggagactggcctccccagcacatgccccgcagtgccagacgcggtcatcacagaggcaggtacacgacaccacggacgtgccacgtacccgccatcgggaccaaggaccactgagaaaccatgaaggccatgcagcgactgtggtggcaggaccgtcaggaggccataggtgccacggctcccctctggtggttcacctgcccacctgtagctggggtggcccctccagtgcgctccccagagcagaacaccccccaggcaacacgtctgatgaaggccaacagcgtcagtcctctggtgtttggtgacatcaaagctgtgccgaaaggccttccctcactgctaacacttgaagggcttctgtccggtgtggaccctctgatggcgaatgtggtctgtcttatgcttaaagatccacctccattaactgcactcttagggtttcttcctctgaaaaggaatgaacacgggaaccccctcaaaggcatttttaaatgaagcgtggaaggcatcaaagatgtgctcttcttcaggactcaggcttctccatcattctctgttccttggaagcgtgagggctaaggagctgctgacttctctctcttggccccacttcaagaaaggcttgcttcccacacacctctccacgctcccagtgcgggactgacactctgcaccgggaggccaagggccaccatcgtcttgctgattatatgtcaagttctgtgtgaaatgagagaccatggggattcattattgctggagttgacgctttgagattttatggaacaatgtagactcatgcccagtaacagatctggagaggagaaacaggctaaaagccaatatgtttcacaagagcaactgaaaccaatatttcaaatgaaggtaatacctataaagaaacataccagggatgactttatatttcccaaatcatgcagactgccttattgacttcctatttggataccttccaaggtaagtaggtgattgttttgtttgttcttttctagaactgactcgtacacaggtactgtaagaatcctgggaagtggaaagagattccaatctcacctcatcagggagcatcgaatgctctcttaagctcaataggaagaagtgaggctactttcagatttctctatcccaatggcttcaattgtactaaggtaaaaactatttgacagagtgtaatttttctgcagttgtgacatgaacagtccagtttgtgtcaaaagaatacttccctcaatgagaatgtggttttgattagagatatttctagtattaaacataacataatagctaacatttaatgagctcttactatttgacatggaactaagtgttttccaaggattattattattataatgaatcctcacaaatattatgacattggattttcaatagcctcatctaatagacactcaactaaggtaagggacagagctgggatttaaacctggggcatgctctgttttttctggtgctgtgtctcaagttacagaggcttgaggtcttttctaagtaatacctatagctccttgtctcccagaagagacctattatttagggaatccttaaagcttttgtcttgcctgcttgcgactacttctattgcttgcagcatattcctcagcaacttcatggttttctgggcagagtgttggaaattatgtggtaggatggatttaagagttgaagggttgtttactgatatgatttggctctgtgtccccatccaaatctcatcttgaattgtaatccccaggtgttgagggagggaccagctgggaggtgattggatcatgggggtggtttcccccacactgttctcgtgatagtgagtgagttctcaagagatctcatggttttataagggggtgggggcggctcttcccctttcacttactcactccctcttgccatcttgtgaagaaggtgtctgcttccccttcgccttccactatgattgtaagtttcctgtaagaggcctccccagccatgcagaactgtgagtcaattaaacctccttcctttataaattacccagtctcagacggtattctacagcagtgtgaaaatgggctaatactgttaccaaggtctattctagttctgcacgtcttcaacccacctgccgctcatagcgtagatttgggttgtgataagcagtactttagtgctggcagttagcctcatttcagggtgatgcctctcacctgtcactttgatggttaacatttagtaggtggagttgataaagcatgttccagaataaagtgtgttgacatgttaacttctatagaaggtcacaatgagaaaagagacatctctgcttatgacctttgtttggtcagaagctcaatgccatcctcctgccatgtattgttggctgcccagagtacctttccctccacctggttgaacaatgactcactaggcagcatgacacttaagtagcaaaactccattaagctttcagttttattttaaagacttctcaatcaaaattaatctaatcatctaaaagactgaaggaaacttaagaattatatttaaagaactattttgatattatattactggtatgtctataaaatacacaatactgcactgttcattttcaaagtgccctgggatctgtccccaaaatggctctgcttccattgctgtataacactgataacctgattaattattagtggtaataataatactaataattaacatttatcaaatatctcctgtgtgtcaggcactgagccaactgtttcatgggtattgtgtccattatgtcactcaaccttctaacaacctgattaaatactaatattatcctcatttttaaaaataaaatttctttttaaaagaagaataaactatcaaagcactatacacatatgctgaacagtaaagaacttacagtgaaaagcaccctttcatgctgcttctctctaccctaagttctaccccctctacccagaagaaacccttttaattatttctaattctttgggtatttatcttcaaaactctagatatatgctaatactcctgcttaatgaatttacttgactctctctcgtattattccatttatatgaaatgtccagaatatgcaaattcatagagacagaaagcagattcctggttgccagggtgctgggatgtgggggaatgaagagtgactgcctgtctactcaatgggtatgaggttccttttaggggagatgaaaatgctctaaaattagataatggcaatggttatacaacatcgtgaatgcactaaaagctactgaactgtagtatttaaaatggctaaaatagtgaattttatgtgatatcaatttttcttcaataaaacatgagacgtctctctggttagaaagtcacctacattactgttttacatatcaatgtttcatatttatatttttatttttaattctttttatcccttttttatttatttttaatctgatttttatccgcaaagcaacaaataaatgtcactattatttttaaatttaatgtatgtgtttataacaaaaacataattgtacatattttggggtacaacgtgatgtttcaatgcatgtatacgtagtataataatcaaatcagaatgattattatacccatcactataaacatttatcatttctttgagatgacaacattcaaaatcttctcactaccttgaaatatacactgcattatttgctatagtcaccctactgtgtaatagaacaccaaaacttatttctcctgtctaactgtaactttgtaccaattgaccaacctctcctggtattccttcctgcttttcctcctcaaccactggtaaccattattctctctctctctatgaaatcaacttttttagattccacatgtgagatcacatgatgtttgtctttctgtgtctggcttatttcactaacacaattacctccaggttcattcatgatgccacggatgacaggatttcattctattttatggttgaatattatttctttttagagttcaggaaatcgaggtaaaaaaggccaactttccaagatcacataaatagtaaaccttgcatttgatcctatgtagtctaactccacagaccacacgcgtaaccactattcaacacttccctccaagatgacaattttggtggctggaattatgtatgtgaaaaggcaattagacctttgaataatctttcagttgtctatagacagaaaattcctctcatacatgtgaacttttgctttaaaaatgctattgcattataacaccatgatcacccaaattatcattagacattatatgccttactacgcatgcaaataggagtctactaacgattgaagaaattctattagggatttacaaaagtagaaccaatccagtttggtgcatgaagggttacaacagcttctttctaatgtatctttaaaaatgtgattttggaattaagcagctaccagttactgttacatttatgcatgacccttgactactaatagtatgagccaactgtattctattagtgatcttagcagcaaagcaaggatgtataattgattattggtgttgatttatatgtctaataagcagctggaagtaaagcatctctgttcagtttccaaaaatgatagaaatggcctgtttttatcattgctaagaaacagtgggagagaagagattcacccttccctcccagagccagtgaatcagtgctaggaaatgatgtcaaatatcatcaaaggcccgaagtatttaagcaaggaggagaaaatggtgtctcagaaggagaatgtttttctcaaaaggtcccagtacctttgttttgatactgagactgttttgttctctgtttcaatatttttgtttaacattcagtaattcaagcaaacatttattgagccttaattagactcctacagtgaaaccactgagctaggcttggtgggaacaacaaagggtaataaagacatagctactcttgagaaatttatgtcggattggcaggcgagatgtacatacaacatggaactcccaggattctttgattcatgatagaatttaaccaaggtctgcactctaatgcagatgataagtgctaagagactctataaacagtttttcttttgccataatcatataacatagtttctctcttgtttttccccacgttacacaaaatacctcccctcagcacatccttttccaaacacaaatactccttttgaaatgagtttttggaatttcttcttaatagcatggacatgggtggtgtttgggtccacttttactagcttttggaacttcactgagttatttaacttcattaaatctcagctttcttatttgtaaaatgaagaaaataatattagttacctcataccgtttttatattgattagaagatatagtgtaaagcacttagcacattgcctaatatgtgatacttagtgatagcttttattattactacattaaataaattgctaaaaattaaaaaatagattacttctaactcccaaactcagcatctgatatcatttttgtgtgttccagtccttgatcatatatggaaattactaatttctccattaactcaaaactttgatcttgccaatggcaaggttttatctaatgtacttcctcagccctgtgtgcacagtgggaatttaataattatttgttgacaaaataagtcttcttgtgactctgtcttcagttactcatagctctctcctgactttctcagataaacttcctgaggggttgcttgcacctttgaactcccagacagttcataaactactgagattggcctttggcacccatcactctccaaagcagcacttatttaagtcattgtcccttccttgcccctaattctgaaggacaattccattccaatccttactttcttattgaccttggaggcacttggagtgctgtcaactcctccccctcctcctggaaatacattctttgggttttcctgtcatgtctctatcctctagttttaccttctccacttttacagccaaagtgactgttatgagttaaattcgttcctccaaaatttgtatgttgaagttctaagtcccagtaactcagaatgtgactgattacagataaggtgttttttttttaataagataattttgaggtaatttggctagaacaaagtcattagggtgaaccctaatcccctgtgactggtgtctaataagaagaggagattaggacacagacacagggagaagatgactatccccagtgaaggagagaggtgctgcttttcttggtactcatggctcctgtctgaaacactcttgccctccctcctccccttggctcccccacatctcctcttggctaactctgtggatccttcaggtctcagtttggaggtgcttggaggactctcctgagctctgctgtgttctcctaattccctgtatttacttctatctggcgcttactgcacggctataattgcctggctaattatttgtatttccttcctgggccataaactccttgaaggcagggaaaacattcccttcacttacatccctagagacggacaaggtacctgatgtacagtagggtctcaagatttgttggatgaatcaatgagattttattgcttagcagaagaaaaaattattttcctaatggtggttgtggtttaataacacaaagacttggttaagaatacaaatattaaagttactttaattctgtagatctgcctgattttgaaaattgtccattacagaaggaatttattcttggtgcataaatgtgccacttcatctacttctcttgaagataaaattcttagcctctgacccttttgttctgtgaagtacccactgctgcaagaaaaattcaaaacagatagcatatacatgtggaagataattttattatctttaattatattttatacctctgtttttcacctatgtaaaacccaattagaaaagaatcagatataaatgtgttattttggaagcaatcaactcaccttctgaagctacataaataagaaagcattagagaaatgggtccaaaaagagtttggttttcatgtggtaaacttgttattcttagtatcttgaggaaccggcaaacaacactgctgacttagaacatgttttttttttttttttgctggtgaaaagagagtgggtgactttgtgcttaagacaactctagaagtgtccttttgtggatgccagttctgcaaaactatttgggactctggatatgtaactctttcgaaacctggggattagaagtttggcactgcatacctttcagaggagaagaaggctctgctttcggtataactgcacggctctaaagaatggcaatgagcaaagaatgagaaataatttaatccactattgattaacatgtttgttgttaaaagctaattttctgtaacagcagagatgcagcccagggtttctggagacttttaaaaatacctccaggcacagtcaatgtttaaattttctaaagcatcccacacactgaagatatttgtaagcatccaactaaagacaatcaaaattagaacttagcaaaaatgtacagatcactggtatatattaaattttaattagaaaaatagagactcctacaagtaaatttcattgtattagaggttgtctcacattttttgaagtaataatacaatcagggaaaacaaatcttttcagtttgaaattaacaacaaaagccaaagaaccaacctctaaaagctctttaaaaaactctaattaaaaaaaaattcatctctttggccatgctcgactgatggtacctataaaaactgaggcactctttggtgtatgcgcgttctcagagcagaattagatcaaggctcgatgcgaaagcacgctgtagttactattatcaaatgcggaatctcattttagctactataaaaggcccctggtattaaaacactgcgtttatagatgatggatgaaaaatgtatttttcaaaccatggcctttgtggtagaacatgacttgcttactatggaaatatctccagctgcctagaaatgttgcctagcaaccctggaaacagagaaaacctaatatctctgagttgcttgtgggtaaagggattattaaaaatatcaattagaaaaaaaggactgcaaagtttgttattgggcatgacaacaactgctacttccgagtttgacagcgtctctgtgccctctttctcatggaatttcagatgtttcttatgtgtttcccatgaattccctagtttctaagtctcaacagtgcagcaaagagggtgacttgtagaggtcatgtctgtgctgtcaggactcagccctgttcccccagccctctgctggaagccgttctttgccttggtgagcagcagtcagccagccacgtcggctttgatagctgtcagcttccttcagacccagcaatttccgggtgactgggaatgatttttagttgctgctgtcctgactgttctgttcattggccaaggctggggggcagcttgctctggaagagcaccctgaagacacccgccttctgatcagatgccctggctctgcccataggctcccctgaagggctggcacaaagcttggaaagcttcttacgtctacaccaggcagacctgcgttctgtgttgtaagcaaagtaagatggcagactaggttcaggcccgactctcttcaaagtccctgctattctttttctcacaggattaaaaaattttttagttgggcaaatgcattctgtgtcttagtcagtttgggctgctgtaccaaataccataaattggatggctcataaaccatagaaatttctcacagttttggaggctgggaatttcaagatcaaggtggtggcagattcggtgtttgtcttctggtccatagagggtcactttcctctaaaacctccttatggtggcaggggtgaatgagttcctttggcctcgtttatataggcactaatcctcctcctgagggcagagcctcccaaaggcctcagcttctagtacctcctgatactatcaccctgtgggttaggatttcaacatgaatttttggggaaaacaaacattcagaatatagcaatgggttcttgattcatgtgacagaaagcgaatcattctgaattaacttgaataaatgagtggtattcaagctgaaactgataatagctttaagtgtgaacatagtttcctggtcaatcttgaaaagccaatctccaccagaattgtaactactcttaagaactttaatagcagtagtaaccagctcgtgcttcaaatttctacagtgttacagtctatagaatatttggacatttgcattctcatttgatctaactgcttgctggcaagggttactgttagctccattttatagcagtagaagttgatgtccaaagaggtaagatgacctgtgacagcaaaggtagagagattccaaacttctgaagcttgggccaagtcaacgtcttttctgtggtttcaaccccagtcagtacatgatctttttgatggatgcagaaccaactgagatattttctccactagcccattagcaggtgctgctaatggttccaatccagggctttgatcttgaacttctcagcctccaataggggtagtgttagctccattttctagaagtagaagctgatattcaaagaggtaagatgactttttcaacatcattagtaaatatgtcagttcttgaactagggtcttctgatttccaggccaatatgattgttagtaagcaattaagatgaggttcacctatcatagaaagtagagacttgagcagtgtaaagatccacaaatttgaggcatggacctcctttgtatggtaaagctagatacaatctacttgacttgccccagtgaccccatacatttcatggaatgtgcatgtgcaggtatgccatagtgaccacctctcagtcatagcataactcctgggaactgaagcctgcttgctctaaacccaccaattagaactccttgaggagcatctgtttgggcaattccctgaaccatatgaaagacagaggtaccataagtccctctctttctctcttgctccctacccaactgattgagtgtgcatgtcctgaaagctcccgtttcccattggccctacaagatgtgctgccctcttccatctgggatttgtaaataagaaactgcttctgttattttgtttgctgtgctgcctcctctttgtctcatctgatcaatacacctgaacctaacttctttcctggagaaaagttaggctctgtcctagagagtggctatccacaggtcagacaagagtcccacaggggtgtctgccagaataaagattttcctgtgcaagagacacctggtcatgggttgaacatttgggcattaggctatccatgagaataaagaagtaccctgtgaaagcacactgtaaatatccatgaccatctaccctggagccctgtgagtgcagcattggaatttgtaccactttccagagagagacctcaagaccaaattagaggaaaatataacaattgtatactggaaatttgttgagagagtagatttttaaatgcgttcacgcacacacatacaggggcaattatgtgaggtgatggatatgttaatttgcttcactgtggtaaccattttactatatataagtatgtcaaaacatcatgttgtatacctgaaatatatggtaaaataaagacatgtttaaaagaaatgatagaaattcactgtgagaatgaaaactacaggccaatctctcatgagcatttgtgctagttatttactcatctttctcagcttcacatctgcccaattatgctatattttatgctactgaggcttgaagtctgcaaactacatttcccagcttccattgccagctggcttacttttcaattatgctaatgggaatctaaagttcctgtttgaagatcagaagtgaaccgagagaagtttcctgcttttgacactaataatgtggcggttgttgtttgttgctatgacaacaaaggtagagacgttctgaagtcccgacgcttggaccaagtcaacatcttttctgtggttccaaccctagtcaccacaggaactttttgatgaatgcagaaccaactgagatagtttctccagcagcacagtagcaggtgctgctaaagggctcaatgcaggggctttagcagcttctaatctttaggtgtcagtctttcttcctcctttctcctacagcacccctccttctttttcttctttagcccttccaaaatatgtgcaaccaatttcctatattaaaatccccttattacaaaaatgttgtgattcagatagttgtatgatctgatttgtccaaagtcacacagcaaggaagtttcagaaccagatttgaaaccaggcaagagtgactatcatgcagggctcaaaaaaattattgtgtttatttagagtatacaacatgataataggggatactatatatagtaaaatggttaccatagtgaaacaaattaagatatccatcatctcacaaagttaccctttttatacacctgttaggatggctattactaaaaagtcaaaagataaatgttgttgaggctgtggagaaaagggaacaggggaacagttgtacgttgttgatgggaatgtagcttggtgcaaccattatagaaaacagtatggagatttctaaagaaattaaaaacaaaagtaccatatgacccagcaatcaccctctggccatatacttgacaggaataagatcaccaccctgtaaagatatatgctctcacatgttcttgtagggctctcgcctcagtagttcgctgcctccaggacatggctgtgaggggacacatgtggctgaccgtttggaatagagtccctcattttaagggtttagatgagctcaattttttttagtaattagggtggattatgtattaatttacttggattcaactatataacatcaagacctggaccatattacatttcttctcttgttcaatacttctcttacctaaagtgggtcccttcctcccccccatatctatatgtatatctatatacctatatctagctatatttctccactgatatgcaagaccttgacatagagccatacatagaggataaagagattatattttatccctttctagtcacctgtgctaggagccttctgttagcctgctcatcagctttggctcactcagtcatggactcattatagtctcaggaaacgctcagcccaaataacttttactagatcgtcatagcccaggatttataacactgtggtcaaaggacgctggcattattatcatctgaagatctttttatctttcagacttctgagtatacgcctcaacctagtgagccctaaccttatggaacatgaaaccctgcaatctgctttcttatcaaactgcccagggaactccagagcaaactgaagtttgagaatcacggaggggcatctcataccttttcaaaaaattaattgcatgcatgtgcaggtgtcctcccttctccatttcaaatcttccctcttttctactccatggtacctggaggagaaaccttaaagacgtttctcactttttctccatttatctcttgctttttgctactaccagtgcttgctgctttcctccttctcatgggaagaaccacagttgtgcagggaagagctatttgctccttgaatgtttgaaaagtttacatggcacttatgtatctttcaacttggtaattgtccaatatggtcaccgaagaggcactgtgcatactttacgcgctgctgaatttcaattccatagacatcatcagtcattcctccttctgggctgaatgtatgtctgtcagtgagagtcaccagaccctgaatgggaacattcactgaagaaggtgttcctgtcggcgttggtagaatgagagaatgagtacaggcctgcagcactttgagcctccatcaaacgggcctctcaatctctacccactcatttcattttttttttgccttattttacaccccaactgccataggcactacccttacccattcatgaatcaatgctttcttgcaagcttcctctaactcttctgacatccatggtaactgggccacagctagcacagtgccacaaagaggtcagctcatgcgagcccttgggagggcttgactttatccttaaaatctttgtgtgtggctgtttacatagaaactgacagaggtcgagagaaagaagtaggcaaattatggtgtgcagggccttgctcctctgccaccatttgagttcaatcactttatactttatctctgatttcacttaaaatcctcacatgccttatagggttgagatggctgttcacaaatacctggcataagcctttttccctctgctcaaccacacaaacagcatttcctggagtgcgcttttgcggttcctctagagtctcctggtggatggaggtggagtgaggaatggtactgaggttaacttcggtcaaattgcatattctcttcctcttggaatatcccagtaaagagtcatttaggataaaaatatggttaatttagcccaattcaaaattattccatcacaaaacactaacatagggtttatggaacataatcctgtagaattccctgggggattttgtcatgtaactgcagactatccctaatctttgcttgtattctttcctccttggatacaccactgggccttggtacctctattagagcaaagatagaaaaaaaagattaattgggctttgcttagaaaggactaacaagctttttcaattgccttctaaaatgagtattctttccttacctcaccctgatattgtaggttatttcttatcttgtatgaactacttttcctaaccatcacttctcctgtgttctaaaacattctctctactccaaccacctgctgcttcgtgtgctatttgctttctcacttctgtgaccttctttattcattttcccatgcttagactgccccctcttcccctctgtctctttcatgaaacctttcttggctgacatctccccttctctctgctcaattaaccaaagaattcattcaacatatgccaattatgtgaaggactgggttgggctctcaagatacagtaatactgaaggcagacctgggctctgttactatggaaatgggattctctagcttctgaaccccacctcactttacttgcattacccttagagtaagtgcttttactcattacctctttttataattttatttttgaaacattttcaaatgtacagaaaagttaaatgtataaatgtctcaaatatatccttaccccagagactccattttagtctcctttataacaatggggtatgatctaggacagaaccttacacccagctgtaatgtggctcaaactgcaaacctgaagcaattctttagtctttttactttccatgaccttgaagagttatgaagattaaaggccaatttgggtctgtttgatgtttccttatgttaagacccagaatttttggccagaatttcacagaagtgatgctgtgttcttacttcatcctctctgatggcagttgtttgtctacttgtctcattgctggagaagttaacactgatcccctagttaagatgatgtctgacatttttttttctgctgcaaacctatctatcttttcctttgtaataatgggtattttgtggaaagtcacttggagactgtgtaaaatctactcatcccaattttatctaccagttttagcctccattgatgtttcttgcctgagttaattgttagcataacagtttgccaaatgccattattagttgccattcagtagtatgtaaagatgtatgtatgtgtatatgtacatatgtattgatataagtgtgtacttagagacttacatcgatgagttataatccattacaatgattatttattttgatgttcaagttgtcccagatttgaccagtgacagcttcctaaacctgatgtaccaagatgtgcacaagcacgtcttctttccttgccccaaccaccctggagttggccatttgtctaagatgtcctgtttttgtcttttaagatggagaagtggcattcaaaagtcgagatctgtgtgcttggtgtgctttattgctattgagatgttgctgcccctaggtcctctcagtggtcagagcaaggaaatctatgcaagtatatacatacctgcatacacacctacataatatatacatatctgcacacatatatgtatcatacacatgtgtatatacacattttcatctctctatatctctgtatctatctttctaggtatacactgaaaatcatgagttcatccagataaactttaattccaatctaatgctgcaggggttgtttctccttcccccttctcatatttgtacctcatgttctctgacagtgaaaagcctggttatcattattcgtgatatttttacttatttactcaattctccagtaagtaatctcctgaccttgctggggtgctgccctgctctcaccccttccttgtgtggtcccgccctactctcaccccttccttgtgtgatcctggctgttcacactgggatgacttcctgccagggatagggaagggaaggcagccccatcacctgtgtgtgtgatgtgtgtgtgtgtgtaaaaacataagacttaaaaaatcataatttgacaagttataaaatgcctctcccacctctttttttaatgcttctctatgtattgaaaaataaactcgttactttcctttaaaataaaccaaatgaaccagtaaagatgatgattttatttgagcaaacctattttatcaactttcgagtttaccttcttggcttaacaccaaaggacttacagtcatttacacacattttgttcctaccccaggactccaagctccttgaggacagaggctggcttctgtttgttcttgagtcaatgggacaccttgcaccagtgtctgaagtggaatgtgtgtccaatttgttatattgattatattcctcctatcagaactgaccagctgttttgcagaattgattgaacttactcattattccaacatttcatgcaagtagcttcaacccacagaaatatctcacctgcaatgtattaagaagcttgtgggaaaagtggaggtcacaagtttattcactagaaaatcttttacaaactgaataatatccttaaaaaggaaataggaagaaaaaatggtacgaacaaaacaaaggaggcattatggagatgcttgttttataaaattaatggagatgttgacttttcctaacacatgaaatactgtgcagcaaatagattctgtttgaaatggaaatagtcaattgattggtaagggagatacgtacaaaatgtttacattgaaagtcataaaatgcaacaatagacaattgtaaaaagtgttgtaagcttagtgatagacttgttttaggtatggcttgagaatatacgtttcacattgttgggattctgtctggtgtgtagcggtcttcactgggctttgagtacatgtttatattacatgcaagttacaagggcttcaaggccctgctacaggatttcccctctcccagtagatctcatgactttgtctgtaaatcagtcattctcattgccatatgccctcttcttaacatgaattcagaacgaatcttccttgaagtctttctccattaccactggctatttttgcccctctgctggtctaataaaatagtttttggaccaatttaatttataatctatttcagatagattaaaaaaagatgactgacatctgtcacatcagtcaaggttaaaaatgcaatttctggttcattaaacctaacagaaaaggtcaatctttaataattgtataatctaataagctatgttctcagaagacttctggtagacttgcttgtgccaaaatgtgcacatttgagaacatatgacctcattatgcttttaaaatacacacacacatacacacatacacgcacacacaaatcaatttgagatttactttaagagatccacttagaaataataattttggtctaattaaggcatgaattaattttcttctttttactggcattagccagagtgcctagaattgaagatggaggccaatctgggctgtaggtttataaaagatgtatttatttcatggttttgatgattatgagagtaagcaacacattccaaatcctgcttacaggaataggctttcacagaaaattatatggataaagtgtctctccaaaatatagcactgcttcgcattctttcctaattgagctttctctgattactaaggcaagtcacatcttataataaacagtgggggccattatccatagaaggggagaagtaaggctgtttgtcctcagttatttatttattttttgggcagagctagctgaggttttattttgaacacacacacacacacacacacacacacacacacacacacacacacacacagagcaattgaattgttttgtagctggaggcatgggcaaggggtgtccccaggcagtaaactcccccgtgagtgggctgagggctagggctgagcctcaggtgggtctcctgttctctgtgctcccctgcacagcggcctccctcttaggctctggggcagccgcaggaagggtatgctgggaggggctgctgcagctgttcacttgggcaggatgtcagacaactcggacaccagcttctcattgcgggtcttgatcttcttcacaaccacgaccctggtggagctggtgcagctgaaggagctacagcccgcgacagaaccaaaactggagcccaggccgtagctgaggccgggagttgtgaggtccccctaggccgagctcagcccacctgcatagccgctggtggtcttcatgtggatactcatgttctgcatcccaaactccagccggttctcctcgccctctagcaggtttctgtaggtggcaatctcgatgtccagagccagcttgatgtgcatcagctcctggtactcacgcagctgacgctccaagtcctgcttggcttgctatagggtaccctccagctcggacagcttggtgttggcatctttaacggccagctccccagctgctcggcaactgtgatggcggtctccagggaagccctctggcctttgaggccctcaatctcagcctagagccggctgatgttctggttcatctgggagatctgcttttgtgtgccgcagttcatccccgtgcttcccagccagcttctgcagcttctcatacttgatctggtacatgccctcagcctcagtcctgctgcgcttggctagctcctcgtactaagccttgacctcagcgatggctgtccatgtccggggaacagctgttgtccatggacagcaccacagacgtgtcccagacctgggactgcagctcccagatctcttcatacagctgcctgaggaagttgatctcatcagtcagaccttccaggcgagactccagctctaacttgttcaggtaagcttcatccacatccttcttataaggacaaattcattctccacctctgtacgcttattgatctcatcctcgtacttgttcttgaagtcttctaccagcccctgcatgttgccaagctctgcctccagcttcagcttctcctggcccagagtctccagctaccgcctaaggtttttgatatagctctggaacattttgtccacgttgctccaagccatcttctgctgctgcaggaggctccagttggactccagcatcttgttctgctgctccaggaaccgtaccttgtcgatgaaggaggcaaacttgttgttgagtatcttgttccgctccttctcctgggtgcacgtggcctgaatgttggggtccacttcaggttaagggggctcagtaggctctggttgactgtgaaggcggtgatgcttcctatgctgctggccccaccatagcctccacccaggccaccctggaagctgctgctgccgcccacttgggagaagcttgaggagctgatgagggcactgggcccactcgtgtagaagtggctgctgaaggcccctgggagagaggtgacacctggtaggacttctgggtcaccctgatggacatggtggaggcaggagtggaggcaggtgggctgaaccaggcagagattccagaaggggtggagaagctgcttcttggtccagttatttcttttagtggtcctaacttccctcctggttcctaacatgctgggatacacagcctgggctggtgagcatttaaagttccttatctggattagggtgctaaaaatatgtgtctactccagtgtccagtgattatacattagaaatatggtgaacagcaatattaatttagttgggaaaagcatgttccttcagagtaaaaaaaaaaaaatgcagattgggaatcttggctcagctacttcctaggcgagtttgtgttgattgattgattgattgattgattgaatctgcctactagggaataggcaagttttttttacttctttgagtcacaggttcttgtcaatcaattgagggcaatactaccatgtagaatagttgtgatcacatgagataatgtctacaaagtgcttcacatggtgtctgatatggagtaagcattcagaaatgatagaaattattataattacataatacatttgtggaagaggaagaattccaaattttattatctacacatatcccattctccaaatgagactgcagaatttctaagtcaaaggacaatacagattattacagtggaaaaaaagaagctcatataccaaaatacaggatgttagctgggcacagtggtatgcaccatagtcctagctacttgggaggctgaggcaggaggatcacttgagcccaggagttggagactagggtgttatgactgcatctgtgtatagccactgccctccagcctgggcaacataggaagacccatctctaaaatcatacatacatacatatgtacataaaaaggaaaaaaaaccctaagaagttaatggtatcaattaatcttcttaagagaggaccagaaatgtagaaggatgcaggctaataggtggttttaggatatttactgcctgtctctcccacttactctagatggccagtagagctgctcttccctttcaattttagtatccctcttctgggccttcctcgaatcttccataggggattcttttggattatcattttatggtttaattgaccttcattattaggaaacaaaacaattctgaacagaggccatcggtgtgctatgcagagcatcatgttttcacaatcaatttactcatttgctttaaaattcttcgtagtttgagttctgagatatctaacaggatgaagtttgttagagaatgaaatgaacagaatgacattttataacagaagtggcatttcataacagaatgaaaacaaccaaaatgatcttttcaacaagcttcctctaattgcctttagagaatgtgccttcctctgcttacttgaataactaaataaaggacaaaacatttgtaattttaatattaagaatatactcagagttggtaattttgtcaaactgacacctgataatttcaaaaaatggtcagagcatatccttacggtttaaaactttttttaaaaagtctgttgaatagaaatcttaaacacagtaaatgataatgttaaaaacaaataagctattggaaaaggctatgaatcaatgtaatctacctaaggtcatatctgttagtaggcctgctgggggctcaggaggtatttagaatgcacccaattggtctcagaaggccagatgtctcctatgtcctgtgagtctccaagttctcctttaaaccacacatctagctactcagaatggggtgtgctttgcagacatcacacaaaggtgtaattggccaaaaagtacattgttgtccctctccctcgtcattccattgtccttgtattaccttctcttctttaaggaaaaaatacacataattgtggtcaatactgtactcattcacatagtagaagtatatagtactcagacagagaatatatgatatatgtcctggagttgtaaagggaggaggaaaatcagagaaatgtggtgtcctggaatccaagaggagaaagcattttgagaagacagtagtcaataatgtcgactagaacagacaggccttggaaactaagggttaagaaaaagctactggatttggtgaggtcatcggtcagccttgacagatttcagaagaaaagtagtttgggaagcctg
